United States Patent 7,868,149 (PLANT GENOME SEQUENCE AND USES THEREOF) - sequence listing, part 15

SEQ ID NO: 7176 - DNA, 74267 bp, Oryza sativa
gatgatgatggctttaatcctcattagggctgtgagttctttagattttgttggaatgaaggcatgaggctgccatctattgaggactgtcctgggtgcagtgatgttggagagagctcgagccgatcatatagtaggggcaatcggctaaggcagatgagaattcctattcatcaaagattgggtccagtaagccaagatcgtggataagaggacaatgaaaacatgaagactcaatggtgtccttctggtatctttatgaagaatcaaaagaaaagggttcaaagattgaggaacagagagcgcttttaggaagtcgagcaggaaatcaaccatcggatgaagaaaacaaagccgaggcaggagtggcgtgctaagaatcaagttatggtggccgatgaagccacagccgatgaagcaaaaaggttggctaaagcaaacagcgttgtaactgcttcggtcaacatggttttcacgttgcctaccgagtttgggatcaagcaagccgatatcgatgaagttgaagaagaatcggctaaattgattttgtcgccagagcaggtagtttttgagaagccagaggggacggagaatcggcatcttaagccattgtatataaatggttaagtcaatgggaagccgatgtccaagatgatggtcgatggtgggcctgcagtaaatttgatgccttacactacattcaggaagttgggcagaaacgctgaagatctcatcaagacaaacatggtgctcaaagattttggcgacaatccatcagaaaccaatggagttttgaatgtggagctgacagtcggcaacaaaactgtccctacaacgttttttgtcatcgatgggaagggttcttatagcttgttgcttggaagggattggattcatgctaattgttgtattccttcaaccatgcatcaatgcctgattcagtggcaaggcgacaagattgaaattgtgccagccgacaggtcagtcaatgttgccagtgccgatttagctctttgggagacggatggtcttgattgtttatctggaaaagattggggtggagattttctaaaagtgtccgattctgatatacagccaattgaaggagaacccaagctattattttgagggcgtcgtggagggttcagatgtctacaacaaggacacagtagatgatctcgatgacaaacaaggacagggttttatgtcggccgatgatttggaagaaattgatataggtccaggtgatcgaccaaggccgacatttattagtaagaatttgtctgcagaatttagaaccaagttgatagagctgttgaaagaattcagagattgcttcgcttgggagtattatgagatgcctggacttagccgatcgattgttgaacatcggctacctatcaaactaggggttaggccacatcaacaaactccgaggagatgcaaagccgacatgcttgaacctgtcaaggctgagattaaacaattatacgatgttggttttattcgtccttgccgatatgctgagtgggtttctagtatagttcctgttattaagaaaaacggcaaggttagggtgtgcattgatttccgagacctaaataaagctaccccgaatgacgaatatccaatgccggtggccgatcagctgattgatgttgcgtcagggcacaaaactttgagttttatggatggaaatgcgggatataattagatttttatggccgaagaggatattcataagacggcttttaggtgccctggtgcaattggcttgtttgaatgggttgtgatgactttcggcttgaagagtactggagctacatatcaaagagctatgaattacatataccatgatctaatcggctggttggttgaagtctacattgatgatgtggttgttaagtctaaggagatagaggaccacatagccgatttgaggaaagtttttgagagaactagaaaatatggcccgaagatgaacccatgcgttcaatacaatttcggcgagccccccaggtccgaaatatttggtaatgtttcgaatttgctgtatatcgactccgagcaagttttgcactttaccgttttccgaccgttacacccgtgctttaaatactaaccgtcaccctcgagaaatctttaccccgttacttccgtcttcaccgccgaagccaaccttctcctttctctctccggcgattcctccgacgctcgaggcgatccccaagcgacttcgtctccggttagatctccgcctgcgacgatgtcgtcttcctccagcccgtctaccgcgccatcagccgagtatgctgaggtaagttctcatcggctagatcccttttcctcgcataaaatcgattcctccttttctcattgtgttttcctcttcccaatttctttggatttgcagcacatttccaacctagttgcgatccccagcctgtcgcacgaaaaccactattttcttggcccaatcggcaatcttgaccccactgattttatcatcggtgaaaccaacagaatcccctttagactagccaaccctaatctaggtcactggaagaatactttcaaatcttggtcatctcttgagaaaaccacccctgagaagagttggaccacatggtaccagtgcatatcggctagtaagaaggttcattggaatgagatcgggatcggccaagcgcttgctctcaccatagccaaatctgctaaggacgaacctctgatggctgccgccacctatttctggtccaacaccatcaatgctttcttgttcaaccgagggccgatgactccaactttgatcgacattaccatgatcactggtttagatgtgacttcatcggctaatcctatgagcatgaacacaaaaaatcagttttattttagaactaaaagcataggtggctggtctggctatgtggcagcatatacgggccaagggtctgttacttctcgagagcatgtagctttcttgctaatgtggctagaaaagttctcttctgtggatccagctgtggccctacaaccaattggcaatttgtagctgaagccctagaatcaaagaaacaatttcctttgggcaaaatcctccttggctatctgtaccaaatgttgaacaatgtgtcggccaagatagccgtcggctcagtagttggtgcaggtggaccatggtggctgctgtaaacttggctgaatctgatggtcatgaaagttgtcaatctgccatctgtgacagaagctaaatttccattaccagagccgattgtggaaaatgatggagaagaacgcactcatcgcagatgcatgtcatacggagaatatgcatccacaccaattgatgctggagcaaaactatcggttgagctgctcaaagactggttctgcagcttctatgagggctttcagaaagatgcactggtttggttcccttatgaagattcagcagatcttgaacttccatcagactttagatttgaagacatcaattatgaaagatacaaaaagccagggaagttctcacagctgcaatcagcccatgcatcttacccgtaggcattcaccagggaagaaacatccaagtctcttacgagttttaccacccaatgagctcggctagacaacttggactgggccaactcccaatcggcttattctttgtcgacaagatccagtgccgaggagaaatttcatcaaccttaatgatggatcggctgctcaatctccaaggacctcctctaggcagtattgaaaatattgagctggcaggtttcaagagcagaaactttgacagatggtggggcgaatggaagctgcatttatttcaccaatcggcctcaatgtacatgacagatctattccctgatgttataccccaggtaaattttgtcattactaaactgcataacggttagccaattcattacttgactaatcttttgttcctgttttgcagacaacagagtcctcccctccacatcaaagcaataatggtagggacattgaatatgccccaggactaattccaaatggaggtggaccatcccctcctgtcattggctatgatgcccccaagaccttaactcttcttcaaggactcatcagagaaccagccgatacaggtaagaaaagaagaaccaggtcatcggcagcagatacattaactgtagctccaaagaagaaagccaaactcaagaaacataaaccaaccgatgatctgcctgtcctggatccatctattgagcaagctctggatgaagaagacattgatgatgatgttgatcaggctgcagccgaagtaagcgatacagaaaagacaccatcggcttcgcctaagcaaacacctccaactccttctgcccctactcacttcttaagagtaagcagctctctttgatcctttttgtaatcacctcattttcagccgatgaatcacagactttatagttgcagaaaaagaaagctgctgtgaagaagaaatcggcaacaacaattcgcaaaccggttccaccagcaagttatttaactctcttattaattaatcccagccgattttgtctaacacttgtctcttttacagcctcctcctcctccttctcctcatgtacagcaatcgtcaagtgaccgaactccatcggctgtaggaagtcatcatattgagggagaagaacaaccagctgctcctgctatcccagtaagttttccccttgatgcaagaaattagatcggctatatttacttagctctcaatcttcctaaaattgtccctgcaggttttagctgatctcttctcttttgacatcagagattatctcgatgaagcagaagaagatactttgagcaaagctctagcccccttacccgatgatgtgaagaaaacacttgaagatatctctcatcggctagaggcctcctctttagatagcttggtggtgaactgttagccaattaggactcggctacatgagatccaagctctaatcccagatgagcttgccgatatccttactctagcggtctatcttgaacaacatcaattcaagctagaaaaagccaagttaagactagccgaacgtcgggagcgcaaggatatcaaagctacaatccaaaccaatcgacagcttgttcatgaagagaaaaccaaacttgatcagctatctgagggcccgatcaagtccaatattgatcggctcgaagctcgcaagattgagctcttggcacaacttgaagaatgcaacgacgagctaggtatggaacataaaaagctggccgatctcccgaagtccatcgaagagcagaaagcaagactcaaataggctatcaagaatgttgctgatctgaccaaatctttgaaagtcatccctggaaccgatgctcaagatgcccaagctattgaagaagtagaacaaattaggcaaagggctatttctgctatccagcaatacttgtctcgatgactttttgtgtaataggccttagaaattttttgtaatcggctaacatactttagtactttactgtcttaacaatcctttgtgttgattaatacaacttctaacttcgctcaaaaattttcattttcattttttatacatacgtgcccccctaattttacaatgtcaaaagcattgataaaattataaaaacaactaagggcgatatagtaatatcggcaaaccacaactgattacaatatgaaaaaaaaacaagggcgatataataatatcggccatctcaagacgatgaaaacacatcggctatcatgtatcggcaacatcagccgatcatgcattaacccaaacgcttgggtaatatttcttcaagtatttgccatttagtgctctgccatagacttctccatcaagtccttgcaatatgtaagctcctttggatacagctttatgaatttggaacggtccttcccaattcggcgaccacttgccgaatttgctatctcgagtcccaatcgacaaaatcaacttcaatacaagttcaccttccgaaaaatctttgggtactaccttcttgttgtaatgccgagtgtcacatcctgatttttgtttcaggatttataaattatttaataaattattaatagaatttttattaaatgttctttaatttacaagtgaagttaaatgtgggaaataaaatttcctaaatataaagcatggatgtatttaatttttattaaattctccatgattaagtcaactctctgaaattttctcggatttttcggagctcaattcctaaatgatacaaagaacagttcagtaattatttgatcaataatgatctaattataattgttaagagcttttcttgtttaaaaatccgtaaattataaattgttgtttaaaaggaattattagaaatgattttaaaagcctaaaagagaagatctaattttaatttgctaaatctcaacataaaattgggctagataaaattttgttaaatactttgcttaattctataattcctagatttttctgggatttatttgagctaaggaagtatttttaataaatggaattgcatttcatgaataatttaaatagaaaaatgtttttaaatcctccttttggctttgggccgaaagccggcccaaaacctctctctttctctctccctccccggcccagtcggcccagtccgccgagctgccgctctcctctctctctctgtcgctgacaggtgggtcccacctgtcaggttcgtcttcctcgagccgccgccgccgcccgaaaccctagccgagccgcgccgccgccgctttccaattcggccgcgcctttccttctccggccgaatagattgaggggaaataatctcctcgatctcctcttccttttctcttatagaaactccggtcaatttcctttggaaataggcggattcgagtttgattctgattcgtttttccccgacctttccttctcgtcgccggcagccgtgggccttcgccgtcgcctccgagcccccttaaaaggacccccgagctctcctctacccatcgccaccctcgccttcgcctctcgtcgtccgtagagctctagcgccgtgtagcttttgcgcaaccgtcgtcgccgccgctccagccgtccttcgccattgctccagtcgtcgccatcgctcgggaagaccgccatcgtggtcgccaagtcgtcgccgtcctcgtccgccgcttcaccatcgccgaagaccgccggagaaccgtcgccgccgtagacccgatctatgccgccgcttcttcctcgtcgccggcgctgtccgttgttcctccgccgcttctttggtcaccggtgagttcgccgcgtcgccctctacccgttggtgcccttcgttcgcgtccttgtgccgtcgttcgccggtgagcttgcgccgtccgagctgccgagccgccgtcggtgctgacgtcatcgctgatgtcacccctgacgtcatcgtcgtcgtccgtccgtgagccgcggtggatccgttcgatctcggccgtccgttttggatagggttgatctcggccgtccgttcccgtgaaccgttgccgtgcacacggttcactgtgaaaccctagccgctgacgcaataatcctccttttccttttaaaaaataattcattattgcgtcataattcaattaaaatccatataagtgttttaatccgatttaatctttaaaaattcataactaattcattgtaactcagtttaatgtggttcaagttgcaaaaattatataaaataaagatctacatattaaaattatccataaattgaattaaatttatttagttctttttaaatgggctttaaatagatttaatcttgtaaaattcataataaattcatttgaagtcagaatgaggccgttcaagtctcataattcatctaaaaatatgatctacatgtttgtttactttttatgtattgtttatttggtttttattagtctttttcttcgttttgcgtgttagcttgtcgtttccgtcgttgtgaaggttcgcgagtgcgtcggaagtgttcaagaagattaattgaagaccgaatattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgattactttaatccttgataccttgagttattataatttgaatagttgagctttatatattggttcagctagatattagatgtgattgcttagccatgcttagaaacattagcacactattgggataacttatgattcattattatttaatgatggtttattgatagttcacgatggttaatcgtgattggttaattaattacttgccaactaaaacttgataatggtgggttgtgagcacatggttttgacagtcgtgctcatgacaattaaggaccggttcgcgagctactattgtgaaacattaaccgtgccaaccacaagccagcgtgggcaacggctttaccttttgtatagcatgattcattgcggagcaccagactgagaagtggcggagataagcccacgggggtcactggggagtccatgcctctggtttttgaggggatgattatgatccaggaatggtgcactgtggtgagttgtgttatgcagagggtattgtcacagcctctattcgggtactttccagtatcgcgacgcatggtagacatgatgttgaggctgtgtcttgtgggtacagtggtacacctttggccagagtaaaactattcgaatagccgtgcccacggttatgggcgagttgagcaatgtttttcgtgattagtcccacacctctcaccgtaactatggatgttatactgggtaataatttgcttagctcctggtttggagttagatctgttcagccgggtatggttgttcagaatggttgggcctgtgcagcatgggtgtgctgttcagtgttgattaaaatttctgattaattactccactgttttacttctcttaaatgttttgctaaatgctgcttttgcaaatgagcctatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgccagtgggagtggagccggagcttcgctagattttattttccgctgcagttttcttcatgatgaggactaagtgcctcataagtaagtatttatcgttttagttaatttgatgaatctgtatattaaattgtcagtttgtgtacctcggctgattcctggacgaggattttatgcacaaataagttcggaaattactagtgaatttccgggcgtgacaccgagcaactcattccttctctttagtaacttttgcaagggctcgcaaacgtgactgaactagatcaatacaatttcggcgcatcgccacccttttgctttagttttatttcgacgagttcttgcattcgggttgagctacatcggtttcgatcttcaacaagaggtaaaacttgttatgacagcttgcgttctcgggattagtgcttccatctttatgacactctaatcctgtttatgtaattcgtcgagttatcatatatcttacataatctttggcaatctcgctatctaacctacaatcggctaacatctatcggtagagggcagccgattaggttagacaccgaagttgacttagattatatgagatatctaccactctatgaaacttccagcggcttgattgtctagatattgttcttgtttttatacttaatgctacatcagttgagtttgatctattaagtcgtgctagaatatcaatctctagcctgccatctggctgttgattagggtaacatcagagttttagccgatcttatctgatttaactacatttactctatgtgttttattgacatgttaaatctgccatttatgtaaagatcttatttcatttaagtatattaggcttttgtttggtatattctattcgttttaatatcttaacatagagttgtatcggagtattagccgatacatgctagatctatatgatcggctatgctacgaacatatataatcctggtattaatatatatttcgatctaagtgatttatactgtctcggcatggcgaccgatctatcccaatcgcttgatttaagtatatatcgacataagaattatatatttctaatatctatagccgatcgagtagatttagttctttattacctatttacaaccgccgatcaatttacatatgacatcggctcaaagatcaatgatatgtcaatggcacttagccgatcggctatcgtttataggtttaaccgcggtttctttgttttgatatcttgttgattgcaggatcaaatcaactggcacgctaacatacccgaaggcgagttttggacctgcactggagttaagtagatctcccaggtctcgtgttttacgtcaacacgcttttggcacgcctggtgggaccacgaattttatatccacatgtctgaagaagaagtcaatgccaagatcatggtcacggtggagagtttaatggaggaacaacaatattggctcagggggcaagcgcatcagtttcagcatggtggagcacatcagtatcggctcatgaaagccgattgcaagaagcaaaggaagatcggttttggagttatcaagacaagaaattttgaagcatgaattctcatactccaaaactgctgcgcatgtgttaacagtgaaatttggtaagcccggagtagtcatcggcttagagtcagcatcggcttcgaagtcctgcgattagccgatgagagttgtcaagtcgtcagttgtgggattattgctatattcggttaaggaaattgatctactaatggaagcttatccagaagagaccgagttcaaagagaatgtggcatggcaagttatctattaattaggaatagtttgttagtatccttttatctttaggaaagtgtgtttagtgtcctataaggactttatcttttccttttatctttaggaaagcttctttcttgtccgacaaggacttgtatcaacccatgggtataaatatgtacacccggggtctatgtaatctatctccacgatcaatacaattcggcgcatcgccaccttttaccttttccactttattttatcgtccggcgggacttggcacctgacgcggggctgcatcggtgttcgatctccggctaaggggtaagtccaatgttctgccggcccaggcaattgtatagtctacatcggcgtcgttcaaggctgcatcagtacattcgacctcttggattgctctggtttggatgatatatttgcctacctatttatcatatgtctctcttaatctagtcttagcatatcaatttagctctatcggctgcttctcgctttagggtttctgccgatatcggctaaatcgtgttgctagattagattagactaggtatctaccaccctgacaactcagtcaacggcttgattgtctagatattgtgtttcttttcatacttagtgctgcattagttaagtttgatctactaagtcgtgcttagaaccataatctctagcctgcttcttgattgccaataagggtttcatcggggtttcagccggtgagttatctggacgttgcatcggctcataaggattgcatatacatataagttggatttaaccgatgacaacaaaggtttcactgtttaatctaatcttttggatttcatgacatcggacctccagccgatgtatgctttaaccttcgaatcgatgcttatttatcatatcattatttgtcagttagtttatattggattatattgttatttcattacatcgttatcagccgattgccttcatatcattatctacatagggcatatctgccgttacttaaaccctattgctatcggctggcatcgacatcgactattatcggctatcggctggaactactccatcggcttgtcaaccgatcggctgttttgatctactatttgcatatcttgttagttgcaggatcaaactgattggcacgctcgcatctcatcaagatttggacctgcacaagagctaagcagatctcccaggccagtgtgtgtttttcgcatcaacaccaggcaaaagaaaaatcgttggagtagaggacaagactgacgaggattacaatcagttggatgggcaaccccctttcacggtgacgattgaccctagcatcctcctatcaaatgaagacaccccttactcacgtagcgatcacaaggaaggaacaatagtgaggagaaagtacgtgcggtcaaccgtcaccgccgatgtattgccataattattgtgtacacgatgtaaactattttggatgtattgaatatccatataaatcaattgttgtatggcatatgttaattatgcatgattattagaatttttaacaattttaaatcatgtgtgtgttagttatatgctagttatatgctagaatttttaaaaatcatgcatatgctaattatatataattattagaatttttaacaagtttagatcattcatgtggtatttatatatgttaattagaatttataacaattttaaatcatgcatatgctaattatatatgattattagaatttttattaattttaaatcatgcatgtggtatttacatatgttaattagaatttttaacaatttaatatcatgcatatgctaattatatatgattattagaatttttaacaagtttaaatctttcatgtgcttattacgtattatccacttaatttactacagacaacaagaatttttcgaagtaattgtcattaatttttcgtctttaaataattttaatgcattatttactattttagaaacacatatgtaatgaaattcaatattcagtgctattatctgtagtcccggttcttaaccctaaccgggtttaaaaagaatttggaaatagcgggaaaatatctttagtcccggttggtaagaacaaccgggactaaagaactaggagtatatatattcccgatgcgcaccctcgtattctccaccaacacttagaagttttttccccgatctcgatcggcttctccttcgccgccactgcctagggcatccccgcgccgacgccgccgtcgtatctcgccgtcgtctcgcaagcgtcatcgtcgccgcctcctccgccgccgcatctctatggtgagagccgccgccgccttcctctctctctcgacctcgacctctctctctctctccaaaccgccgccacctcgttgccgacgccgctgcctctccccgagggggatcgagcccggggtgttgcggcggctgccccctcccagcttggggttgggccgcccccaaacccacgtggctacccccgaggggggtcgagcccagggtggcgcggcggctgccccctccaagctagagggaggaggccgccctcgcttggggtcgagctgccccgaccccctccacgtatcagcccacgtgtacagggcctaacgcccacctaactgcatttaaagcggtctatgcaaccgtgccatgccgcatttaatgcggcgtgctgtgcatatgaccggtctgtgaccggtggaatgaccgatgggacggcgactgtgtaccccggccctgtcagtgtgtcacgcggcgagcggcgtgcttcgtcccgtcgcatcataatgatgaggggcttcacagcctcttacccgggtcagagctggtccaaccactctgaactaacccgggttcccattttctggtgtgaacgagaacccggaagttctcatccattaaatggcgaatgacaagggcgccttgcatgatttgatgggccccgcgcagtaaccgacgtgcagatagcttctgggctaaggcacaagacatgtaatgaatatagagaatattttcccttctccctaggtagcactcgcagcacatgtggtatccccttagagtataaaagttggaccatgcctagcgaggaagggggatcggactgaggatccctgagccaaagcttgtctaaccctagcttgcataccagggattcagggactttttaagcacagaagaatcatacacacaggagtagggtattacgcttcgtagcggcccgaacctgtataaacctcttttgtttcatcgtcttggaggagcctccaagatcaagatcacacacagtttcgctcaccaaatcctcgaatctcacccgctacccccggccgaactctcaaagggggggcctcacagcctcccgctagagagggtcaccccttgacacgaggggacaagtgcggcggccagcgagccgcgagggaattgtggtcatgcatgctttatggatggaatgatggatcaatatgtgttcttactgaaatttttatgatgctattctaagtattcatgctattttttatggtacatataatatttgttcttgctgaattgatgattgtcttgtatttttggtgcagattggatggagatgctacctaatgtgggtccccggaagggtcggggacaggggcctgatttggccccacatctccagtcaggaccgggggtagggagtgaagtcgggggtcggggcggggccgttccagcccaacctgaccccgttgccaacccgaagtgtgttgccctcctagtgtttggaatgacttagagttccagtatgagtagtagtttacccgttggggccggatccccgcctcaacggagcaggggcaaaatcttccccatgggtaatgcggggcagggcccaaacttcatgccggggatagggaagcatctccacctatggggaccctgtggggccctaaaggtctactattagatgaaggtggcctatacaaataaacccaccaggtccaattaatgaggatatatcaagagaaatccggaccttatcctcaatgtccatggacccgatccatccgttccattacagccacaaccctcgtacctcaacctgtgctaaaggccccaaacatcggcacatcgggcactcgtgttatattgagcgctgccatgcttcttctctctcacacaccttgctgtgggccatggacgacctttgcctcgaaccatgccaccaaccgccggaacagaatgtcgccgggcatcggcctcaattatgcaccaggccagtagcttctttctctccatcaccacatcatttctggtcccgcacctcgtcttcgtccgctggtttccctccgcatggggcctgctgtggccggagccggggctgggtgaggcagccgggggttggggattgaggccattcttgcccaacctgtcccgtcgtaaactctatatgttctagtgagtacatactgaataatgcctttccaatggcaattggcaaagtagtgatgcgtctggcggtgaactgttcgtttaaatttgtctaattcagctttaagaaagtaccactacaatttggaacgggtctacacggccgggctactagcacattccttttaatgaatcatgactacgatttgttacgagtaattaagctataacacgtccaagtcggctttaaactatgtagtgactatatatccaggagtagaattacatgactcatatttaattaatcaagttgcataagagacgataaccacacccagtctacctgataaggcgaagaaaacacgatgacacgagcactgggcggccattggggcaacttgatgtaaagaagtcgcttgtcagctttcgtcgtcgcgtctctgtctagatttcaccaatatataatatttctcataacctattgtcaacaggaaactttaattacatagtatatagtactgactaaatacaaagtaacaacgtttccagcttgttgtcttctgtcggtacagtctgtacagatctaactagaatttgaccttgattgcacttcaagtttcaacttatttgcaagatttgtgagcacattgaaatatgagcgggtgctgatcgattttgaataccggcttagggaattttttttatcggtatcaccatatatcacacctacagttcgaatccaaaatgttgaattgaaggaaagggatcctctgacttaactgctgtgcagttgagtcactgacatgtgggccatagtaaagtgggacccacatgtttgcatgtgcattttaagttagaggatctgcttcttgaattgaaaagccggtcgatcgatggcctgaatttttaattttgtcgtggctaaagtgtagttttttatttgatctgacgactataaaatattaatacatcgtatatatattataaatgataaaatgtagtcatgcgtactagtacgtgcaactaattaatatataataatacacaatagacagtcataaactgtggtaatagcatagtcaacactaagaaataataatataatgttccacaacaaatgataattcatcctaacctatcacaaacactagggttgcgaactgggtgttcgtttattcattcataaatatgagtgtgcacgtatatatgagcaccgctgtatgtattgtatttcataaaagaaacaaaacgaattattgcacaattatttcaaattttaaaattcatatctgaatagtatgttgttaccaaatgggtattaacatgccaacattaaggtttcgattacccatctgtacctttcttttagattatggagaagtaagttttggtctatgcatcaatatgttggaattaatgaatgggtctcaacccattcgaagatttttttctttgaaaaatcataaaagcctacatcataagatggcatacatggcgagtttagtacaccttgtctattctaggagaaggagacctccctataagaaaggatactctcttagacactgaggcatgtgaggttgacagaaaaaggggaacacacgcacgctcttacacgcctggactggcctggcggcgcgtgtgcacaacatacgcatcaaattatctctatataagtcgagccgccgcctccacacaacacatgcgaaatcaaatttagggtttgccccctctatactatgtcgtcgctcgtagtctacaccatcccgctcgctagcgtgcactggcgatcgggagagcaggtctctataaccttcgcctttgacattctgcactgggaaaaggcggtaataagatttttgagaagcgctgtgtttctgtcatttttgcagcgggcatggctagcaaaggcctaaggctagccaaaaaacaatttttttttgtggattatactcatctgtgacgggccataacttaatgcccgattgagatgatggtcatctgtgacgggctgtagctaatgcccaattgagatgacagtcatctgtgacgggctatagtttaggcccgattgagattagtattatctgtgacgtgctctagtttaggcccgattgaggttagtagtcatctgtgacgggctctatttgtggcccgattgagataggtcatctgtgacgggctatagtttgactggtagtctgggtcaaagctatcggtgacaggctttaattagggcccgattgagataggtttatcagtgacggccgtttgcccaattgagattacttttcacatcagtgacttctagcctgtgatggacgccgtgcccgattgagatggggcttactgcccgtttgagatgagggtatccgttccagtgattgcttgatttccttcacttttttttaccaatatatatagttgattggaactatatatatttttgatttcttatctatacaaataatacaattgcagctaactccaatattcggtgtttaatcgaaatgattggatagactgtcatactcggcttctaattagaataaaggttgttgccagttctatacttctattccattatttcctcaaactaacgagaaaattgaaattcccatgctctaaccagcgaaaatgcacaccatcctcctagttagtccaagtaaagttacacgagcattttcagcaaaataacaagaaactaatgaagtcaactccagcttgcgtaacgtagcatgctaataatgcacgcgaaatttcagactccagttgttaattttggttgtttaattaccaaagcgaccgggcatgaagttgacttggaaagtcggaaacaatgtgtcagctcgttggcacacttatctatatccttctcagataagtacggcatattctgtccttttcatgcctctcgtccgttcttttgtcgtacgtaactcacggtagtcatgtgacatttcttcttaaactccgttgcattgccatcaaagcatgactatttctagtgtcagactttgtcaaccgtgggtgtggtgtgtggtctgctcacggagttaatttctcacttctcgcttgtactcctacaacagatggaaccaaggccacacgaagcaatatatgcattttccagggaacttttactatacctccagtggaggtgataatattaatagtgtggtagaaattggtgccggttctttataggtggcggttcttaccatccctccaaccgtttctgtatccattgagtaaaaaccaacacctatgttttaagttctggtttgaaaggatgttcgtacaggactataggtgttgggttcttcatcaaaaccgacacctacaataccatctataaagctgacaccgatgactttagtgtcgaccaattgatgccgacaccaaaagtaacacctacgtgaccttccgaaccggcacctataatacttcatatagtagtgaagtcctggtgcgctctcgtcagccgcccactacgccagattctcacacctgtgacgggcataagtattggtcagtgataagggtcacctttgacgggtcctacgggatcccatcatcggtgagccatccggcggcgacccatcacagttaactaatcacctgtgacgggccaaaaatggaacatgtcaaaggtgaggtaaagtcaaatatttggcctgactttacctcacctttgacgggtttgactttacctcacctttgacgggttccaatttttgtcctgtcaaaggtgactagttacctgtcacatatgaggtatacacctgtgatgtgagtaacatttatgtgcccgtcaaagatgataaaaaaaatctctctcataaccctcccctctcctcccggctcatcgatccatcattctcctctctctctctgtccctctcaaccctttctctctttatcgatctagttgtgtgtgggtcggaggcggaggcggcaccggtgggtctgcgggctggagggggaggcgacaccagcgggtgtgggggttggagacggagatggcactgacgggtgcgcgggccggaggcggaggctgcacgggcaggtacgggggccggatgcggaggcgcgcggcaccggcgggtgctggggccggatgcggaggcggcaccagcgggtgcggaggcggcaccggcgtcggcgccagttggaggcgaaggcagaggaggtgggagattggggtcggtgatgaaggccgcctctttaggtcccaactccgtccgcccctccgcctttagatccggcctaccggaggtcggtggtcaccggatcggaccgcccctgactaatgaaccctgagcttcactcgagacactcaaggcggttattggcccgatatttcggtgagttgtagataactacgatttgggagaaacgttgacgacccgattacaaccgtactagacattgttgtgttgcgccttagagatcgatacacctctccatgggttgttgatcttgccggtgcagatcatccttattcctgcaagcaaatcgaagaaacaagcaagaataagataaaagcaacctgaattacatataccaataataagttggggttctgtaacgagcaaaccagcgatctaaccgatcacgggattacacggcaaagtagcaaagctaaactttaatctaaacaaaacccaagaaatcctgaaggggtaccaagctatttatggagatgggaggaccctaggtcgtcctccacctggttggggcacaccccacatgggacccacttgggctagggtcctagacgaagttataagcccatatgcccattaaaggtgatgcagcactttgtttcctcaattgcggctcaatgagatggaatttcacaatgagtttgatccattggaaagaagactccgagagctttccatcaagtactacggaccgaaaacggatgtcgtatgcagattcagtggccctttgaagtcagcagtgtagcaagtggccgaatcagattccatcacttgggcatcttgatcttgatgtgagcaatggttgtatcaatggtagccttggtcacatcatcctccccttcttcagggaaaaccgtctcggtttttccatatggtgctcttcgcatagtccatttaaaacaacatgtttcttccaatgaaaacaagacactcgagataatatgattagcaataatatgtatctctagcttgtatattttatccacattgatgggaggttctaaatctgaacagatgtgaaaaactctatggaccaaatatattcctctatcatcagattcgccaaatatatgaaaaatagcactagttggatatgtcaaattagacttagcaaataatttctccttcaaattatcgagctcacaaaaatcatcaaactaaacatagcccaaagtatttaaagaagatgtcaattttcgttcctcaacttcagtagcaatgtgaacaacatgcttagaatcagcacataacgaaatattataaatagcatgttcattcactagttgtggcatggatataaatgaaacattatcacacaactcttctttatcacaaggaacagcaagtaattcaagttgtgacaaaggcatctcaacaattggttctactaatggttgctcttctctagcatgaaaagtggacatgttcaattcattaacggcacactcaccttgattaattgcagcaccattaatattacctgtggttctctcttcggatgatgtaggtgcatcagtcttctcttcttccttcgtgagcgatggagatggcatctcgatcatatttctcttctcctcacggtgaatgttctgagctccctacagaatgtcagtaataggaggcacaagcatagcttgtttctcccttgggttctttaacatattgctctcaacactgcaagcaagtatgaacaagtggcctatatgattatatgtcatgttaataagcccagcttgaatatcggaattaagccctctaaaaaaatctagtcattgtgttctcattgctttcttttaaaccactataagagatacaaattttaaagttatgaaagtactcccgcacggttttgtcaccttattttagatgttctaatttctcaaggagagtacgtttataatatgaaaacacaattttttttcctcatcattgttttgcattcatcccttcaagcttatggccaacagtataccaccaaaaagacgtagaaccggtacacttattactagcagccttaaccatttcagcattagagaaatcatactcatcaaattgtttgtctactgctagctcctaattaacataagcggcggaatcatacttacaatcactggcaaattagatcctacccttgcaagatcattatcatgtacctcatatacaatgcgtaaagaagtcgctatatctcgttgatggtgaagaagtcaatgttgagcatgaccatcttgtttctgcttgctcaatcctaccatggttagtagcaaacaagaaacatacaaatgaatatgcacgctcctatcaactactaggtagtggcagctgaaatatcacacactcaagcttttcaccaagctcttacaagttcttaccaaagcaagcggaatggtgacgtacacggacctcaaccaagcacctcaatggagtttggatgtatcgataccttggcaaacacttgctgtacggctgcaatcaaatccgtggagctttgggtaggcttaaatatgtagcaaaggaatagcaaatgctcaaatcagagaatgcaaagttgaataatcgttcaaagtcatgtaccgtgctggtcctaggctagaacgtactagagacgcgaccctagacacaaacgataccacaagatagcacaagaaacaacttaagcacactctaatatatgacaatctcaaggatacaactaatgttctctttttttctttctttctttttcttctttctttttttcttttctttttcttcttttttctttttcttttttttgtgcgactttttgtttctttcagcacctttgtgccttttctcactttttttatttttttagaaaaaaacgactcaaggatcttaaagcaagattacagggactcaaatgtaaatataaaaattacagggactcaaatgcaaaaatgcaaaccctaaaactcaaattatacaaaaatggaatgtggaatttatgcccgttccgttttttcaaattgatctcgaaaccgacaccaaacaaaaattcaccaagctatctagcaaatcacgttacccattgaaactgagacgagatgagagggagggagtacgactctcctagtcacggtggtggtgggtgcggggtggaaccatacgctaggtgggatggttcggcctttagatggaaacggggatggtccggcctttagatggaaaccgaataggtgttaatcaggaaaccgataccaataaaaaaggctttccccttcctccttcctcacgtatggaaaccgaatctaatctacaaaaaatctctcaaccttccttcttggtagcgcacacattcacggcaaaaaaaacacacgcagtatttgcaaacactagatgcaactcaactccaaaactaaccgacagaaacttctgaaaactacaaaaatagaaccgtggcaacgagccgattccgttttcgtaggtcacaacagagacttgggggcagcgacaactgtggtacaaaacgtgaccagaactcaaaactctaaacgaactagacgctaagaccagcaacacgatgtgacaatgcaacacaaaattcaacaaagcaaaaactgaaaacaaacaatgcaatggcacaatatggctaggtaaatgatacaaattttttttgtccagctattttttggttatgggtagaaaaaaaaaactcaccgagcaacgaaagctctgataccacctaatgaaccctgagctccactcgagacactcaagacggttgttggctcgatctttcggtgagttgtagataactatgatttgggagaaacgttgacgacccaactacaactgtactagacgttgttgtgttgcgccttagcgatcgatacacctctccgtgggttgttgaccttaccagtgcatatcaaccttattcctgcaagcaaatcgaagaaacaagcaagtacaagataaaagcaatctgaattgcagataggaattcaatatcataagttggggttccgtaacgagcaaaccggcgatctaaccgatcacgggattacatggcaaagtagtaaagctaaactttaatctaaacaaaacccaagaaaccctcaaggggtaacaagctatttatggagatgggaggtccctaggttgtcctccacctagttggggcgcaccccacatgggctccacttgggccggggtcccagatcaagttacaagcccataggcccattacaggtgacgcaacatcttgtttcttcaattgccgctcactgagatggaatttcgcaagaccgaaaacggatgtcgtacgcagattcggcggccgtttgaagtcatcagtttagcaagtggccgaattagattccagcacttgggcatcttgatcttgatgtgtagcgcccgttccgtcgtggcgcctagcgggaaaactatctcttaaaaaccctagttgcgaaatctgtttctttgcttattgtctagtgtccatgccatctcagatctcaaatctccgatctatcgtcgagttcaatcccgaatccaaatccttcccaaatcaaatccctccgcaaaagtctattttgcctccctcgggttcgatgggctgaatccctttcggcccatcccccctcccttcccggctctctctctctttctccccgctctgccgtgagccgcgccgagccctcccttccgctctcgctgccattcccgccgatgccggccaaatcggcgagccggccgcgcgcgcgcgcgccgtggtggccgactggctagtcgcccccgccgtcagcgcctgccaagcctgcccggcgtctgccgcccgtgtcgccgctccactccaaaccggtccaccgtcatcgccgtcgtcatcgacccggccccgccaccgccgcgcgctagcttacaagggacggaggctgagcccgccccccctctgccgcatcgctccctctgcctcctccttttcgccaaagtggcaaggaggcaagccccctttctctccccctttttcccttttccctcccgccggcgtcatccttcccccccctgtcgccgttttggccgcgaccgccgagcgcgagctccctcccttgaccgcccaaggtcggtttccaaaccgacatcgccgccctataaacccaggcgccctcccttccttttcccctcccaatcttcccctttttcgcccgcaccattgccgtcccctctgtctcgccgatcgccgaccgccgccgtcacgtgtgccaaaggagtcggtgcgcgttaggacgcggaaggggactccggacgcaccctctccttcctcttccccggcccgaggccggagagatcgctcccgtgccgtcgacccatcgtcactgcgccccgtccgcacggtagtgcatctccccgttctccctcctcaatccatctcttccccttagttttcgatagtagcatgtgtagcctccccgtagctagccggcgccgccccgactgctgccgtcgctcaccgtgtgctcgccgccgtcgccgcccgagctcggaagcgcctctcgtcgccggcctccctcgatgcgattcctcctaatccggcgcaaggggtgggttcccgtagctgcgtagacgctctcgccgccgggaatcggcccctcgtgacctcattgccgtttcccccttctcccgccgccggttgccgccgccgcaatccgccgccgtcgagcatcccccggcgaatccgagccattggctcgtctcccctcgtcctgtgcaacatcccggtgtgctcgccttcgcctgtatcgccatggttcgctccccgctcgccgccgtcgtccgccgtccgttccggccggcgtcgtcgtctacctcccgccggcccgcgtggcagccacgtaggcgccacgtcggcgccacctcggccgcgaccgggtcaagtagaccccggtccgccgcttccctccgccccctcgcgcgcgcggtccaccgcgagccgtgaggcagcgcgtgggcccgccgcaccgcgtcctccgcgaaccgcacgcatgcgccgcgcctccctccccaaaccctagcacgccccgcgtgcacctcgctcacggtgagccgagtcgccgacaagcgggttccacccgggaccacgcgggatgcacccggcccaccggctctctctctcccctccccgcccgcgcgcgcgccttgggccgccttcttgggtcggccggcccattaagctcggccgagccgcccctttctctcgggccgcgccctagccgcccgaggaaagtctaatttccctccctccttcttttcttttcttttctttttcaaaaaggatttaaataaatcctttttcctttagacaaaaaatccaataatcttagaaattcaatatcttcccaaccgtaagtctgtttgactccgttcaacttccaaaattcctcaaatctcgagatctatctaatggcacgcttagaggtcaataatagggctttattttcgccgtttgctgagttgtcctgtttcgcgtgtagtttcggagctcgaagacccgcagtgcgaggatttcgaggatcaagctgaagatctcgagcgaggcaagccacctttgaacatcttgagcctatatttgaacttaattatgttgcttgaaaaatattatgcattgataggatcgcacttaatctgcttatcccgtctgcaaggcagattggcggacctacctaatttgttgcatttgacccttccattgtaattgttataccatgttcccttgtacccacctagttgcgcctcggtaatcgtgcactctgcacgggtatcgacggtcgccttcaaacttaaaatctgagaaacatcttgggtaaaacttgggttttacaaaagacttggaaaacccgacacctgggttggtgcttgcgaactaaatgaatttccaaaatcgcggaccggggaacgtaccgggtgtacggtttcccactcttgcacttaaggaccgtttccttggaatttcatccgaacacatgacaagtacgaccacatgggtggaatgggacacccctggctgagtaactagcttatcgggggagccatgatgctaagagacatgtggattcaccggggtggtgtcagggaggacccctgggcttcctggcacagtatggtctgggacctaatctggtgttggtctgggacccctctcgttggcatatggtgaacctatgtcggctttcgaaatgccttgtcatgaaagccttaaggtctctagtcgtggccgttctgcacgggctggatgatccgggttagtaatgtcgtgtgggtaaagtataccccctctgcagagcttattaaaactattcgaacagtcgtgcccacggtcatgggcggatgtgaggtgattcctagcgtagttttgtttgactactgccttgtgaaatttgctgttgtggaatgggtttgatgtttggaaaatctgcggctgatgggattagccaggcccgggtggccgtttgaaagctgttggccgggtgccaatcttgatcaattcaaaagactgatacattgcacatactccgaccggacgagacgcactgtctcatccgtgtcgtttgagaagcactcacttagttatttcagaaaagagttcaaataaaatcaattgcaaaaacaacagcctttctttgaagcctgcattaaacacttatttcccatggcttgctgagtactcccgtactcacccttgctctatataaataatccccccccagttgctgaagaagatgaagcggatcccgctgacgaggagttcttccaggagcaagctggctacgatgagttttagggtttcggcctagttcccaagtcgcgcctgtgatgtttggtccaagtcttggcttccgcttcccttttgtaatgcagttgcgagctcgggatctgtctgcagcccaacatgactgtactcctactctataataaagagacctctgttgctgtgatattttgtcttcctgtgataccagcactgtttcctaggactggtatcgattaacaggttaatttagagcgtcacgggctagttccgctcgggactagttcggggcgtgacaagagatggtatcagagcacaggcttggccctagggcgaaacccgacgtttaggatgaccctaaggatactaagttcaaaactacttgcgaaaagctaaggcttcttttggattctttattttcaatagtttgttgctaaaatggttagtgatcttttctccctctttcaaaattgtagatggcagtgaacgccagcttcagttcccacggttttggtgagggtcaccacgtcgctcagcttcgtgacctcgcccgcttccttggcttctcgtgtcccgagtacatggggtactccgtggacgtgttccccctcgctgtgagctctctgtgtacctttaccctcgcggaggtatacacggagctggccttcgcccacaccacttcactgtggctaggcccaccctccagatcgcgtaccaggacctctcctggactgcgcttcgtcgcttggcccacgactacagccaccgtctcgggggctctgccttccggcagctcccacgtcttccttctggctacgcagatgccaggtacccttgtccgtacagcgagtcttagccagtgctgactcgcatggttgagctttcggaggctcaggccactcagcacgacctactccttcaggcttaccgctcccttgcccgccgctacgctactctggaggcccgtctggccgaggagggtgtcacctcagttgacactgtctcttgggactcaggccgcctctgccacgccagccacctgtcctcccacagctcccgcggctctgctcgcactcctagtggcccgcgctcccccagctcgcgtgcgccgtactcaccagtgtactccccctacccacacccagttagcccctcctacacccccggacacaccccagttgcttcctcccgccgtggcgcacgctttatccgcactgtgcggaagcgtgttgttggttcttccaccgtgttccgcttcgactacccagctcccccaccgccagcggcccgtgctgctgccggccctcgacaggttccgccggtcccttcgcgtcagccgatcgacgtttcttcgactgatgagccgactacagcaggcagccaggcaggcgaggagtagaggaggcagtcttcagcagccgtccgtgtgttaggcccttttgttccaccgccaactcttttggagtcgtggcgaggtagtgcgtgcgtgtgttgacgtgggtgttgtttggtagtctggttctcctaggtggtgtgcgtacagtcaagctcggcgtagctctgtgacttgtccacacccgttgtatcaggtgtttttatgatttgagaaaaaaatccagtttatgcctagtgcgtgctatctgagttgttatttactttgctccttgcccttctaagtgcttatctgattcttacctcgccctcttctaggagtttagatgcctagccgcccccgccgtgctgctcatgcaccagcccgcttcagttttgaggaaggtagagttgagccagaagcaaatcatgagtcagctaatgagcagtctcaccacagcatccgttcgcaccatactgcttcccgcaatgcagaagttgagcaaccccaccgcagcaatcgctcgcatcacacagcttcccgtaatgcagaagtggaacaatctcaccgctctcaccgcactgccagtcacaattctggagaagaacgcatcccttccccacctcatgtggaaaacaacatgcagcacttaatgacagttcagacacaaatcttgcaaggattagccgcagccatagccggctttcagcataatgcccatggaaatggccaccctcacatgggcaacaatagatccaagctgacagactttctgaggtctcgtccgccagagttctctcagaccgtcgagcccgtcgaggctgacgattggctgaaagatgttgatagaaaactcaacttagtgcagtgtactcctgttgagaagatgctctacgcctctcaccagctaagaggacatgctgcagattggtgggagaattactgcaatgcacaccctgaacccactaacattgcttgggatgagtttgctacggctttccgtggagctcatgtgcctgaaagcaccattgatacgaagaaagaggaatttaacaggcttaagcaaggcaacaacagtgtcaatgagtacctaagtcagttcaacaagttggctcggtacgcccctaaggaagtggacacagacaagaagaaaatcaggaagttcttgaagggaatcgcagttggaatgagactccagttgcttgctcatgacttccccacttttcaacatatgatcaacaaggcacttctacttgaggatgccagaaaagaggctaccgaagaatacaagaaacgcaagtttaaccatcaggggaattcttcccgaggcgcacctcgccctcgctatggtcaacccatgcaatatcaccaatcggtcactcaggctaaccgccagccaggctacgcccctcgtcctcagatgaaccgtccggcacctcagccacagcagcatgccccaagtggcaatactgcgccaaatagtgttacctctttcaagtcaccactaggactatcagcagttcagtgtttccggtgcaaccagatgggtcactatgccagacagtgccctcagaatcctaccaacaccaactcagggcatgctaatggcagcactgccagaactcctactccagcggcagctcagtctcgtcctagctctcaggcaagtggacaaggttctcgtgcttccaacaactttggtcgaggccgggtgaaccacattcaagctgagaccgctcaggatgctccagacgttgtgatgggtatgttctctgtgaactccgtacccgcaatagttttgtttgattcaggagcttcccattctttcatatcacaagcttttgtgaagaaatggttggaaaacccaaaatttacgtgtaccaatgatagtacattcccctgggaggaatataagggcaacccaaatatgcccggaagttaaccttagaattgaggaagttgacttcctagccaaaccgatagtcctagactcgcaaagcttggacatcatcctagggatggattggttggctaagcacaaaggacagatagattatgccgaaaggtccatcaccttgcaaggacctagaggaaagcaagtctgcttcaccactaacacccctaccgcaagtcggtctatcctaacctatttacaagtcacctccttggagtcggtgcccatagtctgtgaatatcccgacgtatttcccgaagaattaacaagtatgccaccagaccgagagattgagttcgccatagaactggcaccaggcaccgcaccaattgcaaaaagaccctaccaaatggcagctaatgagttagcagaagtcaaaagacaaatcgaagaattggagagtaaaggttatgtgcgacctagctcatccccttggggagccccagtgctcctggttaagaaaaaggatggctctgagagaatggtaatcgactatagagccctgaatgaagtaactataaagaacaagtacgcattgccacggattgacgatttgttcgatcaacttaaaggagcaagagttttctctaaaattgacttgagatcaggttaccaccaattgaaaattagatctgaagatatcccgaagaccgctttctcaacgcgttatggtctatatgagttcacagtgatgtccttcggaatcaccaatgctccagcattcttcatgaacttaatgaacaagatcttcatggaatacctggaccagtttgtcgtggtattcatcgatgacatcctgatatactccaagaatgaggaagaacatgctgaacacctgaggctgataatggggaagctcagggatcatcaactattcgctaaattctcgaaatgcgaattctggttggaccgagtagcatttcttggacacgtgatctccttcaacggtgtcgaagtagatcccagcaaggttggagctgtacttgcttggaacccgcccaagaatgtgtcagagatccacagcttccttggcttagctggatattatcgaagatttattgaaggattctctaagctagccagacctatgaccgagctgttaaagaatgaaaagaaatttcaatggtctacagcctgtgaagacagctttcaagaaatgaagaaaaggttgaccaccgccccagttctcaccttgccagatatccgaaaggatttcgagatcttctgtgatgcatcaagacaaggcgtaggatgtgtcctaatgcaagaacgaaaggttgtggcctatgcatccaggcagctcaggcctcatgaagtcaactatcccacccatgatctcgagttggcagccgtggttcatgctcttaagatctggaggcactatttaatcgggaacagatgtgaagtatacaccgatcacaaaagtcttaagtacatcttcacccagaccgagttaaatatgaggcagagaagatggttggaactaatcaaggattacgatcttggaattcattaccatcccggtaaagctaatgtggtcgctgatgcgctaagtcgcaagacctactacaatgtagctcaaatatggccagaccaagatcgcctgtgcggagaattggagaagttaaggctgaccgtggtacagtcaggtgtccctgccagcttgaccgtgcagcctaccctagagtcgcaaatccgggaagctcagaaagatgatgaagggataaaagaattaataaaaagaatacaggagaagaaggacaccgatttctcaaatagacgatcaaggcacagtttggtgcggtccacacatctgtgtaccggccaagaaggagttaagagatcccatcctaaaggaagctcatgagtccgcctactccattcatccaggaagtacgaagatgtaccaggatatcaaggcatatttctggtgggctggaatgaagcgagatgtcgcagaatacgtggcgttgtgtaacatttgccaaagagtcaaggcagagaatcagaggccagcgggtctgctgcaacccctaccgattcccgagtggaaatgggaagagatcggaatggatttcatcaccggtttgccaagaacccctagcgggtacgactccatctgggtaatcgtggaccgactcacgaaatcagctcatttcgtgccagtgaaaaccacctttgatggaaagaaactagcagaactctacatgacccatgtcgtgtgtagatttggctgtcccaagaagattgtgtcagaccgaggcactcagttcacctcaaggttctggaagcagttgcatgaagctctcggaaccgatctaaattttagtacagcttaccatccgcagaccgatggtcaaacagaaagggtaaaccaaatcctagaagacatgctacgtgcgtgtgccctggatttcgaaggcacttgggcaagctggctacgatgagttttagggtttcggcctagttcccaagtcgcgcctgtgatgtttggtccaagtcttggcttccgcttcccttttgtaatgcagttgtgagctcgggatttgtccgcagcccaacatgactgtactcctactctataataaagagacctctgttgctgtgatattctgtcttcctgtgataccaatactgtttcctaggactggtatcgattaacaggttaattggaacgtcacgggctagttccgctcgggactagttcggggcgtgacatgatttgagcaatggttgtatcaatggtagccttggtcacatcactgacctcgcggcagtcggatcttgtcaccggccttggtctagtcgccgcatccgcccacgcccccgcctccgtgtccaactccgtcggtccaagcaagctccagaatggctctttgaggtcagaggtcaccacctccttcgccgatccatcgctttacccccttccccttcagatccatcgctgccacctctcagtgccgccagatctggcctatttgaggtcagaagctgcggtggggactacaaagtcgttagcaattttgatgaaggtctgatgatccattcggcagtgacatcgttaacaattttgtgaagtccaacgataggggaattgatccattctgtttgtgaatgtgattctgttttgtgcgattgtgaatgtgaatgtcattttgctctttggctagatgaatgtgattgtgatgttttttgtgattctgttttgtgcctaaatgattgtgaatgtgaatgatgagtatttttgtgatttatgaatgtctaatgaaggtctgcgactagctaggctcacatcattatatttcttttgccccatttttcaggtctgtgacgggtttcaattaggacccgttacagataaagatcgccactaacgagtcaaaatatttacccgtcacagatgaatgttacctgtgacggatttaagttgcagaccgtcaaaggtaactcttacctttgacgggtctttactcgtcagagttgactccgagtcgtcagtgaccactaatctctgaccagggccatatccgtcaaaggtgagggtttgcgcccatcacagataatgtgatccagtgtaatggccagccctccctgcacgagccattgctcatggagtcgtcgatgcctctgcatttgatgtggaggcacaccgtcggcttgatcacccgtggacctaccggcccgtgaatacattctacttatattaatttaagatgtgcaaccatactagtataattagtgcggcactttgattgacagaggtaatctgcattagtaatagttttggcactgttttctacgtagtaactaatcgaggaacaccggtagaggaactgcagggaccgacgatagagcatagcatccctcattgttagcactgaaaatggactaggtccggccaatcttcattgacggctagccgctctcttccgtcgtcattgttttgtgcttaatttctcccctaaatctaaggttgccggatctgacctcgatggccatggtgacagtaggcttgggtgggtcgggtatatcgcttattaacggcaacctatggccaaaaggatagaggtgtccttcattttctattttctttccatgaaccactatttgccttaaataaagtactatagatatcaatttatttcaggcgctcatactcttggtccccgcccgcgtcgctcaagggttgggcgacacgggcgtcgcctccctccccagccgacccatcatctcctcccacctctacctcattgccgcccaagcaagccaccagaaaaccgtgcctttcttctcctccctgaaagtcttgagactagagcccgtggcccgatccacgatggggcagccgccgcgacatagggtggaaagccggtggcgtagttttagagagggcaccggtgaccagcggcacgcgcgtaggagcctgagggtggcctccatgcaggcggagaggaggtgtgactagatctggcgtctcctgccagatctggtcggagaactggcgacaatgaccacgatcgacgacatgtgaggccacgggcggtggcacatgagtaatgcacgtccatggccgacggagcacgtccaacgcggcgtgaggccgtggccggcagtgtgaggaggaagtcaacaatggtctacgtgagaaggaggttggtggtggcctcatgaggaggaggccggcgagggtcgagcatggacgccctagcttgcgtgagaaggaccaaagtggcagcgtgggtcgcctgcggtggtggttggcctctagtagtgacctcgacagcttatgacagcaaacatggaagtagttaggcagtagagaggtcttcttctctgttgccggctaagcatcctcttctccatagcgctcctcccctttagtcgtggggagctccggtaaaaggggaggcactggcttttgcaacaagcggtggcggtggcactagttgatccgagcaaccctgcgagccagcttgagctgcggggtggtgacctcggcttgcgcgctaaaggaatgtcgtggtggtccggtgacggtcattgtgcaggatatttgtgtgggcttttgaacaggaattgctagtgaaaaccttgataagccttggcccgacttgacgacgacaccgacgccattaggagccgttctcctccttgtaggtgtcgttatggcactgacccctttttccccaacaccaactgcgtgcaacagtggccattggtggactcctgcaatggtgcagaagctctataggcttagggtgtttcttgctttgcggtgagtgaccatcatttttctttggttgttgttgggtagagttggagctgctttgttgttggggtgtaatgaagcttggcaacgatttttggctagctgtgtgcaggaagtggctccttggtagcttgggccaatgtcctttgtgggttgtcaaacttgtttgtttgttttggcgttagggcatcttcgcagcgaagtcggaactattatgtcgcttgtggaaagcttggtaacgataacacatgtgagcggctgtgtcactactatggcaagcttggtgctaatgtctcacgatgggctccgtcgtggtagcttaggttagattagttggtgtgttgttgtagttgtgtttttcgcttagtttccctaattaactgagaaatgtaagatatggtccctttttaaaaaaaaattgggcaccatcttttttatataactagcaaatatgagcatgcgttgcaccgggtgaatatcaaacaaatatggatggttaagattgcttgtgtacttataacacatgtgcacaaaaatattgaatttggaagcgtacagatcagaaaaatatgcaattaattaaaatacaaatccattgaaatatctggtatttttaagtaggtatgtgtataattaaataaatttaaaagtaaagcaaatgtgagaaataaaataacatggttaaatttaatgttattaaattctccatgattagttacgctctttagaattttattggaattttcagagcttaattgctaattttaataatacaaacatcatttaacaattatttaattggaaaaagaaacaaaatgcttcattttaggtttgattcgaaataaacacattcaacttcttctctttttcttctgcctgatggacctaaaataggctattggtgcatctttctcacccggcccgagatgggtgttgaaggctagacttcttttcggcccttgccggtcggcccacggccttttgcacatgtgcgggcgcacttcccctccccaggccgcaacctgggcttgggccggaaaagtggccttgctctcgatccctcttgggccgatttcggctcgaccgacgccggccgtccgatctctagggtttcgatcaaacagccgggcgtcgagatcggggaaacaaaaccccctccttctcctcagccgccaaaaaccctagcccatttccttctctcccttctctctcttcgccgccctcccctccgcgcccccgatgctcctgtgcccaagtggaggcggcggcgcctctccccccgagcccaagcggcggcggtggcaccctccccccgagtgacggcagcggcggcgccctcccccaagcagcggcggcgggggcggcgcctctctcgccgagcccaagcggcggcggtggtgccctcccccacaagcggtgacggcggctcccccaccactggcggcgcggccacgtcctcccccaccaccggtagcgcggcggcgtcctcccccaccaccggcggcggccggggcagcggcgcctgtgaaggcgtcggcggcccgccggcgtcctagcggcggcggcacccctcccctccgccggatccagcggaaggggagctgcggcgcctggtgtccctgtgatggcggcggttgctcgacggcaacctcccctttgatctttttttttggatatatttgtgtgtatagtgcttcctccgattttattttatttgtgtgattgattgaattctgattgggtattttttttaggtgggggtgatggaattcttactgggatttggggggaggcaagggtgacgaaaaaatcaccgcacctatcaggcaacgaatggaaaaatacgaatatttatattagttatagaaatgtcggcaacaacctaaccatcgaaaagaaataaagtactataaacctccctaggcttgtaaagacctaaaaactactaggccacttaggctgagttcggcacttcatgttcacaaacccacctctttcgtttttcgtgcgtacacttttcaaattactaaacggtgcgttttttaaaaaaaaattatatacgaaagttgctttaaaaagtcatattgattcatttttgaaataaattagctaatattaaattaattacgtgctaatagaccattccattttagtgcaggagggtttagttccaatcctgcactacctaacacagccttaattggtttcttccatcctttgtgagagcaagtttaatagtatagcccactgctatctccaaatcatctataaacaacgtaatagtcaattcatacaatagttgcttgctatattattaatatctggtcccacctgtctatacacattacgtcttgaagttcgtgctgcagcgggctacagatcatacacattacatcttggagtccgtactgcaactggctacagatctatagcccgctgcttttctctctttttaaaatggtaaaattggttatataatatcgaaagtatatttatagttggtttgtacatgctttgagcagctcgaactcgatatggatcattgagaccagtcgtcatgttgggacattgtaaatgccctcgcactatactggagaatctagaacggacgggagggcctttctcgcactgacgcacgaaccgacaaaggtgtgggtttattctgggtatcacgtgttaccaccacgtcaagatgactggacggatgagatggccccgccaccaccgcctgcggcccaagtcgaccgtccgttccttccgcgttttctcaagtttccccccctcctttccacatttatctcacccagaccagacgtgccgtgcttctcgtctcgcattcaatgcccctaaccccactccgctgcctattgtcaacgcccacgcatcacttatacacgcgcaccatccatctctttcccattgtccccgtccgtatactagaggaacttgttcttttccttcttcgcgaagcagggatgaagctggtgtggtgcccggagatggcgtccaaggcgtacatcgacggcgtcagggcgctggccggccacgacctggccggcgccgcggcggacgtggcggagctcgtgtcggccatggccggcggctggaacgcgcggctcatcgtcgaggcgccggactccgcggctccggcggcagccgccacgagcctcgcgctggccgcagccgcgcggcgcacgggcgggcgctacgccctcgtgctgccggaccgggatgctgcggcggcctcggcggcggaaacggccgaagtcgttgtcggggaggcggacgaggcgatggcggggctacacggcgtggacctcctggtggtcgacgcgcgaagaaggaacgcggcggcggtgctcagggcagccaggcccggggccagaggtatggtggtggtgcgccacggcgacgggaggcagcgcggcgccaaggacctggcggcgtccatggcggcggggacgcgggtcgtgcgctccgtctacctgccgatcggcaagggcgtcgaggtcctgcacgtcggcgtcggcaaggggcccagcctgcagaaccaccgtgaccgccggagcaccagccggtggatccgccacgtcgaccacgacaccggcgaggagcacgtcttccggcggcagtgatcagtcgtcgtctgttattccgtccaggtgaattaaatcggatgtaccacggggagggtagttaattaggtgtagcgtgtgttgtccagattcgttgaatctgcccgttaataccatgatgatgtataatcatcggatgggtggaaagtgtgacgaatcacgaacaatgtaaatacctcaaacttgtagctcatcatatctcttccttctacctactgtgaaagctttcttttgagttgatctgctagttcattctttaattccctttttctttttttttgtgctgtgcagagtgcctttgataattaactcagaaaaaaatatgttcaatagatattcattatctataggaaaaatatgtagtgaaaactgaaaaccacatatatagcgaaaacatgtaaacaaccgttggatataaaaatagaccattgctcttgttacctagagtaacatttttttagttaattgctcttaaagccacgtattattaccaaagtttcactttgttctaggctattgatgtttttacttttgatcgggatttcttaccttctattacacattggatcattattgtattccttgcctttaatatactttcctgccactcactccttgatttccttagctcaccagcaactaaacgcatacatcaatactctatcctgatcatctagtaccttgattttctttttggctcttttttcccaccaaaatcatgtgagccgagaaaaatcagttgattgtgagctcacaacaaaagttgctgcagcgagcagccctgtggcttgattttgtgatttgagatcaggaacggatccgagtgaaggaatcgtagtcatgtgattatttgggttaatccatgccaacatctcaatggaaaaaatacaagcaccttgattttctttttagctcatttgttataaaatcggcttgaaatcatcatcagaaaccaaacacggaaaaaacgatataagagatccaaacacgatgacgataccgaggcataatatttattaacgaagttcagccgaaacctacatctctaggacactgattatgggtgctcatccccgatccaacatattacaatgtatcaaagttacaatgaccctcggccggatgccgccggcagtcactacctctcacctatgctaagtcgtcatatgtgattacaatatgtacatccctctatttaagagagggcctaggatagagtccgactcttactctattcttataccatataactccaagtcttaaattgtagctaactacgtatacatattcgacacacaaactctatcaaactccaccttggtgaatatgccacgccaatctgaattcattatttacacgaacttctgtgcattcagaattgagtttattccttttttttcccataaacaagagactccgtaatccctgtaacatcttcctcttgactctacctgcaacagtactccaccttctctcttatgataataattgtcttaccaagcgaaattggatccttcctagctgtcaatccatagattctctaaagaccatgttcatctaaattttatgtcttaaatttgccttgatctaaccaaataaccgatgtaatcaccacatagataaaattcaactcaccatatatgaagagaacactttcttccttatcgtcatatggactgagctaacaaatccaacattcacacttctcgtatcccactactacaaaaatgattttcttggacgaacccatcgttagattccaaacggtcaataactgaccgcgtatggaaaaatcgtcctcccattcttgcttgcggatccttaagaggtccgcacgcaaaaataagactatttttacgtgcgaacccttaataggcccgcatgtgaaaatcctctccctagattttgaaaaaaaaacttctctaaaatgatccaattgttttaaaaattgcctccacaacctactaatcagttggacaaaaaggattgttccatgccatgtaagcaatacaaaaatatattcataaacattgaatcattccatacattcatcgcatcattcattcctcgtgatatcatagcatacattcatgccattttttaaaaaaattattgctatacatgccatcaagcaacctgcttatctttaaattagtaaccttcgtgcttgctgtccagaatttttaaacttttgtaaatgtgggttcaactaagattgatcattggccatttgatcattggccatatatagatcccaaatatatataccataatgtatcttgttagaaccaacttctctagttccactttttggtcatctaccaaagccttcgtaaaccacaactgactaaaacctgccacccatctactaaatagaagtcaagtctataatacaacttaagaaagttactaccactcgtcaatcctcaagatatagtcatgacttaagctaacctcacccacaggagattaggtagaaccttttgttagagatataatgtggtatgtttgaaagaggcttaggaaaaataattaaatcagatactattgtgttatcagaaagcatcatgcaagtaaaacttttagtaggtctttcgatcatcagtcaaggttaggattataatccattcataactttaacaaaaattaaacggagttcgacagtaagaaccacactaagaagagtaggattcttaggaagccaacacattgatcaacgtaaccactacaaccctacccaaatctcggggacgagatttatttaaggaggataggttgtaacatacccgaatttcaggatgaagaaattttcgtcaaaattagttgaaaggaaagttcttcaattttgtgaaccaaaaatttccattttaaaacctaggggaagttgacctaactcatgtaactaaataaaatttgagagcaaattaaaactttttcggaccattcgacgcgtacgtcgtgcacgcgcgccgcctgcccggcccggcccggcccggcgagcgagcgcgcgcgtgtgtttcccctcttctctccaccacacatgcttcaagcgactaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctagtactagaccgtctgtagactacccctcgggtggagcgtataagtcatactcctaggtctttagtaagcttcctagaagattcacccaaaatcttcatagactgcgaccaacagtcaagctcacaaaggtgagttctttcaagaatgctctgcaggacaacatctttgctaattaaagccaacagaactcattaaggcatagccaacctgccttgcagctcatgagagtatatgcatctttacttggagagggtatatatattggtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccaggtttctcgctgtttggatgtaatccaacgttataagtccggagtttcttaatttcctgacagacttcaatcgtcttttcacatgtctagaagatttcatattatccttagaactattcactttgacaattatcgtttgattgtcacagttcataaggatagccggcaccggtttttcaacaacaggcagatccattaatagatcacgcagccattctgcctcaacagtagcagtatccagtgccgttagctctgcttccatggttgacctcgtcaaaattgtctgtttgcaagacctccatgaaacagcaccaccacccagtgtgaaaacatatccactagtggctttgatctcatccacatcagagatccagttagaatcactataaccctccagtaccgcaggatacccagtatagtgaagccccaattccacagtacctttcagatagcgcattactcgctcaagcgcacgccagtgatcatctcccggattagaggtaaatcggctcaacttgctcacagcaaaggatatatcaggcctagttgcactagccaggtacatcaacgagccaatgatttgggagtattccagttgattcctagcaattctcttgttcttgcgaagcaacaatctaggatcataaggtgttggagaaggcttactatcaatgtagccaaagcgattcaagatcttctccatataatgggactgcaagagtgtaatcccattctcacctctaattagcttaatgtttaagataacatcagctactcccaaatctttcatatcaaaattttgagacaagaatgatttaacctcatttatcacctcaaggtttgtcccaaatatcagtatgtcgtcaacatacaagcacaaaataactccctcacccccaccatggcgatagtacacacatttatctgcctcattgactccaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgcaccccacaggtttacacccatagggtcgctctgtcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatattcagtttgttctggtggtgtgattgaactgggaattatttcagagggttggttcgaaccactatgtgtatccttcattgggaaaaagctctcaaagaaggtagcatcacgagactccataattgtaccaacatgcatgtccggtacctcggatttaactattaaaaatctataggcaatgctatgatgagcatatcccagaaaaacacaggccacagtcttaggtccaagtttgcgctctttcgttattggtacattgactttcaccaagcaccccccatgtgcgcaaataagaaagtgatggttttctaccaatccatatctcatatggtgttttgtccttatttctgttaggaactctgtttaacacatgatttgaggtcaacaatgcctccccccaccatgctttaggcagtcccgcagtgtccaacatggcattcaccaagtcagtcagtgtgcggttcttcctttcagcaatcccattagactcgggagaatagggcggcgtcctctcatgtatgatgccatgttcctcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaagtatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaataagattcctgtcgatagaagggacatgctgcacgttcttcagctgtacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgctctgcaggtgccttcatccccttgcgctgtggacacttcctagctagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggtagttttgcaataatgcacccggccacaaatttgtcgggtaagacacacttaaggagttcgagttccttagccatggtttgtatctcatgagcctgttcgactacagaatggttgtcagccattttgtagtcatgaaactgctccatgatatacagatcattgctagcatcagtagcaccgaatttagtattcagtgcatcccacaactccttagcgtcgatcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataagttttttggattgttgagattatagatatataatgatttaatctattccataaataaatcatgacattacagatgaaaactagcatgaacgcatcattagatctacacatgtaaactacacagtataacatgaacagatcaaatatgcgcaacatattgaacacgtaccgaggtgacggaaagaccggctgcttggtcgaaacttttcgcaagtgtctacgaaggcacgaaacacgcgagcgaagaggaaggcgagccgtcgcgaacgaacagggagcagtcgcgcgaagcgcttcccaaaaaccttattgccgccttctcccggtgcagaacgtcgaaggcagaggttccggagacctgctctcccgatcgccggtgcacgccggcgagcgggatagagtagtctacgagcgacggcgcagtacagagtaggaagcaaacccaagattgatttttttgtatgtcgcttgatcagggcgcccgcacgatctctactgcgcgtaaccgaaccggataagtcgcgcgtaacttatccggactccacgccgtttgcacgcaccggatctttcggaacgtttccaaaacaaaaacgaatccgaatttgcaacaaaacaaaactgcaaaaggaggctgcatctgcgcaagggtgtggagccaatttttcggaccattcgacgcgtacgtcgtgcacgcgcgccgccggcctggcccggcgaggcgagcgagcgcgcgtgtgttttccctcttctctccaccacacatgcttcaagcgactaggagggcatcctcccttttaaggaggtccccctctcctagaataagcaaggtggtactaaactccacatgcatgccatcccatgaggtgggcttttgtgattttccaaagaattaatcttcgagtggctaaggcccattcattaattccaacattttatagccccattacaggttcttactactagggtttagattatacaggggaatttacatgattacccttatgaaagggacatttacaagggtacatgatgatataggggctcatgggcccttgatgggccatctggcgatcgccggccctattgcccctaggcttgatgggccggaaaggcttcttcggccctcgcgggggcgaacttgccaaggcgaagtcgtcttccttcggcagatagtcttcgccttgcacccttcgcctgagacgcctctggcctggcaaggcactcgcacgactcttcgcctcacgccattcttgctccatagtcttcgccatgggtttcggcagatttggtcgaagggcctcatgccatccgccaacaagcccctcacgggcaagggtgagattggagcttcggccgagaccgtgcaaaccatgtggtatggtatgcggcgccccctttcgaccgatgctcctgccgaaacctacattattcttgcgaatgaagtttgttatttgtgcggctggtattattttgccgtgcttcttctcctgcgtttggttgcatattcatatatatattatacacatttttttatatattttcttttctcgggccgaaaggaacagtattgggctttcccttcgtgggctttttactgtgccgctcggacggtgggaagttaccgttttgcctacccttgcgacacgtggcgctttattactggtgggtaggcgaacggtcgcccgggtgagctatatattcctaccgaccttttcttttcaccaccacacttgccattttaccgcgtgcgctctcttcctccgtttctttcttccacagcatctctcgacccctcaagcgtttcgcccattctctttcttcgccaccgcaaatgcaccgttcgccatggaccctcgcaagccaaaccctgcttcggcgaaagggccggatcccggccgagtcgatgacgacaacatcgcctttctgggggtctctcttgtggacgacgtcgagctggcgaagctggtccgctctggggtgttggtcgaggggcaggctttcgccccagggaaatccgtggtgccgaaacctatcgacaatcggacggtggtattcaccgtcttttttgaggcagggctatggttcacctgcaacatgttgttgccggagatccttcgcctcttccaggtggaacttccacagctgagcccgtcggcgcttgttcgggtcgctatctttgactgggcgtgccggacttccgggtttgagcctaacgccgagctcttcagcgccatatttttcgccaccgtgaacttgaagacggtgattatcccggctggaacgaagaagacagtgttcgggagcgtgaactttaatgttcgtcccgagcggtccgatctctggccggtgaacgctgccatgtcgaagtgggaccgccattggatggctaggtggttctatcacaccatccccttcgaggctggcactgacttggcgaaagccctccgttgccggcgtggacggcgctatggaggcgcggttcgttctgctgcgaaaggtttgctcccgccttagctgccatgacttggtggaggaattctgtatgcttcgcatctttcccctctcccagtcatggcaagtcacagttgatcaaggcgaagaggttgacggtttgccgaacctggttcttcctgagggtacggacagtaagattgttctcttgctatacactgctgtgctttattatcttgccttgtctgactgttaacatagctacacactttacttttgcagcgttgaccctcgaccaggctgaaaatgaggcccgcaggatgatcggcgacgtgccggtcgtcgagtatagccagttgctaacacgacaagcggctgggcgggcgaaccgggtttacaacggcgaattgcctcctcgggcaaacccccacaaagctgacgacgatgcaggggcttcgcgaaagcgaatgcgcggacaagtgaagcttgcccctaggaagcgaagggttcctgcttcgccggactccgacgccgacgacgaggatgatgccgaagaacgcgacggcgaggaggaaggagaggagaaagaggaggccatggccgataaggccgcgaacgaggcgatcgaagaccgcgtcgacacccccgactacactcctaccccaagtcccggtcacaacgagaccggggtggagtcgaacagctccccccttcgacggaaggatttggaaggggcgaaggccctagttgcattctcctcgggcaaggcggcgaagggaggtccggtgcagaagatctctaaaaagaaaggactcgtcgacatcgcccacgttttcagcgacgacgaatcttctaacgggactccaacttcgcctgctggccgcagtttagacctttcgactgctcccctcactccactcggcgttgctggggcaggcggtaacgtcgccgccggggcttcagcctccgccgaacgaattgtgtcggctgcggcgagggttttcgggagccctctgcgtgagccagctatttcgccgctagtcaaggcgaaggggaagtgtgcggccgccgaagcatctgcctctgagtattcccttgcggcgccccacttcgcccctggtgatttcgagactcgggcggaccttattccctttgtggagggagtgagcaaccttgtcttgcccgccggcaccccgagcttgttcaccgaacttaatgagttcgacgaggggtgttccgccattaaaagcctggcagttcgggtatgccttttcttccttcttcgttttcctcttcgtccccccctttttttttacgtctgacaattaaccttttgttcttttggcccgctcctatctttcatctagattcttgcggcactgttcgacggagcgaaccgtacgggcccgttttgacggttttaagagccatcttcgggccaaggacgacgaaataagccgcaagaacttggaggtggaggccctggccaacaccctcaaggaggcgaaaactgaagtcaaacgccttcagtctgagctagataaggggaaagaggccagggccgaggttgatcgcctcaaggccgaactggagaaggagaaggcccattcggcggtgctgattgactactacaaccttactgagccgaagatggaggctcttcgcctgaaggctagtagggccgaagcgagcgccgcggaggagtcgcagcggttttcacaggagatggcgaagaccaccgaatccgcgagaacggcttgccaaacgctccgcctcacccttaccgacatgggcgcgaaagtgcggggggtccctgccgaggatgcatcagccttcgacttctccgagtggacccagcaggctgacggatcggtttcggactgcgccaccgcgtacggcgattgctgcgcgcgtgtatcggcggccttcaccttaggccttttgcaacagttcggctgcgagcacgtcgccgagttccctacctatgcgaagggggactaggagattagtgcgcagaacatctcgcctgctcttcgcgcgtggcgaaaacagttttggcagaaagatggctggtccgctgccaaagtgcgccttctggagcaactagcgaaggcggaggcggcagatcggggcgaaggagagggcgcggcaggcgaagaggttggaggcgatgcccaggatcacccagaggtgtgaggccctccgccctttccttagatttttgtagttttcctccctcttttgtgtttgcctggagaggcgaatgatgtacattcgtcaggctgtcgccaaaccttaaaaaaggctttttttgtacatttggaatatatgacacaatcttaattactttttgatgatcgaagtctttagcatatttgttatttcgctcatctcgtattatgccatacctcccccttcttacgtctattcttactatgtaagctgtgttttgctttttctgcactgtccatcagggggttcaccgaaagtcgtgcatccggcccccttccgggagctggcgaagtcaaaatgagaaatttgtggcagtgaagggtctgccgaaggtgcgatgtccatttcggcctgtttatcgtgaaatggagataaacggtcgcaactataaggttttcaaggttgccgactggctgcgggtgcaccccgggcgaaccttagaagattacgatcttgttcattctagacgtttgcaggatatggctcgcttttggcgaaaccatcagaagactgaatgtcaggaaacgatctttcagcgtcgttatagtttagtatgtgcttcaccccctactcctcttaaggttgtgtacgatattagtagtgatgacgaacctagttcgcctgatcattccttagggagggatagtgattatggggacgaacatgtaatttacttgtaaggtgaattgtatcgtgttgtgaaacttctattcttcgattatttttttcaaagttaataaagacgtgttttatttccttttcgctattgtttgcatcgtcacattttgtgcttttgttaggtcagaacatgccggcccctttgcatatatgagcgaaataggtgtactgacttttcagcttttcgtcgttcgttttcgatctgtagcgttctgtgccgaaagaaacgcttttgcttttatgctgatcggacgtaacgtcgttcggccatttaatttccgagacaagctgttgcggtttcaacgttcggcgagcgatgcttcggccgattcgtttcgcccccctggcctttttcgctgatcgagcatttgccttgggatttttccacaaattatcaatcacacgaaaaaaataaaaagaaggcggaggacacagagattttatactggttcgggcctccatggtggataatagccctacatccagttttttcttcttttttctctctttcttcttttttttttcttgccgaaaggctttcatagtgctgaagggcttacatagtgccgaagggcttacatgacagtatgtacatttttacaagttggtgatttgggtgccaccctttctagacatagaagcgcttgagagaggcggcattccaggaatggtcgaactcctcgccttcgagtgtcgctaggcgaaaagatcccgtcctggacttgtgtttgatgaggtattgtccttcccactttgattcaagcttgccaaccgctactggttcaccttcttccttaggacgagatgaccaggcatcagctccgtgggtcgaacttttttgttgtaagttgccgaagtgcttgtggcgtacttgtgtatgtgctcgagcgcttcgactcttactccttccaagagttcgagcgatacttcgcgtccctcttcacccccagagaacatcacccttggtgagttagcccctagctttgctggggtcattgcctcatcgccataaagaagcataaacgggctaaacttggttggtcttgtgggggtcgtccgaagggcccagagaaccgatagcaattcctctggccatttgcctttcgctgccccctcgagtcttttctttagtgcttctaggatcttgccatttgtacgttcagccgccccatttgactgcgggtgtgcgaccaacgcgaacctgatttccaggttaagcccttcgcacatttctctgaacttatcagagtcaaactgcttgccgttgtcagtaatgaactcttttggcacttcgaaacggcaaacaatgtttttccatacaaacttctgtactgctgccgaagttattgccccaaggggttcggcttcaatccatcgagagaaatattccacagctacaattgcgaatttatacccgtttcgcgccaccaggaacggcccaatgatgtccagtccccatctggcgaagggccatattggcgcaatgggctgcagatcatactggggcgcggcttggcttcggccatgacgctggcaacttttgcacttattgatttgctcaacacagactttcaacacaatgggccaataaactccttgtctaaatactttggaggccactgttcttgtagcctggtgcgcgccacatagcccctggtgtatctcctttgccatttcttcgccttcggcaaaagagatgcaacgaagtaagggttgaagtaccccggagcggtaaagctaacccgagaccatcttatacttcatggctctgagttgcaaacgcttcgcttctgcttcgtctaccggaagccagccagtttcaaggtgttttacaaatggggttcgccagtcatatgggtcttcgcccagtttctcctggttgattgccatgacttccgagctgtccgtgggcacacttggagcatgtaagacttcgaaaaagatgccaggcgaatgtgggccaccacaagcagcggatttcgccaaggcgtctacttccttgttctggtctctaggcaagtgttcgaccgttatgccggtgaagcatttttccatggaccgaacagcctccagatacctcttcattccctcttcttttgcctcgaaggatttgtcaacatggcctgctaccaacttggagtcagttcgaattagtaggcgccggactcccagtgctttcgcctttcttaggcccaggagaacggcttcttattctgctgcattgttggttgtgtcgatctgcagtcttgctgcgtaccgaatcggcacaccatttggcgaaaataggactgccgcaatgcctgctcccttgtgcgaccacgagccgtcagagcacatcacccagaattgttcggcgggctcggggtcgggggcaagtactggtgtccattcagctacgaagtcggctagcacttgagacttgatagcagagcatgcaacaaaatgtaagtcgaacggggatagctctgccgcccacttgctgagccagccagtgacttccttgcctcggagtatttcgcccaaggggtactgtgatggcactatgactttgtgggcctggaagtagtgcttaagcttgcgtgaagccatcactagggcgtaagcgagcttttccatttcaatgtaccttgtcttcgctccttgcagtgcttcggagacgaagtagaccggtttttgtccgaactctgtttcttggacgagggcagcactgactgccaccggcgaagctgctaagtataatagcagtttgcttcctggggttggccttatcagagctggtgggctttgcaagtattgctttagctcgtcgaatgctacttggcactctggtgtccaattaaactttcctgcgccccggagggtcttgaagaagggcaaacctctttcggctgcctttgagaggaatcgactgagtgccgcattcggccagcaagcttttgtacttcatgtacgcttgatggaggcttcatttgctggatagcatcgattttctcgggattcgcctcgatgcctctttcggaaacaaggaaacccaacaacttgcctgcgcggacgccgaaaacgcacttctccagattcagccttatgcctgctgtgcgcaagctgtcgaatgtctcctgcaggtcgatcgcatggtcgaaagccttgcggctttttacgacaatgtcgtcgacgtaagcttccacattccgccccaactgcttgccaaggaccttgtacaccagcctagcgaaagttgctcctgcgttccttaagccgaaaggcatcctgaggtgacaaaatgtgccgaatggagtgatgaaggatgttttggggacgtcgagcaggttcatgtgaatctagtggtaaccggaatatgcatctaggaaactcatgagcttgcatccagctgttgaatccacgagctggtcgattcgtggcaaggggaagtcgtctttcggacatgctttgttcaggtctatgaaatcgacacacatgcgccatttgccgtttgacttccgcaccagcactggattcaccaaccactccggatggtcaatctcttggataacccccaccctgagcaatttttgtacttcagctttcgccgcttcttggcgatcggcagacatcttacgcaacttctgttttcttggcttaatgtccggcttgaatgctaggtgatgcataatgagatccgccgggacaccccccacctcgtcagggcaccaggcaaagatatcgatgttttttttaagcacctgtaggatactctcaacttcttcttcgcccatgtcgccccccagtgatacgagctttgtggggtcggcatcatcaatctgcacttttgttatcttgccgtgaggggtgggctttggcgtgtgcttcggccgttcatgcggttcggtctcaacactgttcactgctctgttgattatggctagatcaccttttgaagcggccgaaggctgaagccccttgactactatcacccctgtcgggccgggcatcttgagcttgagataattgtggtgggaaatggcttcaaacttgttcagggttgcacggccgaagatggcgttgtagttgtacgggatgtcgacgacgtcgaatagtatttgctcttcgcgtctgttctccccctagccaaaggctatcagcaaaagtgcttggccaagaacttgaactgcttctccgccgaatccgcggagcgatgctggtgctggggtaagggcttgggtaggcaaccccatcttggcatatgcttcggcgaagataacatcggccgaactccctccgtcgaccaagattcgtcggacttcgaaaccagctatctcagctgagattaccaggggatcttgatgcgggaacataactccttctgcgtcttccggcctaaaagaaattagctggttcagatactgcggcgctccttcacccgccgaagtgatgctgtggaccatacggatctgcatcttcttctgccgtttggacaactggcttggcgggtcagcccttgtaatcacttggattacccttcgctgtacatcttggcgttgttcggctgggggtgtttgctcctgaactgcttcgcggggtgcttcaacagttgttccctgctgcggccttgggtcttgcgcgttgccacgttgcctaatgtttcggcattgctccgtggtgtgcgaagagcgtccgtgaaaggcgcagtagaggtcttttcggaccttcttgcgggctggctgctgatggttgctcgcttgctgggcatcgaactccttgcggagggcttgcacttcttcgaccgccatcacagctttgcccgcacggcctgttctaaactttctccaagttatgggggcttggccttgccttggcggctgtccttggatcgccggctgagactggcgaacgaagaggggaggtggttcggcaacttgaacttgtgcttgagcttgaacagcggcgacggaggctttgtcgtactcagcttgtatagcttgccgtcgcttggaatcctcctcgccccttgcgaacccgtcaatgatgcgaagtaggtgctcgagcgtctgaggctccatgttggcgatttttcttgtgagttcgccctcgagcagaccggccgaagcggcgtttataactgacgcctcggttatgtcttgaacttggcaccgggcttgcgagaagcgacgcatgtactcccttatcgactccccttgcctttggcgaatgccgagtaggtgttgctgcgtcttcggctcctcgtaggtgcctcgaaagttaaggaaaaaaacatcgcgcaattgctcccatgagtaaatgctattggctggtaaattgaaataccaagaacggccgatgccgtctagagcgagatgtattaccttcgctttggtagtttcgtcaccatgagccgcttcgatcgctgactcgtagatggagaggaactccttcgggtcagtttcgcctgaatagcgcgggacgggtgggaacttgaactggggtggaattggacgagtcttgattcccccacttagcggtagccccttttcgcctcccgccctgtttaccgcaccctgctgcgggtacggtgtggcgaagggcgaaatcgcagcttgtgcgcaaggttgggccatagcattcggctgcccggctccaactggaggtacttgctgagccgccatggatgggtcaaaaattggctgtgaccacgtcatggtagcttggattggtgcttggtttgttccgaagcctggagttggagcttgctgctgaacggttggcgcctgagcagcgttgacgaagtcgaactgcggtccttgattccacagcgaaactcccaggcccggctgaatcggtggcaaccaattaggcgcaccttgacttgtattcccctccgggtgggccgatggggttgtacttgaaatgcagtggggttggttgagttgctgaaggaaagcttggagttgcgcctgcagagccgaagccccttccaccattgtttgtggcgcttggccgggtggttgatggtgtacttgggcagcgactgcggccgattgctacccggcgaagtacattggcgcttgtgcgacttgaggtggaaagggctgggtcgtcacttgcggatggacttgaggcgggacataacctgccgaatactgaaggattggagccgacgtgaccttggtccgccttgccgcctcgtatgcttgttgttgttcttgcatttggcgaagcatgtcttggagccgtgccatgttttgtcgcatggcttctatgtcggcttcggcttgtgtttcggggtcagggctgacttgggcctgcacagcggcgagcgcagtcggggccgctgccggctgcgatggagcggcttggggcaccaccagttggcttgtcgaaaggatctccgccctggtctggagtgcccttgccaccgcagccgccttcgccacgtcggccgcgttcggcacttgcacagaggtggcgggggccgaaggcggttgtgatggcgcagatgtggaagcgaatggtcctcctccatcttcggccacgggcaccgaaggctctgctccctcctcggcggccatgtccggtgcggcgttgctttccttccgccttgcaaccttctccttcatgaccttcttcggtggcattccctctcagtggtttcgctcggaggtccccacggtcggcgccagctgttgtcggaatgacaactgcatacgtcgaaagacgtggttactcaacagtggtaggaagaagacgaagtgtattaaattttgagtttcccttcttttttctccccccattacatggccctaggggactattttatagccccattacaggttcttactactagggtttaggttatataggggaatttacatgattacccttatgaaagggacatttacaggggtacatgatgatataggggctcatgggcccctgatgggctgtctggcgatcgccggccctattgcccctaggcttgatgggctggaaaggcttttttggccctcgcggaggcgaacttgccaaggcgaagtcatcttcctttggcagatagtcttcaccttgcaccctttgcctgagacgcctctggcctggcaaggcactcgcacgactcttcgcctcacgccgttcttgctccacagtcttcgccatgggtttcggcagatttggtcgaagggcctcatgccatccgccaacacattagaagagccctatttggtaaactacattaacattagagagggacatataccacatttgggtccatcatgtgtggactaagaattcttaactactattcttagtatatctcatttagggtcattttttaaagagtaaagtgcacgggtggtccttaaacttgtagaggtgtgtcatctagatccctaaactctcaaaatgcatattcaagtcccagaacttgtcatagtgtgtcatctaagtcccaaatcgccccagccccttcaagttcatacgtggcactgatgtggcatgccacacgaacatgatatgtcatcattttgactgacaaataggactcattaaattttttttctttttttcttatctttttcctctctttcttttttcctttcttctcctttctctgtgacccgagcaaaagaaagggaaaaaataagaatgagaagaaaacaaaaaagaaaagaagaaaaaaaggacacgtcgcgtccatgtggcatgccacattggcgccacgtaggatcctagaggggctgtgttgatttgggacctagatgatacactttgacaagttctgggatctggatcagcattttgagagtttggggacctagatgacacaaccctacaagtttaaggaccgcctgtgcactttactcttttttaaaggcatcatttcatagaccctcttacgcacagagagtgacagatatttaaacaaatttggcccttaggagaaatttgagattatgcctattatcgattaatatcctgacaacagtatcatgaatacctaaggtcgttcatgtcaaggattcctaaacccacatatccaaaaaaaaaaaaaagccgaatgtttttttattggtccaagccaccctacatcatttttttttctaataggaactctccaccatattttgctttgtatatatgtggatgtgtacatgatacaagatatatggaggggaagctctagtctaaatctaagaaactgtctcgtcgggatcctcaaattagaaactagtagctagttgtgtcatgatcggcgacttggtttcttggcaccagttgtcttgtttaggcttgtgttggcttttcgccacttgggttggcttgaactgatctcaataggtttgccttgggtctgcctacaccaaggttcctaggttcccccttgtcctagaaggacatataacttgatttggatattaccttgagcagtactggttggccctaagtaggataatgtctttctttcctagctggaggactctttccatatcagctcaagactatccttatcttggaattgtttccatagaggagttagtcgtggtatttctggaatggtacgtgcatatatggtatcctatatttagtacaccaacaatggcataaaaagagggtttcactagaatgcaatctcttaactgggatcgatctcaacaccgagttggttgggctcgaatcgatcgtgccacactaacccatcagctcctccacattgcatcgccgcgccagcctgggcacccatatgatattttgatggacatatttcaacggctgcagctgtgcgctgcagcttggaccaccagcaaagggcgcggttgacagctcaatgcaagcacgactgaacatgggtttagattgatcctgcttagttcagcatagccccaagggcattttggtccctttactacgtgagaaagggaaaaaaacactaataggaatttgagaatggcattctagtgcgcatcctctatttgagaatggcatttttgcaaagcttaattgaggtctggaattttggcgaaacctgttttcgatgattgaataatttgaaaattttcccttgagggtaatagccctatgtcatgctcagtttgtatatacttgaacatatataatacaatatttggatggggagctcttgtctagacctaatagactatcttgctggggtcaacaatcagggtgttttcgtaaagctctcatggtcattaacgaaataaaattatatattcaaccgaaggacttcaacttctatgcaacacttgtccaacatgaatatcaaagaagacaacttctcttctctaatctgctttcttcttcatctgcttgattgctcggcaagggcgcaaggcataactagagcctaaccagcttggtcccgtggtgagcagcatcattctcatggacggatgccgggagagtgtgaggttgagactgtgctaagctgctgctattgattattgattatcagtaagggagattgaaagtaacagaagcaataactaaccattctaacagttcaccattagtcaccatctaattgtatcctagcaggcgttcctggaagtggcctgacattggcaggtgccaccacatccacggtggtcatgtctagctctgtcttgccgagcggaggaagaatatattgggggattagagagaagagagaggttgcctactttgatattcgtattggtcacatgtagcacaggggggcaaagcccttcagatgaaggaaggacttcagtcatgtataattttctattgtcattaactcaagttcttgtgagttgtttggcttgattggcttgactcacatggccttgtggcctctctatatttctatcattgtgcttccccatatttgttttgtttcataaattaatttgttcacgtcacattatatacagttgtatagcattacattttcccatagtagtgctgtcaaagttacgcgatttccctgtatccaccaatagacttcacagataacaatctaaaacaggttgtcaatactagtaccaccaaaataagcacgaaataaatatattttgataagtggaaataaatccagcaaaatgccaggttgtactttgtttctactatagctcctagtgggaacgcgttcgtccaactctcctatatatcacaacaccatggacatcaaattcgcactaatcctcccccttcatcccgtgtcacaaagccacaaagaagtttagcaggtcctccatggcagcctctctgccactgtcagctgccatcgttggagccgaagagtcggttgacaaggaggtcttggagatggagtacctctttgagaagtttttgatgccaagtgacttgtgcagcaatactgaatggcttgggatcccagaagaacatgttaggaaatttggcatgatgttggaggacagggacggttactccgtcattttctttcaggacggtgtggtgcctgggaagttgtggtgctttaggtactggaaaagcaatggagtccatggcttgaccaagggctggaggtgctttgttagggagaagggcctcaaagccggagacaccatctccttcttccgaggatctgcatgtggccgtctcttcatctgctgcaggttaggcacccatgcaacctttgcgtcatcctccaccttgcatcatggcttttctatgcccccaccacctgcccgcccgctggtgggtcttcaatctggcatgttggcaagagatgtcccatcattaggacaagctaggttgcatgatggaaatcaagatggaggcggtgcaccatcaagacatgttccatcctcaggacgacgtgtggaggcacagctatcacgtgtgtcgtcgcgccgtcaacgccgtactatgaagcactcgataccagagcccacgatagagacgccaccaattcttgagtcgatgttcctcatagccgcaccaccggcagtgaagtgcttacggctttttggcgtcaacatctatgtgttgcctgtgtcctctagtggccagccaaaacaagaatccagcccataataccaggcaccataattatggacaccccattgaagaggatcagagcgtgttggaggcgacaaatgttcctcaattgtatcgtttggttctacatcattcttagatcattgtggtttcaattattgtaattcttagtttgttatgattggttttctattggcaattattgtctttttggcagttattttagcataagaaattattttgtaccatcttcatttattaatttcttttgtttcattcccatcatgtttggggtatttgaatactttaacttccctactatccattttcttaatatataaaaagtaatcctatcattaatcatagtaattaagcaatatcgggccaattactgtattccttttttggcataatattcaacaaaatgtatggttgcttttcatatttctacattattgcaaattggatcaattcatcattgctccttatgatttaatgttgtttgatatttgtgcacacagatacaaagtgtatgactacatggtggtggcttccccaaactagataacaatatataaatctatttgaactccaacttcttgtcccgtggtacccttgcctatcccaccaagcgatgccgcttaactctttctagtaatcacgcactttctaactactacaagaacagaaccatgggtcactaccacaaaacatctaaggtttccattttacaccacctataaacatacttataaacataaaaggaaatcaactgtttataattaggggtacaacctatcgtccaaataaagaatagtcaagcgttttggtcggttccctaagaactatttcatcaatggaaaaatgaagtgtgaggtgattcaatatcaggtgaactgctggtcaagaggagtggaatgacatgtgggatcacaaatatggaatgaggcaacaacgctggatggtatggtgtgttcgccatacaaaaacgatgtctaaactgtattatatgacaaaaaaaaaacttggtctttaagaattatcataccgttgggttcattccattcaatgtcaaatggaaaattactcaatagctcatatggtttaatgccaaaaaaaaattggcaggctgttggtatttcttacgatcacagataaatccgcaagcgcacgaaacaccgttgtagtacttccccttagagtattccaaccgtatcgaacacgaggaacatgtgtgtattatctactgccaagattcgattgaaggacaacaacccaagataaattagctagagaggattcctatgtcttttagttagttacttaagttacttaaaggtaagactctaacaaatattcgggaaccggccctcccctggtctactaggataagtccgggcttgagctctatgatgtacctgaacgtggatgaatacagaggataaacttggctgtcaccacctgccccctacctcactttccgtgggcacacaacaaacgaaggtaatttctaacctagacaccacacctaagttattaattactactctagccttgcacgggaacttccttctttatccagagttctaatactagagcactcaagtgcacactaagcgatgaacccgcaccgataaaaatgtatcacttaaataaactaattaaataacataaagaaactcgaatacttaattaaataatggaagcatccgacaaggtacaagcgatagagcaaaggcgacaatcccgtcatctatcaaattgccaaaatttcagttgtcacgtcatctatcagatgggccatactagtatcagaaatttcctcagaaaactatgacaccacattatccattgtttaccttttattaccacaggattgtccattagttactctctctgttcctttatgttaatcaccaagcaatattcatattcaaacttccaccattcgtcttctttacagaaaaaatctaaatacttaaatagaccaaattaatacgacttaactagccatatagcagccttgtacttaggctgagtttgaaggagtatttgggcggaattttgtcctcatttaccttgagcacactttcaaaaatactaaatggtgtttttcatataaaaattgtctatataaaagtttgtttaagaaattatattaatacattttccaagtttgcatgtcacagctagcatttccattggcacgtctagcatgagaaggagcttaatcggggggaggtgcgcagtaaattcgccacattcaacagaaataggcaaatagctacgccatcaagagaatccgaaattaaacttctatgatcgtctggcatttgtgttctccttatttacgccctgccttaaaataattttcatgcatatcacgtacgctatctacagttgtccggcattaaggttttccacggtagtagtccaaaatcacgcatttttcctggagtcctgaagaggattatttacagttgacaatcgtgcatatgccaatgtgaatgactagtgctgccaaaataagagagaaatgaacatgtcctgataaataagtagtagataataagccagcagtaatctcacgattactagctccagcaaaatgccaggcttgcactccatatttgcactgtagcctccagtgggaatgcatttcattcctaaaccccaattaaaaaaaaaaaaaaaaggtgcttggacctcccctatatatgtgcccgtaccatgggcctcaaacacttgacctgctccttcgatcgtccaatcctacgaaaccacagagagaatctcagagcggagtactccgatccatggcggcttctccgccactgcctacttccatcgatggtggtcaagtgctagatgacatggaggtcgtggagatgaagtacctgtttggcaaggtcctgatgccaagcgacgtgtcctgggacaccgaacagctcgtgatcccggacgagcacgtcgggaaactactggacatggtggtgatgaaccggccggaagggggcttcttcgtcgtcgtcgtcgaggatggcgaggtgactgggaagctgtggcttttcaggtactggaaacgcgacgacgtccactgcctcaccaagggctggggttgctacgccagggagaagggcctcagagccggagacaccgtctccttcttccacagcaccgcgtgcggtcgcttcttcatctgctgcaggtgcacctgcatgagtttcttgtcactacccacaacatcgcatcgcattcacggctcgtctgtactgccgcaaccgcgggctgcccaggaggcgcaccatccattctcaggacacgccacattgtgtctcggcaacaaagctagtgatcacagcgcgccggcaaggcatgccactgcctccttagggtgtgcggcggcgcagcctccgcaggtgccgccgacgccgacgccgcgtcgtcgacggcgcagtatgatggttcacccagaaccaccggagcacacaacggacggcatgcctgtgattctcgagtcgatggcactcgtatccaccccgcccgtggcgaaacgcgtgcgcctttttggagtctacatcgacgttcctccactgcgcccaggcggcgaggcaacacaagatttcaacccatgatgatggcgtgccatccgtggacaggaacgccctcaagaggaggcgagctgctgcggacaattaacgcctcctgatcgaattgtatcgtttagattgcaagttctgcgtcattctcgcggctttgattattgaattcttaatttgttaggactttggctcctgaacaattctttggtgaatattatgttttttggcaacatgtatggcagcagaaatgtttttcatcatcttttatattaaaattttgtttcattcttccatgcaggtcaatggtgttcaaatactttaactttcccaatttccatttccaaatcagtagcttctttttaaaaaaaaaaactaaaacactaatttcttggtcatataagtataatcctttcatgaaacccgataattattacaattagctgcccaattagtgcattccgttcgagatatgaacaaattcaaggttttcttttcacatttctacattattgcaattgaatcgattcatacagacataatgttgttcggtattcgttcatatacacacaaagacgatgttttcctgtatatatgtcatggtatttccattccggatacatggtgatgggtcccccacgtaacagtgaatctagctagtacaactccaagtgataaggcaccatttcattcgacttagctgatctactctcttgttttcagtttcttgtgagcacactcttcgaagtgctaaatgttgtatttgttttaaaaactttcttttgtagaagtttctttctaaaaaaataaaataaaatatttatttaaatttataatacttaattaatcatgtactaaggatatgctttgtttcacgtgtggctgattaggcagcctatataactctgccaaactcgacctaatctacttgtcttgcttgtcccgtgaagagaatctctctagctctttctaattcatatactcctcccgtcctaaaatataataacttttagccattaaaatttttcccaaaatataataatttctccactaacattctctttctaaccaatcacaaccctccaccattcacttttcctaactacctccactactcaaccaatcacaaccctctatcattcatttctacctactttcttgataaccgtgtccacctctaaaaatacttatattatggaacggaggaacgtagtagtatttatgcccttcctaatttgtggtgatgaaggccatgggcataggcggccctaccagatcaaccggccttgtgactcgtgccactggaagacaaccattaaagaggagcagatgggcaaccagccatccatcttgtaggtgcagccaatgtgaacgtgtcccgatagcccagcagcccattaggccccatctacagttctacactctctccaccttatctctagtcttcctagcgttatattgagcgcgaactacggaatgagcggcccttcggctttggcgatgggagcaggagtgggctacacgttgacgatggcatcgcaacgacggcctctccccggtgagctccctccgctctccctccagtgcgaagtttagatcgaggtcagcttcgattccttgcctcctctgccactggcgcaaccccgcccggtcggcctccacccactccccttcgtcttgctttgcccccgccaccaccagctatcgatcctacaactccggcggggccaccgccgcctcgccacctgcctttgtccgcctcccaccaacggttcatcacctcataggccatccccctaaacccgatgccccacttcccccttcccattgccaccctcctctcacttgatcaagacatggtcccgatctcccggtaggtatcaataagtcgattgaggataactcaacgcgggtgatctaaaggctccgacctgaattattgaacccctcataatcactacaccactgctctgttggttatcaattgtgccgaaacacattagaacccaccaagaaggctatttcctagcgaatcaatagtacaagcaagagggttgcagaagtaatctgaatattacaaatatacgatgaatctcccaagtttgtgttccacaaaccgaactagtggcaaaattggatttcgcaaaataatgtcagcaaaatccgacatgagaacggctattgaataaatatgattaaaaacatcctagggttagccttaagtccaaaaattgtttcgaactagataaggtacgtggattgcgtttacaattctggacaactcggaaggaattttgacatgaggcaaataatgtatgaaagtggactcataagttctataacaaatacacataggctctaagagaacttctggatcagcagatatgtatgtttaaagttgatattgtcagaagacccgaactcacgaacaaaatttatctcttgtctattatagttaaaaaatgatgatgaagcatgagaggagaatagggcaaggcctgatgttggtccccgatccacctcagtgaccatgcgaacattccctgcacatgttccactttgcttcacccatacgagtacttctgcaacacacaactcaatgtgtagcatccttcgttcaaatgcatgtctaccataataaacatgcaccttgagttcattgatgatgtgtaacataaatatggtcatatccgagcagatgatgtattgatcacaaccctatcctcgaatccaaacccgagcgcttatcgtgccaccatcggaatgtatttgcgagaatcccatcacgcacatgttcacaaattaagttttacatcatgtcgtactttactcttgatgcttttctataaataccctgctagagtggaggaaatcgtgatgatgtgaaccaccaacttgtccatccactggcaccgatcaatgatcatctactagtcagtttgaaggatgccaactgatgaaacccgttacaaaagaaaaaaagaaagaccataattttcaaaaaaaaaaaacaaagaaagaccatgctcagccttgggtacctgatctaaaggaaaaattaggcgcccattatccattgttgggcacacgctctctgctaggagcatgtttggttgcttgactacactcagcctagtgcaggcaactaaacaggcatgccccctctttgtttctctatgctacaatttaaaaggacactacttgtgtagttagctagtttctcatcttgtatcttcctcactttaaatggtttttctcccaaaccacctatcctatttacgatctaattataataaatatttgttttgatttaatatttataataagatcaaacacgactatattctgataaaaaatatatgttttaactgttaaaatttgatgcttcatttataagaaacaaatgttttaactagaatttaattatgttgcacatttaagttttttgttacaagaattttttcaatgttgcacatggtattgttttaatgtgtcatttaatgtttacaaatataacagatttgtatttttttaattgtttcagcaaatagattggaatgtatcaatatttacaactccatgtttcacgtatgatataaaaaaatgtttcaattaggaatatattatcacatatatttttttcatcagaaatataatcatgtaaaatcttgttgtaaaggtttagttacaatgaattcaacggtgcaattagattgtatatcgaataaattatttaggagaaaaaattatttaaaatttgataaagaaagttgttttttgttgagagaaaattgatgttgtgtagcacatcatgcatggaaaggttaaggtaacaatgagatgtttttttcttcgatatgttaaaatcgggcagggtactaagacaaattcatccaagaaccacatttggcacttttatcaggttagtatatgcccttcgatttattcgcagaaagaagggcttactggttcaaaccaaaatataagttaaaaggaccaatatccttctttgcttatatgaattgcagtcaagtaccgtagcagagattttctttacagtaaacaccacaatattacagcagcaaaatatggatttccaaattctttgctaggacaattagtttggtgctacaacaaaaactgctccagtagcgcaagctcgggagaacgagtaaatataacttgttatataacatacaaaaactgtataagtaattaaagaagcgcatatgaaccaacaatttaaagtctcaaggcagcaattgcttcaggcctgaagtcaatccgaagccctaacaccctcctaacctctgctggtgtcaaaagccatgtcagatgcccggcattgtcaccccagaaatccagtatctccgatacccgctcaaaattcagaattgttgacatctgggaaagtcttgagaacttgtctcggactggtctctgtgacatttccgagaaatggttgatcagggagcgtacctccttgtcgagctggagcccaccaagctggctgaacctcttctgcatcattatcacttcaagcctcttgacaatgaagtcgatgattaagtgcacaaaggaatcatagttgtttgatgtcatcacgggctggagccatgcaacattagtattaactgtaaggagaagcttctgcacccatggatcattcacctcattttctccatattcggcatcatccagctcataactgacagtggcaacagtgtccagaacaggacgaacacggggtgccacagatgccactaaatgctccagtccagaatgaaggatcttcttgaaggaagcactgatctcacctagctcagataaacaggatttgattttctctcggtcagcaggagcatgaaaagcctgttgaacaacaggaatagtcagtacagctgggttgtcaacacgaaaatactatgctacgaacaaagtgattttatcagataagagtgaaactattagttgtttttggtgtaattaaggtattttgaaagctcattgtaaagttttaatttgccagcaggtttctcccacattcctaattcatttttgacatgcgcatggtctccaatacatacatttgacaattaaactttctcaatgaatgttatcagcattataatatctacaaaattcctctttcaaatataatatggttggatttatcatgtgacatgtctgtgtgttcctcaccttatcatgtctattttgcagtaaaaccatgtgtcactaacttatttcagtcaatcaaatgcactacaattcagggttgtaagcacaaatgaaccaactaggtaacaagtaacatggagtccctaagtccatcgcaaacacagtaataagatgtgtgcatgatttatgttccatacttatttcatagctaagaaatttagaacgaagcactcagctagtcagcttccaatcaggtacgcagcatcccagctccacaaccccaacagggcagtcaaattcctccatggaatgaagcagctggaggtagccaagttttactagggagttcagtgcttcaatgaggcagtagcaatgcacttaaaatattgttggtgacgactggccacaagaccacgctgtggcaggccttgtgcaatgggtgtcaaaaatgttagacatcaaaacatgtttgttgctacaaatatgttatccttttgcaatttgttctctaaagtgttgcaattgcaactattccttctcaatgatacaatgttgcccagtagatattagctagactttttacatttgttgaaccaagggggcattttgctgcaattttgttatataaatgttgccgttcaatgatttagaggcacacagtaggatgcctaagactaaatcactcaggggacgatgcgacaggaacaacttccttcagacatttgtcaagtccttctagttccaatgtaggaaaaaagctaagaggaatcaaggtcaaccatgagcatcggatttaatcttctggaaataaaactatgactacatttcctacccatctgcaggcttgccaaaaaaaattactaccattttttccctttatttcatggttgtgcagaaagatgcactttccggtgacagcaggtcatttgttttcaggaagcagcagcatgtatttgacaaatctcttcaaaggcagcaaccattctgctaccctccaagcatgcaatcatcacatccaaatatattcaactagcttagggggtcactggtggaaacctgggagcgttggtttgcaaatgcatctgtatgacaacatgcatgcaacatttgatcgttttgggtcaatggtgagtgggtaagagcacagatacagttcttgctcttgaaaaggctccttagagacgtactagttcaaatagctgcatgctaacattgattttttgtggatgagtgagcacaatcactacaaaacattgtgcaggtgtgacagatgcagcaaactgtttcaatttccttagcaaaagttagcctggtaaagtgaacattataatttgacagatattatgtactagacaacaatgttgatcagatacataaaaataggttacaaattcaagtgaaccgtggagggagcgaacaaaatgaactgttattataatgaaaaagaaaaggtgagattgcacaatttgtagcttttatctccatccaacaggagatagatttagcaaatagcagtggaccgttattgaaaacaaattgcaccataattgtaggaagttcctaaagatttatctacaggttacagcatagctaaatatatcctaactaagagactatttattcaaggaagacacatataacccttttacatatgtgatgctgttttggtgccactcataaggtgtgacaacatgatattatcaactactttctagaggcttctttcactaaacaaattacaagaactggacaaag

SEQ ID NO: 7177 - DNA, 824 bp, Oryza sativa
tggcaacgatttttggctagctgtgtgcagaaagtggctccttggaagcttgggccaatgtcctttgtgggttgtcaaacttgtttgtttgttttggcgttagggcatcttcgcagcgaagtcggaactattatgtcgcttgtggaaagcttggtaacgataacacatgtgagcggctgtgtcactactatggcaagcttggtgctaatgtctcacgatgggctccgtcgtggtagcttaggttagattagttggtgtgttgttgtagttgtgtttttcgcttagtttccctaattaactgagaaatgtaagatatggtccctttttaaaaaaaaattgggcaccatcttttttatataactagcaaatatgagcatgcgttgcaccgggtgaatatcaaacaaatatggatggttaagattgcttgtgtacttataacacatgtgcacaaaaatattgaatttggaagcgtacagatcagaaaaatatgcaattaattaaaatacaaatccattgaaatatctggtatttttaagtaggtatgtgtataattaaataaatttaaaagtaaagcaaatgtgagaaataaaataacatggttaaatttaatgttattaaattctccatgattagttacgctctttagaattttattggaattttcagagcttaattgctaattttaataatacaaacatcatttaacaattatttaattggaaaaagaaacaaaatgcttcattttaggtttgattcgaaataaacacattcaacttcttctctttttcttctgcctgatggacctaaaataggctattggtgca

SEQ ID NO: 7178 - DNA, 689 bp, Oryza sativa
  unsure (1)..(689): unsure at all n locations
nnnnnnnnnnnnnnnnnnnnnnnnnnnnnnnnnnnnnnnnnnnnnnnnnnnnnnnncgaatcccgagaaaatcgatgctatccagcaaatgaagcctccatcaagcgtacatgaagtacaaaagcttgctggccgaatgcggcactcagtcgattcctctcaaaggcagccgaaagaggtttgcccttcttcaagaccctccggggcgcaggaaagtttaattggacaccagagtgccaagtagcattcgacgagctaaagcaatacttgcaaagcccaccagctctgataaggccaaccccaggaagcaaactgctattatacttagcagcttcgccggtggcagtcagtgctgccctcgtccaagaaacagagttcggacaaaaaccggtctacttcgtctccgaagcactgcaaggagcgaagacaaggtacattgaaatggaaaagctcgcttacgccctagtgatggcttcacgcaagcttaagcactacttncaggcccacaaagtcatagtgccatcacagtaccccttgggcgaaatactccgaggcaaggaagtcactggctggctcacaagtgggcggcagagctatccccgttcgacttacaatttggtgcatgctctgctatcaagtctcaagtgctagccgacttcgtagctgaatggacaccagtactttgcccc

SEQ ID NO: 7179 - DNA, 567 bp, Oryza sativa
catgggcgactgcctccagatgtacgacaacatgaaatccaacctgaactcggcggcctcggcgctcaagaagggggacaagaacacggcgcacaccatgctagactccgcgcgcactaacgtcgacacctgcgaggacggcttcagcgagcgggaggggctcaatccgatcatgggcgacctcgacaagatcctcgccgagctctccagcaacaccatcgccattgcctccgccataattgagtgactcatctcattttctctctgtctttctccctctgaccgtcttgaacaaacaactgaagtgtatgtagtatgtaccgagtgtttcaaaagctgaaactgcattatgtatctgtaccattatgattgattattatgacttgtgaaattgtgaattgtgattatgacatccatccccttttttaatcttgggattcttggttaatcagattagttaacttgtcaatggggaggaatttcctataggcgccaacattaatcagcaaacaaagtttcacacacacacacaaattttgttcagaatttgtttctttcaacagggga

SEQ ID NO: 7180 - DNA, 615 bp, Oryza sativa
tatgacctccttgcccacaaggttgggttcaactaggctggagctttctattggtgtccatgctgaaccactttcattatgatgtctgcggttgagttttaaaaatacctcatcctttgaaatgtaatcgatctttttgttcaggcttctaatttttacagcaacttcatgacgtatacgaatattagaaaagcaggatgaaagtgaaaggccactgcaagcagttgatttccttgacgatgacataggatagtcaggcagtaggacacttcctttaaatctagccaaatcaataatatcatcaacatcatacataacatctcttagctggtcaagccatttttcaactactaaatcttccatcctccttgcctcagcatcctgaagagaagatcttatgacgtttgttcttcgttgcagttcttcaagctcatcttttacccctaaaatgagtattgtcttgtctgtaatgatcgcttgcaacttattgatgcatgatccacccaatgtgtctactattgttgccatccgacaaactcaaaaggggtaatccaccatatataattgatcaatgtaaaaaatgcagcctgacatgtaaccaaacttgtgttaaca

SEQ ID NO: 7181 - DNA, 488 bp, Oryza sativa
ccctcgccgccctcctcatcctcttcaccatcgccgccaccaccctcgcatcggcgaagtgcatcgcgaagaacaaacccgaaggcgaggagggggaacccagtggtgcgggcgcggctgcggcccacgcttcaccggagaagaaacccggctccaacggcgggttaaccaccatgtccgtcggtgagagcgtaccggagatcaagaaggactcctccgatgatggcgccgccgtgaatgagagcaagaaacctaaatccagtggcggcttgactaccctctccgtcgatgatagtcaagcagaacccgcggacagtatagcagaacccgtggaagatggcaccgacgacggcgaggatgagtcggagaaaaagaagaagaagaagaagaagaaatccaaaagcaagagctccgatgatgatgatgatgatgccgagaagaaatccaataagaaatcgaaggactcggggtaccgagctcgaattcgc

SEQ ID NO: 7182 - DNA, 538 bp, Oryza sativa
tttgattcatagcataggaaaaaaagcggtaccaacaaatagcacaagaatttttcgctttcgatcaaaagcacaggccaccgttttttcttcgccccatagcacttccgtcaggtttggagctaacagagttaggttgaagtatataaaaattttgttggacccatttgtccttcgtcttcctcgctgtaatctcccatcctgtgtcatctcgtcctctcgggttagtgcccacgacgacggcgtcggcaccgtcgccaatcagtgacgcagcgacgatccccgtccccaggcgcgccaccgccgtccccatccccaaccgcactgccaagccgaaccacacatcttcaccattctctgtccctgccggctcccgtggcgatgactgcagcagctgtaggagccctagctggtttccatcgggccctaccaccgcggccgagacgagctccgtgccacaaagcaacacaagtggcgcttcctccgccgtttcctccagcgagcaccaaccgtcccgctctcttacttcgtggacgcg

SEQ ID NO: 7183 - DNA, 709 bp, Oryza sativa
  unsure (1)..(709): unsure at all n locations
nnnnnnnnnnnnnnnnnnnnnnnnnnnnnnnnnnnnnnnnnnnnnnnnnnnnnnnnnacagaaaatttatgcatcagcttatacagcagcatctgcatcgtgctcagcaacagatgaaggcttatgctgataaaaatagaagcttccgggagtttcagccgggtgactgggtttacttgaagattcagccttatgttcaaacatcagtggctagaagagccaaccataagctatctttcaagtattttggtccttttgagattcagcataaagtgggtcaagtggcatacaagctggttcttcccaatacctgtttaatccatcctgtggtccatgtatctcaacttaaggctgccaagggtttccaacctgctctacagcatagcttgccatcttctttggggtccttggaaattcctgtgcagttcttggatcagcgagtggctaaaaaaggtaacgctgttgtaactcaattgctcacacactggtcaggtactgcagctgctgatgcgacttgggaggaccaagaagatctgaaggctcgctagctcattttccattcgcaccggcttgggggcaagccggctctcaaggaagggaggatgttaggaccagcaggagcaaccctgaaggagtacagtacggcggagatgacggcaacacggtggatggagaacaggacggaggcggtcgtaaagattgcgtcttc

SEQ ID NO: 7184 - DNA, 15887 bp, Oryza sativa
cgagatgacactattgctagagtaattggggtggagcacactcatagggttgatttgatgtcagctgatgtaggatgggagctgctttggaggagcatgaacatcaaccaagagaaacaagtgcaaaatctcaaggacataggtattgagattgttcgcaaatgtggtggccttcctcttgcaatcagagttattgctacagttttagcaagccaagaacaaacagagaatgaatggagacggatattggggaaaaatgcctggtccatgagcaaacttcctcgtgaattaagtggtgctttatatctgagttatgaagtgctgccgcaccaactgaagcaatgttttctttattgtgcacttttccctgaagatgaaaccattttgcgcgacattcttactaggatgtgggttgctgaaggctttatagatgaggaaaaaggacaattactagaagatacagcagagagatattattatgagctgatccatcggaacttgctccaaccagatggtttatattttgaccactggagctgtaagatgcatgacctcttaaggcagcttgcttgttatttgtctagagaagaatgttttgttggggacgtagagtcactagggactaatactatgtgcaaagtgcggcgtatttcagttgtcacagagaaggacatgatggtgttacctagcatcaataaggatcaatataaagtgcgaacgtatagaacctcctatcagaaggcactgcaagttgatagttcacttttcgagaaacttacatatcttcgtgttttggatttgactaactcacatgtacaaagaatcccaaattacattgaaaacatgattcatctgcgcttgcttgatcttgatgggacagacatttctcatctaccggagtccattggttccctgcaaaaccttcaaatattgaacttgcagaggtgtaaatctctgcaccgccttcctttggcaaccactcagctgtgcaatttgaggcgacttggtcttgctggtactccaataaaccaggttccaaaagggataggaagactgaaatttctcaatgatttagaaggatttcctatcggtggtggaaatgacaataccaaaatacaagatggatggaatttggaagagttggcttatcttccacagttgaggcagcttggtatgataaaattggagagaggtactccacgcagcagtacagacccatttctactaacagagaaaaagcatctcaaagttctgaatctagactgcactgaacagacagatgaagcatattcagaggaaaatgctagaaacattgaaaagatcttcgagaagctaacacctccacacaacttagaagatctttttggtgggaatttctttggttgtagattccccacctggcttggttgtacccatttgtcttcagtgaaatctgtgatcctcgtagattgcaaatcttgtgtgcatcttcccccaatcggacagctaccaaacttgaaatacctaagaattaatggagcaagtgcaatcaccaagattggacccgaatttgttggctgctgggagggtaatctcagatccacagaggcagttgctttccccaagctcgaaatgttgatcttcaaggagatgcccaactgggaggagtggtcctttgttgaagaagaagaagtgcaggaggaggaagcagctgcagcagccaaggaagggggagaggatggaattgctgcttcgaagcaaaagggggaggaagccccgtctccaactccaaggtcgtcgtggctgctgccttgtttgaagcagttgcaacttgtggagtgccccaagctgagggctctccctccacagcttggacagcaggccaccaacttgaagaaactctttataagagacacaagatacttgaagacggtggaagacctcccgttcctctctggttgccttttagttgaaagatgtgaaggcctggagaggatctccaaccttccccaagtaagagagctgcgtgcaggtggttgccccaatttgaggcatgttgaggagttgggtggttttggagcagctatggctgtcaaagaatatgcagaagatctcttcactgtgggtcccagggcttgaggagcaacatcgccagctccatggagatgagcataagttggaggtcaacgagtagttatggagacacttctagagactcatccagtcttattttcaatgacggaatagtctactgctaccaggtctttgaaagttttcttgaaactgcacctttgtcaggctactgcattttttttgtgatggaataattatgaaaacactttcagaggcacataaactctgtttctctgttggacgaacctgagttggaaaccagtttagtttgagctcatttcaaccccttctttcaccagaagcaattgggttaaacccaagcaccaatcattctcctgtcagtccttaatgacaagcctgcaggacaaggaaatcaatgaagatcactgaggcaaaaatatatttatcctcccatcatgatagaaactgattgtgctttgtgaattgtgatcgagaggagaggaaatggtggataaccttcctagtcattcctttgtactgacaatgtttcagtacttgaggaaatctcagtgatgatacctcgtattgacaatcaatacctgtgttaatagatggatacaacacatctttgactgaaatttgcatcggcaatgattgtgtccaaggctctttctccaccagctgctgcttatgtgggatggaacccatgtataacttgaggaagagaagtaaatccaccttttgtttatttcattgaattcatcctttttccttttgaacactgaaaataacagcttgtatgtctttaggattggttcaggaaaatgttattatgacagtgcactagcttttcaccttgttatcccattacattgttaaattaaccatggttttattgccttcgtattttctggacggggatgcaaaccagtgtcttcttggatacttgcatcttcctaactagcatggtggcccgcgcagattgcgcggctagcatcattatattttctatcatataatagcatatatgttttctcattatattattcaaatatattaaaatgacaacataattttaaattttgcaatatgtgtaatattcatattatattttatatacatgttagttattaattatttttaatatcaatttttagttatttgtaaattatatatattcctatatggactctagactcgtcttttaatatttcctttttttaattccgaattttctgtaaattgtatttctatatagactctatgctcttcttccaatattatttatttttatttctgaattttcatattatattttatatacatgttagttattaatatcaaattttagttatttgtaaattatatatatttctatatggactctagactcgtcttttaatatttcttttttaaattccgaactttttgtaaattgtatttctatatagactatgctttttttttcaatattattttttcaatattatttatttttatttctgaatttttattatttctaattgtatttctatgtggactctaaactcatctttcaatattcttcaatttttaatttcgaatttcagttactaataaattgtattcttatgttgaccttaaactcttcttcccatatttttcttaatttcgaattttagttatttgtaaattgtattttttatacagactctagactctacttttaattttattatgtttattccaaattttagttagttttaaattcctatatggactctatactctacttctagtatttcttttttaaattccgaatttctattttttttcttaattgtatttctatatggactctatcctctacttctaatattccttatttttaatttcaaatttatattatttcctaattgtatttctatatggactctatactctacttctaatatttcttgtttttaattccgaatttcagttatttcctaattgtatttctatatggactctatactctacttctaatattccttatttttaattccgaatttcagttattttctaattgtatttctatatggactctagtctcttcttctaatattccttatttttaaattccgaatttcagttatttcctaattgtatttctataaggactctagtctcctcttctaatattccttattttttaattccgaatttcagctatttctaaattgtatttctatatggactatgctttttctttttctccgattaatgtgagaatttctaagccatgagagcgaacgtggaagctcctttttctattcctttaattatataatagatgttccgtgtaagctgatttccttattttgcatagtgtaatgtgttctactagcaacgatagggtttgagatattcggttttgacatttcatttgatggcatttgatcattatgttcaaagatgctcactactgatgctgtagagctcactcccccaaatctgcaaccttctcatggactctgaaattagaatcgaggtttgtgttcattcatgtacacaattgagctattcagtttgaattttcatctgaatcattctgtgttcatctacaacggacaaattattcttatcgtgactgatcaaacgcagcacaaagcaaagcacagctatagcgcatccaccgatgagaagagaaagggggaggaaaacgaggggtcctctacctcggttgtgctcgaggttctccggcgccggcgacgtgggactcggcggcgatttacctcgtcggagcgctcactcgcttgccgtcgtcgcatcaacggcaatgtaaacatataatgtctccctgactcgtggggcccacttgagggcaagaacgcaagaacgacgcgtgtctctcctgcttgagaactaaccggcagccgctcgccggagctccctccggaaaccccaaatctcggcgcccgtatccagaggcggttcgtgtcccgttggttcttgggctcctatcctcgttcagatcagggaggctgttcagttcttgtttatccagcggggcgcagcgaaatttgcagaggaatctcaatctccaaactggtaggaagagagtttggtcgatagaagttgagttcttgtttgttcgttggtctgcagagttcactagttcagataatcatatcatcaacaccatgaattgaaagagatgctgcactgctgtttattgtgttcactgtttaattcatagcatccatcaaacctgtatctgtttgggagaatgttcgatcaatgctacagttggaatcaaattcaactcaggaccaaattcgtgttaggcaaatattcatgttcaatctgttaatacgtttaactgcagttctcaacatctcttgacgaggaagcagggctgctgctgcaattcggcctgcaattcaagtgcagcaatatgttgtgtgcaatttgtgcattagtgcacaagttgagaatggtaatattatttcactcggaagagatggaacagttgcgaaacgcagaaccactcggttcagaggagaatagtcctggacaaaaggacagaaaatggtccaatggtgagcattgatcatttttacagtgaatggtgagcaactgatcagcatcaaccatggtgaagctgaacctgataagtcgacagcactaggggtgatgatcctagccacccataaatcctttcttgtatgtttcctaacatatataagtcagcaagtcaaatgttcttatcgttttctttagtcgatggttcatcgattctgacatcaagacaagaagccaacatactgctagccatgttactttcctcttggctcacatacggccatttgaatggattagattcagaaataatactatatctcgtctttctttcttacttacatgagttgaaatattcttggcctttttttctctacttactagggcagaattaagattttgaagatgagctgcaccccaatccttaagagatactaggaggtactccctccgtttcatattataaaacgttctaacattgctcacattctagacacacacatatatatatattgattcattaatatatatatatatatgaatatgggcaatactagaaagtcttataatatgaaacggaagaagtaccatattttctaatgtaaaatttggtatttctcgataccttcggtattaggtctttctttctctatttactagggtggagtactctgaatgaatttcagtccaaatatctttcctgacatgggaatctttttagtagcacgatggagaaatttatatatgcagctgaaacatcttgttcatacatcagactgccatttgcacaatttgcaaacttgttcaaacatctttatctaagatggcttgtcttgttccgtgcaatttgcacactggaaaacaaactcctcatgcacagtgggacataaatggtgagacggataaaagagccattgtactatttgaacactgcataagagagccagcccatctagtccacgagacataatctcataatgggaacttgctcgttgtcttccttgtgaccggcgatgcctcggctgcacgcatcaaaggccttgctctcaggctcagctgagttttctctcacaacatagggtttgaacaattttctgcttgtcacgttaggagctagccaatcgaaacgttggctcgctcggtcatcatcttgcattccagaagacacccgcctgctccactgccgttcctgtcgatccgattcacttcagcctcagctcggctttcataccaagcaagttagctttgtcaacttgagcaaaattaacaccgcaatttgagccggttacttctttctcgtttgcctgttgatacaaagaagccaccgaaaggtaaaccccttaatgatttcagttcttcagcttcagtaatcagtatatacttgctcaaaacagattgcaaaataacttgctagctacaaagatactctgaaaccacttcaacttttgtccattttcagacggtattactcttgcatgatttaattggatatattgcttacgccaaaaaaaaaacttggatatattggagcatcaccctcgacgagtttctctatggcaaccatactggattctttgattggatcatgtgctaagaagttgcaagagatcattaccgaggaggcaatactaattttaggtgtaaaagaagatcttagagaactgcaggaaaaaatggaacaaatacgatgctttataagtgatgtggagcgaaggggcatggaagactcatcaatacacaattggatttctcgtctaaaagatgctatgtatgatgctgatgacattatcgatttggttagctttgaaggaagcaagctattaaatggccattcttgttcaccgagaaaaacaattgcatgtaatgggctttcacttctctcttgcttttccaacattcgggttcaccatgagattggtaataaaattagaagcctgaacagaaacctagaagaaatagcaaaggataaaatatttgtaacacttgagaatacacagtcatctcataaagattcaacatcagaattgagaaaaagttctcaaattgctgaatccaaccttgtggggaaagagatattacatgcttctagaaaattggtgagccaggttcttacacacaaggaaaagaagacttacaagcttgctattattggaacagggggaatcggaaagacaacacttgctcagaaagtattcaatgatgagaaattaaaacaaagcttcgacaaacatgcatggatctgtgtttctcaggactactccccagcctctgttttgggacaactacttagaaccatcgacgctcaatgcaaacaagaagaatcagttggcgagctacaaagcaagcttgaatcggctattaaagataagagttattttcttgtgttggatgatgtatggcagtctgatgtgtggaccaatctactacgaactccactgtatgctgcaacctcgggaatagttttgataactactaggcaagatactgtcgctagagaaattggggttgaggaaccacatcatatcgaccaaatgtcaccggctgttggttgggagctactctggaagagcattaacattgaggacgagaaagaagtgcaaaatctgcgagacatagtgattgagattgttcagaaatgtggtgggctacctcttgcaatcaaggttattgctagagttttggcaagcaaagataaaacagagaacgaatggaaaaagattttagctaattacgtttggtccatggataaacttcctaaggaaataagaggtgctctatatctaagctacgatgatttaccacagcatttaaagcaatgttttctttattgtattgtatatcctgaagactggaccattcaccgttattaccttatcaggttgtgggttgccgaaggctttgtagaagtgcacaaagatcaactactagaagatacagcagaagaatactactatgagctaataagtaggaatctcctccaaccggttgacacatcttttgatcagagcaaatgcaaaatgcatgatctcttaaggcaacttgcttgccatctatcaagagaagaatgttatattggagatccaacatcattggtggataataacatgtgtaaattgcgccgcattttagctatcaccgagaaagatatggtagtcatacctagcatgggtaaggaggagattaagttgagaacttttagaacccaaccaaatccactgggaattgagaaaacatttttcatgagattcacgtatcttcgtgttttggacttgactgacttacttgtggaagaaataccagattgtgttggatatttaattcatctacgtttacttgatcttagtggaaccaacatatcctgtcttccaaaatctattggtgctctaaaaaacctccagatgttacacttacagcggtgtgaatctttgtacagtttgcccagcatgatcactcggttatgcaatttaaggcggcttggtcttgatgattcaccaataaatcaggttccaagagggataggaagacttgaattcctcaatgatttagaaggatttcctgttggaggtggaagtgacaatactaaaatgcaagacggatggaacttgcaggagttagctcatctttcacagttacgccggcttgacttgaacaaattggaaagagcaactcctaggagcagtacagatgcattgttgctaacttacaaaaagcatcttaaaagtctacatctatgctgcactgaaccgactgatgaagcatactcagaggaaggcattagcaatgtcgagatgatctttgagcagctaagtcctccacgcaatttagaagatcttatgattgtattattctttgggcgaaggttccccacctggcttagtacatcccttttatcttcactgacatatttgaaactcaaagattgcaaatcttgtgtgcatcttccaccacacaatcggacagctaccaacttgaaataccttagaattgatggagcaagtgcaatcaccaagattggacccgaatttgttggctgctgggagggtaatctcatatccacagagacagttgctttccctaggcttgaattgttggctatcaaggatatgcccaactgggaggagtggtcctttgtcaaagaagaagagttgcaggaggagaaagcagctgcagcagcccatggaagggggaaaggatggaactgctgcttcgaagcaaaagggggaggaagccccgtctccaactccaaggtcgtcgtggctgctgccttgtttgaagcagttgcaacttgtggagtgccccaagctgagggctctcccaccacagcttggacagcaggccaccaacttgaaggagctcgatataagaagagcaagatgcttgaagatggtggaacacctcccattcctctctggtatactttttgttcaaagttgtcaaggcctggagataatctccaaccttccccaagtgagagagctacttgtaaatcattgcccgaatttgaggcatgttgagatgttgggtggtttggagcagctatggctgtcaaagaatatgcagaagatctcttcactgtgggtcccagggcttgaggagcaacatcgccagctccatggagatgagcataagttggaggtcaacgagtggttttaagagccaattaattagatggcacaaggtatgtacactgattggttgggttttttcactggaataaactaatcatagggttgtacattcatgctgctcctcagctcttcagttgtatgcagctattcttagcttttgatagtctccttagatgttcatgttgtgtgcattgactgattgtttgatgatctatatgatttagttctttttttcattagtgttgcatgtaaccatttcaccgtggttaatgttttcataaaatggtgtatacacatcaacaaattaattagatggccaaatcttttatcttctcatgatcttattaacatgcatcctgcacgtacggtgtattccagatgaatgtattgtcctatatgtactacaacatgatcgtatgcagtagtgttcctagctctgcacacagagatagagattactgctactccaaaagaaaattgtatgggttatattgtcaccaaacaatgctatgatggcattgatatattcactatatatatgccagtagttatatcacatatgcatatatccatccaaggacttggggacaacataaatggtttagcatttggtacacaggctgcataagttcacgactaaacataatggacttcgaagtaatccttaattcagctcttgaatgtgctagctatgattgactgtgtacatccttcaggatgtagaggtcggtttttatttaatccattatctaaaaatgtgctatatatgatgaagaccagctcacatgcatttagccttcaattctacaagtgtgttctatgtcatatcaatgtgcgcatttagcattcactatcttataaaaaaacacaaatacacatgaattttcgcaagacattaggcctatagagtagttttttagatttgacaaaaaaatatgtcaggcccaatgtttcagattccttgtagcctatgagcaggatattgaatatggaagtgttgtgcccaacatctgttcctagcgtagggctcctaattaaggtttgtttggtgaaaaacaaaagccacctaatgtctttgtattggttcaaattgattgatatttttgttcgtattacatctgttaaaataagcagtggatattgccaagcgacatgcctatgtatagtccatatgtgtattttccttatactttttgtaatgcacgtctgatgtttggtaagttcaattgcagaaaatatgattgttgtaaaacggatgtcacttgtattttcttttccttaattaagttatttaattaccaaattgcttatgtatatacatccatgattaattgtgtgcgcttatttgtattgtaggttaatcttgaaggatttgggctgcagtcacctgtaatctatatttttgtctttacctagttactggtctttaaaatattaaaaaaattaaaaaaatgaaaaatttaaaaaaacaaaaatatcaaaaaatgggaaaatgccaaaaaaatggttatattttctttagctcttgtaaaatacattgccgtgttttattaggtgtgtgtttcttttttaaatttttttttattgtaggtgtgtaggtaactccgcctatgtcatcctaggtttagtaaatgacatagccggtcccaagcccggaaaaaggaggggaacatcttgtatagatgttggttgaaatgatgctctccatccacatagtagatcgttgggatatttccacacttttatcagattaatttcattttcaatgatggaatagttatggaaacacttctggagactcatccagtcttattgctctgttggaaacatctgattcagaactatttaagcttgaccagaccaccagagttgagagttatgttgcgaattgagatagacaagtaggtaaaggaaattcagtgccagacatgacaagagacagggcaccccagacaagatgtgcaacgagacattcgagtctcagagcccagatatgcccgaagtcctaaacaacttgatacaattttgctacaagatcaaaccgtaacggctagatcaaggtacagttctatttttatgtcggtttggccgatctagctaatgaattgacaaaatataagtacagttacagacccactaatcaataaagacatcccatgctaaaacaagtatgaaagatgcgcatatccctccgtatctaaaagactatagttttaagttttaacctataaatgtatcccacaaagactatttttacagtgaggttcactagatctctttaatactactttatatttttattcttattttaaccagcaaattaaccagtaatactccctcttcctcgttttttctcctcattaataggatacagtagtcttttaatctatctttgatagctttaactaccttcttttagaaatggagggagtatgtgagtgacaggttacaacaatcactgtctgatgtgtgcttaggctgtgaactttatgtgttgcttcagtttgttgttccctattgttgtgttgctggctgctattcttgtcatcagttcctgtgatgttagaacccttatcaacagaacagcctctcgcaacaagaacacagaaatgtggaactcgaactagattgatagattatctcacgctcaaccgagcggagccgccgccgccatcgccaccttgccgagttccaagccaaccttccttctagctgttgccagcttacatatagttcttagttacttctctctctctctctctctctctctctctctctctctctctctcgttacatgaatttgggccgataacccacaaagcttagacggcccactcggaccccttatacttcatgttcactcgacgattacgcttttccttgacgaagacgccatcttgacgaccgcctccgtcctgttccccatccaccgtgttgccgtcatctcccgcgtactgtacctcttcagggttgctcctgctggtcctaacatcctcccttccttgagagccggcttgcccccaagccggtgcgaatggaaaatgagctagcgagccttcagatcttcttggtcctcccaagtcgcatcagcagctgcagtacctgaccagtgtgtgagcaattgagttacaacagcgttaccttttttagccactcgctgatccaagaactgcacaggaatttccaaggaccccaaagaagatggcaagctatgctgtagagcaggttggaaacccttggcagccttaagttgagatacatggaccacaggatggattaaacaggtattgggaagaaccagcttgtatgccacttgacccactttatgctgaatctcaaaaggaccaaaatacttgaaagatagcttatggttggctcttctagccactgatgtttgaacataaggctgaatcttcaagtaaacccagtcacccggctgaaactcccggaagcttctatttttatcagcataagccttcatctgttgctgagcacgatgcagatgctgctgtataagctgatgcataaattttctgtccctcagccattcctgtaaatcaggtactgcacaatcttccatggtaataccaaaatgagctggttgatggccataaatgacttcaaagggggtttgtttcacagctgagtgataagcattgttgtaccaaaattctgccaaatgcaaccatgctgcccacttagtaggagtggcatgaacaaaacatctcaagaacagctccacacactgattaactcgttcagtctgcccatcagattgggggtggtaggctgaactcatgtgtaactcagtaccagacttagtgagcaaatactcccagaattggctagtaaaaattttgtccctatcagatacaatcactctaggcataccatgcaacttatagatatttttcatgaaagcagtggctactgtctcagcagtgaatgggtgtgtcaggggaacaaaatgtgcatattttgaaaatttatccaccactaccaaaatgcaattgtacctttcagactttggaagaccctcaaggaaatccatggtaatcgtctgccatgctccttctggtaccggcaagggttgaagtaaccctggatatttgactctttctggtttggcttgaatgcaaacctggcaatgttgaagctgacatttaacttgctttttcattccaggccaagcaaacaatcttttaattcttctatatgtgacaggaaaacccgagtgccccccaatgggattgtgatgaagttcagcaattaacttgttctgtaggtctgtattgttgcctatccaaatccttcctttgtaacgaatgagcccatgcgccaatgtatagtgttccttggcaataaaattgatggctaattcagctagcaactggcttgtgtgagggtcctgctcatatccttttgttacttcctgtaaccaagtaggggtacttactgagatggctgataactgtcccccttccccaacttccctacgagatagagcatcagccacagcattgctgctacccttcctgtaaccgattttatactgtaagcccagtagcttagtaaaagccctctgctgccagggagtgtgcaatctttgatcatctaaatggaccaggctatgatagtcagttagaatcagaaactcttggtgctgcaagtaagacctccaatggtcgactgctaacaaaatagccatgcactccttctcatatgtcgacagtcccttggaccttggccccagggccttgctgagatatgctattgggtgtccttcctgtgacaacactgctccaataccagcatcactggcgtttgtctccacagtgaactgtttggaaaaatctggtaacccaagtacaggagcagaggttaaagcttgcttaagttgttggaaggcagcttcagcttcagatccccacctaaaagacactcccttccttaacaactgtgttaaaggtttgctgatgataccaaagttttttacaaactttctatagtagccagccaatcccaaaaatcccctcaatttcttaactgatataggagtcggccatgtaagtacatcctgaattttctttggttcagtggagaccccctgtgctccaatgatatggcccaagtaagacacttgaggttgggcaaaagaacacttgctcattttgacctgccaatgatcttgtctgagaagttgcaagacctgtttcaagtgggtcaaatgtgactgtagatctgggctatacaccaatatatcatcaaaaaacaccaaagcacatttccttaaaactgaagccagagttttgttcattactccctgaaatgtagctggagccccagttagtccaaaggacataactctgtactcatagtgactagaatgtgtctgaaaggcagttttgtgctcctcccctggtaccattctgatttggtggtaacctgccctgaggtctaattttgaaaaccacttgggtccagacaattcatccaacagttcctttattattggaactgggtacttgctcttgatagttaaagcattcaagtgtctgtaatcaacacagagtctccaagtcccatatttcttccttaccaacaaggcaggtgaagaccaagtactctggctaggttgaatga

SEQ ID NO: 7185 - DNA, 8160 bp, Oryza sativa
  unsure (1)..(8160): unsure at all n locations
ctgggtacttgctcttgatagttaaagcattcaagtgtctgtaatcaacacagagtctccaagtcccatatttcttccttaccaacaaggcaggtgaagaccaagtactctggctaggttgaatgacccctgatgacaacatttcagcaacttgtctttcaatctcatccttgagctccggattgtatctataaggcctcaggttaactggttgggctccctctattaaaggaattctatgatcacaatatctggtagggggcaggcccctaggttcagcaaaaacacctgcaaattcttgtaaaatcttttgcactggagcaggtacattctgatgttcctctggtctgccttcagtcaattgaatcatatacatgatggaacccaacttgccatacccattaattgctccccagttatctcaaaacattgcttaggttgagaagatatacccagcaatctaatgagttgactattgtactgaaactctagccacttctaactccaatctatttgcattgggctgtgctgcacaagacaatccatacccaatattatatcataattgcccaaggttataagtgtgaaatcatttctgaaactatgcccctgcatccaccatgtgcaaccaggaattactggattgcacactatctgtcctccatcagctatttgtaccttcaaaggttgtttcagtatctccactctagatagttttctgccaatttgctcatctatgaaggaatgagtacttccggaatccaccagcattagcaattatgtaccctgaatccatccccttagtcgtatggacttgcttgattcagtaccattcagggcttgttgagaaatagcaagcagactcacttcttcctcaacaggtgtttccacttcaggacttgcttcattatcaatgttcatagcttccataagctcttgtactacatgtagttgtactgcattagcacacttatgatctctcccccaccggtccccacatataaaacaaagacccttagactttctatatgccttaagtgatgcaaccttgtcttccttagctctagtggcctctagggccgctgatgagttgaccttctgtggagaaggagagaacaaagttgtctgtgatgcagacctcggtactgacttgatataatttcccatctgttctgacttcttgtaacttccagccttcagtccttccagagcctcttcttgcagcatagctaaggaacaagcagtatcaaggtcttggggcctctgaaccaagataactgatcgaacctcttcctttaagccatcaatgaattttgtaacaaaatattcaatgggagcagaattttcataagcattcagttgatgcatgatgctatcaaacttctcaacatactctgcaacagaagtagtctgctgaaccctcaaccattgcctaatcaatgcttggtgtcgatctcgagtaaatctggcacacaccctttcacataagtcataccacgtcacccctatcagctgattcctcactgattgtaaccagaaggcagcgtttcccacaaaattcagagttgcaatcttaacccaattgttaggcggaattccataaacatcaaaataaacttcacaattagctctccacatctgggggttatctccattgaactgcgggcacgtcatcggtgacaagctgcttcccaaatttgtccttgcactacccgaccccggtgaagcaattggctcaaaattgaaattattcgcagaattcaaagtgggatctcgcataccttgaatctggaacgacgattggggcgtgaattgctcttccttcacatcagctggtttcttctccattcttccctgtttcagcagagtaccctccatgttttcgaccttcgtactcaaggatccgaccaccgaagcgacttcctccacacgcttctccactagcggcaacctcgcctcaaccaccttcttgagctccgctagatctgcacgagtccgctcctctgcttccgctctcttccgctcgttctcctccatcttcttcaacaagagatccaactttgtttcgtgcaccatggttgaccttccccaaatttctcagcgtggttttctggcgtccagatcccgcgaccgctccaaactcgaccaacccaatcgaggcaagttgccttttcgcgagacaccaccccaggaggtgagtctcaatccccgatcggtgattctacggtcgaatcaagagattaaggtcgcaaagctctaataccagattttgttagaacccttatcaacagaacagcctctcgcaacaagaacacagaaatgtggaactcgaactagattgatagattatctcacgctcaaccgagcggagccgccgccgccatcgccaccttgccgagttccaagccaaccttccttctagctgttgccagcttacatatagttcttagttacttctctctctctctctctctctctctctctctctctctcgttacatgaatttgggccgataacccacaaagcttagacggcccactcggaccccttatacttcatgttcactcgacgattacgcttttccttgacgaagacgccatcttgacgaccgcctccgtcctgttccccatccaccgtgttgccgtcatctcccgcatactgtacctcttcagggttgctcctgctggtcctaacatgtgatgaacgtggcggtctgaaactctgtaagcctgcaggtctcactctctgtctctcctcattcctgagtcctgacagcctatggcccatttccgcatttagtcctaattaatgaatttaccaagccagttgacaccatcaggaggggaaaatactgatgactctgtcaaccctgcaatctagtagtatacatgtttattcaaatgagcaaatctgcaactccctcatggactctgaaataagaatcgagttttgcattcatttcttgtgctcttcagttattcagttcagttctatatagtgtcaggactatcatctgaactgttttgggttcatgaacaataactcttaagtccatctaatatgttcagttattcttcttcccctgaatgactaatgcagcaaagcaaagcaatgctgaaaactatacaggtaccatgaaacgctacatcagtaacaaattcatgttaatcatgtaggcaacaggtgcaacaaattcacccttaacaaacagataaaagaaccgctaataattaattctttggtgatacaaatacaagtacagagttaaatacacactgatcaatgaatacatcatccatgtcatttttactcacagaagtacgtaggtgaaaattgttcatttttgacgggaaacaacagcggcgccggcgacgagggtggcggcgccggcgacgacaatggcggcggcgagcagggcatggcgatcaccgactgtcatggttcgggttcgggatgacggtgtccattgcgggacaatcggcaagtccctctcgctgtcccattcaatggtgcaagatgtccagtcctgaccaggcaacatggaattatcattaatgtctcagaaatatttatttatttggaaatgatcatgttgtaaataaacccttagatagttttccatggatatattgttacacagagcattttatagataaaagtcattactaagaattatttgtttgtactatgctactaagacaataattgttttaaaaatgattaccaaaggacatgtcaaaccaatgtattgtatgagggagatttgcaataatgacgctgcaaacattaatctttgctataataacattggacccacatttcatagacacattcaaaacagtgaaaccccaatatttgcaatcccaatattgcaattttcttattgttatgaggaccatcctaatgcagcgcaaccggcactagggccagtcctaaactattgggggactagggtgagacaaaaattagcggccaaaatgcaggcactaaaatatttccttgatctttgttttcatctcgtccaagaggcccaattgttcataactagcatacagtgtactatactgaaataatagtaatatatacttagtatgtctctacatacctggccttctttttcaagacgacaaactaactcgacgattgctcgcattctcttcacatattcatcacaaccagtatcactgcatacaattcataacattagctaaaaatccaagattttgtaaacattctgagccccaactattcattgtaattacatacctgtcatagagcccaggatgattgaaacaaaaagcttggtacatctgcttcagttcagagtaacccttattggtctcggagaacgccacgcccgccgccgtcgtcgccggcaagacctgcacgccgcagccaccgggggagaaggccgagcttacacaagccatggatgctggagctcgccggccgatgttcttcagcagccgcatcgccatggggtgggtgggtcgagccattttggaacgaaattcaggtatatgtgtacgacgagcttgttgattgttgatcagttgattaatcgtggttttgatcagctggtgtccatatcgagcttatataagttgtgaggaagaagaagacgacgacgacgatgacgcggaggaagaaccgaagaaggagatacaacgcgcatggataccgagtggagatctatggaaggaagacgagagggaaggtcttggtagcagcaacctaattagagcaagtttaatagtatagcccactactagctccaaatcatctatagtcaatgtaatagccaattcatacaatagttgcttactatactattaatatctggtcccacatgttatacacacattacgtcttaaagtctgtgttgcagctgtctacagatctgtaacccgttgctcttttctctcttcctttacctctttaaaatatgtttatagctggcttaattatagtctgctattgtacgtgttcttagaattacttagttaatgcaaaggttaatggtggtggtaggttttgatgaccgatcagtcgtagggtcaatctatgcaaggtcttaaattaactaaagatggatgggttagctagtgccaagcacgtatgcacggaaaagagagcactttttcttcttttgaagactgaaaagatttttaaagagagcaagttatgagcacacgattacacatgacacgacaacaaattggaatgcagaggcatgactaatttccgtcataaaaattaccaacaaaaatggtagcataccgtacatcgaccgagatgaacattgaacaatatgcaacaaaaacctgcaactatgcaacagaaacctagcttagtatatatatatgtatatttgttcaggattaggatagatgttatatagtttataaaaaaaaaaagatatatagatgctatgtatgtttataagaaaaaaaatcgagagtgcacgttttgtgatatttccactcattgcctctcatattagtataactaaaatggaaatttagatagttatcaacttactatatcataatgagtacatatgttcatgtatcatggtgcattaacttttgatgaggcaggtaaaactacttgtttgttagatagtatacattctcaagtgcaccttcttttcttttcagcaatcgcttgtacactttgttttttatattacccatatggtagccatatgtagcgggagtatgttgaatatgagacaacgcgtttatttccgcgtgcaaccataaccatgtttaccgagtcatgcgagctattgagttacgagtaggctacaatggcataaaacaaaagtttctaccgcgtaaaccaggaaccatgcgaagaaagagatcatggatcgtaaccactcgacgtgacgactagtggaagaagagtcggaacagattggttcaatgtagaacatgtcggtgtagcggaagtagttgactgcagcaacctgattgtctcctcctcgcacgagcatctcctcctcatgttcccaagccgatccgtgccgcaacgcagcaacgcctccaccggtatccaggaaaggaacggcgtgcgtggtcgtgctagcacctgtgcgtggctagggttagggtttggcttgtgatcaggaatggtggctagggtttcccacgtgtgatgtcgcttgcttcgtgtgctcctagaagtccaacttggatcctctttcgaattgaaccattattggatctccatttaattatcttgttccaaccaattaaatgtgcaaccccgtaggttcatacaaactcgttgcaacctgaaaatgcattttcggtccacgtgtcaacaacggctcttagcagaacgtattgaaccactgagtataccaaagatcatatcgactgaaccacttttagtttatttgtgtatgtctttctttttcatctttttttttaaaaaaatatcaaagtgatagtcgatcaggtttcacatcgtggaatgttgaagtaatttgatcacattgtcatgccctagctaatcgtggcaataggtgagtatgatatactatgaaaagccaagacaaagattcgtactaaatctgttaggtccattggcattagagtttctactttcatttaaaataggactacgtgagctgtaaataaataaatgcatttgggatttgtgtactctcttataggagcactacgggtgttccaacaatatataatttctgaaagataaaagcatacagtgattaacaaatgacagaacggatttcagtccaaatatttttgtaattcagacaacagagcgcacatcttttcccacatgcacaatgggacacaagtcaaacaagctagtgacatgccaacaaacaacatcactagtgtagtatcagtattctactctttgccactgcataagagctagccagcccatctatagtcgtcgcgattcatgaaatcaccagggaattgaacttgctcatcttcttcctcatggctaccgagatgtcgtggctgcacgcaccaagagcctcgctctggggtgtctggtgagtcttccctcgcaaactctgagccaagctcaaagatgaagggacgacactggaataggagcaagatggtcgctcggaatctcgccgtcaagtcggctttggacaccatcaagttcagtaagacgatgcagcgctgccgcctgcgcatcggcggtagtagcatcgcttgattgcttatggtcacaattctcgcaccaaattcagaatttgaacgaaatgttcagtaccaggttcgtgttagcagtgagatgaggtcatgttgtcagtaacttgggttagttgagtactcttccatgattgatggcattagcatttagccacttaattacctctttgattgtctgagatgctgcagcttatttgaaaatccagattgggggatttagaacaagaacacactctcctcttctgattatgaaatgaagaatcaattacaagcagaaacaggagactatctccaaatgctgattacaccaaaatatattggacacatttgaattggtataatttatttaataattcatcatcaagggcatttggtctagtggtatgattctcgcttagggtgcgagaggtcccgagttcaattctcggaatgcccctatttttttttcttttttttccactctcattgctactaatcaaataaaagctttgccagcaaaattctgaatcttctttttttgcgaaatttcctgtgctgataaagcttccccactcttacttatcaaacgacttttttattatgtgaaatttaatatgctgataaaaagcttctccattcttattattaatcaaacgaaagtttccctgcaaattctgggtttttttcccctgttgaaagaaacaaattctgaacaaaatttgtgtgtgtgtgtgaaactttgtttgctgattaatgttggcgcctataggaaattcctccccattgacaagttaactaatctgattaaccaagaatcccaagattaaaaaaggggatggatgtcataatcacaattcacaatttcgcaagtcataataatcaatcataatggaacagatacataatgcagtttcagnnnnnnnnnnnnnnnnnnnnnnnnnnnnnnnnnnnnnnnnnnnnnnnnnnnnnn

SEQ ID NO: 7186 - DNA, 22219 bp, Oryza sativa
ttgttccccagacgttttcccggcaaaatagggagcaaaggtgaccaacacccttctgtaaaaatcatgcgtttgccgtgaagaaaggatacaacagaacagacagacagacagacagatacaccctctttgtatatctttgcttttgccatttgattgtgctattgacatgtgggcccagactgcatgtggcaactgatttatgaaaggggaaaaagattcacattttactgggaagttggaattttaccactcgagcaaatgcatatttgttgctcgtcactcctcaaaaatgaatcagatagttataaaggattctgaaaaaggattcaacattgataactaagcaacttaaggtttacagactagagaaacttaaggtcatcctcttgctgctccaggacaattgttgccagtgctcgtcggtatgccgctgatcttgcattcctaacaaggacacagatgtctttgcgcttcagattttcatgtgtccattgctgccgcctcaacaccgcgagaagctttgcttcgcagaaggcaattgcaacagcatctcgcccactactgtaatatgtaaaacagattgcagttaaggtttattactcagaattgcgctggcatgtagcgagggggactggggataggcaagattaccttccatggacaaaacccgtcgtgacgaagcctatcggtgtcgaaactagatttcggcaataataaaagggggtggctatcaagctaggaaagtgtatgggtttggagacaaaggatttatacaggttcaggccttcttataaaagaagtaataccctactcctgtccggggatgaatccgccgagtgtattattgattgtgtgattcgggaaaaaccaacatatgcccctataggcgcccagaccccccttatatatgggaaggagtccgagttacaaaagataacctatatcccttacggaatatgaaaatataggtaagatacagtcgtaaccgactaagtttcagggtgtttccatgatacacaagttaagaaacaaacccaagatacaaataagatattctatctacgttaggtatcctgtacccagttcgaataccatcgccgtgtagatatgggatacccataatctccacagtagcccccgagtcctttgcagtcgaccatcgtagccttctcaaagatgataatccgagtacttcaaactcttcaagccaaaacctgccgagtggactgtaaagggcgaaaagaagaagaatatggtgcatcgaatagatgcacctaattaggtgtagcccccaactatgtgattagttaacaaactaaacatatagttgaaagacaaaataacaacacaattgtgcattatatgacaaaagcatatgcggcgccaaaataggcatgctaaccgactgctttttagccacaataaaagaaatccgagtggtttacactctaaaaggttcacgaatgaacacacttgacaggcatccgaataaaaattctaaagattacccatcaagtattataaagattatggtaataaataagtcgaatagcctaggccatgactatttaccatgaaaacaggcatataacacgccaaggaaatgattataataaaaacaagtcattcctagttaacccaaacagcttttgtagcctaaaaaagcttgcaaaaacagcataacgcctttctgtcgggcacctttttaatttgcattgcaataattccaaagaattatatgaccgcataaaaagggtttgatcagcattgggcaacactgttgtgcgcataatattgccaaagcaaaatatgcctaagtccctaaggaacacaatgggccacgctgttaaaagtattgggctgaagtactgttcaggcctaagcccattagcacctccgatacccttaactgaaaaatcctatatccaagcgacgcttcgtcttccccgccggaactctcgccattttccccactccctgctacagtgcgaagctgcgccggcgaactagggttcacaactccggccaaatccacctccgaaaagtgcatcaaaatccttcccgtgatccaccgcctcaattcctcacctctcccaagccatccctcgaatcaaatcagcacatttgagaaaaatcgatggcggaagagagagaaagcttcgaaagccaatgggtgccgtccgacgtgacggaggagaacctgaaggagatggtggcgcacggcgttctcccagccaaggagatcatcgggtggcggccagcgtgcggtgaggttttcccgacccctgatacacatgagatcgtagtcttctcgcatttcttctacggtggctttgctcttccgacctcaaaatttttccgcgggatcttgaatttctatggaatcagcttgcatcacctaaacccgaattccatagtgcatatcgccaacttcgtccatgtttgtgaagcctttttggggatcaaacctcacttcgccctattccgccggatcttcttcctcaaaccccaaccaaacaagaacaaaccgtgtgtagtcgggggggcaggattccaactaaggggaactctgagccaaaaatatttctcgatgcccttcaagacttcgaacaaaggatggcatgcaaactggttctatgttcagaatcccgagcctgctcttcccgggtactcttgtcttcctccagtgtgccaagatacttggaactctcttccaatcggagatgaagcagtacaagccttggagttgttggatcgtatgttaaatcttaaagaacaaggcttacagggagagcaaatcactcggcacttcatcaaatgccgactggcgccaatcaaggaaagatcccgcacagcattcgagttcgacggcaaacatgatcccaaccgtgaagaaccagactccctggatttcaaaatcatgaaggagaggatgtataaaatcttctcaaatgcaattgtagtcagctactctcaccaactgccagttgtgccatataatgcattcaatccgcctccacaggtatgcatcggaaaccctcaaaccgtgatcagaacataattttatcttcatgctgagttgactaactatggaagcatcttgtgcaggaatatgcattgatgaagtcagatccaccagtctctcagcgccggtctcctcgccaacacaccgctcagggaggtggagggccaacgatcagaccagatccgcaacctcagacctccaaattagctggtcaaacaggtcctcgcaagagaaagctggtacttgatgatgatgaaggcgacgatgataattctggggataagggctcgcctaataaacccccaaagcgtaccatgcccaggaaaaaactggctggccgtgcaatgccaaagatcagaacatcttccaggtattagatctctcgatatgattccgcttcggcatgttttgcccatgaaaatgatgctgaatactgaaagaacactttgcaggaaaccatctgatatagatccatctggaaaagaccccgatcctgccatgacagagcagaatatatccaaggaccccgagccgactgctgaaaaccagccgaccgctgaaagtcagccgactggcgcccatgcttcgggcgatagagccaatccgagtgacctgccgccgactggaaaccagtcggcaacaactgaaacggcaacaactcaagagcccccgactggaaaccagtcggacgcaggccctgatcaagagatccccgaagtagaagcgcagacgacgacttcgcaaggaccagaagctggtaacgactcgatagctgggtcgtcaggtaaagaacaaagatcacctcacgctcagctaggtacatcttcaggttagttgtcttctcaaacaatggcgatttaaataacctcagtgtatccgtctaatgtcttggaaacacatcaggaccatcaggtgatgacggagaagaaatccctcgcataaaggcgaccgacgactctcgtcctcctatcttgatcaaatggtgggatgagaactcacaagccgccggcatagtcataaaccgtcaaaaagaagatgaagaagtgtgccagctgaagaaagcgctcggagaagccactcgtattgtaaatgtaagtcttccgagtgacggccttcggtaactttgttttctttttagcagaactgaaccatgatccatcatgcagagaatccatcttcgcaatgaggccaagactacaactttggaaaagctggttcctcatttgggaactctagaagcagttagggaccagctgcatgaggccaaggagtgcgccaaaaagacggagaaggagttaagggaccgaatcgctcagctccaggattcaaactatgagctgagtggttcatcaaaaggtaatccctagatccgtttcattggtttaaactggcataactgtatcctcaaccatctgaatttcaaacagcgcaagccgccaggatggaacagatggcgaagcaaattgaagccctggagagagacaagacagaactggttgcgcaaagggactcagccttgaaggaagtcgaaggtaacgccagctgacaatctgagcttctctctttataatgcaataaatcctcatcataaatgtgttttgtagatcgcaaaataaaatcgcaagcccaattcgacgtcttggttggtaagatcaagaggcttgaaggagcaagggataacgtcgccaatgccgctgcaccaattatccaagccatgttcctcaataatggtggtccgagtgcactcgacgcaaccgaaatatttgacaagctgagtgttgctccggaagtatatttcaagaatatcaagaaagctggaagtatgggagctggcatggccttggcgatgacaaaatccttgtacccgagaattgaagtcgacaccattgatgggtttgcagacgggacaagtgaagaagctgcccttgatcttatcagcagtgcgcaaaatgcggctgacaaaattgcgagtgatgttgtagaacaatttcgcaacaacgacctccaaccgagtaatgaagactctgatgatgaaaggactgattctgactgagtttgaatgtaatacatggaggctcaatttgtacaatactggtgtatttatgctgtgcttgatgattcttgcgaagtttttgatttcttaaaagtttttgctaagctttgttgagcctaaaacccaaagaagctattaaaaactttcagtcctcgcaaactaagtagaaaaaccaaacaaggcaatgataaaccaagcaaactgaattgataaaaaatcacactccattattatgatgatagcccccgactgacaacttcaaggagaaaacttgatgtttgacagtcaaaatagggaaatacaatggtaaagttaagcgtagaaacgacgaagatgttcaatgttccaagagttgtcgacgagagtgccgtcttcgcgcttgagtcgatatgaacctggccgggtgacttcagagataataaatggcccttcccatagaggagataacttgtgccgatctcgtgtggtttgaattttccgtaaaaccaggtcgccgactagaaaggcacgagatcgaacattgcgattatgataacgtcgcaacccttgtaagtaccgagcggactgaatcaaagctgcttcgcggacctcttccagtcggtgcaagtcgtccactcggtcttcttcgtagcgttcttctcggaagttacggaagcgcaaagactcaaattcgacttcactcggcaacattgcttctgccccatagacaaggaaaaaaggtgactggcctgtggcccgactggatgtagttcgcaaagaccaaagtactgacggcagctgttgcacccatttaccggcatagggttttagccggtcaaaaacgcgcgctttaatcccttgaagtatcatgccattggctcgctccacctgtccattgctcatggggtgtgccactgaagcgtagcaaatcttaattccaaaatcctcacaaaagtctttgaaaactccgccggtgaattgtgtgccattatcggtgatgatccgattgggcactccgaatctgtgcacaatgttgatgaagaaatcgcgagcattatctgctgtaatcgtgacaacaggcttagcttcgatccacttggaaaatttgtcaatggccacgaagaggtgcgtgtaaccgccgactgcctttttaaacgggccaaccatgtcgagcccccaaaccgcaaacggccaagacagcgggatagtctgcaactcttgagctggtaagtgaatttgtctggcgaaaaattggcaaccttcacatgtgcgcacaattttgtcggcgtcggacactgcagtaggccagaaaaaaccctgccggtaagctttgccgacaatggtgcgcgcagcagcatggtttccgcatatcccagaatgtatatctttcagcaattgtctcccttcctctaaagatacgcagcgttgcagaattcctgaagggcttttcttgtataactcagattcgtgcataacataaagtttgctccgccttgaaatccgctcggcttcatctttatcttgagggagctcttgagaagttaaaaaccgtatgaggggctctcgccagtcggcttcaaccatagctacgtcatgagtgtccgcatcttgagtagtatctttatgaggcacggtcggtgtataaaggtgttcgacgaaaacatctgagggcgccggctcacgcttggatccaaaattggcaagtctgtcggcggcttcattgttgtgtcgaagaacgtgactgagctcgagtccatcaaatttgtcttccaatttgcgtacttcttgtcgatatgccatcatgttgtcgtcaaggcaggaccactctttcataacttggttaacaaccagctgtgaatcgcctcgaactattaaacgctttatccctagggaaattgcaatccgtagtccatgaaggagcgcctcatactcggcgacgttgtgagacgccgaaaaatgtatccaaagcacataacttagtctttctccagtcggggaaattaaaaccactccagctccagtgcccgaaagtctttttgacccgtcaaaatgcatggtccagtgctctattttctccacgggggtatcctcttggcgctcggtccactcggcgacaaaatcagccaacgcttgagacttgattgaagtgcggggcttgaatgatatgtccaaagacatcaactccaaagcccacttagcaatccgtccatttgcttcgcggttgtgcagtacatcgccgagtggaaacgatgtgaccaccgttaccgggtgaccttgaaagtaatgagacagcttcctggtagtaattaaaataccatataacagcttctgaacctgagggtacctcgttttggagtcggccaggacctcgctgacgaagtagattggtcgctgaactttctggacatggccttcttcctcacgctcgacaaccaagactgtgctcacgacctgggaggtggctgatacatacagcaacaacggctcctgcgggtgtggtgaagctaagaccggtggcttggtgaggagttgtttgaaatcttcgaaggccttctgtgcttcgggtccccattggaaattatctgttttcttcagtagcttgaagaagggcatccctcgctcgccaagtcttgaaacgaatcggctgagcgccgccatgcatcccgtcagcttctgaacatctttctgggtgcttggcggtttcatgttgaggatagcagtaactttctccgggttggcttggatgcccctatgagacaccataaaaccaagcagcttccctgacggtactccgaaggtgcacttttcagggttcaatttcatcctgaaagcacggatgctcgcaaaggtttcttctagatccgagatcaaatcatccttttgtttggtcttgacgactacatcatctacataggcttcgacgttgcggccaatttgtgttgagaagcatctctgaatcatacgttgataggttgctcctgcattttttaatccaaacggcatggtgacgtagcagtatgctccaaaaggcgtgatgaatgaagtcttcaggcagtcggattccttcagtcggatctgatgataccccgagtagcagtccaaaaaactgagaagctcacagccggcggttgagtcaactacctggtcaatgcgaggcaacccaaaaggatctttgggacaagacttgttgaggtcggtataatcaacacacatgcgccattgccctgttttcttccgaactagaaccgggtttgccagccagtcgggatgaaggacttctttgatgaagcctgctgctaacagcttggttaactcctccttgatcgcgtccttcctgtcttgtgcaaatcggcggagtcgttgtttaataggcttggcgtcttctttgacatgtaaggagtgctcaatcacctctctgggaataccgggcatatccgaaggtttccacgcaaagatatctttattattttgaagaaaggtgatgagcgcgctttcctatttacaatctaactcggcgcctattacagcagttttggtaggatcagaaggatctaagggaatctttttagtctcggcttcggtttctccactttttgaaatcttggcagcgggcacttctccttcgctcaccgtggttgcagccagtcggatttcctctcgggcagacgccatctcgcgggtttgggccatgtcgcaactctccttgtcgcatgtgacggcttgcttgatgtcgctccgtagggataggactccacggggaccaggcatcttcatcatcatgtaagtgtagtgcgggacggccatgaacttggctaacgccgggcgtccgagtatggcatggtatgctgtctcgaaatcggcgacttcaaagctgatgttctctgtgcggaaattttcccgagtgccaaaagtgactgggagggtgatctggccgagtggagttgcggataatcctggaattactccgtgaaaaggcgcattgcttggttttagctcagagcgaggaatctgcatatcatccagggtcttagcgaagaggatattgagtgcactgccaccatcaatgagggttctgcgaagcttgacattacggaccactgggtctagtaccagggggtaccgccccgggtggaccactcggtcaggatgatccgagcggtcaaacttgattgcaatctctgaccatcgaagatactggggcgtgtcgggctgaacagcattgatctcccgttcagtcaacttctgcttccgtttagactcataagccagggggccgccgaagatatggttgagctccttgcggtggtcttgaaatccaaccggggtgtcgccgtcgtccttcttccttgacgtgctttgttcctcgtcggagttcttccgagtagacttggtgtattgctccgcgaactgcttatagatgaagcactctttggccacgtggttggagtttggatgatgcgggcattgggagttcatgatcttgtcgaaggtgttgacgcgcgaacgctgtcgagaagagtgagcggcggttgcaacaagttcctcaggcttacgcttgcggtccttatgattgttacttccacctcctcccgtagccggcgtatttttcggcttccaactgggacccgactgcttcgatgcggtgacggcgtcttcggctttggcgtactcgttggctttttcaaacatgagcttgactgttctgggaggtttgcgcccaaatttgccgaccaattcttcgtggcgaatccctttggtgaatgcggcgatgatgacgtcgtcggtgatgtcggagatcttgttacgttgttcggaaaatcgtcggatatactctcgaagggattctccggatttctggataacgttgtaaagatcatattgtgtgccaggacgctcgaaggtgccttggaagttggcgatgaagtggtcgcgtaattcagcccaagatccgatcgtaccacggggcaatccatggagccaagatcgggcggaatctgctaaagccaccggtaaatagttcgccatggccttgttgtctcctcctgctgcgcggattgcgagaccgtagacggtaagccacgattcggggttagtggtgccgtcatacttctctattccagtcggtttgaagccggctggccaatccactcgacgcaggtcgtcggtgaaggctgcaactccgtcaaggtcgtcgtcgcggcgatccggcgagtgatggtagccgcgagctgctcggcgctgtatgattgtgtcgcgaagatcgatggggcggcgacgaggtggtgagcgaggtcgttccactcggcgctccctatgaaggtcgggaggtgagtgaacagaccgctcgtcgtgacccctgctcctgcggttggatcccgcgccggtgatgctgaggcttggatgacggtagtcgtgagatcggaagtggggaactcggctgccagtcggcgtgtggacgctttcggagttaactgggaccgaggccgcaatcatggtcttcgtctggttcaagatgttgacgacgtggtcggatcgattgagctcgttttggttgagtagggtgtcgagaagggtgatcgcggcaaccgcattctgttgaggggtgcggaaaaccggtgtcccttcgacatcttgttggccgatgagatcacgcgctcggcgccctgcttccaaagctcgctgacgtcgatcctcagcctccttggcgatccgctcacggtcctgctgctcacgccgtagccgttcttgttcttgtgcttgatgctcctcctccagtcggcgacgttcttcggtttcccgggcttggcgttgctcctccgtctcgttattggccatgaaaacgccaaagtagagaggagtgtagttgtcatctaggcttccgtcgaagtcgtcgaagtcgtcgaagtcgtcgaagtcgtggtagcgagagctgaactcatcgtactccacgatgtcagtaggacgtgagtcgacggtgggagagctgttgtagtcatctagctgatccgtcgaaaccgtgccgagtggttggaggatgacgccgacttccctgaagctaggcgaaatcggtgttgaagccgacttccgcctaggcctacgggatgaagacgctgtcgtggtgaagacggccgctaaatcgtcggggagcttcatcaggactggcgggtaagccccatcatcttgatctggtgtcgttggagaagatgcgatctctgccgagtggtttgaagccgactcgattgagatggtcttgaagtaagtttcagccgcgtttgggaatccaaacgggactgagatccggttctctcccgactggtccgattccgagtcaaggagagaaatcttgccgaagttgttggtgacgaagtcgaggctgccgaaccgaaacgtctgcccgggtgggaagacgaggtcgtcgatgccggaggaaggacccattgcactgatcggcgaaaagcttgacgctacccctacctggcgcgccaactgtcgaaactagatttcggcaataataaaagggggtggctatcaagctaggaaagtgtatgggtttggagacaaaggatttatacaggttcaggccttcttataaaagaagtaataccctactcctgtccggggatgaatccgccgagtgtattattgattgtgtgattcgggaaaaaccaacatatgcccctataggcgcccagaccccccttatatatgggaaggagtccgagttacaaaagataacctatatcccttacggaatatgaaaatataggtaagatacagtcgtaaccgactaagtttcagggtgtttccatgatacacaagttaagaaacaaacccacgatacaaataagatattctatctacgttaggtatcctgtacccagttcgaataccatcgccgtgtagatatgggatacccataatctccacaatcggccatctgaacgcctttcgtgtagaatcatcgtttggcagctgaagattgctggtgctaggatccagccaagagaaataagaagttacatgggattgagggagctggagttcccatttttctaggcgttcttcttcgtcctcttctgatctgttagatgcataaacagggatgagcttcgtcaattgatattctcagcactcatctcatacagaagaatacagtgggatacagaaaaaaaagatctgaacaaatagcagaatctagcaaatgaatatatttaaaacttaaaagccagaatcaacttaagaaattagatgataatcaatcggacagcaccattgatccaatgttgtaaagtcacttgcaagtgaaccaaaaaatttacagctaaatgaataatataccctcgtcatgaggtgctgaagaaataaattgtgagtactgacctggttttctggttccaggctgaaagatctgatgggagtggggcacaaacaacagcaccctcttcaaaagaaccttccttaaatgctctgatcagcacccttacaagacataatctgtttacagagcatcctgttttcacattatcaccagaaactagactggacttatcagtaactgcttccatgacagatgaacccaaatacttctcatgaaattctttcacatgatgtctcaacatatggatggttcttggcacgagtagttggaaggatgtaggagcatctatttgcgatgattctgcatcaccagagttggaatttactgggagactttcagataatgctgtagcgacgctctttaagtcatctacttcaagagtgctcactatgccatctcctttacgaaagttagcaatgatacaatgccacaaaggtgccacgaaagttagcaatgttagtgtgaacgcaaaatatgatcttgcggctaaacctaaagtcggcaaagagatattttgtttagggcgatcgctacagtgatcgatctctcatgaacatccctgatcgggggataaccgccataccctagtgtcggttccccctgtgtgcagtggctataaatagagatcaatacctaagtgttaaaccttaagagatttctctcgctacccgatcaagcaacccactgaaacacagggaagaaccaagacacgattctctctgtgcttccaaactagaagagaagaaagaagaacaaagacagagagatgggaactccaggagatcaaggtatgatccaatcccatttcaatttgtagtcccactttgtgccaaaccgatccaaagcaatccaacaagcaatgcatacaatggccaacgtcaaaggcaactgatacgtgggcgagaggcatccctgccaacttgagacttcagcggcaaccaacgtaggcagtggcgtcgctgctagtgacagtgtacgagcagcctgtcgaacttatcgtaggaagcgatgagccgatgaggctgtcaattgcctttattgttgagagtcgcttgcaggaaggtaatatcacacaattgaatgcatttcagagttagactgaaatccgcatacctttttttcaactgcgcataaggattgtgtatcttttatattaagactttagaaagtttgatgactttagtctttagaaaaaacatagtgatggctaaggaagacgcgggactgggcatcggctgctgattccacgaagcgcagtgaggcggccaagaccgacagtatcatcaaaatatatgattctctcgcagatcaagcgtcgcaactacggatgaagatggtgaacttgtaggcgacgcccgtctcccctccgccccggctgcgtcgacatccttcccatcttttgctaggaaactattctaaactatcgagaggacgtcatcttgttgtttgcatgttgcttaaaaaagtgtgggggagagagagtggtattttcacatgcgaacttgttaagaggctcgcttaggaaaattgattttttttgcatgcggtcctaatgtgcttggagagcatttttttttaggtgagagcagttatgacgcacctgcaacctaaaaaggtctcgtccagaaaaattatttatgcagcaatgaaagttgattttagtacatcgagttatttactacttattatttctttataaatgtgtatcacatctacaaataaattttggatatgcagcacggtgcatatccaaatctctactattataaaaattgaagatgtttttcctggtactttgatatgtcatccgtgtatgagtcggttttaagtccgttcgcttttgaaaatacagatccgtatttgactcgggttttaagttcgttcatttttggaaatacaaaagtagtcgtataagaaatctctttaaaaaattcgcatactaacttgagatgatcagacttttaattatagctcatgattttctagaaaaatatatatccaagcgaattctcttaactaaaccgtataacaataataaaattaaaataaccttcacccgttacaacgcatagtcatttttcctagtaaaaactaatttatcaaaaacagaaagaaaaaacagcttttgttttctgaaggaatacaaggcttaattaggaggccgtcctatcgatcggctgatgacggcggcgccacgagcgaagacaggacctcatcggtggtttaagccgctggtgaacccggcattcttctccggtgaaatgtgggccgccgccaagcccaagcccgcgtccgtgccaccgggtttctccaccttgccttcgggtttgttcttcacggtgcacttcgccgatgcgaggggcacggtggtggcggcgacggtgaggaggatgaggagggcggcgagggtgaggttcgccctcgtcgggatccttgaagacatgtttggggtaggggggtggtgtttgaaaatctgcaagggaggaagcaagtgaaggagatgtatttgaatagggaggggaaaggagagggctggctttatttggcgggaaatgagaggtcaggttgttcccggacaattttcccggcaaaatagggggcaatgctggccggtgacttgcaagttgcaaccaacaccccttcatgcatttgccgtgaagaaaggagaggacacaaccagacatgtgggcccagactccatgtgacaactgatttatgaagggataaaaaaggattcacattttactggggagttggaagtttgccaccctgttgcttctcactcctcgaacatgaatcagacagctgtaaaagattctgaacaaaaaattacaacattgataaataagcagcttaaggtttacagactagagaaacttaaggtcatcctcttgctgctccaggacaattgttgcgagtgctcgtcggtatgccgctgatcttgcattccttacaaggacacagatgtctttgcgcttcagactttcatgtgtcctccattgctgccgcctcaacaccgcgagaagctttgcttcgcagaaggcaactgcaacagcatcttgcccactactgtaatatgtaaagcggattgttcagttaaggtttattactcagtattgcatcgttggcatatagtgagggagactgggtgaggcaagattaccttccatggacaaaacccgtcgtgacgaagcctatcggccatctgaatgcctttcgtgtagaatcgccgtttggcagctggagattgctggtgctaggatccagccaagagaaataagaacttacatgggattgagggagctggagttcccatttttctagacattcttcttcctcctcttctgatctgttagatgtgtgaacagggatgagcttcttgaattgatatttcccagcactcatctcatacagaagaatgcagtgggatacaaaactaaaatgattcaagccagaatcaacttaagaaatcagatgacaatcaatcggacagcaacattgatccaatgttgtaaagtatcacttcagttgcatgtgaactaaaaaatttacagctacatgaataatataccctcatcatgaggtgctgaagaaataaattgtgagtactgacctggtcttccggttccaggctgaaagatctgatgggagtggggcacaaacaacagcaccctcttcaaaagaaccttccttaaatgctctaatcagcacccttacaagacataatctgtttatagagcatcccgttttcacattatcaccagaaactagactggacttgccagtaactgcttccatgtcagatgaattcaaatacttctcatcaatttttttcacatactgtctcaacacttggatggttcttggcacaagtagttggaaggatgtaggagcacttgttggtgatgattctgcatcaccagagttggaatttactgggatactttcagataatactgtagcgacgctctttaagtcatcttcaagattgctcagtatgccatctcctttacgaaaactagcaatgacacaatgccataaaggtggtacaggaacccttggaggtctcatggaagaagggcggcagttggtagctttatcgagaacagcagcctcttcagccataaataatgaataggctttgctgtctggataatcataagggaagcatggcatcttgagctgcaaatagagggatcagtgtattgctatagaacaaacttctcacaattaacaataaaacataaatcaaagctgcacaatcctcagcttccccaaggctgtaatcttactgttactttaactatatcaactatttcatactattgaatgaatacagatggcaatgttaaacatactactgcaccaggaggccaatcaccaatagtaataacataataaatttgcaaggatctaagattacatcattagcttgttttctggcgcattctatctttttatcaataacaatacctttgaggctatccaccgtctctctcttaagccaatagcatgtgcaccatgagatacaagataaaaccagaaaggttttacccaactcaaaggtagaataacagaccacctgtgaagtcaacaaaaatgaaacaagatagctgcacatcaggatgatgacataacaatagcatgtagagaatcctagcttttaggaatattatcgcacaatcctctcaaacaaatcattgccagtaaaaaattattcacaaatgcaccagaaagaaaacagatcattgttagccaatgttcaacaaataatcaagcaaaattagtgataacagatattgaataaactttttataagaagccaaagctaaaataacttaaaccaatatgagcatgatacactgaggtaggtctagttctcatgttaagacttatgatggttgcacttctattatgggaccatataagagctaacataaaagagcaggacagcaaatgtaacatgattgagaaaatgggccttaccctacagagatcagactgccttttgcatgtttcagaagaataacaggacaggatcgaccaatggaatccttctcttgacttgtttgtccttgatcatttccagaatcaaggcagaaaaacttcatacgtctgtggtgtttctccatacaaagaattttctcatccacaggaggatttatcttaaggctggaatcccacaattctctacagtctgaaagggccaaatcgtgatttcctgggttcagccatatcgatgacaaaatattcccaatccctgatggtgtctcatcagcatttggaacttggtattcctccatgagttggttattctggtccagggaaactgttttagaagaatctgttccctcgactgaattatctctggggtcatggactatcatggatagtatagcaccagactgaagaatgtcagcattatcaaaaacagatcttttcaaaagatgagagccagtagagcaatacagaggatcagttgatgtagtcacattatttttattaactagcttggtggatatacttggactgcattcattgaaaaaatataaattagcacagctcgacatcatctttttctccagccaggagtgaccactataattttctcagggaaagatgaacttacttgctaactggcttcaatatactcttaagagattgcatagcattgcttcccatgacttctaatcttgccattttcccctccagtgagcaacaactgattgtgtcaccagattcttgcatctgcaatgtaagaatgacattactgcacatagacgaacaaatgaagcaatatttctaaacaaatgtttatctcaaagctcaaaagctggaagctacatgtagcagaaaaaaaatacaaagaggactaacctgttgatgacaagcggctcttaatgtttcaagcccttcactgagagcagaagggtggatccatatccataattggcgccgtaaagaatttctttcatcagatataatttgagaattggacaaatctacatcttcagtctccaattcaccaccctcccttaaaaatggacgccacatgtatgtcaccggcccaacaatttcgaggtgaggacacccaacacggcaaagctggaaaatacaattaagtcacatttttcattccaaacaatcctctacctatgctgtctgtggtaaatgtataactaccatagcattctcatagcaaacacctcgcataacttgaccatgcagatgcttcaagccaggagttttatcttgaggagatggatgcagaaccattctgacaatcgataacagggagtcctacgtcagttagccagcaacataattagtttctttaagtataaaagaaataggagataagcaaggctaaaaaggaacatagagaaacttgtacctctggaccatctagctcaactggagtgaagtagctagcatcatgaacaactgttccatttttgagccacttcagaacagttcttgaaccccttcctctgcatgatagaatgtgaactgcattactcatttgaatttacatatatgataaaccttagcatgaaggtcatgaagatagcgtaagataaactacatgtaagacatcaacctctacattttgtacaagaatttattgcactctcctcaaggtgatgaaactgattaagaatttattgcacttacaagacgaatgttggtatgaagaacactagcttaatgctttcataatttgattgcccttcaaatcggtttaacttgctctgctagaattctagaactgcctaaacagtggtgcccatgttggactatgaacaaccagaacgagcatataactcttgcctttaatcctttctcactagagatgagctagtggaatacaaactcaccaaaaaaattacaaaatggaaagcaagtggaatgatgggaatttcttctagtataaatgagccccgccaatgcaatgattacaacccagtgagctcatttcaagcttgtagtacactcagatcaaatacaatctaacacagaaattcagtaaagttaatttaacacagaaaattcagtaacgctgtactatttcccctctccgtatgaaagtcaggtcagattatcatctactatcaaggatcttgtaatcataaactgaggattcgaggcgtacctcccatgggcaccgatgggcaagacgaatccccaccgcctctccatggagaacctcttggcgtgccacaggtgcgtgcgcagccgccgcgcgccgtcgccggcggcggagaacccctccgcggtgttgcccgcgagctcccgccgccgcctcaccctcctcgagggccttccctcctcctcctccgtaccgtcggccgcctcggcatcccggcttcggcggcggcggcgcttgttggagggaaggtggcccgtggtgcggcggcgcgcggagcggggctgcgtcaagcggccggcgaggcgggcggatacggattcgtggagggaacggagctcgccggctcgagccgccgcgaagcgccgcacgtcgagctgccgcggcggcgggggaacgccggccatcggagaggaattttctttttctttttttttttttggctagcgggagagagggttttggagagagattaagggtttattatggacacttatgcaattagccccttcactgttaataaaatttcattttggcctctttttcttagcaaaattttattctttatcatacacgagtctagagtctagattagtcgcgccggccgccacctctctccctctcccaccaccgccgtccccgctccgccaccggccacctctcttcccctctgccgctacaccagatcgagagaatcaggagagaagagaagagaaaaagaaaagaaaggagaaatatgggcccataccattttctctcatgtatatgtggggctcgtatattgattttaattattttgctgactaggatgctacatcagcgaaaccaggcatctatactgtatcgggacttttttgaacggttatatatagtttagtggtatacatttatgatattacggttataggacctcaacagactcgggtaaaaggacggccagtgaacttattcctaacgataactagaggtctgtgtaaggtgtaagttgcgaagtactagtacatattaggcctaatagaaagattgaggccctgggatgggccgggaactacaaggcctgcaaggagcatgtagtttggcttttctgacctatatatattcaataaatattaaagacttgatgtgttttctaacaatgaaaatggtttatatctttggtatatatctaccaatagacacaaaattaatgagtcaaaaaataaaaaaaataaaaatactactcaaagtttttttaaataatagaaatgttttacatcttatcttacatattgtggttgtacaacaacttgcataaaatgtaacatctctcttcttctagctatagggcaaagggcatgacggcttgtagctgccggaggggcgatcgatcgatcgactcaacgacgatatatataaccctagctatatctcgatctctggctccgtcgacgtgtatatatacgttcgccgacgacggcgagcgccgccgaagtaggcgtgaaagatccggtccaggtgagccgccgacgtcgccgaggcgacggagcacgccagctgccaccaccaacggatctctgctggtagtactagcagctgcgccggggaagaagaagaactcgcgagggtcgccgtggcggtggggcagcaaccgacggcggcgccgtcgtcgtttctcgcctcagacgtcgtcgtcgtcatggaaccagctagctagctgcagtgcccgtacgtcgccggtgagaatcaattctaaattaatttctactagtaatctaggagtatctagtagttagcttggtgtgtctattattctgggacttgtatactttaatcgcagtttaattatgtagaggtgagccgatcgatatttcctgggtctcagtctttgatagttagtgtaggactgtgaatcgacgatgatatcgattccgactacgtatgtatatactcgatcggccgatgaacgtatatacgttgagatatgaacgggaggcgaaccttacctcccgccaccgcgccctcctccctttcactccctcccctcatcgtcatcggagcgcatcgccggagaactgagcagccagctaggagggcggtggcgaggccaatccccccagggcgccacgcctctgtgcgaggagggcatcgaagacgatgcagggtgggcgcggcggatccaacatcgtcgtggacggatccggttacgctgcatgtggatctgccgctgccgcactagatctggtcagagcggtcgacagcaaggatgtcagcgtggcgatgaggctgcgagggcaaaggcagcgagagacccatgcagctgatggcaaggaggcgcagctagggtggcgcggtggtcgggcggctagcagctgggcatcgacgtcatctccgttggagctgacggtggtggtggcaccggcaccggcatagctcgagacctcgggcggcggccggattcgacgaggaaggcctggtgacagtgcgcaagagagaggcggcagaggaaaaggagttggtggcggtggttcgtcttcctcattgctggtcggcaccctattcctttctggagcttctcccctccttcgtgaggagtttttaggtcgggttgaggcagttgctggtcaacgagggaagctcaagttgccgaaccaatgt

SEQ ID NO: 7187 - DNA, 1171 bp, Oryza sativa
  unsure (1)..(1171): unsure at all n locations
gtttttaggtcggggtgaggcagttgctggtcaacgagggaagctcaagttgccgaaccaatgtcgttcagcctcgagttctacttttgctgaacatggcaagaaggctagctagcggatggagggaccgagaaggcctaggccaactcttaggggaggagtggtaggataaagcgagctggtggtagggtactacggcaagttcggaagtcggccaacgaagggacgccggtgcagtatggtggagactacgcacggccaatgggcctgttggggatggggagcagccggatcagaaccagactggagtcggtgtctgcatgcctataaactaaggctgtgtttagatccaaaatttggatccaaacttcagtccttttccatcatatcaacctgtcatacacacacaacttttcagtcacatcatcttcaatttcaaccaaaatccaaacttccccctcaactaaacacagcctaaacagagtcgggctcgcccgacgcgactgcattgattttggactagattttcacttttggagctaatttgggttacagggacaagagagattgggatttggagtaacgtcaacctaaatgagtacgtcttgcacaaagctctctttcgacaatatttgccttttcccattcataagtattatagacttggtgtggtttttctaaaaaatgaaaatgatttacatcttcattatatatctaccaacagacacacaattagggctgtcaaaaagcttgaggctcgcgagctgctcgagctcggctcgagctccagacgagccgagcttgagcttccaacgagcttagtaatatatgatttttgttgttatttaataaattagaaggtcaaatatgttatttgtatatcttatattgacatcatatatttattttattcttttttcctcttctattaatatgatgaactagaaattaattatttttttaaagattatctttgaaatatatattgttttacttaagattcaagctcggtagccgagctcaagcctaggcagacgagctcgctcgagctcggctcgttgacagccctacacacaatcaatgagtgagtcggagaaagataaataaaaagactcannnnnnnnnnnnnnnnnnnnnnnnnnnnnnnnnnnnnnnnnnnnnnnnnnnnnnn

SEQ ID NO: 7188 - DNA, 1116 bp, Oryza sativa
ttttttcccggttgatgttatcaaccgggactacaaatagatctttagtctcggttggtaacaccaaccggtactaaagattgaaaagtatcctgtaacttttaaaccgggactaaagatatttttagtcccggtttttaatacaaccgggactattgtaaaatctggttgaccgaccaaagatggtttctccaccagtgtcatatcatttgattcattgttaaatatactttcatgtacacatatagttttacatattttacaaatttttttaaataagataaacggtcaaatatatgctaaaaagtcaacggtgtcaaacattttgaaacggagggagtagcatggatcagctgccggagggcgatcgacgaacgatataaccctatatccgtctggctctagcgacgacgtacgcacgacggcgacggccagccgcgccggcgtcgaggatccggcccaggtgatcgccgccgacgtcgtcgatgcgacggagcacgcgatccgccaccaccaacggaactccggtggtagtagcagcagcgcgacctgcgccggggaagaagtactcgcgaaggtcgccgccgtggcggtggcggtggtggtgcggcaaccgacggcggcgctgccgtttctcgccgcggacgtcgccgtcgtcgtcatggaacctgctaattaagctgcagtgcccgtaccgtacgtcgtcgccggtgagaatcaattctagtagtctagaggtagcttgttaatttgtgtctataatattctttggagcttgtgttttaattacaatttatgatccgataatcgtggatccgagtcttaatttgatagtttgttagtgtaggactccgaatcgacgatgatatcgactccgactgcgtacgtatatactgaccgatgactggaccagctggaaggcttatcaaaaggaaaaagtacaccgaaggtccctcaacttgtcatcgagttacaaaatagtccttgaaccgcaaaaccggatacaacacgtccctcaacttacaaaaccaatgcaaattactaggtccctcggcggtttttgactccggttttatctgacgtgacagttgactcagtgtgggacccacgtgggtc

SEQ ID NO: 7189 - DNA, 13106 bp, Oryza sativa
agtcaaaacccgccgaggacctagtttgtactggttttgtgagttgagggatacgttgtatctggttttgcggttcgaggacgattttgtaactcaatagcaagttaagggaccttgggtgtactttttccttatcaaaacggcaaggcccaactacgcgtgggctgtacgtggcccagtactcaagctaaactctttcgagactcgattatcatcatggtttaatttctttcttctcttatgctagctctgaatattttggtttttattttttgttgtgaatataggtcttacgcaatcatttgattttcgtagatgatcatattttggataattatatatgtcaggtttaattatccatcgaaacaaccatatgcatacttacgcttacttttggctctgggagatgatcaaatagatgctgacatttgatgcatgtctagatatataggagtaaagtttcatccagccgctaactataaacacttagtacctttataaggtagataagaatatgagataagtacacatagcgtgtactttggctttgtgttagttaattgcgtttacgcgacagatcatcggtcattgtcgactctcaacttaattttagtccgacgaaattattggcaagttgcagcctgatgtcgacatgagaggccaaaactatattattaaactggtggtcagcagctgtgtgatgtgttcgttttccagggcgtttattacgtcgccctcactttcttcacaacagttgaacttttgtttgtgtggctaattattattagtatttcctttaaaattataattataatgatggatgataaacttgtgggtcaaaaagacgcctaaagtccactgtaaatggagtaaatataaatactagctatcaatggtttttaataggtaattaaatttcaatttgtgctgatagtgtctgcttcatatgcttcctagctagctagttttctcataattagttttgctagtagttttataattcttccttttctgcttcagaggatatactcctaaatatttatgctttctttttagaactcacgtgtggctgactaaagtatctcctgttgactgaaagtgacctttttctgctcaaagagcataaatttctttagaaaaaggaggaggaatataattctttttttttggaccatggaggaggaatataattctttttttgtggaccatggaggaggaggaatatacagaactcattatatattatctataactaaagtgacttatatatattctgacgtacttattatatatgcagagagaaagaaatatgggattcatatccataactgacatgacttatgctagctctgaggtacaaataacagaagatttcgaccttgcaagttgagaagaataagacttttcgatcgactactgtttcatattccatatgaaaatagttaaggttgggtcaataatgctacaaacaagaggtttgaaaacacaaaacgtacgagcaccaaactatgacttctgagagaccaagttaattgcatgctgtatggccatatttcagagaaacgcacggactttttaaaaaaagcaccgggaaaatgtaacaatatcagaaatatgaatattttgattatacttaaaatatggtcaacaatttttatttccattgagcctttgacaatgtctattttgatcagacgcatcatgttgttttcaacatgcaaatttgaccaatgcttttatgtgaattcgctcactcaattaaaaaaatataaagttgatttataacaatatatttcattataataaatctagtattaaatttaaaatttactagaaaaaatgcccgtgcgttgcaacgggtgaaatctattttaatcttattattgtcatatggttttagttaagatgaaattcactgtgagagttcgcttggatatatatttttttagaaaatcataagctacagttaggagtccgatcgtctcaagttagtatgtgagtttttttaatcagattcttatatgatttcttctgtattaccaaaaatgaacgatctaaacaccgattcaaatacgaatatgtatttccaaaagcaaacgaacttaaaaaccggctcatacacgaatgatatagtagagatatagccattctgaatacttcatataggtcaaattctagtattttgcatcatccatcctaaaatacaaacaattatggtattttgcatgaaaattaagataaattggtcaaattaaattagaggtacttgtgattggttcatatgaagaagtaggaaaagaatctaaatgagaaataattacgattagttaagataaaagaatagttaaaagaattacttggatattttagacaaatgccaacactaaaagaagatctattttaagacaaaagagaatatatatagttttaacatttctatgctttttcacttacacatacagaagacaacaaagtggcagaccgcaggcgaacaaatcgatcggttggttatgtgaaaacaaaacgagagtcacagcaactgcgcccggatttgcgtgcgtttggacagacagacagatagacacacgagatccatcgagtagctgctgccgacaggcagcccaatgtactgttcataagagcaagtttaatagcatagccaactaatagctccaattcatctatagccaacctaatagcttatttatacaatagttacatactacactattaatatctggtctcacttatcatacacacagtgtgtcttggagtccgtgctacatctggcaacaaatctgtagcccgctgctcttctctcttattatttatctctttaaaatatatttacagctggtttatagcccgctattgtaacttctctaaggtgaggtgtcgagaggagaggagaaacaaagttttgggttccaaggaggaggcaacttgcactgcaaatcttcaatgcagacaaaaaaacacagtgccacagccacagatcctattcctagacagagggtcaggtgtattacaaacatccataaaaaacagtttcggacttttcaggccggatcgaaaatcataagccgtttataatttttaagttcacaaaactcatattgaattttaatactctttttttacaaagtttgttttttattgtttctttttcgtttatcaatgatttttatgaaatctgaatatacaactctcctcgtatttgcgagaaagtgtctgaatggttgagctcaactaataaaccataaaaatataaataaaacattaaaaattttatatgtgtataatttatgttttaaaagctaacgttgaaaaatatactattctgaaaaaaagccccaaaatcaactttccaaaaatttcattttggctacagctaataaaccaacaaacatgaaaatgatttatcatcaattttgtatatggagttagtaatatcacaccgagcgagtacatatataacttaaaaccaatatagtggataatggatataccagatacgaggagaaaattcagataagtgtagtgtggtgcaaaggtgcagtgagcattcaacacagatgtggcctaaaaaaccggtcagaactcaccaagttcccaccaacacaagcacatgaagaaaaagggcagccacagctgatgccaatcaacatcacatccagccaaaaaggagcacttttctaaataggagtatatactaccaagagcagcaataatctccaaaagatcatctctaggagtagttgaattcttctgaaccccaatattctaatgccaaatattcagaggccacttaatcaggcaaggagagtttagtcagggtgtgtcaatagatcaacggctttcccaagttggtgatggtgactgcaacaattggggcagattgatggagacagatggtgagaaggcaaaagctatccctgtttgagatcatccctgcaccaaaaatccaactcataaagaaattcatattttgcaagtgaaattgtgggaacaaaaggaaaaaaagcccaaagccaaaagccaaagccaaaggcaagacagattgtgacagattccatatattgttttgattgtttgctcctatctctaaggaactctccaacctgaaaggattccaacttgaaaccaaagcttgctgcttcttttctctcatttgtctgaaattcatccattttttcagtagacaaggcaagaaaaggcaagttgtgcaaagttttgttcttcagattagcttggaggcaggcaaaagaaaaaaataaggcgccaaactttgtgtgctcctggatcataggaagaaatatccaagagattggtaaaaaaaggcgccatttttgagagaaaggcgtttccttgcgatcaagctggtgatgtgatcgaagagtagaggcggccatggaggcggcggacctggtgaagaaaatacgggagctggaggagggccaggccgagctcaagcgggagatatccaggatcgtgccggagcgcggctatgcgcggcggccgcctactctgtccgcgcagcataggcgcaccgagctcccgcatgcggaggcggcggcaccgttgtctctgatcctgcagcgcgtggaccgcgcctgactccccgaccggcactacgtcaggatcctgcactcgctggggcaagccgtgcacgtcatctccctcgacggcaagctcatgtattggtgagcctttgttgcttgttttcttgctcatcaagtgcttgacgaaatgctagactagtttgatgcagagggttgaagcgaaatttactgaaattagtttgacggttgagctgtagttcgtgcaatcttgctgctgggaatggtgtattagtgcggtattcctggctaatgtgatggtacctgcattatgacggtgtatagagaaaaatggaggtttagtgggatgaactctgttgctaaattcagaatggagaaatacttttctgtagatgccaggtctttaatttcagtgacatcctctagagttttattaaattagataatgagtatggaagtaaattaatagtggaataattgatcaagtgcctactgtgaatagctatgagtgcaagcaactccaagtatctattccttcttgtattactgtacagagaattgcacttgttttctggaaaaactattagaatgtatggtgcaggacctgaagagacatgttgcaagaataatggttgtagtttcctatttccttatatgaatatacatctggaatacttttaaggtaactaaatacatagcattgttcaatgcatgtaactatatcagatctcatgcacaatcttatcattaacctgcctcagcaggcatgtttgctctaaatttcattttaccacagtttgatgcaacaagtacaacattccttaccagatatttctatttttacttcaacccaggaaccggtacgcggagcatctgtacggctattctgttcctgaagcagttggtcagaatgcccttgaattaattgttcatcctagtgactatggtgcagcaaacgacatcatacagaatatattcatggggaagtgttggagagggaaatttccagttaaacacaagtcaggggagcgtttcaacatcgtcgccagtaacacgcctttgtatgatgatgatggtagcttggtaggcctcatctgtctctcaactgatacgcggacattggaggagatacttggccattcaacctcagggaaagtgtatccgagttcagcaaagccgcgcgttcaactcaatgggtccaaaagtggtttgctaaacaaagtttcttgtgactcccagcaacctcttcaatctgctatcacctccaggataacaaatttggtaagtcatacctctgagcaaacaaaataattgactataatagaaagtctcttctggtatttcttcatgatttattttgtagtgtatactttgatttttagagtaacaaacacaggctaccagggttacaaatagagttcgctctcgggtcaagacgggtcagaattgcgatgatcagttcggtggtgcctgtgagagccattattctgaacatgatgccagagaagagcagacatctagtgaaggaagcaccccaagtggggatgttcttcatggggcctttgttagtgaagacaattactctgggaagtcaagcaaaacaaacagtgatgactcaggagaaggaaaactggggcttcacaaaattcttagctcaacagcagaggcactgtgggccaacaggggaattccatggccttggagaggtcatggaaatgatgatgctgggaagaatcgaacgaacttgccacagttccatgaaattcaagagaatggacagagccataaggaagttccagagccaatcatactaccagactgccaagatactgaatttgtccaggaagtcaaatatgaggtttcaggttcctggtggtctttcaatgccagcacaagtagtatgagcagtactggaagcactaatagcagtgctatcgagagagcagatcgtgaagcagactgcctggattttgaaattctgtgggaagacctggcaattggagaacaagttggtcaaggtagttatttctcacttggtaaattttctgtgtacacatgtagaaacacatttacttcaacacattcgtactcaagcataatcactttagttggtttcatgatctctcaatggtcatggtaccatgactagtcttgcatatcaagacaggctacacggatggcactttgcctccatatggttttttttcgataatggaagctttattaaaactcagtcaaatacaccaagatgatacatttcaactgagcccactcccggcctctgcataaaatgcacacaaccacacacaaagaaagacctatgaagacccctctcacaaaacagaaatattagtggctatcaatccgtagactagatcgccaaccatgctcctgggtaaaaaaaactcctgtgccaccttgtccaaacgtcgcgataccaccacaatagtatcctgaagacccggtttgtggaggatagctcaggtgcgaagccaccgggtgactaaagtaataacctctagatcgtgaattccaagcccaccttaatctttgggacgacaaataatgtcccacttagcaagccgatattttttcttatgtccatccccttgccaatagaacctagatcgaaagtagtcaagtttcttacataccccgctaggtattgcaaggaaagacatcatatacatttgttctccaaagagcaaatgtatatagcctccatatggttatatctgaaagttaatggaacttccttttgtttacttacgaatgttcatgtgcataattagaaaaaaaatgagggagaaataatctattaattgcctgaattgcctgctatatgcatacgggcactgttctgtttttctaatagatatacttctttccatgtttgaccaaacaggttcttgtggaacagtgtatcatgctctgtggtatggttcggtatgtatgccccattatgtgattattgaagtaacagttaacaataaatcctgaatatttatcatgtcctactccttgtaggatgtggcagttaaagtattctccaaatatgaatactcagaagacatgatactcaccttcaggcaagaggtagatatttactgtcctattgagtcaaataattaggactgcaatttctttttcagattgcacacactagagttcacagggctcatagtagttatgtctttctttttttctatgtattgacacggtcatatagacaaacatgaaaaataagggtgagctgctgagagacagaatattttttttatcttgtgaattgttttaggccgtaatgccatagagatcaataatatgctcttagctttgtttatcctattattatgatttataatctgtaattatatacatagcccatatttccatctttcatttgtctaggtagcattgatgaagaaactacgccaccccaatgtgatactcttcatgggtgcagttgcgtctctccaacgactttgcattgttacggagtttctgccacggtatgcttcatatctccttcgactgaaagaatcaagacactgtaaaaaattgtgtacatatttccctctggttgtgaatttcttctttattgttgtaagagagggtgtgtattttgaaaaaggtatatggcttaattatgatgatacagataacagcaaaatttaaatatttattgaggattctcgatgatctatgtcacagtatgaaatctaagtagtacccaacatttgtttttttgtttccactcttcgcaagccagggtgatttgaaggacactttcctgtttaagaagttaacatctaagactgaactttcctgtatacatatattttgaaaagctctgtaaaatttccaatccatagattatgtacctgtgagatgattggagtggggccataaaatgatgaacctgaagtcttgatggttacagacatagtgatgtataatgtattattaacattagttgtgtagtaagtgaaccttttctttatggaacttgaagtattactgcggatttacttgtgttattcttatgtaattgtttctatgctcataagaggccaaagctttctttcttctttcttttttttgcctacctttactttacaccaaaaactgtaccacataatgcagagggagtttgtttcgcttacttcaaaagaatgctggcaagctggatccaagacggcgagttcacatggctatagacattgtgagtgcattttctcttaaaagctcgttctaaaaatggccagtacattatgttctgcggaacatctgtggcatgagcagattgtaacaaaaactggatgaacattcttcacctgaagaaatcaagagaagttttttactgttatggaattattttcacaaatgtgtagaaaaaaaagctgaattgtgtgtgactaaaccatgtctttaagattcagcatgtgaaatgatgaaatgcaaaaaataaaatgatatcatatatgttccatctaacaaagttgcttcttctatttccccgcaaaaaaggctgcttgttctatattatacattccattactatgatttaactgaggattctatcactgaaatccaatcaataattgaactgatatgattatgatgtgaattattgttgttccaaccaacttttgtatcattcttattcttgttgaggctttggaactacaggaataatatattgtgactccaaattttgttcaataattacatattttgcctgtgtagaaacttcgattaccatgttgtgtttcagaacataacttatatatttctgcaggcaagaggcatgaattatctccacaattccagcccacctattgtccatcgtgatttaaaatcatcaaaccttttggtcgataagaactggactgttaaggtaaatccgaaagttagttctttcttcatatcttttatgtattaattatcttctcattgtttttaattttatcaggttgcggactttggtctttcacgtctcaaactcgaaacatttctgacaacaaaaactggaaaaggaacagtaagtgcaagcaagctctacttaatttcacatggattctccggactgacaagacttagataaattttaaatttgtgctaatgttttctgtttattgcaaaatatcttgtttttgttttgatattcagccacaatggatggctccagaggtattacgtaatgaaccttcaaatgaaaagtaagttcaccgttcagaattgctcaacataatttctctgactatccataggtggtttgctcaattttgttttccttttcataaagcataggtctgatgtgtacagctacggagttatcctatgggaaattgctactcagaagataccatgggataatctcaatacaatgcaggtacattttggcaatgtatttgtctgttggttagtttattcatcagagtttttttatcatattattcgttgaaaaactatgcagttgtgaattcgatagcataatttacttatagcatataaaaaaagcaaacctcaataatataattgtgtactggtggtgatattaggacttaacagccgtttgcaagttgcaacaacatatatctttcatcatgtgtttgggtgcactggtcattgtctaaatttatctgcacatagttttcctgtttcagactatgcttgtcagtttgctgttgctaaaaaaaaaagaccatattatcttgtcaaaatggtcctcattgtcaggataggataggagaagtccataaataccatctctgcaatttatacataagtattagcaatgtgtctaattgaactgttggtaaagcattactagaacatgaaagattcctaacagtgtgatcccaaatgttgcaggttgttggagcagtggggttcatggaccacaggttggacattccaagcgatgttgatcctcattgggcgtcgatgatcgagagttgctgggacaggtgcacatactatatatattttttcgacatttcaacatactacttctttgcaaattccgaagaaacaactgttctcaatgtaaaacaactgatcctagtattcaacaaacctatcctttctgcgagcagtgacccgcagcgtcgcccttcgttccaagaactgctagatcagctccgagatctgcagaagcaatacaacttgcaggctcaactgcagcgaactgcagctgccaagatgagtgttgacgattgctaacttcaaaatctgaatggtccatgttcagcttgttgccaatatgaggtcccagcaggccagcaaaatgggattcgttaggagtccagtctaaccaaaaagggttctgaattctgaacattttgctacttttctgaagaagctgtggcagcaattgagtttgtgccagaaaaagatggtgcattcgatctgaagcctgaagctctgcaactgcaattcaatcaatcttccagcagtgatgaccgatgaaatttcggcagtcatcgaatacaatgctgtattcaccctattaaccatgtacatgattttttttaaaaagaaaaggttgttgttggtattctgcaatgtactagtacttgagattatcgccgagttaatcagtgtcagaaaaaaagaaaagaaaattcacagagcaagtgatcaatgctgtcaattatagagggagtatgttacgtgtcaaatactttaacattcgaaattctaaactctaaggtatccaaaatgatagagcacggggaatttactatctcgcaataattacatataattacccttcaaaaataacaacaataaggtgaaagcattgatacgatggtggagtcgtggggtgcataacttctttcaccaagttcaaatcctggtgcctataaatattacgtactctatataagtggactttcaatattgagaaaatttgattcatagcataggaaaaaaagcggtaccaacaaatagcacaagaatttttcgctttcgatcaaaagcacaggccaccgttttttcttcgccccatagcacttccgtcaggtttggagctaacagagttaggttgaagtatataaaaattttgttggacccatttgtccttcgtcttcctcgctgtaatctcccatcctgtgtcatctcgtcctctcgggttagtgcccacgacgacggcgtcggcaccgtcgccaatcagtgacgcagcgacgatccccgtccccaggcgcgccaccgccgtccccatccccaaccgcactgccaagccgaaccacacatcttcaccattctctgtccctgccggctcccgtggcgatgactgcagcagctgtaggagccctagctggtttccatcgggccctaccaccgcggccgagacgagctccgtgccacaaagcaacacaagtggcgcttcctccgccgtttcctccagcgagcaccaaccgtcccgctctcttacttcgtggacgcggtttgggctgttgagcagtgcgctcgatgctgctacagtgagagcgcgaccatcttcgacggcgacggcgacggcaatgactttgcggagatgctgctcctcaacagctgctttatcctcgagttcttggcaaaagctgagccgcgccaatcgagggacgaaacaacgctgtcgaggaactctggatggctcatatgaatcaggacaatatggtctttctaactcttgactaacagctaaactgttcattggaacgatgaccacgacgaaagtgctacggggcgaagaaaaatcggtggcctgtccttctgatcgaaagcgaacaattcttgtgctatttttttattaccgtttttcttcttcttatgctatggatcgaattttctcttcaaaattcatctcttagcgaatgagttaggggacggacgtgcgatatgtgtttgctgtcaactcgccaaaagaaaattaacatcaataataataattatagcccttaaaaaaataataacagcaacaataatccctatgccaattggggcccaccaagagtccaggatatgtatagcatgtgcggtgtgtgagtgtgagccaagctttggtacgcgcagcacttcttctcatcccttccccgaactcacgaacgcacgccgccaccaccgcccaccgtcgtctcgtcggagatggcctcctccgcctcatggccggcgttcggagtgtaatgtgccttctcctcctcctcctctttctcagctgtacaggagcttgattcgttatcacgtcgtttccttagatcgatatagaccccccaacatttttggtggcttgttgctttggttcgaatctctcgccttcgatttcctacttgtagatgatggataacatggaggaatgcttgtgattttgaggattttttttaatgcctactttgtttgtccccccttccttattctaatgggttttagggttaagaatttgtagatctgaacatgatcttgcatgattaaaatatgggtaaagtagcattgaagcatttgttgcatctgggtaccgagctcgaattcgccctatag

SEQ ID NO: 7190 - DNA, 11851 bp, Oryza sativa
ggtagcttgaatggcagtacattccttgctgtggcataaacccatctaaaatcctagatttctgatgtaatggggtttacaccaagaatgtgtggatctggatgcgaaatatctgatgctatgagactaaaattccttcagtaattaccgttcttatgaaaattattaggttgcttatatatactgcacttgctcgtagatctgtgggattataattggttttagttaataatttgcagattttggacatgaatatgaatggttaaaatttggtttaagcaactgatgtattttgagggtaccaccgatggcagtatattctttgtggtagcattttttgtagtgaaaaatcttaggggtggcataaattcaccaaaagtctagatttctgatattctaatggggtttatgtcaagaatttatagattagaaacaaaatctgatgctaatatttcaccaccgattgacacacttaaattcctcatcattcttgaaaacagaaaactattctaactagcctgtaccattctttgattgcttacaattcattcgctagtaaatcaattcctaacctacctactcttgcttgctattatctccagaagcccagaggaagcagggaagggtaaatggtacatcgcaactgctgctaccaaccacatgaccaatgacaagagcctcatctccgacctcaagcctgtcgccgatggccgtaatatcattgctgatggcaatggtgcagggttgaaggtgcagggcaggggagctgtgaacacagaaactgtggttctccctgcagaagtgtggtatgtgccggagattgatgaaaacttggtttctgttgaccagctcaatgaacttggcctcagtatttcgattggccgaggtgtatgcaccgtcactagagttagtgatggatctgtagttggcaaagcgcgtagatcaggtggagtctatgaggtggaattcctcaaggttccccttaattagcaccagaaattccttgctgcagtatcagttggggtagtcagactcgtatgatgatattgcctactatatgcaatgcttgttgggttggaacttaagttggatctttcagtagttaagggatctggagttttctctgaatgtaaaaactaaaaagtgaaagaaggagctgcctgtgagcagaactgaggattttaccatgttggtttgaccttgtcttttaccactgtttttaagttcctgtagcctgttgagctgttcatatccatcgacttgcaattgccatttcagtttcagtgttcctgccctgctgatttattggtgatcattttcaatcttgtgctgtaacctgtaacttcagtatgtcaatgattatctttgcaaggttctctcttgtcgaccaattttccatgcatgatgttacacgttacagcaaagctctttaggctgtgtgtggaggttggcgcacgcaaaatgatgggatagattagcgtatataattaataacaatgggatagattagcatatacttcctccgtcagggcatttgcaaatttgccaccgtttttttcaattttgcaaggatgctattcgaatgacagttctagtggtatttttgcaattttctagtggtagtcttgcaataacaattcaaagtagtggtaaatttgcaattgctcatcctccgttttatattataagactttctagcattgcccctgaattttagaggtagtaattaatttcatacttaattttttttgaaaaagaattagtatgaaattttaaaaacaactttcctataaaaacatttttataaaaaatataccgtttgacggtttaagaaatgtgcacgaaaaacgagagaaaaagtaggacacattgacaaaataacacaacttatacctccattcatgacaaatttggttcagaaaaatagtaattactctaaaataataatagcaatctcataatatttgccgttcaaaaaaaacaatagcaataatattagtaataataacccttcaaaataattaataatagcaataatactccctatgacaaccggggcccaccaggagtcgactagtcgaggatactggatactcctacatatatgcggtgtgcgaaccagcttgtgtgtacacgtagcagtttctctcgtcttctccccgagctctcgccgcctcgccgcctcgggcctcgccaccgcccgccgactcgtcggagatggcctcctacccggtgttccaagtgtaatgtgccgtctttcccctcccatctcctccccctgcacacgtgctctgtacatatgggtttgattccttgtcgcgcgtgcgtcgtttctttggatcgatctggaggaccccatcctttttttggtgggttgtgctttgtttcaagtcttccatgttcagatttcatttgttggaagatgttgtgcaagatggaggaatgctttgggatttgatgatttcttgggaatacctactactttgtttgtttccccttttatattctagtgggttttaggtttaagaatttgtaggtttggacatggtcttacatgattaaaatatgggtaaagtagcatggaagcatttggtatacctttggtgtggcattgcattctttatagtggcacttctaaagtttcaatttttttttttgggggggggggggtgattgttgtagcaaagccctagatttgtgagatttttaggggttttatgccacgaatttgtagatctgatcattacccagaaccacgaagccctagatttgtgtgtattgaatggtctttacttataaacttgcagatctggacatgaacaggaataatgaatttgggaaaagtattgcatttttgcctatttctatggtagcttgaatggcagtgtattccttgctgtggcataaatccatccataaccctagtttcaagtgttgtattttcagggtagcatgaattgcagtacattctttgttgtatcaaattgtacgaatgctcagaacctagtttctgagatttagtggggtttatgccaagaatttgtagttctggatgcgaaaaatctgattctgatggttgcgatctaatctaagctagccttcatcattcatagatttcttgcgctgcattcgctcctagatttgtgggattttaatgggtttttagttaataatttcgaaattgagacatgaacatgattgaaaattaggtaaagtagcaagtgatgtgcttttagggtagcatcaatggtgtacattctttgcaatttcattttttaaatcttgggagagaataaagccacccataagcctagatttatgagactgcaatggcgtttatgtcaagaatctgtagattaagaagtgaaaatctgatgctaatgttttgccaacagtctaaatttccttcagtgattaacgattattgtttttgtgcactaatgtagctagcctgtaccttcttgattgacattcattcctgaatcaagtcctaacctgctactgttgcttgttactatctccagaagcccagaggaagcagcgaagggtaaatggtacatggcaactgctgctaccaaccacatgactcgcgaccagagcctcatctccgacctcaagcctgtgaccggccgtgtcgttagccgtggcaatggcgcagggttgaaggtgcatggcagtggagctgtgaacacagagacggtggcgatcccagacgtgtggcatgtgccggggatcaacgcgaacctggtttctgttccccagctctctctacttgggctcaacatttcgttcgaccgtggtggctgcactgtcactagagctagtgatggatctgtagttggcaaagcgcgtagatcaggtgcgatctatgaggtggaattcctcaaagttccgcttaattagcaccagaaattcctcgctgcagtatcagttgtggtagtcagactcatatggtggctaatatcgcgtactgtttccaatgcttgttgggttagaacttaagtgggatctttcagttgttagttaaggatctggaggtttttctgaatgtaaaaagtgaaagaaggatgatgttggttatgtcgctggctatgagcagaactgatgagtttaccatgttggattgaccttgtcttttaccactgttgttaagttcctgtagcccgttgggctgttcatatccatcgacttgcaattgttattccagtttcagtcttcctgcatcgctgaattatgtctgattatctttgcaagattctcttccgtcgaccaaatctccattcatgttgcatggtagtatggtacatgatagagttccatcggtagtcctaaaatgaataagctaaagccaaaatttaaattttaaaatttaattttgaagttggatttaaggtatttttaacataatttttttagctttggcttttaagttgctaagattatttatacatataagttttagatgcaaaattacctttttttttatctctaataaactgtcactcctgtctcaattctccacgtttggggtaaaaatgggacgtgtatttttcgtccgtccacctatatcaattattcaattcatggcaaaatttggtcagaggaaaacactaattactcccaaaaataaaaggaataataattgcccttcaaaagttactccgtaatactggagtaatagcaataataacccttcaaaaaaattaataatagcaataatactccctatgccaaccggggcccaccaggaggagtccacgaaccacgatacatagggacccgatacatatgtgtgttgcggtgtgaaccagcttgtgtgcgcgtagcactttctctcatcttctcccggagctcacgccctcgccgcctcggcctcgccaccgccgccgactcgtcggagatggcctcctacccggcgttccaagtgtaatgtgccctctctcctccccctcctcctcctagctcaacccctgaacacgtgctctgtacatatgagcttgattctttatcgcgtcgttttctttgatcgatctggacccatctttgtttggtggattgtgctctggtttcatgttcaatttcatttcttggaagatgctgtgcaagatggaggaatggtttgggatttgaggatttcttgggaacacctccctactttgtttatttccccttcatattataatgggttttaggtttaagaatttttagatctggacatgatcttatatgattaaaatatgggcaaatagcacagaagcatttggtgcatctttgttgtggcacatgaggcattgcattatttgtagtagcactttcaaggtttcaatttttaggggtaactacaccattaaaaccctagatttgtgatattttaaggcgttttatgccacgaatttgtagatctgatcatttacacaaaaccacataaccctagatctgtgagtcttattgggttttagtttgttgtggcacatgaggcattgcattatttgtagtagcactttcaaggtttcaatttttaggggtaactacaccattaaaaccctagatttgtgatattttaaggcgttttatgccacgaatttgtagatctgatcatttacacaaaaccacataaccctagatttgtgagtcttattgggttttagttaataatttgaacatctggatatgaacagcaataattaaaatttgggcaaagtagaaagtgttgtactttgcctatttttagggtagcttgaatggcagcacattcctttggtgttgcataaacccaaccaaaaccatagattgctgatactctaatggggttcacatcaagagtttttagatctggatgtgaaaaatctgatgctaatgttttgccaacacccctgaccgtttgacactaaaatttcttcagtggttaccgttcttctgaaataatctagctagcatgtgccattcttagattgcttacactgcatttgcttgtagatttgtcggattctgatgagctatggttaataatttctgaatctgtacatgaacatgaagggttgaaatttatgtaaagtagcaagggatgtattttttgggcagcatcaatggtggtacattctttgcggtagaatttatcaaaacgtcaactcttaggagtgcataaagccacccaaaagcctatatttctgacgctgtaatggtgtttatgtcaacaatttgttgattaagaagtgaaatctgatgctaatgttttgccaacagtctaccgattgacactaaattccttcagcgattaacgatcattgttttgcaaactaatgtagctaaaccttgtaccttcttcattggcattcactcctaaatcaagtcctaacctgctactgttgctttgctactatctccagaagcccggaggaagcagcgaagggtaaatggtacattgcgactgctgctaccaaccacatgacccgcgaccagagcgtcatctccaacctcaagcccgtgactggccgtgtcgttggtggtggcaacggctcaggattgcaagtgcatggcagtggagctgtgaacacagagacggtggcgatcccagacgtgtggtatgtgccggggatcaattgcaacttggtttctgttggccagctctgtcaactcgggcttgaagtttcgattttccgaggtgtctgcaccgtcactagagctagtgatggatccgtagttggcaaagcgcatagatcaggtgcagtctatgaggtggaattcctcaaagttccgcttaattagcactggaaattcctcgctgcagtatcagttgtggtagtcagactcatatggtggctaatatcgcctactctatcgaatgcttgttgggttagaacttaaatggcacctttcagtagttagttaagaatctggaggttttctgaatgtaattgaatgaatgatgctggttatgttgctgcctatgaccatgagcacagaactgaagaaatgcttaccatgttggtttgaccatgtcttttaccttcctagcttgttaaaattgttaccatctttgttcgaccttatgttttttaccatccttgttaagttcctgtagccttgtgggctgtttatatctgtagccttttcgacgagggaagattgccaactttcgaaagcgccaagaaaaataaccttgtcggtttggaccgacaaaaaatatacctttacttggcggcaatgaaaccgcaaagaatacttattcttggcagtcggaaccccgccaaggaaatttctttggctgttttttttggccgccaaagaaatcactttgccgccggaattttttgctgaattgaagttattttcaagagcatcgtgtactctcgtgaacaaattaaagctgaaaaaagattgtttaccatcagttgatttatgaggttttaaaccggcgatcaaagcggaattagtttggaggaatgagatccactagcagcaattaatgggataagagtattgggatcgggacagggaaatggatgaagggctatgatgaaatgagggagggataatagatggctaggattagaagaaactctttggtgggtgggaaaatatttccccaacccattagccaaacaggccctatatatgtgtgtatatatatatatatgtatatgtatatatatatatatgtatatatgtatatgtatatgtatatatatatatgtatatgtatatatatatatatatatgtgtgtgtgtgtacgcgtcaaacaactaatttggagcgtatttggtggctaactccctttttatgagaacagctgatccgaactaactcgatcgatccagttggcttgcgtcgtcgtacgcgtcgatagtcttcgtcgtcggagatcgatcatggcacctcgcaaaaggtcgcatcctagaaggtaattaacgtgccttaattaattctcctcctcatcctcatcttcatgttcaatgatgcatatatacgtacgtgctctgtatctttagtgctagattgattgcatttaatttgggtttatattagatctcggctactcatttgtttggaggattattgtgccttggttcgaatcttttttgttcttttgtatttaatttgtagtcaaacgctactttgtagctgatttgtgatttctgacatacatgttggaaatgcttgagattggaggctttccagtgaatatacctaggttgtttgtttccttctctttttttttcatgtatattctcagaacttgaacagagaaccctagatttgtgatattataataagttttagtcaagaatttgtagatattgcgcgccatggacatgattgattgaaataatatgggtaaagtagcagctaggtggcatattattttttgggtggcatcaatggtactgcattcttttcggtagcatttctgcacatgtcaattatctatcagttgtggcataacccttaaaggcgcttactccctccgtcccaaaaaaaacgaatataagattggatatgacaaattctagtataacgaatctggacataggtgtgttcaaatctatagtactaggtgtgtcacatccagtactaggttggttttttatgggacggagggagtagacttttttttttttgtcaagaattcaaagatttggacatgaaaaccagatgcaaatattccttcagtaattttaatttgttcttgtaacaattaacctaatccagcctctatcatctcttgattgctatactgcgttcattccaaatccaaatcctaacctgcaactactgtcacttgccatcatctccagaaaaccagaggaaagagcaaatgtcaatgtcagcagtctcaacaacatcttcataagtgcagagcccggagcaacatttcctagatggttcatcacagaagctgctacaaaccacatgaccagcgacaagagcatcttctccgacctcaagcctatggccggccttgtcatcgacgaccgtgccggcgccggcgcagggttgccgatgcacggcattggagctgtgtactcatgggaggtggcgctccaagatgtgtggtatgtgccggggatgagtgcctacattggcttagtttctgctggtcagctcactgcaattggtctcaaaactgagattgcaggagatgtctgcaccatcactagtgctgatggatctgaagttggcaaagggcgtatggttagtgataaaatctttcaggtggatttcctccgagttccgtttaattagttcctgaaatttcattccttggaaaaaaataacttggaatagtttttatgtagtaatttttagtttggagtagttgaaggatctggatgttttttcttctgaatggaattgaagcaacgatgatgattttgtcactgaacaaaaaagttatctagaatggtcttatttggcctctatgagtagaactgaagaactgtttaccatcttgttctggcttgtgttggcttgtgttttaccatcctagcttgtactgcaggttgttaatggctatcattttgcaattgctacggaaagtaatttatctgcttggggggggggggggggggacgtcttccccagctccgcaccacacgatatgcgcagcgattcgtgcgtacacccgaccacagcagggtatttccccgcttgcccgcgtttaacccattttctagctgaccatggaaatacgccttttatacgtgggacccaccttgcagttgtcgctcacgggggagcacttcttcctcctcctccgccggccaacgcctccaccccaatcccattaccatccaagctacatcttcccaacccagggcatgatcactttaatgccaaaaaaaaccttattaaaatttactaaaattttgccaaaattttgtcaggattttttatatagttacaaaaatttggcagcaaattaaatgtagccacttttttgataacttaaccaaaatttggtaaggttgaaaatggcatcaaagtgaacaaacccccagacagctgcggaacgccggctaggaacaacacagccctagccatggcattgtggaaggagatgatagaagagagatggaagtcctgacatgtgggcattgtggaaggagatgatagaagagagatggaagacctgacatgtgggcccaaggcattttagaacttttataccatttctctcctcttcaaccagaaattattattttaatggatgtagtgtccaccaacaaatatctaacttttgagagtgtttttccccaaaagtcacttcgcacgatgtattatagctaaaaccacaaagtcacaatgcggcttccctgttcctatgttgtgttcccctccctgtcactgccagatgtcctccctctattggctgcggcttttctagtggacccaggccattcgctcgttttctttttttaacgcaaacaacgttaacatctggaatggctcgttcctaatcggtgcctaggttgccgaccaatgttccacgcgccaaaggtaggctgtgacatggaagaagcgccggagtggccgacgccgccggaggccgcggtgaccatgacattcaatctgggcagggtgtccagggcggcgctcatcgccttgagcgagcgcggtgacagcctggagagcggcagggatgcacccaccgccgctatggatccatgaagtaaaaaaaaatcttagcgcccaggaaatttcgaagacgctgactccaccgccgaacgcccgaactacatgacttcttcggcgagatcacttgctcatgtgattcttttagcttcctagcacatatcatcttaaattcttaagtattacctgaaatttatgggaacttcctaggcatgcaggaatggccggaccatgcccgaccacccttgtcttcctcattgttctctccaacaaggagatcctcctcatcaacaaatcaacaatggcaagcagctgtcctgtgcttcaacttcttcaccggtaagcagctgtcctgcacgcgcatattgtccatcgatggcaatggcaagcactgaaattgccttgcctgcctaattgccccgcctagggcacgccacagcagtgtaagggaaagaaaacggagattgctgccgtttgcttcaaaaaagaaacggagaggttaagccgtttagatgaaaaaaaggagcgtaaggccctgggcccgctggagaagtgatcgccaatagagcgaggacatctggcaggggacatagatagaaacacagcgtcggaacagggaagccgcatccgtgtccaccaataaatatctaacttttgagagtgtttttcctcaaaagtcacttcgcacgatgtattatagctaaaaccacaaagtcacaatgtcctgtagcaaaatttgatatataagtagtatgtatctcactattcatacatcaatagctaaggtgctagttttgttggcttgttgcactagcacgccctcgagtgtttagttttttttccttcttccacacacgaatcttaaagcgtatccggtggcccaaaatgtgaatgacttcatctcttatttctgtcacgagatatacagaatatgagaataaatatcctctttcggatgtgcatgattttcgaaaagaaatttagatgtgcaagttaaatacacgtgctcttgcacacacggagtttcctgtttcccgtagtttataatccaccaacaaattatctatagaaattactttggttaacccgtagtttttcgtagtttcctaattaacaatgtatttaataatcgaaaatgtcagggataattttttttcgaattctctttgctctaaaataattaacaagacttaaggcggaatattcagagcatcgcaa

SEQ ID NO: 7191 - DNA, 11782 bp, Oryza sativa
aagacttaaggcggaatattcagagcatcgcaattaatgttgctaatttaaattgtcaggatttgaattaataatattttttctctcccgcctttggtcatgaatcatgcctgattcactcctctcttcgttcgcggtttcgttttgcatgacgagccgagtccgagtcagtttccggttccagttccgttcttttcctaaaacagcaccgcatttcttttccggtttggtgaagtcctaatcctaatccagctccctccccctccctttcggccgcgccctccccctctccccctccgagtcggccccctttcccctcctaatccaactccccaccggtcctgccttccctcctattttccctctcatatatatgtcctagtcccccacctttttctaatcttttttttgagccgcaagccgcctccgccctaaaccttagcgccgccgccgccgcttgctgtcccgctgccgtcgccgttgcatcgccggtactccgttctccctctctattggtgcgcttgccgctgcaaccatcaatttatctaatctattccatttgtttctcatctagcgtcgccgtcgtcttcgtgtgttgccgccggaccgccgtcatcatctcctcctcgccggtcgtctcggtttggtgaggaccattcccgtgatctcctggtttaggctttattttttcctagcgttatcgtcgtaaccctaattatttagtcatgctaaaccctagtgttgccgcttcgctgccctagctgcgctgcctctgccgtgcgcctagccaccgcctagccgaggcaccgcagccgccgccttagctgtcgccgccgccgctctcccgcatcgttttcatggttggttcgctgcccatagctcggtagccgagtcgcaaagccgtaggtgcatccctaaactcctaccggcctttcgtttgtcgtaccgagtctttgtcgtaaaccgtgtctagtttactggtttagccgtaatcgttctaagccaccggttccgttcgccggttcggttgaccatttggatggtcctgtgtcatgaagtattggcttgttgagtctttaattcatgagtcatgcttaccggtgatatatttcctttgttctatttatctatgggcaataatatgtaataaatgattaagttttttcagctattactaataaagcagctcatattgtaaaattcataactaaataatccgagctccgttttaatccattcaagttacagtgaatccattaaaatgtatagaatccattaaaattggtttattttgctgtttcagtagccttattgcttgtatttcttgtgtgttttgtttgtcgtttagattccgtcagttccggtgatccagtttattttgaagtggttgccaaggtttcatcagctcaagagcaaggcaagtcatacatacaacattgatcatgttgaacctattttacaaaatcccttgctttctattaaattgcattattttagaatgggatggatgcctatcgtactctacttgttgaatattttatgccattgataaattgggttataattgactagatgattgggttaggaatgcttagccatgcttagattaattagctcacaattggattcattataatttagtccttaattatattatgatgtaccaccatggttatggtttaattaaactaaaatatactttaatggtgggttgtgggtacatgcatgattttggaagtcgtgcccataacaattaaggaccggttctcaagaatccctggaagatatactcgtacttaccacatgccagcgtgggctccatgctaaatctagagtataacttaaactagctgacatatcatggcaagggtagaggcgatggtgcagttcggacctgtattttggtctttgttgcttccgaatttacctatgcatgagaggggactgcccgacttggcacaaggagagggtgaaacctgaggtggttatgttcggttagggaaggttatatgacggtttttgtcacggtttcccctttgcagtatcgtggcggtacttcggggcatggtaacatgtgtggaattatgtcttgtgggtaaaattgtacacctctgattagagttaaaactattcgaatagccgttcccgcggttgttgggcggtcaaccagctcaccatgattagtttcactataataatttgacctatagaactggtgtagttcaggtagtttggttgggcctgttgcaacgtggttttagcattggacaatgatgatttaatatttcttaattatatacttcccccgtcccataaaaaaccaacctagcactggatgtgacatatcctagtacaacgaatctggacgaggaggggggggtaatgttttacttattcaaaatatgatttataaatgctgcttttactgcaaatatccaatgagccattcctttgagaataccttgcatcatgccttcccgttggtatgacttgttgagtatggtggttggtactcagtcttgctttatcccccccccacagaagcagagattggttcagatggtgagttctattaggattgagcttgttcaggacgtcgaggatttcctgtggtttatggaggaagcttcttttggttgtgaagattaagtctagtttttttcttgtttttccgctgcgtttgtgagttttattttattatttttgtaagatgtggaactgtttatcaaattgtcatttgtatactctggctagtcttggatagagatttagggtgtgtttagttcgtgaaaagaaaatttttgggtgtcacatcggatgtttgactagatgttggaaggggtttttggacacgaatgaaaaaactaatttcataactcgtctggaaaccgcgaaacgaatcttttgagcctaattaaactgtcattagcacatatgggttactatagcactttgttgacggtcgttacagacaaatttcgaccaccaatataactaaaatgatagagaattagctatgcttacaatgcatgtttgttttcaaataatatagttccacttgtacttggagaataacatattgcaggaatttatcaaagaaaataaagagaaagtgaagaaacctcactcctacgcaagcaaatggataagatgggcccacaagtcaggtgtaaccgtcggaaaccgaccttaactgccacaaccgcctaaaggactcatctgtcagccactgtaccgaagctggaggcctgttgggccagcataggttcggccaaacccgagggttgcccaatcagcctggccctccacgtgtgtgctccggatgcactctcaatgatggttgtgagggtaaaatggacatttcgcatggctacaaccgtcatactgaccctataaaaggaggagctcacttcacttatcaacacactcaagcaagctcaattcctcttcatactttagtagtagtagtagtatagtgctaagtggagtagtatagaatagtgttcagaagtcctcggagtcttcggaagaatttcggtatggctgtggtagctcttgtaatctcttatgtaatactttccgaattaatgaaacactcttctttatatatcttcggtactttgcttagtttgagtactggtcttactttatatcatcattatattaattgtatgggtagcataccagagagctgtaatggtgtaggtttaatgtctgatttattagttgctctatgtcgggtgcacaggtatagagtagtgtttagtaatgtaagcatggtgcttagattattaaatatcattaattgagcatatatgttgtgggacagtagagatgggccgctgatggtgacagctcagtacgggtattcctccacgttagtatatattcctaagacaaatttctggggagggcattccttcgtatttagccccggttggacggccatgataggttgtcgtaagaaactcagcaacccagggtggtctctcgaagtatcaggacactgttagaggatattggccacatgattgtatattagcatatgtaaactaggatttgagtatatactagaagtataggaattgaatgctttctatttcttcttccacttagttagacttatttgattatgaggatttgatcagctttgcttcgtgtcactctacccttatattgcacttaacccatgtttaggctttgatgattataagtaatatatgtataaagtgcattagcaaacttcactcttattatcctcccttgggattaaaaatacgatacctcaaaatacttccgggtgaaatgctacaatgatatatccgtgcgcttgcggattacttctgtaactataaatataccatgactatttccggcgccattgctgggaatgaagatttctagtaatatcgttaagaaataccaacacacttatggctaatcatggactaattaggctcaaaaaattcgtctcgcgatttccatgtaaactgtgcaattattttttatttttatctatatttaatgctctatgcatgtgtctaaagatttgatatgatgtttttggaaaaaaaatatttgggaactaaaccatgccttaatacacatcctacttgaaattcgggttagtgaatttctaggcgtgacatggtcttcctgaataaacaatgcatcagattgtttgcgttaaatcacctccaaagattaagacatggtctttctgaattaacacataagcaggcagtttaatctggactcgaccggcaatgtaaggctcttcttgaaattttgaacagttcacattagtgttaatatatttatgtcagtttgaataagagaagcaaaccaaggatgcagatcagttgagctgacatgtgacgctgagctgtgcaaggccatgtgccagacgctccaataagattaggtccaacttatcaataattagctaggttgttgagttaattaatcctatcttacttagagttataacccaataatcctaaaactcaagtactcgacatgcaaacatgctacttcatcattcactggcaacctaaaacttaatatgcaaacatgccatctcatcatccactagcaataattacatagaaaacttatgcaagcatgcaacatcatctataattcattgaattctacaaatcaacatccaatcatcttcattcacattatttttcataatatttttaacatatatatatatatctatcataattaaagtgcgggatattatatttcatctacaatctcatatagagttactaaatgtattgtatttctctctgaacatagttttataaatcagttttatttgttgttaataactaatataattttttatttttagctcgatatattattaaaaaaattaaaagttatttagaaatttccatagcaaaacgcggggaatcacctagttatttaagttgctcttcccgatggactgccacaacggacttgcctaggaagacttacaatacgatatgactcgaagctttggtagtgtatatagggtctctttggatcccaccctaaaattttacaccctatcacatcgaacgcttgaacacctgcatgaagtattaaatataggctaaaacaataactaattgcaccgattgcgactactttgcgagatgaatcttttaagcctaattgttctatgatttgacaatgtggtgctgcagtaaacatgtgctaatgacagattaattagacttaataaattcgtctcgcggtttactggcggatactgtaattagtttttttattagtgtccgaacaacccatgtgacatcctatataatacccgatgtgatacgccaaactttacacactgatctaaataccccctatacggttgtgactatgttttaagttatagtggctataaatatttcttcctccgatttcataactgtatattttagacaaagacacgatttacaaaaatttctttgactatgatatatataaagtaagtaaatgtttattttattaaaatgattttttaagactaatctatacatcttggtttagtgaatttaaaaatatttaagtcattgatagttaaagttttaattgtttgacctcggaagctgcatggaagacacgtgaggctatgaagaggacagacagctgcaccgaatataagaagtgtttgcggaagctgcatttaaggcaataattagtggttaggtgacgagaggtcccaacacaacacttcaactcttattagttctgaaacttgattctggacttcatctttcagaaagagaaaggcatgaaaattttgagagttttgaggcctcataggattctcacatagatatgcctttgctcttgaagttctttcttcctgaagttctgtttcgtcacagacatgagtaaaagggcgtaagagttatttccagctggcctctagtgtgaacatgcctattcggttttgagaaatttcacaggaatttttaaggaattgaactatttcctacgaaaatcttgtaaaattcatgtattccgaaggaggcttcaacattctagggatggccaagaagtaagcaatacaagttttgctaaccatcatgacatggattgattatccaatatacaccgacaggtatgcaaactaaaccaatcgtgaatcgtctttcctaacatagagttgcaagtttgtattcgtacttctcacttctttttccttctgaagtgagtttcttttttttttcttcttaagtgagttatatctgttggtgatgctcttatggtcaatcttaggattgtaacctatatgttggtgatgctcttatggtcaatcttccagtctagatgttttttttccctggggatttcagtgctaacttgaggtttcctcccatccttagaaggtatataccttcttaccacctatatatggtagttatattttcagctcaagctagctttgcataaatatttccttgcaacacatggtaggagtatttgtgactgcgaattaatacactatacttgttcttatcctataatctcgtcctattgtagaaccagactcaaagtgctagcaattgcaattaatggctgaggctgtgattcttctaaccgtgaagaagattggtgttgccctggggaatgaagcaataaaccaagccacatcatatttcaaaaaatctgtcacacagctgacagagcttcaaggtagcatggggcgcatcaggagggaactccggcttatgcatgagtttttttccggaatggatgttcgtaatcgcaacaaccggaagtatgaaatctgggtggaggaggtgaggatgctagtctatcagatcgaggacattgtggataattacttgcatcttgttggccacaagcatcacattggatggggtacctatctgaagaaaggattcaggagaccaaatgttctgctctctttgaacaagatagcgtcattggttaaggacgtggaggccagtttagtgcacttgttccaggccaaagaacgatgggtgtttatggatgtcggtgcggctactggtggtgaaagctcaagctacattgttgttgagaagtcccggcatctagctagcatttcacgctccctcgatgaagaagatcttgtgggggtggatgaaaacaaaaaaaaactccacgagtggctgtcaagtaatgagttgcaacgtgatgtgatagtggtgcatgggatgggaggtctgggtaaaacagctttggcagcaaatgtacagaagtgaaaaagagaagtttgaatgccatgcctgggtctccatctctcaaacttactccatcaaggccgttctaaaatgtttgatcaatgaactagatgagaaaaagagtattcggggtaacattagcgacatggataccggaggtcttcaagatgaactaaagaaattcttaaaggatcagaaatatttgatcgtattggatgatgtttgggtaccagaagcagtcaatgacttgttcggagcacttgtctcaaatctcagcaggagcagagttcttgtgacaacacgcattgatggtgttgctcaccttgctttcccagacaagaggataacactaaagccgctatcagaacaagaatcatgggaactcttctgtaggacggcttttccaagagacaaagacaatgagtgccccgcagagctgatgacattagcaaaacaaatagttagcaaatgccaagggatacctcttgcaattgtttctgttggaagggttctgtttgtgtgtgaaaagactgaagaggaattcaagcgcatacataaccagcttgactgggagctagtcaacaacccaagccttgaacacgtcaggaatatcctttacttgagctacatctatcttccgacacatctgaaaagttgcttcttgtattgtagtttgtttccggaggactatctttttacaagaaagaggcttgtaagatggtggatagcagaggggttcgtggagaagaggggcataagcacaatggaggaagtggcagaagggtatatcaaggaattggtttacaggaacatgctacagcttgttcagaagaactcatttggtaggatgaaatcattcagaatgcatgatatcttacatgagttggcagttgatttgtgccgaagagagtgtttcggtcattcatacaattccaagaataaacatgaagagtttcttgagaaggatgaacgccggatggtaatacacaaattagacaaggatgttaaccaagccatttcaagtgaatggagcagacttcggtctttcgtcacattggaaagaaatatgtcatcacccaacttgctaactctggtagcgggcaagtgcagatatatgtcagtactagagttaattgggctgcccaaagacaacattccaaatgtcatcggtgatctgtttaacctcaaacatcttagcttgcgggattccatggtgaaattcctcccaaattctattgagaagctttccaacttgatgacactagacctttgtaaatcggaaatacaagagctacctggcgggatagttaagctaaagaaacttcgacacttgtttgctgagaaattgaacggtaagttttggcgagatttccagtggagcactggtgtacgcatccacaggggactggagatgctaagcgagctacagacgctgcaagcactggaggtgcaagatgaacgatctgtgaggagcttaagggagctgaggcagatgagaagcattaggatattgggtgttaagggaaggtactttgaagacctctgcgagtccctatgtcagatggaatatctttccttgttaaacatcgcagcaagtgatgaggaagaggtcctccaattgaatggtctgaagtggttgcatccaaacgttaaaaagctaagattgattgggcgattggcacaaacaggactgctgtcgtgtgcacctgaagcagggagtcactcattgtgttcattatgtctattttggtcacagttagcagaggacccactgccatccctgtctcggtggtcgaatttgacggactttaggctgacgagagcatatctcgttgaacatgtggttttcctcccaggatggttccctaggctcaagacactctatttggtagacatgcctaatctgaagaggctgaagatacaccaaggctccataacaagcctggaggaactacatctaataaacctccgtggcatgacagaggtcccatctgacatcatcttcctcctgcccaccctcaagtatctgtacttcctggagatcacttgggacttcttcatggcgttgcgccgctctagaattggcagtatccgatggcgatacagtctagcttctgatgcgcgcctctgatgcatgaatggatgaggggatgataaatggatagatgcaggccgcgtgcatcgaaccgttaggagtgcctcacctcatcgaccgaccgtggttgcatctgctgcctgcatgcatgtgagcttattcaactcgtattgcctactttattatggcttaatttgctatcgttttaattacaactacgtacctctactactagttcagtggctcagtgcttgcaaaaatatttccattgtgattactagacattcctgtgattgaatctatttcgttcctgcccaagtttaactgtaatattcagtaatagtacaactcacactgtataagcatgcatttaatttctcacacatttatgcagtgtagctagctgttgctagctagtagaaataaaaggaaccaatttttttagagcaattttatattctttgaagaggtaccataagctactaaaaatttagtgtaaaatttagtacctcatagtatcaaggggtaccaaatatagtaccagatcgtatcgtcttctttccctgctttgttcttgttctacggtttgaacgttttaccggaaggagatagagggaaaagtgtaggtatggttgagggttgaataggagactagatcacatggtcgacgatataaatctcttgctggaaataaaatataaatttcaacagaattaaggtaggagtttttacgtattcgttggaataaaatgtaaatgtagaaaaaaatcacataattaggccaataatgtgttataataacacaatgtaaatctagactccaatacaacataaatctataataaaccacgcaaaacagaaaattaaaccctagtgccgtggtaaacgtacaacataaatctacaagaaaccacgcaaaataggaaattaaaccatgcagagagaggttttacaatgttaatgcgtaccgttatacctatgcggtaccttttataatttgggagacaattctaccatttttctctctactagcataatttctactagcaaaattttgtttttacccttagtacctaagtacctatattaatacttaaataccttaacatggtaccggtgattgaggagcgttggatctttacctttttggaatgcaaacaccgtaaaacctctcattgctcaatatacaatagaaaaagggcaaaatttgtcacaggacacgcaaaaaacgtgtaattggctgagagacaccgcgaaaatgtgacacggctcatggacactaaaaaaacgtgtaattggccgtaggacaccggtcgtattattttattatttccgggtaaaaaaaggtgagatatttatctaaatgcctagattgccctttctcttaccttctttaaataccggtgggtcccacatgtcatggatagcgtatgtttaatctaatttttaataggtttttaaccacctgggcccacgagtcatggactaatttattcgtaattagtagggtgattactatttgctaatcataagtggggtccacatctctcttctatcctcttcttcctcacgcacgaggcggagcggaggaacgacgcgacggcccgagccgggacggctcggcgcgcagcggaaaaagcggcggcgctctgctagggtctcaccgccggcgatggcgaggcgcgacggccaccatacgcacggcgcgacggacaggtgcgttgttgtaacaccctgaaaattcgaccaacaaaaatcaaagttccaaaaatatgggccttcaaaaactttttaaataaattgcatcatgccgattttgttcgattattttattggattttgatttcggagtatgttgatcgcgaataaagaatagttaattaggaataaaccctggaagtaaattggtaaaataaatataatttaaaataaatattaggtgtgg

SEQ ID NO: 7192 - DNA, 5808 bp, Oryza sativa
  unsure (1)..(5808): unsure at all n locations
agggagattaaaaaggtctagaaaatttaaaataattagaatttaattatagattaattatagtcgtagaattgcaaagtttcatataaattatggattattgttgggtaatctctataagtaatcgattcacggtagaaattcggatttaattactagggattttagccgtgtaatatatttaatcatttagtcatagactaaattaaatcgtataatatttctaggattttgtccgatttttagctcgcgatagaaatttctaacctattatatggatataatgctcgagtagattaaattaaaaacttatgacaacaaatatttatacccgcaaaatagtttaattcgaaattgggtttgccttagttcgcgaatagtaaagttaatataaaggaattgactttcgcattcgactttcatttggatttatttggatttttatttgaattctaaccgaattcaaatcaattttcgcacgtaactatagagcccgagggagccgcggatctaggtgaaggccaagactcgcaagacctcgagcaaggcaagtcaacactattctttgaacatgttgatcccaattgcgaaattgttttgtttacaaataaaattgcatgcaattatgaacatcctacttgtgattataccatgccttgattattgttcacctttaaatctttgtaaccatagatacgtacgagtccctagtcaactatgacacttgcttagaaatgctattttagattcatgcatactcatatttatcaaatgctatatgcttgggcaattacctttgggaaggtaattgagatgcggcatgtggagacatgagcgccacattgccatgatattgatgacatgatttgtgaaaggaaaataaagtaaaacaactgttttcgactggggcggttggaggacttgggtggtatccggaaaaggctagtgtcgtccctggtcaattaaggaccgagccatgaagttaagcatgaaacgacccccgtacaaccgcacttctcgtatgggtatagacctagcggagtagatagctgagcggaggcagtatccatgcatagtggtttcttgatgtgtgaggcaggggctctacgatggggcagccattggtaggaccgcaaggcgggtgtctacagtggtgtcgccatcggtaggactgccatgtgagaatctaaaacataattataacttaatgcatgtgtgagtcttctcttcccgggtgcgccagaactcctctcactgctagaaaccgtgtacgcctagagtgcatgaggatgaaaagttcatagagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagaatctaaattcttaacttgtgtgggaggggatattgcatgatgaattttatactgttggagccacttcctgagaggcgggaacgtggacgtcctcagaaaaccatgacgaatcaatggcgggaagctatccttgggatcacaatggatggtggacagaaccgtcgttgtttaaatacaaactctggtactaaaatttgatcagtcaatgctaggtcttaggcttgtgaaaagaattacaaaacttgctttgtgcaaaagaactatggccatcctttgaactccccctttcatatgcattgttgctgtggtggcttgttgagtacggttggtactcacccttgcaaatataaaattaatcagaagcgggcgatgaagctacggaggatccctatgcctactaccaggagggagacgaagacgatggtgcccagtaggtcttagtacggtcgttgcctgtggcaatggcatgccgctgcctaaattccactgccttatctaaactctgcttttggttgtattccagaccgctcggtctgatgatttaagacaatgcctgcgggcttatgttgtaataattcgtactagactctcgtatatgagcatttggtattccagctatgaattcgtgtgtaccagactacttgatccagggaaatggtacggtttacacgattgattcctgttataaaaacgggggtccacagtcgtggcggacaggtgcgcggcggcggcgggcagctgctggtgcggctacggcgtcggtggcgcagacttggccaagctctgcggcggcggcggcgttgcagagcggctgcagcagcgggtggtggtggcgagcggctccatcgccattgtgatttgtgcattgcatttgatcgatttgttgccgttgattggtttcttgttgatgtgtgtgcaggtttgaggtggatccatggcgacgggtcggtggagaacaggagctgcagaccgtggcctgcggcggcagcgacggcgccgtggggctcagcttcgagacgcaccacggcggcggcgtggcaccttcgccggagttcgcggcgtgcgcggcgagctcctgcagcgcggaaatcatggtgttgctgctcttgcagcgcggcgagctcctggtgcaccatgaccggccgagccatcaccaccgccgtcgcttcccaacgccgcaaccagccgaagccgccgccgcagttgaagttggatggggatttcaggtactgaggctgagggcattttcgtccttttgaaatttctctctcctctttttcaccgaaaataataaaatattgtctcgggtgtcctacagctaattacacaaattttgtagtatccattggcagtgtcgcgttttttgagtgtcttctagctaattacatgatttttggatatcctgtggcaaattttgtctagaaaaagtggtacctcatggtagctttttaaggacggtaaaattactcaaagctgaagtacagctgatccttgacaaattagcaaagaaagttgctggctgaaaaccaaagatgctatccatctacggcagactttgtttgatcaaaacagtgctcatgtatgcatgtatgtgctcagattcctcaaggtccttgtgtaatcgtcattacaaatgacgtatgggctcgatcgagaactacatgcgtacattttttttaggattagcagcgatagactgcatttatttcttcagactttgggatttaacttgacgggcaccatgagaatgatagtgcagtcgtaaggggtgatggttttaaccccgagatcacgtgtttaattcgttggatggtaaaattactctaaatcctaatgctgcatgtcccctgcctctctgaatggttttcttctacatgcattaatgaatcgactgttgattcttacagttacagtttgccattgaccattgtaattgtaatgcttaaatgcaggagattcagtgatcggtgcctttgtctgcagtttgttcacgagagaaaaaaagagcaaacaatcatgggcactgttcaatccctgaggtaaatcaagtgattcagattgactttgagcatcagcgtcagagagccacagatgaggcaaccttcgccttctattgatcctctgtctgttgcagcgattcagacttgacagtttcagactttcagagtctttttggatgcgtaaatataattaccagcacaagctttcttcgttgctacatgaacgagaacgggctgtgtttcatgctgaattgctggagattcagacattgaacatgtcacgtaacgtacgtcggaagcaacaaggcaaaagaacacgtacgtttcagattgcattggaaagctcttctctgctgcctctagtacgcaatcatggagtagttaactggaggggaacactttgtgcaacaatactagcacaaagccaattcagtaaccgcgtttattaacaaacccaaattatgtatgcatgtttatttattgagttggcaccaaactccaaacatatcgacgaactttacatggaacatgatcaattataactaattaagaagcgtatcgccgttttgattcttgacaccactgggaactgatgctgtgacgttcatacagcagcataccgtaggggtgacgcctggcttgcagtagtattctaatctgtctccgtatatcttcttgcacgtctcgtcagtgcacgctaaatctcctaggtcattgcacgtttgtctagctgcaaaaacgcaattcagttcaaccatccatgattcatgagccactaattgcaaactaaattaaaagaggggggaaaaaggcatatcatgaacccctcaaattatacagagaaaacatattcagtgtagtttggatattttttaaaaaatgcagagtaaaattaatagctttgctgcatacgtgttaatgcatagcaggatgagaaggtggaatctgccacgatcagaagaagcatgaagaaaaccacagagatggaggacaccatcctccttgcaactgccattattaagaagataattaagttctcctcctatatgtatttatgattttccactcttcaagttcactgtgctcgttgccatggccctctgctcatgtttatatatatgcacaaccaacttaatcttggagatgtactgatggtttcttgcatttatgccatctcctgcacaatttattgtttttgttccatttacatattattgttgtagttttagatagattaaacatcccaaatctttacacattttattgttttttccatttacatattattgttgtagttttagatatatgttccaacattaaatgacataacttccttaagaaacattaaatgactttatatcttgtataatttattgctgtcatatcgttctatacatatatttgtatacgacaataatatttttggtggatgtgctaaatctgcaaaacatttgtatatgtacaaatacatgcttgttgccctcaaggttccataaaactgacaaaaaccattcggttttcacgaaatattgaggtttcaaaccagcttgagtaacaaaccgcttggttttcacaaatttttgagatttcgagcctacttgggttgacaaaccgctcaataaacagccaaattgaaaaaaattaaatcaaactagattccactttttttaaaaaaaaatctataactctggttttcacttttttcgcgaacatgtaaaagaattgcacgtcaatatatttgaagaaaaacaatgtttttgttacacaacgcaatgcaaccgcccaggcggccagcccgagggcaaggaaacaagagaattgaaaaaaacaaagactgctagtgtaaagagagcgttgctcctgtatagaggagaagttttacggtatttgcattccagaaatagtaaaaatccaacgctccataataaaaggtatcatacaaaaagtatttaagtattaatataggtacttaggtagaaagggtaaaatgataatttgctagaagatgaaaaatggtagaattgtctatagtattagttgtaggtacataggtaccgcatcagtagttcatcaccaaatatgcggtaagtcatctccatcgcctctaattttccattatattatttgcattgtatttttttatatttgcatattgtcgtgcccttttcccgtggctgtctctaccagttttaattttttttcttagtagcgacaaaataatgaaaatgtagatgagcctatactatgtaaatnnnnnnnnnnnnnnnnnnnnnnnnnnnnnnnnnnnnnnnnnnnnnnnnnnnnnnnn

SEQ ID NO: 7193 - DNA, 533 bp, Oryza sativa
gagctcggtacccgatcaaggagtgcttcaagaagagcagtatatatgggattactcagatgaagcatatttttccttcctagtagatctcatctcatcaatcagaaagcagacagaaatggacgcaactgatcctgttgaaaatccgtgccctgcagtcaagatgagcatttacggattaacttaaggaaataaaggaagtaaattcagctatatgtattgagcttacccacagccggtagaaatgcagtgtaagaatgcgacacagtggaacaaagcaacagtactgcaggaggctagggagtgatttaggaaaggtggtaaggccttacatatattgtatagctgaacattcagactagctagacaactgctgaaccactcttcttttcttttatctttcccatggtactatccctgacaaaattttaagttattggccacatgtctatgctccacaacccaacattttgtgtatattcatcagaagaattggaccggcttagtctctccctggcagtttgatcttgttt

SEQ ID NO: 7194 - DNA, 16354 bp, Oryza sativa
ttaggaaaaagcttacgtggaacattaggaaggttgaagtatccaaaaggggcactgatcagcatccccctgcataacacatgaatgcatcaaaactacagttaattcaacaatagggaataacaaggggaaaagctgggggtattggtcataatatctctcctgatgacagagtaaccagctcagctgttctgttcagtgtttaaatggagaaggatggactcgataaaaaacgatgttggataatggagggaaagcttttattttcggttcatcgagatatacatgtattttgtggtccttaagcatcatctggtggaggaaaaagggtcttgcacacaatcattgctgatgtgaaattcagttaaggtaggctgtaaccatcagggagactaaatttgctgaatatacacacagtcagactggtactcctaccatctacccattgatccattcattgattcctgctcaataagaaggttgatgtgctgataatgagctgcatggaagttgcagaacctaatagaagattaccggaacaaactaaaagtacagttatgtagttcttatactgccatttctttgggattattgtcatatctgttatagtcgatattacaaagtactagatcctttcatcctcaagaccgagatctagtaaagcaaaagatatatatctatgtacacaatagcatgccaaaaaatgggcgcaatctgaatccagagtatataaaatcacataccttgcatcaaacaaccgaagcgtccaaataattttggcatccatacattatcactatgtccaattgtagacaaacgtagatggatcaaattcccgatgcaacctgggatgcttggtacaaatgaatcagtccaatctacaacacgaagataaggaaatctcttgaaaaatgaattatcaactctgagtgttttctcataagaagttttccatgtccttactttatattgcacctcgtccatgctaggtaacattaccatgttcttatctgtgacgactgaaacacgtcgaagtttagacacagtgttacctaccaatgattctgggtttccaacaaaacattcttcccttgacaaataacaagcaagctgccttaaaagatcatgcattttgcagctgctgtggtcataatataaaccatctggttgaagaaggttccggtggatcagctcatagtaatactcgtctgctgtttcttctagtagttgacctccatggtcctctataaagccttcagcgatccacatccttgtaagatcatcacggtaaatgtttgcatcttcaggatatacactacaataaagaaagcattgcttcaaatgatgtggtaactcatcgtaactcagatataaagcacctctcaaatcatttggaaggttgttcatgaaccaagcatttttgctcaatatttttttccattcgttctctgtttgttctttactcgctaacactctagcaataaccttgattgcaagaggaaggcaaccacatttgcgaacaatctcaatcccaacatcctgcagagtttgcaattctatgctttcactgatattcatgctcttccaaagtaactcccaccctacgtcggttgacatcaaatcaactcgataagtatggtccactccgatttctaaggcaacaatattatttctagttgttatgagaattgctcccatttctgcagcatgcaacggaattcttaataaatttgtccatgcgtcagattgccacatgtcatccaactcaaggaaaaaacttgtctccttaattgctatttcaagcttgctctggagctctccaattgattcatcttgatcatgatgaacttccataattcgaagaagttctctcaaaagagaagcttcagagtacactttggaaacacaaacccaggcttttttgttgaaacttccttttatttttctatcattgtatattttctgagctaatgttgtcttaccaactcccccagtcccaacaattgcaagcttataaagttttctccccttatgttcaagcactaaatctaccatttttctgcaggcatgtatgatctccttgccaacaatgttgggctcaagtaggtgggaactttttctcactctcaatactgaactgcttccagtaggaaccgtactcttgagtgtcaaaaatactctgtccttcgaaatgttttctatcttcctgttgagacttctaatcttcacagcaacctcatgacgtgcctgaacattagaaaagcaagtggaaattgacaggccagtgcaagcaattgacttccttgatgacgatgaaggatgatcagttagtagaatgcttcccttaaatctagccaagtcaataatatcatcaacatcatatagaacttctcttagctgaccaagccaattgtcaactgctgactcttccatcctcctttcctcagcatcactaatacaacaatgtatgagttcagtcttccgctgcaactctgcgagctcttcttgtatccctagaataagtatcacctcttcagtaataatctctttcaacttattggcacatgatccaaccaaagaatctaatatggttgccataggaaaaatcagcaagggagatccacttttaacgtttcagaaagtgacagcattgtaggttggcaaggaatgcacgatatctgttagcatgatctgaaaaatatataatgttcactaaaccttttgtattgataaaatagacatccatgggtataactactgaattgccatttatattaatacaataattagcttatcatacttaaactaaagttctagggacaaatcatgcacagtatgaggtacataaccaacactaaaagtattacattcttatcatgtgaggtattcatagaagtatgttttttttctgtgtagtgtagtgtatctactcttaatatgggactacaactaaagaatggtttatcttttacaattacataattgtatataggactggtgagaataagactaactaattaacagcaaacaatacacagtctaacatactaaaatgaacggaagaaggcaattatttcataaaatcatattcgatactaaccgctgtaaatttcatatagtgcagtgatccctctacccctatttggttggtgtgcaaagttccaattcatcttggatgatgatatcatggtgacttggcgagggcatcatgtggatggtaagaactagaactagaacatattaaatctgaaagaactagaacaatgggattacctttagacagcttcttgggtcaacgggcaacgacgaagaagaaatgggcaacaagttgagaggttttgcttaagcatggaaggcgaagtgttgctgggtgtgaggctgaaatgagccggatcaacgtcttctgctggagtacaagaagaagatgactgagtgagccaacgtctcgatcgactccaaccatgacaggaagcaggaattgaacaagggaaagcagaagatatattaagtccatatggcaaagaagaaagactcaccccagtccccagaggccttaggtgcgtacagccacagcatcaccggctgcaaggaagacgatgagcacgttcctggtgatatactggacctagattatgcagtggcagagaggagaagacggatatgaaattggtgcagctcgtttagtttggagtattcacagcctttagcagtgctggacatgacaaaagatgctgttaggtgatatgccctgtctgtcgcagtgtgcattaggagtttgtttttcgccaaattgcagaaaagacaattcatcggttttgacattccagaagccaccgttcctctattgtctatatagggtctgctacataattttctccatcatgctaataaaaagattcccatgtctcattaaagaaaatattaggagtgaaatctgttgtgtcatttcttgacatgacatgatgctggtacaaagttatcattgtttatatctttctgaaagtattttattttcatatgtctggcaaaagtacgctggccgattattaagtgaggagaagtttttagtacatgtatacagcaagcatggttattaagacatccctagccgcagcaacctccccacagagcaacttgcaggaggtcaccagaatctttccaaaatctatcatattattaaagaaatagaaaaagaagcctccacgttcactctcatggcctagaaattctcacattaatcagagaaaaagaaaaagcagagtccatgtagaaatacaatttagaaataactgaaattcggaattaaaaaataagtaatattagaagaggagactagagtctatatagaaatacaatttagaaatagttgaaattcagaattaaaaaataaggaatattagaaatggagtatagagtccatatagaaatacaattaggaaataactgaaattcggaattaaaaataaggaatattagaagtagagcatagagtcagtatagaaatacaattagcaaataactgaaattcggaattaaaaataaggaatattggaagtagagtatagagtcaatatagaaatacaattagcaaatcactgaaattcggaattaaaaataagcaatattagaagtggagtatagagtccatataaaaatacaattaggaaataatagaaattcgaaattaaaaataaggaatattagaagtggagtatagagtccatatagaaatacaattaggaaataatacaattttggaattaaaaataaggaatattagaagtagagtatagagtccatatagaaatacaattaagaaaaaaaatagaaattcagaattaaaaaaaggaatattagaagttgattatagagtccatactggaattttaaactaactaaaatttggaataaacagaataaaattaaaagtatagtttagagtccgtataaacatacaatttacaaataactaaaatttgaaattaagaaaaatatgggaagaagagtttaaagtcaatataggaatacaatttagaagtaactgaaattcgaaattaaaaattaaagaatattgaaagatgagtttagagtccatataggaatacaattagaaataataaaaattcagaaataaaaataaataatattggaagaagagcatagagtctatatagaaatacaatttacagaaaaattcggaattaccgcgaaatctgcgcgggccaccatgctagttatgattgaaacagagtagtgcatctcatcttcaaaggattttgggtggcaactggcaccgctcatcacccctaactaggggtgaaaacggtacggaaacggacggaaaccatctttattattttcgttttcatattttttttcggaatcggaatcggaaacctcggatacgaaaacggaatcgaatattatcgaaaccgaaaacggagcgaaaacgaacaggcgcgaatatggtaacgaaaatttatcggaataaaaaaacccctcaaactaataaatccaattgaataaattatctatgtttgaaagagtaatgttgtcgataaatcccaatgtaggacaaaaaatattcttctgtaattttagatttgcataacaaatattttttaaaaaaataacagccaaacaccatggtattcactatttagcgcttaaaaaaagaatccagggtatttcagtccaaaatttctggtaattccgagaaaatttccggaaattccgagaaaatttccggaaagtttccgaccgataccgagttccaacggaaactgcccttttcatttccgattccgtttctgagaaaatatttccgatttcgtttccgtttccgaaaaattccgaaaaaattccgaccgaccgattccgttttcgaaaataagtccggaatccggaaagtttccgtaccgttttcacccctacccctaacgctgtcaacttttccagttgaacacaatcccagtttcatgtactcgtatctgtactgtataacatcaataggttctgaagcttaaacggcagtacggcatctctgcatcattgaacgctacagaccaacagaggaacacgaactcaactgctatcgaccaaaatttcttcgttccagcgatccaaaaccacagcctctctctgcaccgttcgatcatatacaggcggctgagattagacgcgcctcggaatccgtgggccgattttcgtttaggccctcgtattatctcgtgttgtcgtgtcgttgtacaagggaggaagagatgtcgagacgccgccgccgctgccgccggcgatgaggagaagggaaccgggcgttgcccctggcgcggcctctccactgcaatgttcacaaagataccccgaattattactccatctgcaactacacattctgttaatcacagttggcatctgaaccgaaaccgagaattattttttttgagaatatgcagaacttgcgttagttgagtatcttttgtattaactctgaactctgaataaactagttggtttggttgtgatcgataatcctgacctggaagaagacagcttcgccgtggccgcaggcggcgcaccggacggacttggtgcggggcagggtggggtcgccggcgacgtcctggagcacctgggtgaaatccccgggcggtgtggtgcaccacgttatggtacgcgcagtagctctactgccagctacctcctgtgattcagggaattgcaagttcagtcaagcaatgcagtgacattgccatcctaaactgttagtactttttagctcaagaatgaacctgaatcaaccaaacaagggcactagctccgtagtaagatctaactgatgttgtgttctggcctatatgacagtggtaacgcagttgtttcttttacaggaaaaaaaaaaggctaacagttggaactgatttctggaacatggctgtgtcctatctgcttcttgctgaccttccccctcctcgctgaattgtacctgttttttttttctagaagctgcaggcaactgagatgatctctctcaagaaggcgattaaaagatgagaaagatcaaatctttgtagtatctccaagtgtctggagaacagaatctcacttggccttcctgacgccaaccagttctctgcttaggcatgcatttgcattgtgaaagagctggttgacagagacaacggcagaggtttctatgagaattcggggcttatttccagtcctgttgcatacttgggatcaaaacttttagcgttgaatccaatggacaggtttcacgagtaaacatacagaaatatttctcatcaaatattggagtttacaggagtaattgtttacaagtatacttgttttcatgcgtttttgtgtatctggccaaactttgtacgtactgctaacaaacagtgaatgatttcctttgcctaacttgtgtctcaattctcaactctcaaacagcaggatgcaaggactgagagggggatgaactggtgcatgtgtctatcccaattgattttactgggaaactacttcactgtgtttggtccatatgtggggagtactgttgtatcttttgataatagaatcagatttgtccaacagatacagtttggctgaagtgctgaactgaatcttgtctgcacatctatctacaagctacttgcatttaccatttagaaagcatatggattgcgacttcaacgggaagcattgatctaacattctcccaaacagagatagtataggttgattcaggtcttgagatgatgtgaatcactgaactctacagagtacagaccaacaaaggaacacgaactcaactgctatcaaccaaaatctcttcgttccagcgatccaaaacctcagcctctctgcaccgctcgatcttatacaggtggcttagatttaagcatgcctgtgactgtgaatcgagggtttattttcatataggccctcgagttatctcgtattgttgtcgtcatgatcgacggtgacccggcggcggcgggatcttctgcgatagcctgtggaggcgctggcgatgtcggcggatgcgggtcactggcggcagcaagtggaggtgcgaggtgaggatgaggacggtgaggtggctttgcgttcaacagcagtggctgtggtggtggtggccatgactacggtcaccggaggcatggcggcctcggacggcaagacgagggcgtgggagatggctacatttggccggcgcgacatcgtttggtagaggggtcggtgaccggcttggcacgagaagcgcggccgatggagggaggccggattggcgcgagaggcgcgtccgatggagggaggccggattggcgcgagaggcgtgtccggtggaggaggccggcttggcgcgagaggcgcggctgacggtggaggaggcgacctaggtgtgaggagaatctgctggtgggtgtggcgcgatcttcggcgctcgaaggctagccgactggggacaccagtgcaggggtcccacaggtcggcagagcttgtatggtggtggggcatcagtgcgtcagccgtggatttgcaggtggtgagcggcgggtgaaaactcagtccggccttggtcgaaccaacaacgaggttctccctcctgagggtgttgtcgtgttgtttcatcccccaagggtaattgccgggcgaaagcctagtcttggctccttcgagtcccgacggacggcggcagcggcttttccgtcacttctcttcttgaagacatcgttttggcacccctatggggcgatctcgtcagtgtccctttgtcggcctagtggcggtcggtcatacttagcggcggccggtccggtgctagccttctcctgggcttgtgtgttggcgatgtcggtgtgtgggtggggttttttttctttttcctggttacgaccctccagggttgtaatcttgtaatctcgtgcgagtcattcaaaaaaagtttgcctccgcagtgtgaaggagcagggcgggttaggaaagggcaagaatgtaagtgtctctatcatcaatggtatagttaggtaaaccttgtataagcaaaatcctagggtttgcttacggttcctgtaaaataaaattagacccaagtggggaggctacaggggagtttttgaaatactcctacaatatactacttcactccttttggtccacatgtcacatgtggggactactgttgtgtcttttgataatagaatcttgtctgaatacagtttggctgaagtgctgaactgaatcttgtctgcacatctatctacaagctgcatataaaaagcatttctagttggattgcgacttcaacgggaagcattgttctaacattctcccaaacagaaataggttgattcctttggatatagaggccggattttatccattatctaaaaaaaataggttgattcatgtcttgagatgatgtgaatcactgagcgctacagaccaacaaaggaacatgaactcaactactatcgaccaaaatctcttcgttgcctcaagccttgccttcgagcacacattactgcttgggtggtcaaattcgcttaaccatcttgtctccccttttgtatctatgtatctcttgtatttttttttctttcttcctgtttttctcccttgtacctctgttttttctcatgtcttttctttctgttttttccttcttctcccccctctgttctcttgttcggctttaccagattttatctgatttgaccaccattaatgcaatggttataaggtagtctctaccttttgcgtcaaaaaaaaaatctcttcgttcgagcgatccaaaacctcagcctctctgcaccgttcgatctgatataggcggctgagatttaaacacgcctgtgaagtgtgaactgggggtttattttcgtataggccctcgagttatctcgtattgttgtcgttgcgagcgacggcgacccggcgacggcaggagcttcagcgagaggcgatggggagaagggaaccgggcgttgctgcgagcgggcgatccgacgagccaatgaggtcatcctcgagctcctagcgcgcgcggccgtcgagcgagcccccacctcggcgttcgtgccggagaccagagaatgtaagcgacacctctcactcctccctttcttttcccgtcgctgaatgcaattcagttttgctttgctttctgctgcattttgtcatccaggggaagacaattttgtacctgttagatgaacttgttgcgatgacactaagcgcctctttgaattggaggaaaaacataggaattttggaggatttcaatcctataggaaaatttcctatgaagcccttcgaaacaaaggattgaatcatatacaatcctttgaaattcctatggacaatcctaaagagattttggaggaaatttagcaagagcttcaacctcttggtaactttcctacgagtctatctctctcatctaattcctgtgtttttcctgcgattcaatcaaacggtcattcctgtgtttttcctgcgttttgcaatcttctgttttacacttacattcctatcaaaatcttacgtttttcctattcctatgttttctcaatcctgcgattcaaaggggccctaaaaagtctgtgcactaaactgaatgactgaagagctcttacaggaagatgaaaggaggacgcgtcccccgcgtcgctctcacgcgggcggctcgggggcgaaaccctagccacccgtgccgccacaccctcatccccctcctccacctcgccgccgccgaagctcgccggcggcaaagccagtggtgagccgggaaggcggcggcaaggcccaaacgtacagctcggtggaaccgtcctctgcgtgaggaggacggagaaggccgacgacggcgcagccgaaggtgagacggccgatcggtttggggcggcggatccggcgcctccgtggccggatctggccccctcacccacggtttcggccagcgggctagcgtcgcgacggaggtggagaggggcatcgagcggcacgagggaggacgcgggccccggctggcgaggccctcggccggtgatggggggccacgcgagacggcggtggggtggccgcgagacgacggcgaggcagccgcgagacgacggcgaggcagccgcgaggcggcggtggccctcggcccggcgatgggggcggtcggatccggtggcccttggccagatccaccaccctcctggctggatgatggcgtgctgccaaggtggggaccagtgtgccctcgccagagcggcagtgggaggccggcgacggcgggggtctggtgctgcgagaagacggatgccaggcccttgtcggcgcagtggcaacctccagctacgcccactggcgtcttgacaaggtgcagcgggcctgcgggcgcttgtggcgacggtggcagcggcataccggggagtgggtgctcgtggaagcgatggcagcggggagcttctacgaccagtactttggccgccttggccggttctggtcggtgcagcagaggagtgtgggcgatggtaggatgcgtcgagggtggaatgcttgtgagtcatcttggactatcgtttggtcgtcgatgtgggggtgcttgtgtgggtaatgtgcagacgctggcgaaagccttgctgtacctttggccggctcgatgacgacgacgcacccattggcgccatttcccttcttgaaggcgttgtcaatgtgctctcccatttgccccacaaatctccaagtgaaaaccttgctccggcttcggacgagcggcggcggcgttacgcgtcgtgtcctccttgggggcgtcgcttcggggaagttcctttacatcgatgactattgagggtctcttcggttcaaaagctttctttccttggtgcttggcgaggcctaagcctcttgggttcgcttcgctcttgtggtgggcgacacactcttcggttgtttctacggaggaagtcggagctgctcgctgctggggtgcggcgacgcttgacaacgatgacgtgttgcggtctcttccaaagagttggtgctggccatgtgaaggaagtggctctttcatggcttggctgatgtccattgtggatgtcggagctgctttcgctttggcaacttccgtggcttcaatgtcgctgcagtggtgaagtcggcgctgctgggttgcttggccggctagctcggcaacgataacacctcttctatgatgtcggagctgttgtgccacttttgtgtttagcttggcaatgatgtcttgcgtttgggctccgccgttgttgttagtagtgtagttaggtcccatgttttcctctgtgatgtcggttccccataattaaccatgcagctgtatgggtttcgggcccgatgtctcttgtctgtacagtttctccctctcttaatataaaaccagcaatgctggcttaggtttaaaaaaaaaaagagctcttacagtaatgaacgcaacacagctggattctaatttcagagtccatgacagtgttgaaaatttggggagtgaactccaaagcattaggagataacattctctgaacattacgatcaaatgccatcaggtgaaatgctgctaagtatctgaaactggatctaggaatttaaacttctgacgaaccgcagcctccacaccgcagtgttcacaattctcaattctcaaacaggatgcagggaatgagaggaggacgaactggtgaatgtgttcgcctccattgctttcacatgaaaactggtttgcaatgaggtcaagctaaaatagtttagaaacagaattgcccaatagagcaccagagtggatgagtgtctagaagtgtttttcagtaaactattccatcaataaaaatgcaattaacttgacaagagtgcagaaattttcaagagaactttcactgctctagatagcagcagcgcattgtttcacttaatgtctatacactattaccccctgctccttttccgggcttgggaccagaagtgcttcagcgttgatgacttaggggtatttcagtccaaaaagagatgcaaagatgataaaataaatttaaaatggaagaaatgatgaaaatggtaaagtggcgaagtgtactcagttcaggatgttattctagcgaagcccatttaagtgatggtatttttacgaagccaattttacgcgatggtacatatgcaattttctctttttcgggcttggaactagcaatgccattaaagatgcacacccaagatggcataggaggagctacctacacacgtgcaagacaaaaaacaaaaacacgttttttttttcatttttggatctgtatcccttttttgactttttttttgtaattttcgtgttcttttcactcttttttttttcagtttttgtaatcttccaaagaccagcaactaggtaaagacaagaaacaaatgagaggagcaaaattgtttgatcctgcagcaaaattgtatcttgttgttcaggacttcaggcacatttgggctccaagacttgaaaaaaatttttgctcctcatcaggtcatggtcggcactgaatttccttcacctacttgtcaattcgcagctcttagacctggtggtctggtcaagctagcttaaatagttcagaatcagatttgtccaacagagcaataagggtggatgagtctccagaaatgtttccacaattattccatcactgaaaatgaaattaatctaataaaagtgcagaaaattcccaatgatctagcaacggagcatcatttcaacacacatctataccaaactatcccctcctcctttttccgggctggggaccggctatgtcatttagttatacctacgatgacataggcggagttacctacacacctacaaaaaaaaataaaaagaaaagaaacacacacgcaaaatctaacgaaacatgacaatatattttacaagagctaaagaaaatatattttttatttttttgacattttccctttcttgatatttttgttttatttattttttaaaaaaataaaatttttttaatatttcaaagaccaataactaggtaaaacaaaaatacatattacaagtgactgcacagcccaaattcttcaagattaacaacctacaaaataaataagcacacagaaattaatcatggatgtatatatacataagtattttggtaatttaataacttaattaaggaaaagaaaatatatgtgctatcagtttttcaacaatcatattttctggaattgaacttaccaaacaatacacgtgcattacaaaaggcataaggaaaagacacacatggcctatacataggcatgccgatcagcaatatcctcttcttcttttaacaggtagaacacgaacaaaactattaatcaatttgaaccaatacaaagacatttaggtggcttttttgtttcaccaaacaaaccttaattaattaggagccctacactaggaacagatgttgggcggactgtgtgctgtgccggcatggcccatttgtccgtgtcgtgcttgggccagcaccttagcccatgggcttacacggcacggcatgcctgttgacgggtcggcacgagcacggcccagctgcccatttattttccctacaattttctaatttttcccatatttttctcatatttttttattttttttcatattttatcctatttttaccatatattttctaatatatttcgtatatttcctaaattttcctcacgtttgtcctgtcttcattcattttttaacttcatattatttttccctcaattttcaattttttatgggccacgtgcacggcctgctacagttgccgtgccttagtgggtcgtgccactagtgggcccgtgcgtgttgggccgggccacccatttggccagctatagtcatggtactgtagttgagtatttttaattgaattaattaattagttttggattaatcatcattatatccgaaccgtggagacttccctcactgttttccaagtcaaatcatggtaaagtacaagagaccggatgcccgaatgccgccattccaacatttttttaagcaaaataatcattttaacccatgtattcaaccacatgtacaattgaatttcttaaatattttaataacccatacaacgcacgggttgacgactagatctaatggttgtaaatgatgggttcaccagatttaataaagataaatgacaagatgtttttgtttttctcggaatttttagaaatttctttaatttattagaatgtcatgtggaggcttaggagtgttcgtaggagtgctacgtgatggcttagaagcgtttgtaggaggtttaatgtactttaggatataatagattataaaatgctataacacttgtttctgtactggttatggacattgagaataattacaacacaaagttttaaggatttctgtactagttttaggtgacaaggtcagtaatataggtacaaatattaatcataacaactaccgaaagtttgacattttgtctaatatatatgatgatctccttactaagaatgatgcaaagtgtacaacatcaatgaatgtaaagtgtacaggtgagaataacattagacatgcatgattttggctgaaaatatgcaaagttggaatgaaattaaaatatgtttccactattttagataacgatagaataaaaatatgtatcaacaaatacagagccaatgcccttaccttgtgtctctactaatctactgtcttttagttgggtcttcacatctcactctctaggccacgtgtagacatccaggtggcggtactgctctcgaagcccatgcacccacggtgatgagtcctccatattcacatccaaccatagctgctccaaactgcctaactcctcaacacagctcaaatttggacaaacacttacaaacagctttctcactttgggaagttctgtaaccctctccaggccttcacatctacaaacagaaaggaaaccagatagggatggaaggtccttcaccgacttcaagcagcttgctgctacaagggagagctctttcaaactggtggcctcgtgtccaagctgttgtgggagagccctcagcttggggcagttatcaatgtccaacctcttcaaagagggcagcacacacaaccttggaaatgaggcttcccccttttccgtcacagtggttccatcctctcctccttcattcattgctgcaagtgatatctcctcctcttcggccacagcagttccatcccctcctccttcgttcattgctgcaagtgatatctcatcttcttcaataaaggcccattcctcccagttgggcatatcattgatgatcaacc

SEQ ID NO: 7195 - DNA, 616 bp, Oryza sativa
  unsure (1)..(616): unsure at all n locations
nnnnnnnnnnnnnnnnnnnnnnnnnnnnnnnnnnnnnnnnnnnnnnnnnnnnnnnnnnnnnnccaggggaccaggacctagtcgacggcggaggaagtagatggtagaggagatccggcatccggcagcgtggtgagcttaagcgacagcggcgccacgagcccgccggctatggcagcgagacagattcccccgagcggcgatggagacagtggcggacctctccctggagcaacgtgagcgaaggtggatgccgaggccggcgtagaggggatagaccggcgggagtccgcggtggtcagcgtggaggagtcagggacgcggaggatggcgcggcggcaactcggcaggaccggcaagtgtggtggccaggcagtcatcgggcaccggctgacggtctagggacgttgaggtcgaccggcccggggacgtgcgccacacctggggcgaggccgccccgacgtcgcggctggagtccagccatcgccgagttcccgttgatcacatgatcacctttgccaccgcgccgtcaccttgggcagcctccgccgcgccgctccctgtcagcgctgacccgccttcgcggtcatcttcgccaccagcactggggatcgac

SEQ ID NO: 7196 - DNA, 439 bp, Oryza sativa
attccatttaatttgtgggccgggacgatactacggggacatgcggcccgtcagcgcagggcaggagcaatgtgaggcccaaagtgtacgggccgtctctggggcgatacttggactttggaccctttcacagcccaacgtgctgcaagtgaacatgggcgggatgcaacgtggggcccatattttatgggccatcaaggggtttgcggatgacgtgtgggccgggatatctaagggcgcctgagcattggaggatcattttcgaataagccctcagatcatctcgtattgtcgttggaaaaagggcgcgtgggtcgccgacgccgacggcggcgctccggtgagtggcgaggttgatggtggagaaaggaactaccgttgctgcgggtgagcgctccgatgagtaagtgagtgaggtacatcgtggagcgcctggtac

SEQ ID NO: 7197 - DNA, 694 bp, Oryza sativa
  unsure (1)..(694): unsure at all n locations
nnnnnnnnnnnnnnnnnnnnnnnnnnnnnnnnnnnnnnnnnnnnnnnnnnnnnnnncataggattctcacatagatatgcctttgctcttgaagttctttcttcctgaagttctgtttcgtcacagacatgagtaaaagggcgtaagagttatttccagctggcctctagtgtgaacatgcctattcggttttgagaaatttcacaggaatttttaaggaattgaactatttcctacgaaaatcttgtaaaattcatgtattccgaaggaggcttcaacattctagggatggccaagaagtaagcaatacaagttctgctaaccatcatgacatggattgattatccaatatacaccgacaggtatgcaaactaaaccaatcgtgaatcgtctttcctaacatagagttgcaagtttgtattcgtacttctcacttctttttccttctgaagtgagtttcttttttttttcttcttaagtgagttatatctgttggtgatgctcttatggtcaatcttaggattgtaacctatatgttggtgatgctcttatggtcaatcttccagtctagatgttttttttccctggggatttcagtgctaacttgaagtttcctcccatccttagaaggtatataccttcttaccacctatatatggtagttatattttcagctcaagctagctttgcataa

SEQ ID NO: 7198 - DNA, 2099 bp, Oryza sativa
agactattgtattttttggacgaccgacaaaatatggtttctccagtagtgacacaagctttccgtacacaccaactagtaaatctttactattataaaaattgaagatgtttttgcctcatgctttggtaagtcgcccgacttccacacggcctccccacacctccattttctcctggttttttttcaaccgcagtcctataagttcaatttggtttcagtcaggcgttgtccgattccccagctctcacaagctacgcaacgatgcacgatggatgagatcacgtttccacgcagtggtgcaaaatccggttcatttacgttccgaatcgcctgaattagagcccgccgatctatgtatatactataactatatacacacacacagatatactccctctgtttcgaaatgtttgacgccgttgactttttagcacacgtttaatcgttcgtcttattaaaaaaatttaagtaattattaattattttcctataatttgattcattggtaaatatatttttatgttgacatataattttacatatttcacaaaagtttttgaataagacgaacggttaaatatgtgccaaaaagtcaatggtatcaaatattttgaaacggagggagtactatacgcaagagtatcgtaagtacacacctgcagattgttcgactgtcgacgagcgcagttggttgaggctgcgttttgattagcagctaggaagcggccgggtgcgctccaaggcctgaggccgatggttcagtcgtggcgaggcgaaccaccaaggcatgcacctgccagcagcaacgacaagatctactcatcgtgtattagatggatacgcatagaacaaattatttagttttcctgccatctagacaacttgagtttttgtttatagggcaatcgtcagatgaattctttacatggagaaaaaaatatatttttggttcttactgcctcgttttttaatatatgacactgttgattctttcaccgttctttttattcaaattttttatataaatctttactattataaaaattaaagatgtttttgttggtactttgatatgtcatctgtgtttgagtcggttttaaattcactcgcttttggaaatacaaatccatgcttgagatggttttaagttcgttctctaaatacagaaggagtcgtataagaaatggtaacttgagacgatcaaactcttaattttagctcataattttataaaaaaacaaatccaagcaaatttccacggtgaatttcaccttagctaaaccgtataataataaggtaattcaaataacctcctcgttgcaacgcatgggcattttttatagtgtaatacaaaattttaaaaaaattagacgcatacttctaataatattacacctacgtgcgaaatcttatcttcaaattcattatgttttagctgtaaaaaaaagataaaattctgacagatttttatccttaacactatcagattttttaactttttttgttacggctaaaatataatgaatttaaatatgagactttgtagatatgtgtaatactattagaagtaaatgtccaattatttatagacatttttgtgatatttgctagtcagtgtgcacttatattcacagtatatggaagttcttacccctaatttcaattttaattctaattttaccttaattttgtaatattataatttcattccgttttctcaacttaagcttgtgtttgctttgattttaggaattaacggtgctcaagcttgtatgtacttccttcattttataatatattataagccgttttgatttttttttcaaactttttaggttttatcaagtttatagaaaaatttagcaacaatataagtttgacgtagaaaatagcaagtcctgataaatagacaaaaacacccaatgagatgatataagtagattagatcatgcaatgagtagaaatgcataattacatactactatactagcaatatacatccttgttcttattcccccatatatagtagtatgtaaaccatattattgatataacgtacggcatccaactatacctttcatacttttttgcattca

SEQ ID NO: 7199 - DNA, 6439 bp, Oryza sativa
aacattttgcttcgatgctttgacaattatggatcaatgtgtttcatccttttacaggagatattactctctccgtccaaaaaaaactcaacttctggagtttgaattttgtcccaaaagaaaccaatttctatcatcctacctacccttagcatataaaacgagaagttttatctctcgaaaaccctgtacccacctatcaccattactaattttttcgataatgaggagcattttgatcatctttactcctcactaaatttgtattggaatgctctttttggacggagggagtaggtacaaagcagacgcagaacaagtccactgcagaattatataaaatcgaatcactggcctttcaatcgctagactggactgtgtccaatattacttattctaaaccatattattgatactacgtaccggtcgtactagcactgcaagtcgcaccagctgctacaaccataaatctaccacatgaatacatatactacctctgtccgtatcattttaaatgcagttatgggtttccatgtttaacgttccgttttatttgaaaaaatatataaaaaatttagtcaaatagaaagtactatttatgtttgatcatttaataacaacaaaaaaaatactactccctctgtttcacaatataagtcattctaacattttccacattcatgttaatgttaatgaatctagacatcaacatgaatatataaaatgctagaatgacttacattgtgaaacggaggaagtaataaaaaaactgttcaaataagacggacgattaaacgttggacataaatagtgtaaaactatattctttatagatcggaggtactccctccgtcccataatataagggattttgagtttttacttgtaacgtttgaccacttgtcttattcaaaattttttgaaattattatttattttatttgtgacttgctttattatctacggtattttaagtacaacttttcgttttttatatttacaaaaaaaaattaaataaaacgagtggtcaaacgttgcaagcaaaaaaaactcaaaatctcttatattgtgggacggatgaagtagtatatcttcgtgttggaatacaggaataccaagctagccattttccttccattcctcaatagcaaagtaccgatgaataatgacgatccacacgaaaacggctctgctatgcctcctaggcgccgtagcaactacggcatggctctccttcgccgtcgcgcaaccacagccgccgccggcctgccggagaagatgcggcgacgtcgacatcccttacccgttcggcctcaacggcgatgcccccggctgcgccctgggccacggcacctacggcttcaacatcagctgcaacgacaccggcaacggcgtgtacaagcccttcatctgggacgtcgagctgctcggcgtcttgctgccggaaggccaggccaggatcctgatgagcatctcctcctactgctacaacccggccaccggcgccatggacggtcccgaaaacaacacctgggcgctcgacttcacctcgtcgccgtacaggttctcccacaccggcaacgtgttcaccgccatcgggtgccgcacgctcgcctacatcggcggcgacaacgtggacgccgacgtcggcagcctgaccaccgggtgcgtggccacgtgccggctgcaggccggcaacctcaccgtcaccgacgacgacgtcggcgcctgctccggcatcggatgctgccggacgtccatccccgtggggctccagtactactacgtctggttcgacgaccgcttcaacacgacggccatccacaacgtgagccgctgcagctacgcggcgctcatggagaagtcgtcggcgtcgtggttcaggttcaccccggcgtacgtcacctcgtcggcgttcaacgacaccttcaacgggcaggtccccttgctgcttgattgggccatcggaaacgagacctgcgagcaggcgaggcgagcgagtcccgagtcctatgcgtgcaggagcagaaacagtgagtgctttgactcgccaagcgggctaggctacatctgcaattgttccaagggattccgtggaaatccttacctgcacccagaagatcccagcagttgccaaggtgaatgttcccttttcttgattgaggaattaaaatagttgctgtgttagttagtttggacagtaacataggattaattaggtaataatcaaacaacaaacagagtattattaggttttaattgaggatcagagcaattaattaatttagacttatggtgtttcttatttgtagtatttgattttgttaaaaggacaccttagtattatggacgtgactacacagctagtggtaactagtttgtctaaaccagctaccagttcatctatgagagacattatcaacctatatttcaaatacaattttctattaaactactcatccgatttatgatccgattgcaccattatgtttgtaacaattaaatctttaaaacaagatcacacatgattatattttgataaaaaattataaattacttttataatatatctaaattactttcaaatttcactaaattacttcttatacatgtaaaagtaaattcaatgaagcctaaaagtaatttgcatatattatagaagtaacttataaccaaaagaaagtaactttaatgaatgtcttttttaattggatgtgactacacagctagtgatagctagtttgtactccatctagtatctcctttcaacttgaaaaatacgatagtatcttcttttctcattctatatgaaaaacaaaaatgaaagaaaaagacaatcaatgattaaacagatttatagagagctacttttgaaccatgcaaaagttacttccaattaacattgaaattacttttaaaaaatattaaacttatgtgtgttgatctgtgctgattaaatttaatttctagataaagtcatatttttatccctacgacgaatttacttctaatgtcgtgacaaaattacttccgttttgttttaagttacttttataatatatttaaattacttttagactctattaaatttacttttatatgtctaagaagtaatttagtcaactctaaaagtaacttatatatatgataaaagtaacttacatatataataaaagtaatttacaaatataaatattttttcatcgtaatataatcatgtaagatattgttgtgaagatttaattgtaacgaacacaatggtgtaatcagattgtagatcggataagtaatttgagagaaaactttgtttgaagaggaaaaggacgtacatgtatattaaaaaaaatgcatgcatgtattaccatgtaatagctggacttctccacgtttctctatgttggcgtcgctagttaaggcaaaattgagatacctctctaaatagattttacatagtattatttagctacacattgtagacgcacaatctatttgatttggttcaaattaaacggacctttcaaaaaaagttccattgtctcgttcacccaattagggcctatttagttagcgaaaagaaaatttgttggtgtcacatcggatatttgactggatatcggaaaaggtttcggacataaataaaaaaactaatttcataactcgcctggaaaccgcgagacaaatcttttgagcctaattaatccgttattaggatatgtgggttactgtagcacttatggataatcatagactaattaggctcaaaagattcgtctcgcgatttcccccctaattgtgcaattagtttttcttttaatcttatttaatggttcatgcatgtgtccaaagattcgatgtgatgtttttgggaaaaatttttgggaaactgaatcaggcatagtgtggatctcttgtgaagagaatgtcgatatatatatatatatatatatatatatatatatatatatatatatatatatatatatatatatatctttgttttaagaagaactgcttcctcctactctaaagaagtgcagtttgaactagtcaaacacatattaagaaaaaggttaaaagactaatatacctttcactactgttgacagtacactaacttggacccgatgtcgcgcacaagtcgtattgttggaatcggctatatcggcttatttagctcgactcagactcagccgatcctaaccgtagccgatctgaactccagccgtctttgtttccgaacttgatctccgcctccaactccgctttgatcaaatcctctttcttgacatagatgctaccaaatttgtttgttaacaactactagataattatttttctataagaggacctatataagttgtaggcggaccataaatgatcgtgcctttaaaaatcgaggctcattttcatatgcggtctaaaaatctatttatgcagacagaccacggcatgaaaagatgagcatattttttcatgtggttctcttaagtggctaaaactacacttatttagggctacagggagtaactgctaccatgaaagtgttagtctatacatgtttgttttggtttctatatttgctatgatatatttttcacttaaactctctctctctctctgtttaatgactaattgtagatattgatgagtgcacggatcagaacatgaataacaattgccccgggatttgtcgtaatactcttggtgggttcgaatgtatttgtcctgcgggtacccgaggcaatgcctcagttggacagtgtcagaaagtgctaacacatggagtactgttggctataggtataaatgcattacaattatgttttgtgtgtttgtatatatatgaagatgcttacttaatttactaatttgatctaaaaaaatcaggaatttgttcctcaacggttgttggccttctaattttccttggcatagaatggatcaagtataaacgtcgattggttagacaagatctcatgaataaaagggatgcatattttcgtcaacatggaggccaattattacttgatatgatgaaattagagaatcaagtttcatttaagttgtatgacagagaagaaattgagttagcaacaaacaacttcagggagagcgcaatcctcggtcagggcggtcagggtactgtttacaaaggttttgatctagatccagaaaacaatcctgtggcaataaagagatgcaagggaatcgatgcgaataggaggatggaattcggacaagagttgctcatactctcccgagtgagacatgagtacattgtcaaacttcttggttgttgtctgcagtttgaagttcctgttctagtatatgaatttgtgccgaataagaccctacactatttgattcatggccaaagcgatgcatccactagaacactagatatccgactggaaatcgctgcccagtctgctgaagcacttgcatacctacattcacttgatcatcctatttttcatggggatgtgaaatctgccaacatacttattggtgacaaatttactgcaaaagtttctgattttgggtgctcaatatttagggcagcggctgatgaaaatattaatgtagtgaagggaacaattggttatctagatccagaatacctcatgacgttccagttgactgataagagtgatgtctacagctttggcattcttcttctagagctcttgacacgtaggaagcctctatccaatgaggtgagcctcgcctctctcttccaagatgctatgaagaagggaaacattgatcatcacatagataaagaaatactacatgaggataacatggaactgctatacgaattcgcatgtctagcaagccagtgcttagttatggacagtgagaacaggccagcaatgagccatgtggcagacatacttcggcaattggcagatacggcgtcacaacaacacactggcacacttcagggtattcgctcactcagattattgggaaactcaagtggtagcatctcagagccgtgttattctcctgttaaaacaatggagtatgacagcaggaagacatctatgggcattgaatttgcaagataagggcatctgccatgtataagcattaaacttagttgcacaagcctatagaaagtttttgtctgagctacatttggcttctatgtcgctctgagattgttcaacatggaaggaatgagaacgtaccaattcccatgatagcgtaatatggtgatccgaacatgtaaaggtggtaaaacatgctttggcatggaattgtcaacactttgctgactgtacatgctatggtccaaaaccgaaaaattccgattcatttgtgctaaaacagatatgtccggacctattttctatgcttaatatcctcttacattctatattttcctcatcacacaacaaccttttattttccaacgtacgttttgccataa

SEQ ID NO: 7200 - DNA, 14071 bp, Oryza sativa
  unsure (1)..(14071): unsure at all n locations
acatttggtttttgctgaataatgtatggaaccactcatggcataacattccacagaatggcatagcctatctaaacccaacaacataggtcggcctcttggcaaccggccgagatagcgaaactatggcttgctacgcgataagatcaccacataatgcgctacttctctcgattcacggaagaaactacaacgccgattggcacaaccatagctttgcgcatctggtccatatccaccagcagcggtgtgaacagagcatttatagatcgacgagtttcctgggtgaacagattgaagacgaatgacggagcagaaaataactgagtaccagcccagttccgtacacgtatgacctgatccattgtcagcactattgaggggagatacccgtagaccggataaatagggtattggggtacattggtacgaggatctatgcgatatggcatctagcaaacaagaagacaaggattataataaggattgtgctagttcaggccccttatcaggtatagccctagtacagtttatataatattgatatggaaaactatatagtacaataagagtagatgaatccgatgataccggcgagatcgtagtcgtgggattagacaagatctcccggcaagttggcttcacgtgctccggcttcgtagactatggtgggtatgctgccggtgagattcgatgccttgaaccctccagggggtacgccttttataccgtggatcaacttagtctccaagtagaactcggggacatcggactacacgcgatatagaagaaacccaaccctttccaagtaagacgtcattagtcacttgcctataaggatattttccatattatcttgtgatttcctttatcgtatacggaaatagatcatatcttcgatggtgtaccgtatccgcatattacataagtcataggataggagatatgccttatccgtaaccatgacagtagccccgacttcaacttaaatgagttcacgttgtcattcacgactacgcttatgttaacagtgaaatttggtaagcccttaagagaattatcacatcgccaatagttggattcctgctatattcggttaaggaaattaatctattaaaggaagcttatccagaagttaccgagttcaaggacgatgcggcatggcaagttatctattaattaggaagagtttgttagtttccttttatctttaggaaagtgtgtttagtgtcaaataatgactttatgtttagtatctccccatgggtcattgtaaactatctctcgatcaatacaactactctcggtgcatcgccaccctctttaccgaggtttttacttatcatccggtggaacttgacacctgacagagggctgcatcggttcagtttgatctccggcgaaggggtaagtactacgttccgctggacctggtgaatctatcggctacattgctgttgttcacggctgcatcgcttcgatctcttggatcgctctggtttcattgatttagccgatgacaacaaagatttcattgatttatctaatcttgtggattttatgacatcggacctccagtcgatgtctgctttaaccttcggatcaatacttattttatcatatcattgttagccgattggtctatactggattatattattgttatattatattatcatcagtcgattgcctcgacattgttatttacatcaagcgtcagaatctacatcggaattatagccgatagctcaaaactctattgctatcgactggtatcggcatcgactggaattactccatcggcttgtcagccgatcggctcattgatctgctgtttacatatcttgtcagtttgcaggatcaaactgactggcacgcccgtatctcatcaatattttggatctgcactagagctaagtagatctcccaggccagtgtgtgtttttcacatcaacacgctttttggtacgcccggtagaaccacgaattttatacctacatgtcttaagaagtcaatgccaatatcatggtcacagtggagaatttaatggaggaacagaggcaatagatggagcagtttgtagctgattttcaaatgcgttgtcttcaatgtttcatcatgacacaagaagggccaattcagaagactcaattccccaagccgatagttgaaatacttcaagatacagttgatgaagcggttcatctcgcattgtttaatcaatctagagttttcacggatacattacaaaatttgatcaaggtaacagttgatgaattaattaatcagaaaagccagctcagggggcagactgaagaacaagaacagtatcggcttgggggggcaagcacatcagtgtcagcatgacgagctacatcaacaatatcggccagaagaatataaaacacatcagaatatagaagattgggccgatagaattgcgaagttagtagaggagcagtttggacttagacctaaggaacagatccatgtgtatcggctgccatatcttgagtggtttgatagggttccattgtgttgatgcgaaaaacacacaccggcctgggagatctgcttagctccagtgcaggtccaaaggttattgagatgcgggcgtgccagtcagtttgatcctgcaactgacaagatatgtaaacatcagatcaataagccgatcggctgtcaagccgatggaatgattccagcagatgccgataccagccgatagagatagggttttaagctatcggctatgtgtttgatgtagaatctgatacttgatataaataacaaaggcaatcggctgatgataatgcaagaaagcaataatataatccagtagaaaccaatcggctaacaatgatatgatagaataagcactgatccgaaggttaaataatatatcgactggagatccgatgtcataaaatccacaagattagattaaacagtaaaatcattgttgcaatcggctaaatccaacttatatgcaatccttataagccaatgcaatgtccaaataactcatcggctgaaacctcgatgaaacccttattggcagtcaaaaagcaggctaggggttatggttctaaacacgacttagtagatcaaacttaactgatgcaacactaagtatgaaaagaaacataatatctagacaatcaaggcgttgactgattttttaggctgctgaagaaagtcgcgagcaagtaagcggaatgtcctgactctatgttctcgggtttcgtgttgtcgtgacttggtctttctgataacttgtatatttgtcttcatagggcttctccggcgtcctccgcacacagagaggacaatgtcgcaacaagcgtggcgccagtggtcgtcgcagcccgcgcccctccacctgtcacccttccgccttcgcctcctccagcgctggctgccccacagacaggcgccgagatgttggctgagggccggcgtctccttgaagctgacgcttgagagctgcaactcgagcaggaactcgacatatgtcacgcccggaatttctatccaaaattccaaacgtttacatgtgtgtgaaccctcgtccaggaatcagctgaggcacacaataacaaattgataatagagtacaattattactctaattaataagcgaataaaatgtcattacagaggtagatagttcctctcaatcaataaagatctaagcagcggaaaaataagataaacggcgcagacgactccactccacaggcagcttgaccagggctacacctaatcctctacaccatcagcatcactgtagaactcttcctctgattaatgattgcaaggtgagtatatgacatactcagcaagccacgcagcaaatatgcaagtgcacaggataacaaaggatggcatagtagggtttcatttgcataaacagcatttaataaacatttcagaatttaataaaacagttaagtaataattaaacaatattaatccaacgctatacaacataccctgttgcataggcccaaccattctgaacaaccatcccggctgcacagttctatctccaaaccaggaatataccattccaaaccaggagctaatcaaattattaccagttatagcatcttttattatggtgagaagtgtgaaactaatcacgaaagacattgttagacccgcccataaccgcgggcacggctattcgaatagttttactctggccagaggtgtaccactgtacctacaagacacgatcccgcacatgttaccatgccccgaagtaccaccacggcactacaaagggggaaatcgtgacagtacccttcgcacaacacaatccaccacagcgcaccattcctggatcataatcactcccttataaacaaggcatggactccccagcgacccccgtgggcttatctccgccacttctcaatctggtgccccgcaatgatccatgctatacaaaaggtaaagccgttgcccatgctggcttgtggttggcacggttaatgtttcacaaccgaaactcgtgaaccggtccttaattgtcatgagcacgaccatcaaaaccatgtgctcacaacccacctttatcaagttttatttggcaaattaattaattaaccaatcacgattgaccatcgtgagcttccattaaatatccataagtgatagtgaagcatgatttatcccattaatgagctaatgtttctaagcacggctaagcaactataaataacatctagctgaaccaatccaatatatatggtccatgctagtcaaattataacccataggaaaataaagtcatcttcggccataattaaatgggaaaggctcaccacccaatgacattcgagaacaatgcataagttgaaataaatcaatagctttaaacaggttcaacatgctcaaagggttgtttgggggatctgtgtgacttgcattactggccttggaactcttcaaattcttctcctgaaaaaacgaactctccgaaaacgtcggaatctaatcagaaaggagcaaaatcaccaaacaagcactcaaacaagcatgaacagtacatgtggttatttttaacatgtagatctcaattttggaaaaatttagagacttgaaccaactaaatccgagctaagatgaattagttatgaattttcaaagattaaatcggattaaatcatttatatggattttaattgaattatgacgcaataatgaattatttttgaaaaggacaaagggaattattgcgtcagcggctagggttcgcgaaggaccaggtgcacggcggtggttcacgagattggacggccgagatccatccatccaaaacggacggccaagatccatcggtccacgaccaggccacgggggacgacgacgatgacgtcagcagtgacatcgccaccggcggcggctcgggcgtgcatgctcgccggcgaacgacggcgcggcggcgcgaacggagagcacctacgggtagcggacggcacggcgaactcaccggtgaccaaagtagcggcggaggagcaacggacggcaccggcgatgaggaagaaacggcagcgaccttcggcttgacgacggcgacggtgttccggcggtcgacagcgacggcggaggggcggacgaggtcagcgacggcttggccatcacgacggcggctttcccgagcggcaacgacgactggagcgacggcggcgcacggctggagcggcggcgacgacggcggcgcgaagctacacggggctagggcgctacgggcggcggcggacgaagacgagggtggcgacgggtagcggcgggcttgggggtgcttaaaaaggggctagggcgcggcggcgaaggcccacggcgaccggcgacgcgaaggaaagattagggttcgggagagagagatgaatccgattcgagattgaatccgcgaatttccaaagcgatttagacgatgtttccaaaagggaaaaggtagagtggatcacgaagatcatttcccctctattgatttcaccggaaaaggaaaggggcggctgaatttggaaggagacgacggcggcgcggcgctagggttcgggcggcggccggccggaggtagacgacaggcctgacaggtgggccccacctgtcagcggcagcgagcgcgcgcgcgggcgggcggctgcgggccggcttgggccggggagagagagagagagaaggttttgggccgactttcggcccaaagccaaaagaaaacttttaaaaccttttccaatttaaattattcattaaatgcaattccatttattaaaaatacttccttagctcaaataaatcccagaaaaatctaggaattatagagttaagcaaagtatttaataaaattttatctggccccattgtatattggaatttattaattaaaattagatcttctcttctaggcttttaaaataaattctaataattccaattaaacaacaatttatatatttaggatttttagggtgtgacaacatagcacacgaggaccttcagaagatgaaggaactcgttgttgggaacgagtcacagcggcacgggctggagcagcagatgttggacctaggggaccacctggagccaattcgggatgccgtccacaagaacttcactctccttcatcatctcgcgggggaactcggcatcgaagccgacatcccaaaacactccgacgagacgatgctggtgtcttctctgtatgacctcatcaaggcgatggagaagatccctgggaagcacgccgccaaggtggccgaggacacctgcaccggactgcgcacaggcgcatgtcacattcttgcctgcgtcaagcttgcctaccctaatatcgacctcaacatggtcttgaccaagggggcagacgacacgagcaaggacgtgatgtcggaggtgtcggagaccatcctccctttttatgaagagtaacttatcttgcgcttttaatttcgaacttgtaaacacattgggtttgtatagtccttgctagaacgattctccctttttagtttacttcgagtgatttgcgctttaatgggcagatctggaggtgtagctataaatagtccactctctccatttgggagtgctgctggactgattggatcatttgagattcatgctttcttggttccatctctccatgcgggtttgattcggatttggtgcgtgtgtgagagttgtggattcaagattgtgtgggtgcttcttgttgacttcgtgaagatttgtgagcacttgcatcatctccgggagatcgttttaacagaagacaatttggctaggaggaattggaatggtagtttgagatgttggttttgtatgaaaaatgaatcgatttaccatcttttcctacattgccattttgctagatttctttggagatttatgcaattctcgtttggattataccctccacatattatatctcatatgtttgggaattggcttgttggtgttaattaaaaaaatcaaggaacttatccttgttggaccttccactgtttgttgggctctctggcttagtagaaatgaaatggtttttgatagatcacctcaactacaaaggcatgatgatcatatcaagctaataaaagatgcgtatcataaacttgagtcgacgatcatgcagctctttgccaactttggatagagattcaccaatagaattctgtagttgtgggatctttaccttgtttggtttttattgtttgaaccttgtaataattggttgtagctattagagcaaaagtcaggatgttttattccattatctaaaaaaatctcactttttctcttatcgaattgcatcaaaatgaatattcatttagacacaattgctcttgatgtctttcttcatacttgttcacaagtgagcaactgttttctcattggtcatatgaagggtgtcatcgcaacagttgtgttaagaagcttttatggtccaggaagctaccagttgaagtgcttactgaaagttcaagtgccattagtttggttttggtgattaatgacaaattcaattacatgagactaatattgttataaggatgaaatgcgtggagatcaagctatatgtatcactctttctctccatgcacatattgatatattcatatataatattttcatgtgagactaatgttttgtttgagccatatcttgtttagtctctttacattgagaacatggagatgatgaaggtatgtttttattttaatgtctatatttgataaatgccttctattcttgtataggataagctctcaatgtttaatatcttgttatgtatactcttgcttcacacaaatattttgtatgcatacatctagggggagcaaatcctatactttagttatgcatgtaatcgatccaagttattcactttcatttaattgagatctttagatttgagcatatatttgagtatatgacacttctggtgttgattaatactcatcatttattcatatcctattatacatgcgatcggttggttaacatgtggaggttgacaaccagatcattgggactaataattttattgagttgaatgaaaaaaataggtctcaaggattgcaaaggtgttaatgctcaaatgatataattacaccaaatgataccaagaatgacaaagtgaagatattgaatgtaacatcctgaaaattacttattttctaattaagcatcatgctggttcttatgttcttattaaccttttaaacctaggaaaatataattaaagagacctccaaaaattaacttgcgtagaatctctctttgctatttaaagtctttcgtggtttttattctaaaattgatcttattaaaccaaggtatttactttgattcgatttttcactttaaaccttcttttgtaaaattcctctatttcaattcaattaaaaacccttttatgaattatggtcctagaaaccttcccatattacccttgaatctaaaccaccaaaaattctaattccattggaattaattgttaacccatcctttaatcttaaacctatcctttgattctcgatccaaatatccaaattcctccttttgatctaaccgccagtttaattcctacggcttgatcccttctcggcacaagaatggtattattacaaacattgtgaataattgctcttgtgctaaggaaatagattatatccttgtcattcaaaatctcatttagcccataattaattctctagatttctaccacatatttggggctaaaatcttatgtattccattccctccatttccctcccatattcccaactatatcttcaattttattcatatattcctctctcttatttgagtgcatcaaataaatctcattatatgccacctctaaaatattgcactcaaataatttgaaaatatctctcttgggaattatgtcgtccgagtcttcatcatcatcatcaatgatcagttttcttggcctcttcctggagctagcttgatgtgaccatggctactacggatacaacaattgctcacatcatcgatgaacaagatgatatcaaaatcaagtccttcaagtgctgatcaacaatccacggagaggtgtattgatcgctaaggcgcaacacaacgtctcgtacggttgtagtcggatcgtcaacgtttctccctaatcgtagttacctacaactcaccgaaagaccgggccaacaacagccttgagtgtcgagagaaactcagggttcatcaggtggtatcagagctttcgttgctcggtgagttttcatttttacctagaaccagaaaatagccaaaaaaaaatttcatacattacctagccatatttgtgccattgcattgttctatgcagtttttgctttgttgaatttttgttgcattgtcacgtcgtgttgctggtcttagcgtctagttcgtttagagtttcgagttctggtcacgttttgtaccacagtcgttgttgcctccatgtatctattgtcgtcgggacctacgaaaacggaatcggcttgctgccacggttctatttttgtagttttcagaagtttctgtcggttagtttttgagttcttgagttgcatctaaggtttctgttcggtggctatgccgtggttgtatccgtgatggtgcgcatgtgatgttgtgcatgaggaagaaggaaggagaagagtagattagatcggtttttggtagtagattggatcggtttctatttgaaccggattcggtttccttgcatgagagttttccttttattcggactccgtgtgccgtgtccttcctttgccgcccaccaccaccaggccgagatttttgagtcagactccctccctcacggctataccatgacatcccatacacttgggtgaaaatttttcgtgcgtcggattgaagatctgtttgcaaaaacgcaacctatgcaacgagagcatttcatttttgtatagttctaattttgggtttggattttcgtatttgagtccctgtaattttagtatttatatttgagtccgtgtaatcttacattaagatccttgagtcggtttttgttaaaaaaataaaataaaaatgagagaagaaaaggcagaaaggtgcataaaaaaagaaaaagaaaagccgctccaaaaaaaaagaaaagaaagaaaataaaaaataagagaaacaaagaaagaaagaaggcaaaaaaaaatcagtttggtttcatatattaagagtgtgcttgagttgtttctgatgttatcttgtggtaccgtttgtgtctagactcgcttctctattacgttctagccttggaccagcacggtacttgactttgaacgatcattcaactttgcattctctagattgagcatttgctattcctttgctacatatttaagcctacctagagctccacagatttgattgtagccatacagcaagtgtttgccaaggcatcgatacatccaaactccattggggtgcttggttgagtcagtgtacgtcaccattccacttgctttggtaagaacttgtaagagcttggtgaaaagcttgagtgtgtgtgatatttcagctgccactacctagtagttgataggagtgtgcatattcttgtgtatgttttttgtttgctactaaccatggcaggattgtgcaaggggaaacaagatggtcatgctcaacatcaacatcttcaccatcaacgagatatagcgacttcttcacgcatcacatatgaggtacatgataatgatcttgcaagggtagaatctaaattgccagtttttgatgctaagtatgatccgcttatgttaattgggagctagcagtagacaaacaatttgatgagtatgatttctctaatgctcaaatgattaaggctgctagtaataaatgtaccggttctgcatcattttggtagtacacagttggcaataagcttgaaacttgggatgaatgcaaaacaatgatgaggaaaaagtctgtgtttgcatattataaacgtactctacttgagaaattagaacatttaaaacaagggtgacaaacctgtgcnggagtactttcatactttttaaatttggtatcacttatagtggtttaaaagaaagcaatgagaacacaatgactagtttttttttagagggcttaattctgatattcaggctgggcttattaatgtgacatataatcatataggccacttgttcatgctggcttgcagtgttgagagcaatgttttaaagaacccaaaggagaaacaagctatgcttgtgcctcctattaatgacattttgcagggagctcagaacattcaccatgaggagaagagcaatatgctcgggatgtcatctccatcgctcacgaaggaagaagagaagactgatgcacctacaatatctgaagagggcataaaaggtaaattaaatggtgctgatattactcaatgtgagtgtgcttctgatgagtcacatttgtccactatccatgctaatctagagcaaattttggtggaaactacttctgatttgcctttgtcacaagttgatttacttgctgttccttgtgataaagaagagttgttgataatgcttcacttatatccctaccacaactagtgaatgaaaatgctatttctagtgtttcattgtgtgctgattttaagcatgttgttcacattgctaatgatgttgaggaacgtaaattgataacttctttaaatacttttggctatgttcagttcgatggtttttgtgagctcaataatttggaggagaaattatttgctaagtttgatttgccatgtccaacaaatgctatttttcatatctttggcgaatataatgatagaggtgatgtgactatggctactacggatacatccgttgctcacatcatggatgaacaacaagatatcaagtttgagtcctccaagtgccggaatccgattcggccacctgctacactgctgacttcaaacggccgccgaatctgcatacgacctccgttttcggcccgtgagtacttgatggaaagctctcggagtcctctttccaatgaatccagcctcattgccaaattccatctcactcggcagcaactgaagaaacaatgtgctgcgacacctgtaatgggcctatgggcttgtaacttcgtctggtaccccggcccaagtggggaccatgtggggtgcgccccaaccaggtggaggacgacctagaggacctcccacctccttaaatagctaggtagccctttagagtttcttgggttttgatagattaaagtttagccattgctacttgcttgcagcgcgcgtgtcggctagaccgtccgtctgcttgttcttcggaaccccaacttatcgtgtgtattaattcctatttgcaattcggattgcttttatcttgttcttgcttgtttcttcgatttgcttgcaggaataaggttgatctgcaccggcaagatcaacaacccacggagaggtgtatcgatcgctaaggcgcaacacaacgtcttgtacggttgtagtcggatcgtcaacgtttctcccaaatcgtagttatcatcaagtcagcgaaagatcgggccaacaacagccttgagtgtcgagagtaactcagggtccattaggtggtatcagagctttcgttgctcagtgagtttttatcttcctataaccagaaaatagccatacaaaataattcgtatcatttacctagccatattgtaccattgcattgttcttttcagtttttgctttgttgaattttgtgttgcatcgtcacgtcgtgttgctggtcttagcgtctagttcgtttagagtttcaagctctggtcacgttttgtaccacagtcgtcgccgcccccttgtctctgttgttgtcggaacctacgaaaacagaatcggctcgctgccacagttctatttttgtagttttcagaagtttccgtcggttggttttggagttgttaagttgcatctaggatttatgccgtgtggttgccctctgttccgtggttctgtatgtgatcttgcatggccgtgctgatgcgcttgaagaagatggaaggcgtgcggaagatggaaggtagagattagattagttttgtttggttcgggaaggaaatagttgattggatcggctgaagatcatatttcctttcttcttatctctttcatgcgcaccaaatccgaacacctgccgtttcctttcaccccgcacccaccaccaccatgacaaagtccgactcctttcctctactctcggtttcagtccgcaccgtgagttgctagacatcttggtgaaaacttttggagtgtcagattggagatccgtttacaaaaacagaatctacgggacgagagcattccatttttgtataattttaattttggattaggactttttcatttgagtccctgtaatttttgtattttcatttgagtccctgtaatcttacaataaggtccttgagtttgtgtttggtaaaaaaaatcaaaaaaaaggagaaaaaaaggcagaaaggtgcataaaaaaacaaaaaaaaaagagccgccccaaaagaaaaaagaaa

SEQ ID NO: 7201 - DNA, 6117 bp, Oryza sativa
gtttctttgtgtgttgattttaagcatgttattcacattgctaatgaagttgaggaacgtaaattgctatcttctttaaatactttgggctatgttcagtttgatgatttttgtgagctcgataatttgaaggagaaattatttactaagtctgatttgccatgtccaactaatgctatttttcatatctttggcaaatataatgatagaggaatatatttggtgcatagagttttcatttgttcggatttagagaaacatgttattgctaatcacactacttcgagtttctctagttttgattggatgaaacaggttattttgaatggactatgtgaagaacaccatatggaaaaatcgaggacggttttccgtgaaaaaggggaggatgatgtgaccatggctactacggatacatccgttgctcacatcatggatgaacaacaagatatcaagttcgagtcctccaagtgccggaatccgattcggccacctgctacactgctgacttcaaacggccgccgaatctgcatacgaccttcgttttcggcccgtgagtacttgatggaaagctctcggagccctcttttcaatgaatccagcttattgccaaattccatctcagtcggcagcaactgaagaaacaaagtgctgcgacacctgtaatgggtctatgggcttgtaacttcgtctgggaccccagcccaagtggggcccatgtggggtgtgccccaaccaggtggaggacgacctagaggacctcccacctctttaaatagctaggtagccctttagagtttcttgggttttgatagattaaagtttagccattgctacttgcttgcaacgtgcgtgtcggctagaccgtccgtctgcttgttcttcggaaccccaacttatcgtgtgtactaattcctatttgcaattcgtattgcttttatcttgtttttgcttgtttcttcgatttgcttgcaggaataaggttgatctgcaccggcaagatcaacaacctacggagaggtgtatcgattgctaaggtgcaacataacgtcttgtacggttgtaatcggatcatcaacatttctcctaaatcgtagttatcatcaactcaccgaaagatcggaccaacaacagccttgagtgttgagagtaactccgggtccattaagaggaatatatttggtgcatagagttttcatttgttcagatttagagaaacatgttattgctaatcacacaacttcgagtttctctagttttgattggatgaaacagattattttgaatggactatatgacgagcaccatatggaaaaactgaggacggttttccgtgaagaaggggaggatgatgtgaccatggctactacggatacaaccattgctcacatcatggatgaacaagatgatatcaagatcaagtcctccaagtgctggaatccgattcggccacctgctacactgttaagttcaatcggccgccgaatctgcatacaacctccgtttttgacccgtgagtacttgatggaaagcactcggagtcctctttccaacggatccggccttatctccaaattccatcccagacatccacaaaggaagaaataaagtgctgcgtcaccagtcatgggcctttggccttgtacctttgtttgggaccccggcccatgtgaggcccatgtggggtgcgccccaaccaggtggagcatgaccctagggacccctaggtcgtcctcccacctttataaatagttaggtacccctttagagtttcttgggttttgtttagatgaaagtttagccattgctacttccttgcagcacgcgtgtcggctagaccgtccgtctgcttgtattcgaaaccccaacttatcttgtgtattcattcctatttgcaattcagattgcttttatcttgttcttgcttgtttattcgattttcttacaggaataagtttgatctgcatcggcaagatcaacaactcatggagaggtgtatcgatcactaaggcgcaacacaacgtctcgtatggttgtagtcggatcgtcaacgtttctcccaaattgtagttacctacaactcaccgaaagatcgggccaacaacagccttgagtgtcgagagaaactcatggttcatcgtccctccaaacacaaattctcctctaaatcaaattattcaatctccatacaaaattagactttctcccttttgagtttgggccgcatttctcctttcctcctctcactcgcacggcccaagccggcccaaccagctgagccgccctttctcctctctgtgggcgcactcggcgcccaagccacagcgccgccgccgcccacggctttgtgcgccgtcgccgccgtcttgccgtcgccaccaagtcgcgccgccaccgtcgccgtgccgtgctgctcctcctccgccacccaacacagcagcagctgccacgtgctcgcgccgccgtcgacatccaatgggagcacagagctggcgccgacttcttcttttccacggcgccgtcgcgaagttctcctcgatcttctcctctggaaccgccttgcatcaccgccttttgccgcctataagtacccggcgaggtcgcccttttcctccacacacatccaagctcaagctcttcttctctctctcctccccatgccggccgtcggccgatctccctcgtcggagcattgccgaccaagccctcgcgccaatacgttcgcctcgacgagacaaatccattccctaaccttccccttcctttccccttccgagattagccaccaccgttacttcccaaaccggccggggcaagcttttgtcatcgccgttccggtctcctctctcactccccctgccggacaccgccctccccggacacgcgacgctcgggaacacactttgccgccggcgtcgccacctcccggccaccggagcaccggcgaccctctctccctctctcccctgtgactcgactggaaaggagaagagaagaaacgaacgaagaagaagaagaaaagaagaaagaaataaagaactgacaggtgggtccatgaacagtgcactttcatcttttctagatttaattcaaaccccaatctttagaagcccatatctcctaaaccatatatccgattccaatgaaacttggatctaaattcatctaaattcaaatccttcattttgatatcaaatttgctatattaagattttatttgaatttccttaatttattcaaataccatttgaataaatatttgatttaattaatcttatatttgaatttccaatttaaacttatatttgtatttcaaatatttccttttaacccaaaatacccttcagccactaaaaagctgccggttagaactttacaccttctatgtgggcgtccgtgcgatctacaggccccgacgtcgaacagttggttgtaaagcctggcaaaacccaaacccaaggtcgaagtgctgctcctggcaccctacgcctcgatgcgtacaacggtcggagcttcactattccttcgacctccacagcacacaacatagttcgctcttgaactctgtgtgatcctaaccacttcgccaccactcacggtcgtcggagtaacacttcttgtacaaacttccggttcctctagccgtataatatccatcgacaccagctagagaagaaaccaaacctagtcgttatgctactcaattctagcatcggctagtacacaacccaaacctagccaataccttgctagtcaaattccagtcgtcttccaattttccatatcagctccaatattacctatataccactttccataattttactcacccccaccatatattctccatctacccagaacctatacatataatatagagcctggctaatatattgccctactccacaattggcttaaatataaccaaaccctaggtgtaaacctacctaaacctaccaccagccaatactagccacatactcgcttaaccagttatatcccctactctccaagatattaaagctttcacatgaaatataagcgagaatagttgcttaatcccctctagcctccaaccatttagaatctatacctgaaatattagccaccaatccctaccaccttataaaggagatatctataccctaaacccagcctttctcgctcttcatcattttcttgctattttatggcttttattgaagttggttcttcctcttcttcagtagagtctattatatttggatggcaacctgtggtatttcgagcatcggataatcaggttgcctatctcggatttatttgcgctggagcaaggcaagttattattcttatccttgagcataattaccctatattctatatctctattctatgcattagtcatacatgatttcaaatgcataacctaaacatagcaaaccagatatgctagcttttgcttagccctgcctagttagactgcataaaatataatgaacttagattggaacagtacgatagaaatagttgatttccgggtggctagtactgtttcaaccgacataagactgcccaaatacttatgaagaacgaacgggtacgaccacagctctaagtgcaggtatagatctagcattatgttattaacaatgtggtacctatgtacagtggttctttttaagtcctcatgcaggaggaaaacttatgtcgagcggggcaatattgtgatatttaccgaggcgcaggtaaatatttgtttgagataaattatgatgactagtctgtttggcatggtgtcatacaatcaattctctctaaatacctcgggaatgccataactcctcacgctgctgataacgttacgttcagagcgtatggggactagagttcatggaacaggtgccactattgttagtaatctaatactaggccatgacgaaactgatgattatcagcaagtcgtgggctgtgggtaaagcgtacatttactgcagtatgaatattcatgaatctattcgaatagccgtgctcacggattgagtatcgagactcatatggtatttggttagaaacttaattctaaactttattaaatactgttgcatttaaaacattacatgccttcttcctctatattctcagccttctgcaagtaaacttagctctactcaaatattaccatttcatgcattcaatattgattaatataatagcttgctgagtacgttgtactcatccttgcttaaccccacctttttcagagtccatttgatgttcttgccgaagccgggagttcaatcatataagttagtctcattctaacttagttctcaagcatatactagatagtttaagtctatagcaaaacattagagttggctcatcctatagcttctactgtaatagttagccacaaacttctaaatgtcctattattttataataacatctcctctggagccttaattaaatgtatgcaatgaagatccatattattgaacctgtatcaatctactgatccagggcttgatacagttttaataagtcggttaccgaatcattagttttgggacccgacactgaagatgtgggatacaaagttactactatggcaagacggtgaaggacaagcaatgctcggtcacgatggaccatgcggcggtgaagggcaagcaaggggcttggtgccaaagaaccaaatccggtggtgaagggtgagtgacggctttgtcatgatggaccgtgcgaggccatttgaagctacaagtaatcgcatcaatcatttgaggaatatatggtgaaacggttttggcattggtatcccttaagacaataaaagaaagatgaaaagaaggcattcctgttgacataattatcttcctatttatatttgagtttaggaatgccgtactattaagagggatacaacgtcgaggtgtatatgccaccggtttcaccccctaacttgaataagccattataaatatgcaaactgcaaatttgccgctgaaattagtttgcattgcttccgtttgacattaccatctaaactggtatgattaaaagggcaaaaacaaggagcatgaaaagaccattttttccctagccggaataaatctcgcacccctttctttt

SEQ ID NO: 7202 - DNA, 9418 bp, Oryza sativa
aggtcgactctagaggatcccctggaggcggccaggtgggcagatggcgtgtggacgggcggtgtgttggagcatgacgccatgacgggataatgtgtggaccgcggcgtgtggccaggcagacggcggcagggcggcggctagtgtgcgcgtaggtggcggtcggagtcctcaccatgacggcatcggagtaatatttttgaggtaatcttgcggaaagtgcgagtcgacggcagccgccgcgatagcagctgcaacaggagcagcaatgcttgcggctgtagcacaagcatgcgacaacagccgtgcttgtggcggccccagcagcattgtgtggcatcagctcactataggcatgtcgttggagcagcagcagcaggtccctgcgacagcagcaagccagcaagctggtagagctacagcaagagcagcaacaatggcggacaaaggcagcagcagctgtagcagggacaggggcatccttggcctatttgttttgtgaaaacccatagtctaacgatgatattccgagccgtgtatccaatatgtacgtgggttccaaccgttttcgatggcaggcatgcaattacgttttttatagtggtaaattcacaataccgattcaaaccagtgctaaatatgcaattggcccaaaatgagttgagtagtcctctgagtgagctttacatagagtccaagatcatcaaaaaggactcccgagcgaaaagttatggtcgttttactctgtgctttccggaaattccgaaaaattatcggaaactccgaaaatttttgaaaaactccgaaaattttcgaaaattccaaaaatggctgcgaatctgagattggcttctgtaaatttttggacttatctgaaaatgcatttcggaacttccgaaaatcacattcttggcctccaacggctagtttttgaggggctcgggtatataaactcctccatccctcctttgagtggctactgttcttgggaagtattagacatattcaaagccaaatagtcatccccatttccctacctttgtggtgcctctttgtgagagggatttaagaaggggagagagttggattgagagactaagaagttgagagctagtgagcttcgctccatactttgagcactcgagttcatagcaagcaaattttcgattgtgtttgttactcttggggattaaggtctcctagacagctaggcgtcgccggtgagcacccaaggttgtggtcggccaccgaatgtttgtgaaggcttcaatttctcctccgcaaggaaagaaatcaagagtaaaaccgaggagtgcatttgtgcaacctcgtgaggaaagggttgaaatagggctggcccttgtggctcctcaacggagacgtaggatccgtgaatctgaacttcgggaaacgaatcacgcatctcctctcttggtttgcacattcttgcattctctcatattgtgcttgagcttgtttttatccgttctacttgcatggttaattaatatagttggtgaccttatatcttggatagataacttatttgtcaccttttgttcatatacattttgtttgttcgagctacaagttcatagctagtgttttattccgttatccgctgaacttttcggttgagaccgaaacttccaatcccatacctaaagtttcgatttgaactgaaagatctcatcattctaatatgctatgaagttgtgataatttttaggaacgcctattcaccccctcccctctaggcgacatcaaggtccttccaattggtatcagagcgagatctctcatttcgggcttcaccgcctggagagaaattatcgacaagaggtgaaatgttccttgaactccttttgctagatggttcaaattacatatcttagagtactcgtgtgcttaatgtgtttagggccatgggtctgcatatagagtgagttgtagatgtgagtatttctcctcctaatgataaagagctatcatttgaagaggaaaagaaatgcacacatctcaatgctaaagctactaatgttttgtttagtgctttaagtgaagatgtgttcaaaaccatcatgccacttgaagatgctcatcttatttggacaacactaaaggaaagacatgacaagtccaaatctgatggagatgatactcttgtggaagcatcatttggggattgctctacttcatcgcctcatcatgacaagtctcaagtgattatctcctccgaccaagaaggtctcaccccatcatatatctcaccaacatgcaactatgagcaaggtaataaattggtgagtaaggttgatgatcttccaactctcccattggactccaacaacactgataatgaaattgatatatttgattgtgttgttgactcatacatatcacttagcattaaatatgtgcatgtggatgatatggatggatgctctacttcatgtagtacttgtgaaactaaccttttgaaggagaaaatgaatggacatcaatgattaaatgaagaatccacaccatcaatttgttcatcttccattgccgaagatcatctgtgctttatgggtgatgatgatgactccgtggttgatcacttgaacaagacgaacacaacaatggtgatcaagctcatgaggattattgagaagtaacaagcatgtctcattaagaagaatgaagaaatcaagggtctagccgatgaacacaagaaactcgagggatctaattcttcattaattatgaggtatgaaaaattgataaatgaatttgcttgtgccactaattctattgcatgtgtagcatctttggagaaggaaaatcaagagctcaaatattgtttggagagaatttaaactagaatctccccgcccagggaaataaaatgtgcgggcgtgccagtgtactaagtacacaaataaaatagacaaaggaaaatgtatttattataattcttgatgaattaaaacaatgcaaaatccttgatcaaatgcgctccacggcctataggcaaggtggatctgccttggcgattgtgttctcctggttctcggggtctcggaagacacccggttaattgctctcgcgggttaaacccgtgagatacctccgattaagctgcgctggtcgtcgtcgtcagtcttcgcttcactttctcccatgaatgattgtgatggtggtgaagatgtagacgtgtgtaggcgccggcagcggtccacggcctcatcggtccgtgcgccggtgttggtgacgtcgccttgatgtagacttcacttgttcatgccgtttagcctcatcggtcttaaatggtgtacttatagtggacataggtttttttggttgtaagcactaggaggctggtacaactcttctagtcttcttgaccgtcttggtgccatgtgagcaatgggagaatagtcaggagaacattgaccaatcattttgctcgattatcagcgggataggtctctggctcgatgtagagatacatattgttatggccttgcgtcgaccaatcactgtgacactcggaatagcgctgcttttctggtttctagcacactggctgaatatcattgtggtacaagagtaggccttccaatcattgcagtgcacacttaagattaagtggtttttgttgagattatagacatataatgatttaatctattccataaataaatcatgacattacagatgaaaactagcatgaacgcatcattagatctacacatgtaaactacacagtataacatgaacagatcaaatatgcgcaacatattgaacacgtaccgaggtgacggaaagaccggctgcttggtcgaaacttttcgcaggtgtctacgaaggcacgaaacacgcgagcgaagaggaaagcgagccgtcatgaacgaacagggagcagtcgcgcgaagcgcttcccaaaaaccttattgccgccttctcccggtgcagaacgtcgaaggcagaggttccggagacctgctctcccgatcgccggtgcacgccggcgagcgagatggagtagtctacgagcgacggcgcagtacagagtaggaggcaaaccctagattgattttcgcatatgctgcgtgaagacggcaggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaaacgaatccgaatttgcagcaaaacaaaactgcaaaaggaggctgcatctgcgcaagggtgaggagccaatttttcggaccattcgacgcgtacgtcgtgcacgcgcgccgcctgccctgcccggccaggccaggcgaggcgaggcgagcgagcgcgcgcatgtgtttcccctcttctctccaccacacatgcttcaagtgactaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaagcttcctagaagattcacccaaaatcttcatagactgcgaccaacagtcaagctcacaaaggtgagttctttcaagaatgctctgcaggacaacatctttgctaattaaagtcaacagaactcattaaggcatagccaacctgccttgcagctcacgagagtatatgcatcttcacttggagagggtatatatattgatactctcctctagtttactaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagctctgcttccatggttgacctcgtcaaaatggtctgtttgcaagacctccatgaaacagcaccaccacccagtgtgaaaacatatccactagtggctttgatctcatccacaccagagatccagttagaatcactataaccctccagtaccgcaggatacccagtatagtgaagccccaattccacagtacctttcagatagcgcattactcgctcaagcgcacgccagtgatcatctcccggattagaggtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagtgtaatcccattctcacctctaattagcttaatgtttaagataacatcagctactcccaaatccttcatatcaaaattttgagataagaatgatttaacatcatttatcacctcaaggtttgtcccaaatatcagtatgtcgtcaacatacaagcacaaaataactccctcacccccaccatggcgatagtacacacatttatctgcctcattgactgcaaagcctgtagatgtcaatgttttgtcaaatttctcatgccattgcttaggagcttgtttcagaccatacaaagacttcaacaatttgcacacttttccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgcaccccacaggtttacacccatagggtcgctctgtcacctcccaagtcccgttagcgacaatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactaacatcctcctcagagacaagttcatgtgtatgttcagtttgttctggtggtgtgattgaactgggaattatttcagatggttggttcgaaccactatgtgtatccttcattgggaaaaagctctcaaagaagatagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataaaaaagtaatggtttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcggttcttcctttcagcaatcccattagactcgggagaatagggaggcgtcctctcatgtatgatgccatgttcctcacagaataagtcaaactcgttcgagaaaaactttccaccacgatcagacctaagcctttttatctttctgtcaagttgattttcaacttctgccttataaattttaaaatagtctagagcctcgtctttcattttcaacaagtacacatagcaaaatctagtagcatcatcaatgaatgtcatgaaatatcgttttccacccttcgtcaacaccccattcatttcacaaagatatgaatgtaggagttctagtggtgccaagtttctctcctcggcagccttgtgaggcttgcgggttgctttgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtttgccctgcaggtgccttcatccccttgcgctgtggacacttcctagccagatgaccaacttgaccacacaaaaagcaaatcctctcatcctgattaggataattgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgctatcaacccctcaacggagtattcctgtctcttgtgtttgagtgcagtaccgaaacttctccaagatggaggtagtttcgcaataatgcacccagccacaaatttgtcgggtaagacacacttaaggagttcgagttccttagccatggtttgtatctcatgagcctgttcgactacagagcggttgtcagccatcttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttaatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatagacatataatgatttaatctattccataaataaatcatgacattacagatgaaaactagcatgaacgcatcattagatctacacatgtaaactacacagtataacatgaacagatcaaatatgcgcaacatattgaacacgtaccgaggtgacggaaagaccggctgcttggtcgaaacttttcgcaggtgtctacgaaggcacgaaacacgcgagcgaagaggaaagcgagccgtcatgaaacgaacagggagcagtcgcgcgaagcgcttcccaaaaaccttattgc

SEQ ID NO: 7203 - DNA, 793 bp, Oryza sativa
ctccgatcgcagtggcttgacttgggagtactgcgtcgtcggtcttcgcttcacgttctcccatgcatgatggtgatggtggagtatatgtgtgtgggcgccggcagtggtccacggcctcgtcggtccgtgcaccgatgttactgacatagtcttcatgtagactccgcccaccctgccgttcagcctcatcggtatattgttgttgaagacatgtatggaattgtgtagcttggatgactcgacgccatagcaattgcgtcggaattaaattataaaggtatgaatgatcaacacggatgatagctgaattagtcagggcttgaagatttaagggcggagcagcaccaaatgagtatgaatttgccaactcattttaacttgtcactgtgtacggtagcatgcatatacaggtcttgtttgcttgcttgtcatcgtgtacagtagcatgcatatacatgcattcatacagtgcgcatgcacaatacaatcatctgagtaatttcagcgcggcggctgcaaacgacatgatggcatccggggcatgatgaccttcggatggcttggtcggcagcttcccggcagcatagtgacgccggcagcgaagccaatgatttaatagatgtcaacggcgatccgcagaggctacaacgagcgtggaggacggagggcgtcgccgattagtagagtctcagtcggacatccctgcccagcaagccgcatcatgacaggtgccagcaacaggggtccgatgatacccatcgcggcttgtggatgatatattaacgacctc

SEQ ID NO: 7204 - DNA, 972 bp, Oryza sativa
agtttagggaccgttgatgaactttactcaataccacccattcaaagggtatggctatttgaatttcatccaaaagtatataatgaccataatgacctaaagttgtattttgtgggttaaactaatggagctaaagttctttgtgaatattggctaaaattagtttctgaaagttcaagtgccattaatttggttttgatggttaatgacaaatccaattacatgagactaacattgttataagcatttctttgtctactagtctcatatggatatgaaagtggaatatgtgagaggtgatttctggacttcatatgtgttgagagagaaacgttcattgatggtgtacctaaatcacaaggatgaaatgcatggagatcaagctatatgtatcattctttctatccgtgcacatattgatatattcatttataatattttcatgtgattacataagcatgtcagactaatgttttgtttgagccatatcttgtttagtctctttacattgagaacatggagatgatgaaggtatgtttttattttattgtctatatttgataaatgccttctattcttgtatgggataagctctcaatgtttaatatcttgttatgcatactcttgcttcacacaaatattttgtatgcatacatttagggggagcaaatcctatactttagttatgcatgtaatcgatccaagttattcaccttcatttaattgggatcatttattcaagttatgcatgtatatgacacttgtggtgttgattaatgctcatcatttattcatatccttttatacatgcgatcggttggtcaacatgtggaggttgacaaccggatcattgggactaataattttattgagttgaatgaaagaaataggtcccaaggattacaaaggtgttgatgctcaagtgatatcattacacctaacaataccaagaatgacaaagtgaagatattg

SEQ ID NO: 7205 - DNA, 9670 bp, Oryza sativa
tcatttgaagaatatatggtgaaaggtatcggcattggcgtccctcaagacaatgaaagaaagatgaaaaaaggcattcctaatgtataattcttttcttatttacatttgagtttaggaatgccgtactattaagagggatgcaacgtcgaggtgtttgtgcatgtctcagtgctaaaagtgacctatcatagtgctaccttgagagaaacccaagctttaacctatcctttcagtggttttagaccttgtttttggttgagttgggtagtcctctgagtgagtttttcatagagtccaagttcatcaaaaatggactcccgagcgaaaagttatagtcgttttactctgtgcttttcggaaagtccgaaaaattatcagaaattccgaaaaattttcggagttatccgaaaaattttcggacattccgaaaatggctgcgaatctgagatttgcttctgtagattttcggacttgtctgaaaatgattttccgcttccgtagatttttggacttgtccgaaaatgcttttcggaaaatccgaaaattacagtcttggcctccaacggctagtttttgagaggctctggtatataaactcctccacccctccaccacccctcctttgagtggctgttgctcttagggagtattagacacatccagagccaaatagccatccctatttccctacctttgtggtgcctctttgtgagggcgatttgagaaggggagagagttggattgagagagtgaggagttgagagctagtgagcttcactccatcctttgtggtgcctctttgtgagagggatttgagaagaggaaagagttggattgagtgatggagaagttgagagctagtgagcttcactccatactttgagcactcgagttcatagcaagcaaatcttcgattgtgtttgttactcttggggactaaggtctcctagacggctaggcatcgccggtgagcacccaaggttgtggtgtgccacggaaagtttgtgaaggcttccatttcgcctccgcaagggaagaaattaagagtgaaaccgaggagtgcatttgtgcaacctcgtgaggaaagggttgaaataggcccggcccttgtggctcctcaacggagacgtaggatccatggatccgaacttcgggaaacaaatcacgcgtctcctctcttggtttgcccatttgtgcattctctcatattgtgcttgagcttgtttttacccgatctacttgcatgcttaattgatttagttggtgaccttatatcttgtttagataccttatttgtcaccttttgattcatacacattttctttatttgaactacaagttcatagctagtgttttattccattatccgccgaacctttcggttgagatcggaacttccaatctcatatcggaagttcctatttgaaccgaaagttctcatcattctagtatgctatgaagttgtgataatttttaggaacgcctattcacccccccccctctctaggcgacattaaggtcctttcagtttctataacccatctaaggctcttcaaatgtcaaactccatagaatttatttttgggcatgatttgagcatttgattgaattttgccgcttggaaagagatacaaagcaaatttcaggtcttctcttgatagaaaatcgcttctgcaaaaattctttttgggaaagtttctttgatttacaaagatcatttctgcaagatttcaactcgcttggacttgatttggaagagttttgagtttttataactttgatcaacttgctaaaaaattcagaaatgacatggttataggctgaattgtgaattttgtatctcaaaatgcaatccaaattggaaggagcttccattatgacttttgataccctaaggctgaaccttacttttaaatttttgtttgaattttttcagctcttttgtactttgtttgaatgctttttaaagcccttcttgagttgtgaaaaatctggaatttcagcttactgaaatcttgtgatttttgttttgcctatatggttgagatatgagcaagactaccaaaatgaaacttgtgcatgattacatgatatatctccatgatttattgcatattttttggagctcatttccacaagtttatgttgcttcaagagcttgcttagttgtatcttttttgttaaacttcaaattttaaaagtgtgtttcatttagttgaaaatctgagttggtggcttaaaaaaagttgtgtcaagaagtgagctctatgttatgtgaatgttaaatcaattttgagctcgtttggatttattccttgcatgaactcctcttgctctcaaacacccattatttgagccaacctaaactcaaatggaattttcactgtcaacctacatattccatctattttgcttctaaaattgaagttgatccttgtttctattgctaactaccatttcttgattccaaattcgcacttgcatacacaagcggtgtccatataaaatggtagtatcatttgaccatcttgaactcggtaattgcctatcattgtcattcctttgtcgagattacacacttgaccaagaagctctcaagtatcattgaccgaaatcctctcattgataaaatacttgttgagtgtatttcgagaggaagttcaagtgctcacaaccactccctccgagagcaagggggagcgtttcttaaatggacattttctcaaatttttgctttgaaatttcatctaaaaattttatttggtcttgtgaatgtttgttcttgttttgctcgagcaaaattgtttctctttcggttccatgcaaattgtttctctttccattgagtcaaaaatcataaaaaacggactcccgagcgaaaagttatggtcgttttactctgtgctttccggaaattccaaaaatggctacgaatctgagattggcttctgtaaatttttggacttatccgaaaatgcatttcggaacttccgaaaatcgcagtcttggcctccaacggctagtttttgaggggctcgggtatataaactcctccatccctcctttgagtgtcttctgttcttggggagtattagacacatccaaagccaaatagccatccccatttccctacctttgtggtgcctctttgtgagagggatttgaaaaggggatagagttggattgagagattgagaagttgagagctagtgagcttcactccatactttgagcactcgagttcatagcaagcaaatcttcaattgtgtttgttactcttggggaccatggtctcctagacggctaggcatcgccggtgagcacccaaggttgtggtgtgccacggaaagtttgtgaaggtttcgatttcgcctccgcaagggaagaaatcaagagtaaaaaccaaggagtgcatttgtgcaaccttgtgaggaaatggttgaaataggcccggcccttgtgtctcctcaacggagacatatccgtgaatccgaacttcgggaaacaaataacgcgtctcctctcttggtttgcacattcttgcattatctcatattgtgcttgagattgtttttacccgatctacttcgcatgcttatttaatgtagttggtgagcttatatcttgcatagataccttatttgtcaccttttctttcatatacattttgtttgttcgagctacaagttcatagctagtgttttattccgttatccaccgaacttttcggttgagaccgaaacttcctatcccataccggaagtttcgatttgaactgaaagttctcatcattctaatatgctatgaagttgtgataatttttagaaacgcctattcaccgcccctctaggcgacatcaaggtcctttcacttacaactactgcggttgttagcacgctactatcaaaacaagattcagatagtaaagttagaaggttttagatctgcagtttggtacacatactgtgataatctggatgctagagtgtcagttggtttaattacagttcttctagaatctagagtcttatagcaagtatctgaaggagagaactctgtggctttgatcaactaacaagacaaagcaaaggggaagtatctagtgatgtatccgcagcaccgtatcggttgatatatttcaatattggactaaaaaacattgcggatagactggcactacttgaacaaggtagagtgaaaagcaagctaacttggtgtctgctccactctgttgaaaatcagatacatgaggattcgattgatacttatgaacgataagaaatgtattatttgttttatagtactattgctattgcttggattcattcttcatattgaatggtgagctggttgttagttatgtcttagctattttgccataaaaccttgccttttctttaatgactggaaacattgaatataagataaggccttcaattaattagcatgacaatgtagtagttcacacatcaatattagctataagacatctggaaaatcatgttaattggggcagacattgccatgcatgttgttgtcgaagagacaactgcttcacgtcaaaggacgtggttcactcaatggaatggttgaatagtaaagtaatgtattaatgggctttttatagtcttagtacaagctcatgcactctagggtttaatgtttgcaggggaatttacatggatacccttctgatagggacatttacgagggcaaacaatgtccatttggttaaggggtcttttcatgggcttttgggcccgacccatattggtgaacggccttctcgggccgttctgatccttaggcttcttggcgaaggcctcacatcttctggcgaacccttcctgcttcgcctgaagtgaagacttgccagtgggtcctttggacatgatggcgaaccctttcagatgcgtcctcagggtttcgccataggcaaaccatcttgatcattggtggatcatcacaggtaaaacggtttcggcagttaatccatgacttagtgaatttgatatatgtgaaataactccgctggggattgaagtcactcctaacttatgtttatgctaatgcttgcatattctgtgttaaaatttttggtgacacactagtaggaaatagtcttgagataatcaaggaggcactaaatcccaaaaatttgtttatagtgactttgtcgttttggacttagtgcatttgatatgtgtggaaatcactaccctggggattgtaatcattgctaactttgtgctggagtcatgccacgaaggccttcgaccgaggctaccaaaaccactacgaccagggcgaaggatcagtcgaagaccaagatgcttacctaaggcgaacctgctgggcaaaactagagggattcaccaccaatctggacgccttcgccatggagtcaaaaggcaataaagcctagccgttcgccatgtctggcctaggctaaggcccattaaggggcccagggcaaaatagacactagttaccctcataaatctctctatcataagggtattcatgtaaattaccctgtacttattaaccctagggtgtatgagcttgtactaaggctataaatagccccataagggcatttagtaggggatcccaaaaaattccattattaatacacactgctttacttttctactgtgtgtatacctcgttcttcgacgaacgtagttgtcatttgacaacattatgtttatgctaatgcttgtgtattctttgttggaatttttttgtgacttgtactagtaggaaatagtatgagatagtcaagctccaagatctgtttatattgacttttgacaacctggcttctctctcaaaaatgaccatttctctatattcttgaaagggatatttgttcagtgtcatgtataccaagtaatacacaatagtttagtattttgaatgacgtatttataacagtggatctatgttttctatgagacaatggagtattgtcggctgaaaatggtgctttgccctgataaggtttcttcttacatgttttatcaggtgggatggcatttggtaaaaatattttcgactagttgtagatggttttttttttactttcttgcaaatgttggaacttccgtaccctcgttcctgatctatggaaatgcggggagcatggctctcattgataaactacttagctaaatgttggttttggttggaaggatgatggtttatgaataattgtaaatgtatgttcttttgacatgatatctagattaggagttagtctatttaaaaatttgttttactgcttttttttcaaatttgtcaccaaggtagtacaaaatggtttagagttactctttgcattttaggaggtctttcggccttaggaaatcgtggctttgtcttatttggttacattgtgaatgatagttatctctaacaatgttgaaaaggtacatatacagcgttccctcttttagatctgctgagaagtagtctcataatgtgtatcaacatgcaaaacatttacaatcgttcatacccgatgaagatcaaatacttcatttgtggctttgagagataaaatttagtcgaatcagtaattcaataagaaaggcagaaaggctgcgagagtgctaacacctgcaggcagaaaggctgcgagagtgctaacacctgcattttgtgtggagaactgaaacctccaatgctatattgtttatttttctgacacctgcatttttctgatgtagagatatagggatggacaacaatccctataaggttcgaagatataaactttttttagctttttcaatggtgttgatgtagagatatagggatggataacaaccctaaaagcttcgaagagttgttctctttctcactaagaataataaggtttttctttcgttgagcattgtaactatcttttgtatcttatgtcgaccgggatatgtcgttccttttgctgctagcctctttcgcttcgttccctttgctgctagcctctttcgctttcagtaaaagccatgtctcacgacttttgtaaaaaaaaaaggctcctaccttatgaaaattttcttttgggtacaataatataagagaattcaatccactattcagttacatgaaatagctcgggtttgatatgaattttgtgttctttatgcccaacctgaaaaagctgcacatgtcttttttattgtcttttgcacaattagttggtttcacttgtagggatgctaatgcctggaatgctatttcagtgtgatttaaacattattttacaaaggttgtgggtaaaacaagcgtttgtatgctattagttgctacagttcttaaaaaaaatacattccactcctttgaccttaatcttccgcatgctttcttatttgcttcagtgaacctaacggccctcttgaaatgtgaagtctggttgtgttggcaactctgactaactagcttattaatcagcaactattcttttttaatgttcataaatatatttgttccatctccccaactattcttttctgatgtatctctctacttctgcagtgctgtcatgcttagaaattcaacaacccgaatctctgtccaggaccagccagagtacacaaacgacaaattgatacagatccatgtcttacaaaaatattaaaataaacttacaaatgcagcagaaaataaaagacaatctaaacttaatcttcacggcaaaagtgtagcatcctccaaatcacaggcaatcctcaacatccggaacaagcttaatcctcaacgaactcaccatctgaaatattctctgcttttggggttgggaaaaataatttaagactgagtacaaccaccgtactcaacaagtcataccaacggaaatgtatgatgcaaggatatcacaaaggattggcaataggatatttgcataaaagcagcatttgcaaatcataatttgaatacagtaaaacaatagatattattaagcaatattaaataacatcactgctcaacgctaaaaccacgttgcaacaggcccaaccaaaccacctgaactactccagtcatattatttaagtgagactaatcacggtgagctggttgaccgcccaataaccacgggcacgactattcgaatagttttactctgattagaggtgtacaaatttacccacaagatgcgattcgacacatgttatcatgcctcgaagtaacaccgcgatactgcaaaggtgcaaatcgtgacaaaacccttcatataaccctccctaaccaacatcccacctcaggtttcacccccacccctaaacaggcattgggcagccccctcttgtgcctaggttaatccggaagcagcatagaccggctcccgctccatccatactccatgacggccacccttgccacggtatgttagctagaaaagattatacttcaggtcaagcctggagcccatgctagcttgtggtttgtacgtgtatatcttccaaggattcccgagaaccggtccttaattgttatggacacgacttgcaaaatcatgcacccacaacccaccattaaaatatattttagtttaattacttgtatacatgttgacggtcgttagcgatcagtttcgcccatcaatattactaaaataaaggagaactagttatgtttgcaatgcatattatgttagaataagatatattccactagcactgtgctttctaaccttttgtagagaataaatacaaaatggaggagaatcaacagtgaaataaacgatcaatcaatcagacactgtcgagaatcagacttatgaatggatgggccaagaactcagaaatgacacgaccaaaatgggccaaaattcacaagtctgcgaaaagaagaacataaggaggcaaccagccaaaacctgggctggttgggccggcccctggttcggtcgaacctcgggtgcagccgaacccccctcgtcgccgtttgatccaaggctttgcctggacggtgtagattagccccaatgacggttggagggtatttccaacaattccaaccgtcgcaactgtcattgggaggttataaaaggagctctcatcctccactccaggacatactcaagcaagagctcaatcatctttctcaaagtttagtttagtgtctagagtatagtggaatagaaatagaatagagtcttcagtcctcggagacttcgggaaaagttcgggtattgctctagtagcttttccttcttttgtaagacttgtactatttttagaatattcttctaaatatatatacagtactttgcttcattctgatcatctgagtactagctttccaatatgttatttgatatataattgtctagctagcttactcgggaaatgcaatggtgtgggtataatgttcatgtatatgattgctctgtgtcatgacgatgatattagagtagtatttggtagcataagcgaggtgcttaggccgctggatatcattatttgggattatatgctacgggacagcagaggtgggccgctgatggtgacagctcagtacggttattcctccacattagcatatagtcctaagtacaatttcctgggaagggtactcctccgtatttagccccggttggatggccatgacgggttgtcgtaaggaactcggcaaccagggatggtatctcgaaacacta

SEQ ID NO: 7206 - DNA, 1404 bp, Oryza sativa
ttaaaaaaataccaacaataccatggcggcatagtatcataatgattaaggactaaaatcataatgaatcccattgtgagctaattgatctaagcatggctaatcattcctaaaccaatcatctaataaattaatatccgaggctatcaatgacatagggtaaacaataggctgagtacggtaaatatccaccccacatgacattataaaataatgcagtttaatagaaaagcggggattttgcaaagtaggttcaacatgatcaatgatattcgtatgacttggcttgctcttgagctgacaggacctcggcgaacttcaaaagagactggagcgtcggaactgccggattctatacgacaaacaaagcacacaagcaatacataataaggctactgaaacagcaaaaggaaccaattttaatggattctagacattttagcaaattcactgcaacttgaatagattaaaacggagctcgaatgatttagatatgaattttacaatatgaactgtgttgtttactcatttatcatatagtaatgcccatagataaattacatcaaagaaaatatatcatcggtaaacaagcctcacgagttaacaactcaatgagtcaatatatcgtgacgcgggaccatccaaatgatcaaccgaaaccggcgaatagaaccggcggcttaacatggctcaaactaaagaatgactcaaaacgactggacgaatgaagcagtggacagcacttcgtgcaaacgaaccattaacaacctaacaaacgactacggctgaaccggtagactagacacgtttacggcaaagactcggtgcggaaaacgattgatcggtaggagtttagagatgcacctatggctttacaacttaactactgagctttaggtcaagacggtggctaggttttagcgagacacagccacggcacagcgggacttaacagcggctcggcttggcagcaaagcagtggcggcggcggcaaagcgccggcagcaaatcggcatcggcgcggctcggcttggcacagcagcagcgacatcggcactgcagcggcgcagcagtttaagcaactaggcacgcacaacacatacggggacgacatgacaagcggtggcggcgctagagcaacagcacggtagtggcgtggtagcagtggcgcgcggaagctggggttagggtagctgcatggcaacaacgcgacgacgcaagccaacacgagtgaaggaaaaacaaaccctaaaaacaggatggaaacctcaccggagagtgacaagtaccggagaggagatgacgacggcaacggtggttccaatggcaagctcgggatcgatgacgacggtgctagatgagattaagcggaatatattagaatatagatggatgggtataggc

SEQ ID NO: 7207 - DNA, 11709 bp, Oryza sativa
  unsure (1)..(11709): unsure at all n locations
gtgcatcttgaccttttgcttctgcattaaagtcgcggaaacaaagcatactgaaattcttgatatttagccaatctgaaattctgatttctttcgctttcatgtgccgttgaaaacttacaataactagcgaagacaccttgcgccattgagaatctagtaatgtgtcattttttttgataattggaaggactgtactacaatatctatttgctacgagtattaaagtgtagatagtagctaaattatcgaatcaccacataatgagttgctaatgctgtgtttgaggagaatgagatagacgagattggaaatatacgcaaaatgaggtgagccattaacgcatgattaattgaatattaattattttaaattttaaaaatagtttaatatgattttttaaagcaactttcttatacaatttttttttaaaaaaaacatactcgggaagcgtgcgcgcggaaaacgaaacacacaaactcacaatgttacgctgctgaacgcagcctaagggtccgaagttagtttgatcgagttagtgcattcacataaccgattaagacacctttggacccctcacacctcgtattctgtcactttttgataacctaaggtcgtgctcgatgatgaacagtatgtcacttttagatgtatcaatcaactatttatcactggacccacatgtcatagacacatgtgaacccacgtatcattgagatagatgtgacaaatagttaattgccaaatctaaatgtggcaaatagttaaaagcgggggcgggttcattttccttccttcttcccctgagactgataggtggggcccacatctgtcctctaattctctccacccttctcgtttcggaacgccgccgccgccgccgtccaccgccgcaaccagcccccaccaactccggccgttcccggcgcgtcctcccgaacgcctcagcccccacccgccagcaggtggaggcctgcgccggcgcgtcgaccccggctctctctctatctctgtctcacctagtcgaggcgtggagaatcgaacatggagtccgagggggggaagacggagatggtgctcgcggggacgtttccttcaagaaaggcagatcgccgacaagtaccccagggccagtcccgcggccgcagtggaagcacctncggcttctncttcaggccgncgacgccaccttccttccccccgaccgccccactgtaagcgcctccgatccaaaccaatcttccccccctcccccctccccgctcaattaatctgccgatttcttcattgggatcagtttaatggtgtggatttatctaccttgttggttgttgggcgcttgtgattgtactactcatcgaggatttgtgtggattcacttctataggtcaacgagcccttgttggcattgggagatttatctggttagggattgagaattcgatgctatgcattattcatgttaggcccttgtccagccaacggttgctattgtgattgcgcattagattgttcttatgttctgttgcaattttacaatgttactatgtgaataacttaatatggtttagatttggtggtaatctaatagatttttgaggctacggaagctacatgttcatatgccttgtcttgttgcgaaccgtccatctaccgtgaaaacgcaaaccaattggatagggttatcatcatttgtttactctcccaaataatctggataagcaatctgagtccgtgcaaacaacttggttctggaagcggattcttaataatcaaacgatgtttttctactgaagtccaaaagcaggtacggagctgcttttgtggattttaagcggtaatgttataacataagagtattaacatagatggtgcatttcattgtatcaaaagccaaatccacaatcagcttttaagaatcccccttgtgaaaataacattccagaagcaggattgtgagaatcaaaagcaaaataaacaggccccgacaatggtacaataaggatttttttcatacaaatattatgagagatttctagtttcagtacaaacatttctaaaatatttaatctaataagtcagcctaaaggtaaatgctcacctctacctcattagtgttaaacttttaattagtctgttaggatgagatgagcactaatgatatgggtgtctgatggcagcatgatcagcaagtgatgtgtatagaaattacaacaatattcagaaataagttatgttttacaacaatatgttcatcttaatatttttaataaatatagtactagtacatatgttgtgcatactggcattagataaacataggaacaggaacataatatttccaaaatgattaatgagtcattaagcaaagtggatcatttgtacatatcatataatcatgtattgctgtgttgttcaccatgtctaagcagatgacagaatttgtatctttgatcatatgattctggcttttggtattttgatggttgatattgatactagtattgtttatgataagggatatcatgaggtactatttttttttctggttgtgtatgagtcagcattgataggcaagtgaactaagaatcaaatttattctatgagatcataagatgtatttgtttcacttcttaacatcatgaggtatttattcttacatctcctgaaggagaagcgtgggctgtgaatgtgtcgtgatatgttgggttgtcacttgttacataaatgtagtaattaactttgattcagtttgatgcaataccatgctatgagaaatattaggatccgttgtcctacttatcattcttgcttttttataagcttttttttaataagcaagataattgggtaccatttcattaagaggagagaatggaaagggagcagtggccaccaacccggtccaaaacaggccagagtctttacaacacacgcaaaaacctcacctccgaggggctatcgacctctcacggaactcctttagtctagaagccccggctagcgaccacatgatacacttattggccactgtttggaggacagcagttacacaagggttaacaccattaagcacattgtcatttctatgcttcccaatctcccacagtaccaaaatgatgagagctaagtccgttcttggtgtctttgtcccttcctctcatcacccttgaccaccaccttgataaattggttgtatctggacctggggctatatgggccagccccatcctttggaggattataaaccaaacttgccgtggacacctcttatcttaattatttgaatggccattaatgttataaatcacaaggcatggctgaaaattgatgttaagttaattatgccacatattatcacttttccatactgaggctattgcatttgtctttattcttacattatggtgttttgtgcagatttgaatatccagtcgcccccatcaatttatccacccaagagatattgtgacataactggttttgaggttagttactttgctgtgagttcgtcttgttggatttgcatgttttcttgttattttgaatgttcattttatgctacttactactgagtttaaattgatctaaatatcttctgagctagatgggctatacaatatctcgcggtttagtaatattatcaaagtcgacattctttgagttggatctcaaatgctcaaattaaaatcccgtatatgattagcatcagatcaataatccacagaaaatgttatcacaatagacaagctacatgtctggagaattcaatcctctgtaaaggattacgaacacatgcatgtatacagcaacaaaagattccagcaattaaatcttttggaattgttaggaaaaaaaaacatgtggtagtgatagtacaccattgtcattaactcactctataggcgaagatatccaattaaattctatataataactcaaccttttgtccatgctatcatcggatccttattttccaccctctgaactttgaaatcctcaacctttacatctctctgttctaaaactgcctcagcatataccgtagtggtatttgcttgacgacagtcatcagtagattggatatcttccatgcctacttttccttcttattgttgtcaaatatcaaatctcttcctctgtctgtttaaaaaaaatacattctcaatgtgacctaggctaaactcaagtgcatagcttcatggcctctgagctccaccacaggtgcaattttccctagtatgtcatcatgccttctacatctctcctagtcagcaatccatgccacctcccaaatcctcttttgctcctgcaaacacaatacatttcttgattcatttgatagagttgtgtagtattcgtgttagctaaatgaggagctggcccttagactgatcctacatgcagctcatactgcaaagctgccatctcaaattccttccctgttgtgaacgcctcatggacataaatgagctttatttccccacctgtaatcatggtggtgcatatgagggtggaggatcgttgcttacattaccactgaatcatgtgtcgctaacatgtccaacatgagatagtatctcaaattctcaattctactgcagacaagttactgagcatgaaattgaggctgcctgagaggtactgagagcgcgagggagtgaatatggaattgctgttgttttcagttatcttgtttaaattgttactagttacctggctaaatcagcaatagaagatgacatttggagccttcttgttgccacataggccaaaactgtagtggattgggcttttaggtgtttcagtgcataagtattgttagtcgaacttagaagtccaattttggtcctaaatagcacttagttactactccctctctttcatattataagttattttgactttttcttagttaagcttctttaagtttgatcaagtttttagataaacatagtagcattttcaacacaaaataaatctattatcaaaatatattcattgttaatttggtgttttatatattgttaaatttttctataaacttagtcaaacaaaaaagtttgactaagaaaaaagtcaaagggacttataatatgaaatggagggagtattaggtgtccaatttctctacttagagagcatttaagttactgttttggccaggatacttcactgacattgaaaaatgttagagcatatgtgactgacatgacgtttcaccaagaatttcctgttctatcttgttagtaatggtttgtcttggacatcaacttatctgtaatccactagaagctttatttgcgcccaacaacgctttaatgctcacacctaatactccgctaatggggagcacaaaataaactgagacaaacattgataatatcacttggtcttgcattctctatttgctcttcgactgcaatggtgttttgtgtgcctatttcttgtgttgtgtggataataattgtatattttcttgcaggcaccatatgtggatccaaggacaaagctgcgctatgctgatccagaagtgttcaagcaaatccgaatgcttcctgatgaatatgtccaaaggtatctggcactgagaaatgctgccgttgtactgagataactatgcaaaatctatgtagaagagaaatggggatttgtgctcttgagtctgttggcaaatacatctctagatctagtgtgaatgtatatctacttgtatgcttgtttcttagcaaattgtaagagatgacttttcctccgtagtgatagctgacatcatggctggggacgttcagttcgtgctttatcgacgttcatgaattactggtaatctgttctcgtgcaccatagccgaaattactttctggattgccctgatctttatcaaggaatgcaatgacggatgaatgtgcatgcttcttgaccttataaacggtgcgcaaaaaaactttcgatatatcaatttattagagaaccgatttaaatccaaatttgagctttataatatattttcaaccacaaaaacaaatgcagttgcttgtatacacgcgtgcacacaatatctatacgagcatcttcaaaaaattgagctgacatgtttttaaattgactgttgttacgggtgtcttgctatcatcgactgttggtcattgacaaaatattagccgtaaatgtgagcaccgtgctaagcttaggacttatttaattaatttatttgtaccattatataatcgtcacaaataattcagctattcacccatttaacatgagaacgaagccaagcatacggacgggtctcatcttttcgattatacttatgcttatcaacaaaaatttgaattttgaaccttaaatttagagttgattttggtgttttttcatcgtagtttatttttcagcttttgtttttagatcgtttagaacacgtatataaaagttttattcacaaattattttttatttataaatataccgttaggcttattccaccaaacagccaaacgatgggcatcacaagatcatgatttgatgtacctaaatcctggtccattcatttgtgtggaattgaaattaaatcctgggttatacccacatggatgcattgatcaacttggatttgggttcatacaaatgatgtcttatctctgaatctctgatatcattgaagttaccgataattcatgtaattttcacaaagagcaattgatgggcataaagtgcctgagattttcttaattgcatgcaacatcatatttttccttcaagcaaaaaaaaaaaagaaaaaagaaaagaacagccaaaacagctctgcaaatgctgttcctataactgatgactgaacaaagtccgtacctatagttaccatggaatgggggcccacatgtcaatatcatagttttcttttctaaatgtcaactaaaagaaagattcgatgatattccatacctcaacgggtcccacctgtaagtttttgttttcctttttctgttaaaaatctcccccagagtcctctttcatacatactccgatttcgtccatcttctttctaaatccatttaaaatgaagtcggtaagcactaagcactgtagtatctagtattaggttggacacctgggctcactttggtcggttctttggtttttgtagattgtgtgtagctgtgtatgactgaccatgtctgtcagtagcacgagcagtacatgcgtgtgaaagacttttctagagctgactttctttcatttgttcttattaaatctaataatgttcatggtcaattcgaaagacagttactattattatcattacttttgctgttatgtgcagaacaggttgagatgaacgtattgaaaagctgcatggctgacataccaaatgattaattatgtgctttcttttgtttctagccccttttttcttgaaaactcgtcttttgcatcaagaaaccaagaaacctcgttctactgtaatagactttgtgcaacatgtgaacaagcaacagtgacatttattgtttattttttaacaggcccccgaatcccaatcaaatctccccttatccaaacatgtccacactgatgagtatattctaataaaaaggtagcaaggcaagaaaacgtgtaaaaaaaattcaaacaacctaagaaacaaggtcatctggtaaagtcaaaatccatcagagatcatacatgcactttatcttgaggaacatacggcaattgggacagtataccaactcaactgcttgagcaaagttttaccaattccgaagttactgatgatgtcaagtttaacgcctaccatgtttgtctatttaagtacctccagcgatcctctagtgttacattaaatgtacacctgtaccttcctgagaaggtctgaggtgttggttgctgcctggctgggtttatggtgagaaatctctctgtacttttacctgatattgatccctgtgatgtttttggtgatacattgatctatgctgtgtgatcgtggattcagatatattatcttgttttcatgatgaatgtttagttattgtttcttctttgtattgagtgttctgttctatttagtttattttgccagtaatctttgtttagacttattccttgactttaagccaatatctttttaaacttaagtaccctcccttcttattttgttaacttccatttattttttaaaaaaatcttgtgttgaaccagtggactaggtgatggacgggtcacacaacttactgtccaaacaaaattgtcctcagtttaatggttaacgaatgcttttgctaccttaagaacaacataaatcagtcactgaaaatttgtttttttgatggaggtctctgcaaatttcagtttcactatgtttttttgtttcttcttaacggctctcagctttcaatggttttatatttgtacctttcgttcccagctagcatgcaaagtttcacgtgggagcaagcaactaatgggctccaaagaagcattccgacgtatcatattctgcgtcttgcttctactctgtgtgagctgcaaatgcttaacctcagaggtaaacacaacccaactggcagtcctcaaggttgatgcctcaccgcagcatgctcgaaagatccctgagacactctttgggatatttttcgaggtactttagtttccttcccttgaaaaaatatcccagttcttaacttgttaagacttatcaagttttaaatacgaacgtttacatattcttactgattactttggtaaaatactgtaggagatcaaccatgctggagcaggtggaatatgggcagagcttgtcagcaacagaggtacttctactggcctgccattaatctcatctctagattgtgctgtgtgcctcttgaaataatttttgtcaagttattagatagtagagagagtttactacgtggtgtttggtattttggttgggtgaacttgctatggaatgcaactacatctataacaattactgacatttcaatggctctcttacaaaaatagatgagtattgagatcaatgcctatctggtccaaccgaggataaaagaggttatcgtaatggcttataaatacaagtgcatgctatgaagtatagaaaataatttctgcccagcactggcccatactataacagaattgttttctgtttaacaattttttgacatcgaaacttgagcataaactggaaacagcattcaaacaggcattttccttctgaagtttagttcaaccagctcatgaattttatgatacaggtttcgaagctggaggccctaatactccatcgagcattgacccttggtccataattggaaatgaatctgtcatatcagtggcaactgatcgatcatcatgtttcagtcgaaatatcattgctctgaggatggaggttctctgtggtgactgccaagctggtggtgttggcatttacaatccaggattctggggcatggtatgaccttatgttgatcagaggttgaattttcatctcatagctgtcgttttgcgaaatgttttcattaaatttaaccagaaaatacacagtttctgtttggaacttttcgttaatgtttgctttcatgctctcaagtaaggcaaatgtttagtacacattgtgtaatcctgccaattcagctggataatgtgaccttgtcatgtcaacttacagaacatagaggatggaaagaactacagtcttgtcatgtatgctaaatcattagaaaatacagagttaacagtttcactaacaagctctgatgggttgcaaaatctgtcttctgctaccatacagtaagcattctttgtttactaaaacggggtaaacttttcatttttacaattttcatcagtgtatagtattttgttgccatagagttgctggtacatcaaattggacaaaacttgagcagaagttggttgctaaaggaacaaacagaacctcaaggcttcaaataacaactaacaagaaaggtgtcatatggttggatcaaatatcactcatgccttcagacacgtataaggtaccattgtagtttgtttcacaggtattgcttgatacttcgaacagcaaacagaagagtgaacccaagtatatttcacaggtcaattgtagttggattcttcttttatccaagatcatataaaagctttcatttctgtctgtatttatttgtttgttaatccattgagtttgatctctttctagtagtcatgcttatgacgtatgccatgaggttatttccatatttaacttccatttctttgtatgtacagggtcatggtttccggaaagaacttgtatcaatgcttttggatttaaaaccacaattcatgaggtttcctggtatgtgaattattctttccatcgttgcacatatttgatcagacatattttggacagttaactagattgaagggaactattccaggaggctgctttgttgaaggccagtggttaagaaatgcattcaggtggcgtgagtctgttggtccgtgggaggagaggcctggacactttggtgatgtctggggttattggactgatgatggccttggatattatgagtttcttcaggtaccaattggcattatttcagctctacattttcttgattattccataatcatattttcctttgaattgaacatctaagctttctgaggatctgggtgctgccccaatctgggtgttcaacaatggtaattatttttgtgtttattgcatctttgatcaccactaccgtctgcctttattgaaataattttgcctcttaaatgtcaggtttcagccacaatgaggagattaataccacggctattgctccatttgtaaaggcatgttttgagctcccaattcatttttataccagcatagacatatcttgatgcagtgaatgaattccatttgtaaatacattggaaggagcaattctcacttttcctgtacatatatcaaggattagaaatagaaattttgttgctcaatcctttctgagacagctattatatatatgatgggtctgctcaaatgatggtagatgtttatccatcataatcaatattgggacattattaagatggttctttggtttatttacatgtactgcacaaattgatacaacaccttgggttaagttcagattgtttttttcccaaaattattaatggattacttacaattttttttctaaatttgttcatttttatggataaaagttagtaacaactaattatctcaccacacgttgcccatattttccccagacttggataagttataactgaggctcatatcttttgttattgtcttttctccaggatatactggacagcctagaatttgcaaggggaagtaccaactcaacatggggctctcttagagttgcaatggggcatcctgaaccatttccagtcaaatatgttacaattggaaacgaagactgtacaaaaaaattttaccatggtaaatatatcagttagtttcttatggattaaatctatttcccactacaagttgattatgtttatgtatacaaggattaagctcattctttgtcaagaaaaaggaaacataaataattttggtataagcagataagttactcaaccttttcctgtagtttttaaacacaaaatataaacacctatttttatgattgggcatattttgcaaaaaaaacatcaatacaagaattttttttt

SEQ ID NO: 7208 - DNA, 35370 bp, Oryza sativa
acgcagccgtcataccataactatcgatcgtctacaacagtccaagatgtgaggcctaaaatattgacgagccgcaagtactgattagagaagctgcacgagatatatagcagaggttaaataatttgatctcaactggcaataacgagatatagacaacggtaggatgatataggctttttacttaataactaggaagaaagcctgcgcacatacgggaaatttatttactgtttataaaaaaaactaaatgaagctttgcctcgctatatttactataaagaatgctccctctgtcaaaaaaaaaaatactcacttctatgtttgaatctggtcatatgtatccatattcaaattcaaaagtgggtttttttgacgggggagtaaaccataaatgttgacatactaaataatatgaatatctatcatatccaaacaaaaatctttttgttctcactcatcaccactacttactatcattgtcttaaaatatgaaggtctttttaattgatagaattatatatgtaccaaaaaataaacccaatgcatcattaataccaaaaaaggttcatctctacctcattccaaataacatgacttacaggtatccaaatctatatataaatatttaaatataccgcttctaccaattaacaggatgaaatcattaaacttatatatgaatgcctctctaaaagtcgggtgaagccgattgtagccgttaagattttttctttgatgcctttattcttgggttccgcattgatatagtcgagctcctaaagataagcgtagagtataattttataacggattgtattggtaagtaggtcagttgagatccatgcttggcatcatttagggtgtgagtgaaagaagatggagatgatgaaaatagttttttttttatgtctttgagtcgatttattgtatagagtagacataatttattttctcttttaaaaattagctcggttgatcattcgactctactttaaatttaatagcttcagtcaatggtgaggaccacgtaaaaaatatttgctcaaactgtgatctttgctaacatatgagttaatacaagtttttatttttttattatattatacatctatttcaccaatgcttgttcgaaggaatatttgtccatcatgtatgtaagtgtatccatagagtgcatctgcacgcatttagacgagctcatattattgctttttacatcgttagtaaaaaaaatacttcaagtaaattgacgagaagagggtagagcaacgggtggcatgaggcggcgtcatggcatgtcttctctttccatatcgctaggagttttcgctatgcatatgatcaatttgggaaaaaccttatagttggaaagaggaagaaaacttctagatgggacagatcatatactatttttttttcttttttatctattgtgcacgtatgtaggagttgtgtatgtatataagtacagcttggatagtttttagggcaaaggtattactgtcatatatctaatttaatggttgaaaataatggatcgccgattttgagtgtaaatagatgttttgcttttttaataactttttctagattctatctaattagagcatcacgtgacatcttatgagcgtctataggagtgtaggaatgctattacgcatagtcgcaatctaattgtagtaactattattttcggtggattggttgcatcctctttgacagttacgtagttagtattgctttttatcttcggtgcctgatgagacacatgctcattagatctcagctaatcgttatatgcactgtgcacagagacctcataagtaatatgacttggcgattagtgaatatggcttgtatataaaacttacatatatggtatatgggatcaatgaggatataccattgatattttaggctagaattgaccaagtttattgtacagtacatattgtgttggtatctaagtaataagtaataagtttaagagtgtgttctaaaatgcttctgggattagttactcccttattcggtataataaaaaattaacaaataaataatattattactttttaaatcataacattaaaattattaatagtatacttaataaaaaaaactttccttatttttatgaatagtgtagatggttagtgcactaatatttgccaagtttatattatatttttggtaatttttttaattattaagtatttgattggtagagtgtaattataataatttagtaatattattcttatataacagtattttcttatagtagggagtaatttttttaatgttactcataactggagttgtttttatttttcaaaatgcatttctaatttaacaatacatgttattaagtgatatacaattatataattatataatgtatattatccacttatttagatattttataaatattttgatgacgtgcgtatagtacaatacaactcaaaataacttatatttgtacaactatgggctgaagcctggaattattaatgtggtttttatctcatgtgcaacgtacatactccgaactatatgggctgaaatatgaattttatttttctcatcatgtgctcgtgaaaaagaaaaataaaaagaagacatggggcccacgtacaaaatatgtacgtacttgacgtacgtacacgtacgtgccatgtgtggctttttaaagataataaatctaattgacatttttatgctatatctaatggttaaaaataatattgggtccaccagattaaataaaaaccaacggccagatgttttgcttttttttataattcttctaatttattagagaactacgtggcggtataggagcatttgtatgggtgccacgtgacggacttttagtatataataactaggaaggtagcccgcgcaaatacgcgggcaccttattgaacagtgtttgaaattttgtgatgaatgtttatgtataggattttttttatactcttctaaatctatatttatcaatatttttttggattgttttggaagtttgtttcgatcactggacgtacgagcgtgcgttaagagggaacatgtttctggatatttgtctatatgcatatgtaactatagaggtaagttggaccgatgggaacgtcagatcctttgaggggggtgtcttagacatcctagtgcaattaggatgtggtctatgtttttttattgaaaggatttgatatgtgttgtccataagcattgtgtgcacatgattagtagtactatcttgctatttaagcaagagtgtagccaacttgtaaggcattatccctccaaccatatcatttttgggttgactattttatgcgaagcgagaatgaaagtgtaagtggggtaatatttataagtaagcgtgccaattggatggaggctgggctgccttgttctgaagaatgggctgttacaaattgtaaactaaaattacttgcatcatgtcgtcttaaatttatgagaaaaatatgtcacaataatggagctggttcatatgaaaatattatttttatactacatgtttttatttttaaaaatatttagcatcttagtttaaacttttaattaatattttttcttgtatacaaaatatgcctttgtagattttacgatatattaatataagaatttttctattaaaaatatgataatatgacttctttatctaattaaacaaatactcatgtacttctatttacttctactacctccatccataaatcgaaggatttaaattttatatcctaaaatataaggaattattaatactactcgttccatctggtcattcttcatttaatttttatccaacattactctaaccattttctaactctctacataccccttatttaatgagccttatttaatcatgggtatcatagtatttttttcattcctccttgatttctactccctccgtaccagaatataagaagttatagagttggatacaattattaagaaagtaagtagaattaatagggagatgttatgttgggttgagaaatgaaggaaggtgagaaaagtgaaaggcggagaattgtgattggttgggacgtgaatgttggtggtaatgtaccgtaagtgctaaaagttgttatatttcgggatggagggggtataaaattttaagatccattataagacggagatatatagtaataaaaaagagcttcattcatagacggatttatttgtaccttatagattgatttagcttaaatagacccggtatacaagttgggaaatataattaagttggtagaaagtcgttagatgtctaatggtatgaagtaattagtctaccaattttattaaaaaattaaggtggatatttttttcagggtaatttttaggatcttttatttagtggttaacttaattgttgtaaggaaaacaaagaggcgagagatccagtgggtttgtttagtccgtgagcagggaactggaaacatgtgctgtacatacgcactctgacggcctctgacggcctgatcgatcagtaggtgtttttaatatatagatctaatagtttaaaataaggtagatcagtttgggtaagatgacttcagctcaataatgcatactcctgccatagatactacaatgtagccagttgagatccatgcttggcaccctttagggtatgagtgagagaaaatagagttgatgaaaatagtttttttatgtcttgagttgatttattatatagagtatatatagtttgtttatggtgttaatcgatactactaaattttagtggtatatatataagtttctcttttaaaaattagcagggttgatcattggactctacttcgaaaaatctaatagcttcgatggtgaggaccacgtaaaattttttttctcaaactgtgatcttttgcaaacatacaagttaatataagtttttatttttttcgtgtattatacatctaattcaccaattcatgtttgtggggattaatatttgatgaaatttattaaaattatttgtgcaaaatgttaacactattttgatggggacgacataaaaaaaagagataaatgtagttacatgtttgtttttttctagcgtagtagtttctagtatggacgtttgtttttttttcttttcggataaatatttgtctatcatagaaattgggtttgcgaatttgtattcatgatgtgcgtccgcatgcatttatgtgagctcatgtgattgccttttaaattgttagtaaaaaagtatttttaaaaatttgatgggaagagggtggcatgagactgtgccatggcaaggagtgatcactacatatatgctcaatttagaaaaacaccttaatccggaaagaaagggaaaacaaccatatgagacaaatcatatacacactcttctttttttttcttttttatatatctgcataggtatgtacataggagctgtgtatgtacgtaagaagggattagatggtttttagacagagggattattattatagatctaatttaatggtagctgtgtatgtacgtaagaagggattagatggtttttagacagagggattattattatagatctaatttaatggttgaaaaataatggatcaccgattttgagtgtaaatcgatgaatagttatttttattttattttacagtttttcttagattagttctaattagagcatcacatgacatcttagaagtgtttgtaggagtatagaaatactattactcatagtcacaatctacctgtagtcaagtattgtttgcgatggattggttgcatcctctacttacctataatttgttgatcattacacacttagaattgctctttatcttcggtgtttgatgacatacatgctcattgctcattagatattagctaaccggccgttaggtgcattgtgcatgaacaccccgtaagtaatatgacttggtgattagtaaatagtgacttatatatataacttgcatatatagggatcagtgaggatatacgattgatattttaggctaggattgaccaagtatattgcataatacatattaagtttttaatacataagtaataaatttaagacaatgttgtaaagtgcttataggatcagctactccctatttatttggttgaaattatttatttggtttttatctcatgggagtgaaaaagaaaaagaaaaaataaaagaaagggagggggggagggcgtacactaacgaagtatacgcacatgagcgtacaagtacacgagcgatcgatcaacgtggacgtgtggctttctgaattctaaagatgaattaaatatatttggtatttttagatataacggttaaaaatataggtccaccagattaaatgaaaattaatggctagatgttttaaacgccacttggcagtctaggagcgtttgtagagatgccatgtggcggcttaggagcgattatagtaagtttaattgacttttagtatataatagatagatagatttacggagttgctagaaatatggcgccatatactacagtcgattttttttcagccacttacacattagttacacctcatttacaccccacttacatatgtaattagtacgtaatttttgaatttacatatgtaatttttgacttacatatgtaattttgagacttacattataaatacactaaaattacatatgtaatttagggacttacaatgtaaatacatgccgactattttttgatgaaaaatatggtgccataaatatagctacaccctagatttataagcggcctacttattagttaacttgatactttcaattttactgtagttaacgcagtatgagagctgctagatgacggtataccattataaaacggtatactttctaattttgataagaaagcaagacgtgcgctcatccgcatatgactcctctcacggcaataacagcagtgcagcaccttcacgcgttgcctacctaggtctcttacagtgctcctagctggcgcgtgatctcgttgtgccacggcggattcgcgtcaacatggagcgggcgaccgcgcctcagctaggtttctcggcccctaagtgagcgacgcagaacctcgccaaaacgagggtgcacagcaaagagaagacgcgggtcgcgcacgctgtgggcagcgtagccttgcgctcgcgtgccctagcacccaaaatctcctcccaccgcagcaaaatccctgattcgccctcctgaaatcccctcccgccacagcattatttctcccaccacagatcagattggaagagaaaaggcaagaaaatcttggggattggaaaagaagaacaaatcagattcaacaagataaaaaagaaaaagaaagcaaaaccatcatagaaaaatacgacgactgggtcatgctcgactccgacaaccccgcctgctccgactccgatgacgaggaggacgacaatgaggtggggagcgacgctgacggtgcggcaaccactggcgccggcgcctcccggggacgcctccctcacacgtcagttgccgcggcgtcagcgctgctcatgtccactagcgccaccgccgacttcgcctccccagcccgcgcacgtactgatgaggagaggagtcctccagtgcgcgtcggtcaccgcggcgtcggcacctcacctccccggtgtcccccctcaccgccatagcatgtagtgggtgcggcgctggcggcgcggtcgacggcaaggcgaggcgcagggcggcggtgtcccaggcgtcccccgcgagggaggagagcacgacaaagaaggaggagacagtgaaggggaggagaagcgagcggcgcggtcgacagcgaggcgaggcgcacggcggtggcatcccccgcgtgctgccgcggcgtgggaggcgagaaggcgtggcggcgtgggagtatagtaggagccgcggtggtgcgggagagaggagaaggaggcggtcgtgccgaggagaggtgcaggaatactcttgcgagtagtaggtgaggaccacgctgaagggtagttgagaaaaataaatttcgttccgctctgtagtaacgcgcctagggtcacgcccactgtgggcttgataccctttaccagtgcctccatccaattaaccacacatatatgggtgcttacactatggggtgggtgtctttgggtcaactttttaggctaggggtatgggtcccatagcttgcactgtgagaggccttaggctgtacctacactactccgtgcataagcacagccatgaagaacctgctagagtttatcagttcaccaactagtctgatgagacctgctagagctgtcttttgatgggccatatacctcatcctacatgtatcatacttgttgatatatatatatcttgcaaatatcgtcactcaccactaccttttaatgtatagtcactcgttgatacctgcaagtatcatcaccggtacctagcaggtaatatacactcatacttggtaggtactatcatcgatacatacatgtatcatcattagtacctgataggtaccatcactaaacagggagtttcatcattggtacttagtatcatcgtactataagtatcattgttagtaccttaaaaatatcatcactgaacagcatgcaaatatcaacatgcaaaaaaagaataacaacatcaacaacatcctagaagcagcgcctcgatggttgtcgtcgttgcaggaggtcatcgctagattcaggcacgccatcatcggatctgcctccaccgccgcttcctttcttgaccaccaccaccatggcgcgctcctcaacgagctcctcctgccagtgtggatgaagatcggaacaatctcagttctggccaggaaatgatggtcgcagtcgatgccctgtcgcaactatcaccgacacagtagcacctgaggcaagccatagacggatccaatagtgaggctattggatatgggaccacgatgccgagccccacagccaccgcagctactaagttccaccgccgacaagccccccgcagccaccaagctcggtcgtcgagccagcacctgccgctgttgaaccccgccaccactagcttgtatgcatggtaggtagagggaatgaaggacgtggtagtgcgtgaggataggtttgaaacttttggctgggagaggatggtattgaggtactttagaaagatgggggcatggggctagctgcctgcatagctgggtggtgcacttttaatatagcgatttttctttgtgcgggtggttctctttagcagctgtctaaaaagtttacgtagtctacttgcgtatgtgaaaaattggtttttcgataaaaatattcggtactaggaccataatacatatgatgaacaaaaattttgaaatgaggattactttactaaaatagctttgaatgcctcaagaaaaatataggggcgtcacagaagtcaactaaattcgcttaatcacaaaacaacccatgcatgtaagtttcgtggccccgtaacagtatagctgttcagctattccctgctcatgttgactgttccatttcatcatgatcctcatatgtacgctccatgataatccgccgccccccccccccaacccacgcgcgaaacccagccacatatggtcttttttattggatactccctctgtacctaaatataagaaattgtagtgagatatgacatattctagtacaacgaatctggacagaagcatgttcagattcattagcctaggatgtgttactagcttttaaccaaaatcctttatatttagggacggggtggggggagtactaaagtaatgaaatatcctattgatggtagaactcgtgggactagctaggacaacaggctggaagtgacaaacattcgataataatgtacattacatgctttctaacataaattctccattcttcagaacattgcagttccaattgttgttcccggttattcctgaccccaaagcaatgcccacccctccaattactccaatagcctagtcctttgtagattgtgatgggtagcaatttcactttcaaacactacctgtagataaatcaattatagacccatcaagaaggtccgtgtggttagaatccttgatgcttcccattctaagaatatatatgtaccgtcttgtgcacatatgacatgttctatcttctatttgaaatgctggctaatgaaatacgtgaccgctatttatagtctgttcaccccgagaagcggcattacctggtttgctgcagtactgttcattctttcgctcaactaccaaaaccaaaagatccctaccttgtagtggttttaggccatttatttatccaaaattgactccagtactctttgatacatgtttggcaagacatatgacttgcttttctactactcgtaaaagtttaaatacattctcgtaatcttggtataattttgcttaacgtagagaaatttttcttccaaatgcatcaaattaagttgatggccatgctgattgatcgatatcgatgtgacattatgaaatggatttggcctggttaaatactccaggcgagtgtccaaagcacatgaatttggtatcctcatccagactagtactagaacccaagagagaagaagtaagcaagtgggcggagaagtaagtgaaggaaaaagaaggcggcgcatggctgtttatatgcacggggcagtaaattgatgtgttgtgataattgaagccactctaggctttgttcttttgtgctaattggaaccttccgtttcagcaagggaaacggaaaagcacattaacatatgattaattaaaactaacttaaaaaatagattaagggggtgtttagatcagggcgtaaagttttgacgtgtcacgtcgggtattatataggatattcggacactaataaaaaaactaattacagaatctgtcagtaacagcgagatgaatttattaagcctaattaatctgtcattagtaaatatttactgtagcaccacattgtcaaatcatgaagcatttaggcttataagattcttcttgcaaattagtcgcaatctgtgtaattaattattttttagcctatatttaatactttatgcatgtgtttaaacgtttcatgtgacggggtgtaaaatttgtgtgtggaaccaaacagggcctaatataattttttaaagcaactttcctatatttttttttttgcaaaatacaccgtttgatagtttgaaaagcgtgcacacgaaaaacgacaagagggagttggaaccattccaaagaaagcaacctaaagagtcattcagtgcacaaatattgcccatgatgaaataagtattagagcaagtttaatagtataaccaactgctagcttcaattcatctataaccaatctaatagctcattcatacaatagttatatactatactattaatatctggccccacttaacatacacacagtgcatcttggagtccgtgctacagctggctataaatctgtagcccgttgttcttctctctcccttatttatctctttaaaatatatttgtagctggcttatagcctgctattgtgtatgttcttagtagcaaaaaactttcacctttaggccttgtttaattcccaaaatttttttctcaaaaaacgtcataatcgaatctttgaacacatgcatggagcattaaatatacataaaaagaaaaactaattgcacagtttgtatggaaatcacgagacggattttctgagcctaattagtccatcattagccataagtactacaataacccacatatgctaatgacggattaattaggtttaataaattcgtctcgcgatttccaggcgagttatgaaattaattttttcattcgtgtccgaaaaccccttccgacatccggttaaacgtccgatgtgacacctaaaaatttttcttttcgcgaactaaacacacccttaagctgctaattcaatcagaatgaatcgtccgcttagctgagaatgaatcgtccgcttagctgtgtaggtactcaagcttgacagagttttgaaggcaatcctaaacactcgtgtgggagagccaaagctgtgcagaacaaaaggtgggagatgtgtagcaacgaagaatcagatagatgaacagaagtgagttcctctctgtttatcccgtaggtggataacgtctctgaattaatcgtgattgatcgatattcatgaacttgcctgttaccagagtaacgagagtaacgtaacagaaacgtgagtgtccatcggtttcgctttctcgtaaaaacagaaacgtgaagaaaacgagcggccaccctgccacgccccgaccagctctaggacgcgcgtgcgcgttgcattctcaccaccaactcaaccgctgaaaggtgctctcaattactccctccattctcttttgattttgatctacatattttgaaaaacagaaaattccatattgatcagcggattacaaaagagctcctgaaatctcgcgcgaagggcgacgcttcgtatcgctcgcctcgtttccatcaacgccgcgccacatgcagcacgccctctctggccgagttccaattcttaagcctcttcgtttactcccgcatgcagcacacctctctggccgcttgcgtcgcgctcgactccgctgctcgcgtcgagctcgccgccactgctcgccgccgccgctcgcatcgcgctcgcggtcatggctgacccgctcgcctcgcttgctcgcgccatggaggtggtgccagactcggagatggaggtagcgccggtctcgtcggaggtgttgctggactcggagtagtagttaatttaggctgtgtgtttgatacctggggttaggggttaggaacccaactctactgcacggaaaacggagtaatccattaacacttgattaattaagtactagctattcctttttcaaaaatgaattaatttgattttataaagcaactttcgtatagaaactttttaaaaaaaccgtatcatttagcagttttaaaagcgtgcgaacgaaaaacaagagagatgagttgggaacctcgtgaaacgaacgcagccatactgtgatactactctctccattccaaattgatctacatatttcataggtataccaagacaaaaaaaagctaataaatctctcatactatatttactctatcaacaaactcgatgcatgcaccatcctcactattttctagccaatagcaaatcaagatattgcatgtatgttataaatacttgtgtgcatggatgtatgcatcaatgttcatttactccaatacacaaataagaaatagacttaatgaatgaacacaaatatatagatcatttaggaataacctcaagaaaattatacgtagatcaatttggaatgcagggactatctcatttgttttcaaggtattattaatctcttaacataaataatgaggctttgaaattgctggaattaaactgggtccagtccttttaattctaacaaattaagtactagtatatttattagtaccttgctacacggagccattgctctggatctctcctctcaatttacatgtcaggctccccacaactcatccacccatcaaaattgattagttcaacgacatgaccaatcaggttggaatactgaaccgaggaagagtgtaagcgcagcagttactatgcatgcatagaggttgagccaatcttaagcatgtatagtatctaactgtacagactttttaatcctttcttcctctacgaattggaaagtaacttaagccgcaaagaaaggattttaaaagtaaagcaaaataagcgactagggaacaaaagtataccggtagctccaatatgcagaacaagtaactgcagtgaggagtgatttgctcactgggtttcacttgtgcaacgggagatgaccaaatatcgcgatcattccagatcatcagagcaactatatgttttcctgatgtcgctcatccctaattacctacctactccttaattagtgagtgcaccgtgtatgcatggagcttcactataaaaatagataaaggtgtgtaggtagactagatagtcaagatattgcaccgaaatcaactctggtaaacaaaatattttttttgaaaaaaaacaaagaaagtgggtcatgaatatatagtgcagtactacaaaatgaatgtggcaaggggtataagctattcctgctttgttttcttcagacggtgcgtgtgtctatatgtgtgtgtgtgttgggggggggggggggtggtgtgtaagaaagtaagagcatatggtcccctatagaaaactaaaatgaactattgatcgatgaaatgttcattgaattgacttgatgaaacatacggcaaaatggcttcattgaattgacttgagcggcaccaactctactcaagggatgaaatgttctattaatcaacatatagggagtaaatgtatttgagaaagtttaataatgtagccaactacttactctaaaaattaaaatatcatatatagccagccaaatagctcactcattacaatagttagttgtaattatatattgcatcattaatacaactaatccacacatccctgtcacataatttattggagctagctcatgctgcagctgtctataaatttgcagcccgcttttattctctcatctcctgtctcatccacataagcacaaatatgatgtggtaacttgtacaacctatgtatatcaccctattgtactcgctctaataccgattagcagtgtttgtggcaagatgcaacctttttatgtgattgaacagcttttaataacattagattaatgggcaagggaccatcaattaaataattattagggtgccatttgacatatcaacatttaagttctacgacaacgggctcgttcgtttggtccaacggcttcatccaaagaaatttaatggtcatctctactttatgcactacagtacgattgacggcagctgggaagcaaagtactgtcgtgagccaacagagcaggaacggagcgaggaggcgccgttggatggacgttaggccgtcggtggagatgttgctgaggctgcttagcagctgttctgaggccgacgcactgctggtgggaatcacggcagtaatgaaggatgctaaaagctaatttatgcaagatacgaaatcaaatggagagattaacacaaaggtggtcgcattaatcataatagtctcgtacaggaaaattagacaaataaaacagtactacaaacacactgacttaacacatgcaggaacagacagatcatagaaacacacagactgctacataacatatccacaacagccatggctatgttatttattttaaacggtgcgccctaaaaaccaactagttgtaaacttcatcggcaatagcgtcgcggactgtattcattacttccgcactgttgggtgcatcgtaccagccgcgtagaggtggagcgtctgaaatgattgggtacccattgtacaatgggttttgtgtaaggaaatgagtgtcggagctgtcaatcctgaagttatggagagcgaaggcagaatgtataatcttggtatgatcgtcactcctagggaagtaaggtaattccctcaggattctctattggcttttgatgactccaaatgccctttccactgtgttacacagtgaattgtgcatgtagttgaaagtctcttcccttccatgcggcaaggctgcttctgtattacccccaaattcatccaagtggtacaaaaaatgtgggtatgatggtaggaatccataccggcttgcatatcctgagtccacaagaaaatatttccctgcaccaaaaaataagcaaactcatttttttttgtgaaaatagatagtcagctttgcatttgtgtaagattaaatttaaaacttaccccatggtagccttgggaaagcaaagggatagctccgtactgcttctgtcagtactctttggtcatgcacagaccctggccatccagcatctgcaaaaatgacacggtcgtcccatccaacaacaaaaagaacattcctagaagtaatgtggtgacagttcctatgttgaatggaatcatccactaccacaatgcaaggaatgtgtgttccatccactgcaccagccgcaccagcaaatggcagaaattcttcctcattaacaacacgataatgaactctctcaaagtttggatctaccggcttatttttgtcagcagccattgcataaatagcattaagtactctatgaaagtacttagagatagtagacccagatcgcaccatcctattattagtcgccctatttgaattgccccccgccatgatgtacagaaatattccaagtgcttccattaggcatacctcaattgatccatgcagattgtaccgattagtaagtaccccaaacagagcatggatttgatcaggcatcagacggaaaattgcttggcattggatgggtttgccattgtctccatcatccattccattccagattgttgcggttcctgttgcggttcccgacgtgctgccctcacacttagccttgccttcaaagccgcaaccaacatgtccagaatggagtcctcttcatcactgtagtagccatcgtcagaaccatatgacctttctgacgaagtgctcatgtttcctacatcaacagataacaaagtaatatcatggtacagttagcaccctatgtgctgaaaagaagcaatgcatctaactagggataaatagaattgtcagtttacagatatcttagtttagtttattaaattcctgcaaacaaaatatccaggggttaacatatcgaatgtattagtgcaatggttagttcaatttagtatagtcctgcaaaacaagaaagttattgagataagtaacatattagtcgaaacgttagatcaaagtattagaacatattaaagcaactaacatattagtccaaacgttagatcaaagtatcaaaggcctgcaagaaaggcagggattaatgtatagaacatattaaagcaatggtactgtaaatgtagttagggtaacaataaaaaattacctacttctacaaaatacaggaagtgaacagagggcatataaatttcagctgaacttaatttattcaagcacacaagctcatagttctaattaatggtgccgaaattgttcatgaaacacacaacttaattaaggcctacaacaagaacgatgcccgatatgaatcagagcaagttattaaacaaacatcacagcggaattaaaagatgcatcacaaccatagcatggcaccagatcgacagaagcaagcaacagcagtgctaaaacacagctgcaccatcagaaccaccattggcaccatcgccaccatcatcatcttgaggaccaaacctcttgtaccagtcgtccatatggcctgagcaggtcggtggtggcagtggagcaaacagcagagggtctggagcgaatgctggagggtagggtagtccaccatgctggtggatgaagttgaggcgctcctccggtgtgatgcagtccttaatgaagaaatcgcgcaggtacccatcacgaaacatcctcagggctgtgtggtatatgggatcctgcctagtaatcccatcagccttgagcatctccatgcatgctctagcgctcttcgcttgcttctgctcctccctccttgcccaactttcgttggactggaccctcaggtccgcaagcctgttcagtgcatccctggtggagtcgctccttgtcctcttgctacttccacctgaagagtaccccggcgccatgattctcttgccccttctgcgcggtcctgaagatggctccggagagggtggtaggagtgccaggttggtgaggtcatcaacatcgaggatctgagcatcttgtggcacctatggtgctgccggcctatgccgaacaacacccgacctgttcagcatgacagtcctaccaccatacaccgcgtgatgctctggaatgaacttcagaggtccatgcctgaacacacgggcacctctcctcatctgcaacaagaacaaaacaattactctttcaatatgaagggaagaaatacaaacagggcatgcagaaatgtcataaatacaagcagtagacatagccagtgcactgggcagaaaaaaaaaatcaatcacagatgatgtgtgcagttatatgtactcataaaatgagttttctgccattatttcataagccctagacagaagaacttgcagattggttgtacaatttcataaatagcagcaggtctgacatgtgcatgtaaaatcagttaactccatctatcagattagcaaattgtttggcacatgtattaacttccaatagtacaacaaaaggcaagatcaactagcaagcatgtactaatgaatttagcttgccttaagtttacagatatccactaatctaaataggtacaaatacatatgtactatcgtatattacacattcaggtaaggcaatcaatcacctagcattcatatttgcaaggcagtaggttttgtaaagttctgatgtaatttaaccaacatgtgaggcaaagcagatgtaatatcaaggaagtggaaaaatgagtaattaaataagcagccttctacaaaaataggacaatgtaaatcacatcgatcataccatgagtaaaaacactcggtgactattgaccttacaattagcaaaatacaatttgggccttgatgctaaacttttcaacagctgtgctggcaaatgaggatgccatttctcacgagagaaagttaggtgatacatgacacgaaaagattagtaggtcgaaacaaacgttaatgcgcacagattaagcctctgataaaaaacctatgacctctgtgagcatgattttggatgagtaggatacgtaataattatttaaacctttttatgccatttgtgaccaccacatgattttggatgagtaggatacgtatacgcataaatagccactcaaacctcaatatgttcatgatcacaacttaataccattcaatataaaatccgtaatgccgaataatgagcaaaggagatattgcctagacttagcatgccagtcaactttagcctcagtcaaaccacacgatggcagcgaccaagactgtgttcttttcctcacttttccaacttccctcgttttctgcgcgcacgcttttcaaactactaaacggtgtattttttgtaaaacttttctatatgaaacttgctttaaaaaatcatattaatccatttttttaagttttttaggctaatacttaattaatctcactataatcgcgtgctttgtttttcatgtagagaggcaaggttcctgagcgcagcccaaatgtgttacacatcccaggagacttgactcaaattgcttaagctctacaatatctcaattgctcaaaattcttactcatgctcagctatccctaggaagaagttgctagctttgcattttcatctaagccatgttatcaaggtaaagtacataaaagatgacttagatataaatagagacaaagaactagattacttacgtacgaccgacagggcagataaatatcgattcgcggaagcttggctacccaatccacaagcaaaccactaggggtagaccccatttagaatcaagccctaagtaaagcaacagtcccgaacactcaatttaactaagtctatacttgcaaaacaaaattaaacatatacatagcaagagtcagtacattaatcgaattaatgtactagcaatcacaaatcaatcctaacaaactacatgcaaggcttgcaagcaaagagggctatatgtagctcaatttagcataatagcaggttttatttcacaagcactagcaactccgatttcgaaatttttgtgttaaagcgaggacgaagaatgcagtgagttgcagtgctaggtgttaatgagatggatccaataccatttacgggccctgggcgtcacagcatcactactgcataatcacttttttcggacaagatcccttccaggctataggcgggccataactgtccccacatgcaaaaatctcttccctgaggatggttcatgggccagtaggcagctgcttaagaggcccactgttagcgaccaaatttggtaagacatgagccagattcggtattggaatcaaagtagattcggcaaagagttcgattcgaagaacagagtgtgcatcggctgtgaaggcatcagttggagtctgcattgactgagatggatcgaacagaggacagccgatacagccgattctaatgaaacaacttctagaatcgatcaacgtgcaacacaagaattgccacgatggagataagctctcagaaagacaattgtatatattaattagtatattttatgtaatttccttagagatatgtttgggtaaaagtctgccgtaaagacttatgtgtatcttagagtttgttagagataagagtcgtgtccggcaaggacatatcatgtatctcgggtataaatataacccgatcccatgtaatttacaacaacagtccaataacactttcggcacatcgccaacctttttactttcgttctatttcggcgagttcttcctttcaactagaggtaaacttgtcatgacggcttgcgttctcgggattagtgcttccatctttatgacactctaatcttgtttatgtaattcgtcaagttatcatatacacttcataatatttattagttgcattatataacttgttattggctagtttttactgttagaaagtagcggatagagttagatctcgttattggtttagattatatcgtgtatctaccatgtcttagaggttttcattatcttgtttagatcttacaattatctttatggttaatgatgcatcggttgagttcgatctattaaattctatctataattgtgatatctagcctatttcatgatcatcattagagatattgtcggagtttcagccgatcttacctgatttagctactttatatcatgtatgcttgattgttatgctaaatatgccctttatattaagatcttgttgcattaaggtatattacactttatgcttaatatattttgtctgtttctatatcttaatatagagtggtattagagtattagccgatacatgctagatctatctgattggctatgttataaacgttcacataatcatgatcttaatgcatctttagacttaagtgatttatactgtttcgacatggcgttcgatctatatcccaatcacttagtttaagtatacatcgagagaaagattatatatcgttaatatctacagctgatcgagtagatttagttttatattactttattcatcgttgccgatctaatgtcaataacatcggctcgacgattgacaatatgtcatcggctctcagccgatcggctatcatttatggatttaacctcgttttcttgtcttttattcttgttgattgcaggatcaaatcaactggcatgctcacgaacttaaaagcaagattttggacctgcacaggagttaagtagatcttccaggccagtgtgtgttttttgcattaacacccacctgcggtaataggtgcatgccaggtcaacggggcatcgtgaagggtgcttggctagcaagatccagttggcactttaagcggtggctcaatgccgatgacttggagtgtgtttgtagtggtggctactattgggaagatggtgtcctaattgtgtggaccatggcacgtagaaggagcatagaccatgcagcacctatgaagatagatctacgtgacacctcccatgagtaatcatgcatttagtcagcttttgcctgtacgcctaatcggtgctcgggtgtggtctatacggaggccacatcttgctagttgttagcatgaagtggcatcgggtcaagacgagctagccgatgacagagtggtgtggtagctgcttgttgcaaagttgttgaggcattggcaccgggcaaggcccgtgcgaaaggtatatacctagcactgaggcgaaggcactattgaaaacttgttgctgcattagatccttccatcttgtcggatttgtctcctttctccaaatctagcctatgaggagaattatggtgttctagtggctgtggaagtgtttctttgcgctgttgcctagtttgcggcgtggggtcgtgcggtattttcagttggctttgagtggaagactttcttagctttgaatggtacgagcgatgactacattcttgagtgttgtttgtcttcttaaaggcgttgccattggtgtcctatctcccatgtcctgacccttgtgatcttcaatgtgaaaatctaaatgtgagttgtcgaattgagtggtggagctagtcttgcctgtatgtcttccttggatgactgttttggcgttcctacctcatattgggcatccaccagtttaggaccaatggtgattagattgagatgtgttggttgattttgtcgacttgagtcgataaggattaggaaaagaactaaaccaccggtttccttatcctaacaagaaacaaactaagagataaattcgttttttgtgtgattggtacagaaaacagaatcctaaactaattgagataacccccgagccccaccagtgtcgcttatataaagaaagagaaggagggaggctgggtgacgatctgatttctctctaacctcaaaccctaaaattaatcgcccgatcgattagacactggaaggggttcgtgaggttttctctgtgcttcctttccatcaacagagaagaagaagaaagaacagaagaattggcaaagcttatggcttcagttcatccggtcagtaatcatctcaattccgcacttagaattggtgatcatgtgttaagctaagcaaattagatcctgagaattaaatctaacattgtggtatcatagcaattgcttagccacatgttcccatcatggtcacaccctgaaaattcaaaatttaaattgttgtttagttggaattttttagaaataattttaaaagtcttgaaaagaaaatctaatcttaattaataaattccaatataaaatggggccagataaaatttcattaaatactttgcttaattctataattcctagatttttctgggatttatttgagctaaggaagtatttttaataaatggaattgcatttaaggaataatttaaattgaaaaaggttttaaaaagtctcttttggctttgggccgaaagtcggcccaaaaccgctctctctctcctcggcccagttcggcccagtccgcagccgtcgcgcgcgcgcgttcggacgctgacaggtgggtcccacctgtcggacccatcgtctaccttcggccgccgccgcccgaaaccctagcgcgccgccgccgccgttcctttccaaatccggccgttcctttccttctccggtcgaatcaaaagagggaaaacaatctccgggatctcctctaccttttctcctttggaatctttggctaaatcgttttggaaagagttggattcgagttcgtcccggattcgttcttcccgatctttccttcctcgtcgccgaccgccgtgggccttcgccgccgcctctgagcccctttaaaaggacccccggtgtctcctctacccgtcgccaccttcgccttcgcctctcgtcgtcggaagagccctagcgccgtgtgccctagctttgccgtcgccgccgccgctccagccgtgcgccgccgtcgtttcagccgtcgccgtcgctcgggaagaccaccgtcgtgctcgccaagtcgtcgccgtcctcgtccgccccttcgccgtcaccggagatcgtcggagcttcgtcgccgtcgtcaagccgaagagcttcgccgcttcctcctcgtcgccgtcgccgtccgttgaccttccgccgtcgttttggtcgccggtgagttcgccgtgccgcccgcttcgtcttggtgccctccgtttgcgtcctcgcgccgccgttcaccggcgagcgtgcgccgttcgagccgtcttctccgccgagccgccgccgctgtcggtgacgtcaccgctgacgtcatcggggtcgtccgccgtgagccgctgtggatccgatcgatctcggccgttcgttttggattggttcgatctcggccgtccgttcgtgtgaaccgccgcccgtgcgcccggtccaccaaaccctagcccgctgacgcaataaaccctcttttccttttcaaaataattcattattgcgtcataattcaatttaaaccgatataaaggttttaatccgatttaatctttaaaaattcataactaattcatcttagctccgatttagttggttcaagtctctaaattcttctaaaattgagatctacactttaaaaatatccacatgtactgttcatgcttgtttatgtgctgttttggtgattttgctcttttctgcttagattccgtcgtttccggagagtccgttttcgcagaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggccgttttgtacttgattaccttattccttgataccttgggttattacaatttgactagttgagctttatttatattggttcaactagatattagatataattgcttagccctgcttagaaacattagtacacattcgggataactaatgactcactaatatttcatgatggtttcatgatagttcacgatggtcaatcgtgattagttaattaattaatgtgccaactaaaacctggtaatggtgggttgtgagcacatggttttgctggtcgtgctcatgacaattaaggaccggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttcccagataccgtggtggtattgaggcacatggtcacatgatgtggggttgtgtcttgtgggtacagtggtacacctctgatcagagtaaaactattcgaatagccgtgcccgcggttatgggcgggtctaacaatgtctttcgtgattagtctcacacctctcatcattgtaaaagatgcttaaactggtaataatttgattagctcctggtttggaatggtatattcctggtttggagatagaactgtgcagccggggtggttgttcagaatggttgggcctatacaacagggtatgttgtatagcgttagattaatattgtttaattacttaactgttttatcaaattctcaaatgtttgctaaatgctgcttttgcaaatgcaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgctgtttatttattttccgctgcttagatctttattgattgagaggaactatctacctctgtaatgacattttattcgcttattaattggagtaatatttgtactctattatcaatttgttattgtgtgcctcggctgattcctggacgagggttcacacacatgtaagcgtttggaattttggatagaaattccgggcgtgacaaagagctccaatggtctagatgtggacatgatactcttagtaggatgagaacatgcaacttatttgccggcttgacaagcactacaaagcttatctttctcaaacttcacatctttcaattccacaactagatcacgttttgaaagtttgctcaattgattcatgccaacatgggctagcctcctatgccaaagccaacccaatgaagtttttgcaactaaacaagttttcaaatttgcttcactagaattgaaatcaaccaaataaagatttccatatctaaaacctttgaacacacaagacttgtcaagaaggttagaaacaataacttcttgcgggaagaaagcacatgacaagccaagatcacaaatttgagcaaccgaaagcaaattgaaatttagagatttaacaagagagacattatcaattaacaaatcattggagatagcaattttacctaacccaattatctttcctttgctattgtctccaaatgtcactttctcttgttcattccctcctacttcaaatgtggtgaacatagccctatcaccggtcatgtgttgagtgcatccactatcaagcacctaatggctcccaccggtgcagtagttcacctacaaaagaagatcaagctcttttaggtacccaaacttgtttgggtcattggaggttacagaccaaagctttgggcacccaaatggcattctttttaccaccgagtataggggaacccacatatctatcaacaatgctaccatcatgagccttcctaagcatataatgagaatcaaacatgcatgtcttaggaggcttaccaccggggcaatcattcaccaaatgcccaacctcacgacacttggagcaatacttaccattactcttgacaaaacgagtggcacggtgagaaggtttcttacccttctttggaatgaatccaagtccctccttgttaaggatgcaccgttgctcactcaaaatcttgtcaagagtgttcttacccttgaagcacctctccaagctcttattgagcttagccacttgctccttaagctcattgtttttaacaacaagtgaggcatcacaaatagaaacacaagagttagagctagagctagacatatccacaagatcatcacaagaggtagaaatgctagatgatgcaacatgagcaatatggcaagtagcactatcatcaagcaaatcacaagatatgccaacatcaatgagagcttcatgttgagtagtgaaaaggaggttgtcatgagcttccttaagcttctcatgagaaatggtgagtctctcatgagaagtctttagctcctcatacaagacctccaaagaagcatgatccttctttagggccttgaacttgacaattagccgcatctacaatctgtccatgttttgttgatgcaaattttatttcaagattatgtttattagattaagttaatttatgatcttcttctgtaatgcttaagcttcagtttaattaagttaattgtctcaagaaaataagttatggcctcggtcagaattatggtttcggccagcattaagatagatgaggattggggaagaatgagctagggttagggttctcaccctccccgtcggcgactttttcggcgtggagcgaatcagagccgtccattagatcggacggttcagaccgaccccgcgttaggccatcttcgccgatgggccgcctccgccgatgggccgcacggtctctgggccgcaaaaaaagatgctgagccgcgccgctcaagcttgcgagctcacgcgtagacgggccggcccgattttgggccggcattggaagaagttggccgaaatcaatttaattcactaagcacctatttaattaatttcaaaattacacaattcaatttggcattattttagccatttaaaattgctggaaaattatgatcaattatttggtcgttcagaaagaaattaatgatatgatattatatttgaccaacgttaatatggtttcatgtcaatattattaagattattatttctttaagccatttaatttaattctagttgaatggaaatttaactagaaagtatttatgatttcatgtcaacatcattatgatggtcatttccttaataacttaattatttatactcgaatggaaccaacgagaaatttgactagaaagtattaagatttgaagttatatttaacccacattattataattgcatgacaattataattttttattccttagttattttctaccaaatggtgatataattaaggaattaattttaagattattcataattatttatgaccaatggtgctttgactatgaaattctaagtttattttgcatatgattgattaagccatggtaaactaattatatgcaatcaccaattcttattatttaagatcacttgcaatactgagtaaattatttcaagataaatggaaccaacgggaagtttatctagaaagaaagatgatttcattaagattggtatttccttaattattttctgcccaatggtgatgtaattaagggaagaaatctaagtattgtcaatcactattttaaatattctctgtaattttggccttaatggtgatatgacttagaattttatttatgccattagtgcattaattccttttatcacttctaccttacggtgatgttatcgaggatctaatctgtcagtaagcttaattcctttaccatttctgcccaacggtgatatggctaagaattttaattttaattctatggcatcactaagggcatcattcctatatcatttctaccttacgtgatttgatttaggattttaaattattaacttcatcatttttgcccaatggtgatgtgatttaagacattaatgtttattccctaaatcatttctgcccaacggtgacttgattttgaattacaagtaatttcatttattgattccttcattttgtctctgcccaatggtgatacaaagcgaaataaagattaagttattattgtgcaagttaatgtactattgcacgtaatttgcccaagcaaccacaataatagtgccacttaatatttcagcaataaataatgttgtttatcagttaaagtctatggaattattattattattcctcattgacttaactgagcctaaggcctatttgagtatgacttagcattaaaaaaggattccttgtgtctcccgcagctaatgtcactaatttttcctaaactctagaggcatctttagcctgggagaaggccaatataatgttatgtttcgcatgtcactcataaatattaagattatcatccctgttagtgttaggggagaattttgagcatgacattgcgaaactgtatctagcaaatgttgagatgaactttagaagtttgtcaagactaatgcttagtacaaatttagtgcctatgcacatttgccgccataattggcgtgcaaacttagtgggatggacatcgcacatttcatatgcgccacttgtccatttcatatgattcttctcccattagactacggtcattttcggagttgtaatactaagacaaaatggaccataattgacttggttcatcactcttcaaatcaataagaaatattgaagactaagagacaaactaagtaagatcttgttaatcttgtcatttgatggcaaagatgaagcttcactaagggggagtgttgcaacttccaaatttaatgataataaagctcatattcctcgcaaggggaaatcaaattgcctctatgtcctatgtatgctactcttgaaattttcttgtgtaagttctttgcaaaaaatagggacatgcttaatgtcctgaattaagaaagtagttaataagaagattaatggcattattttgggttgaactattatgagacgttgtcaaaattatggccttaatattcggccacatttcaaggggagaatggacgtctcattgagatcgagacacttcacccttagaaatttctgacatctattattacttagatgataaatcaccaagtaaaattaagtgattcaagtttatgaaaaataagatattatgcttccattaaataaataatacaatctgtgggagctcatcaagagctctaataagagaagattattctaccttatttatgactcatagctccattatgtggacgctagaattttgtatctcttaatttgtgacttgcacaattaaatatatataacataactttagggttttgttatggaaagacaagtcacgcatagggtgcagacctaagaaatccatttgtggacttaatcaaacattgatgatgttttaaattctgttccgtcattagtgaactaagcttaaataagaatgaggagaataattattctataatgatgaaagcaagacgtcattgaaattgtgtcattatctcttatgtcacatacctaggggagtttggaacgtctcatgagatatagatattctttcccttagattttaatggcgttgtttagctttaagtgaaaatttcacgaagttaagatattagccaacaaatgattttttatggctatgtttacccataagcgacctccgatttcctttaagaaatttaagacactaatgctaaaatcaaatgaagttatgagatcggattatggtggtaaacactaaataaagcttgttcaccttataagacattaaaaataagcgttcatccaaatagttttcgaatcatgtaagaataaattgagatggatgaacaaaataagacattaaagtgttcatataaatggttttcgaaccatataagaataattgagattgatgaacaaaataaagaatttagtagaagtttctgaatgagtcaaaatattgggccatttaagtgggttaataaaattaagcctgactctgatggaaatttcaaacaattcaagtgaggtggacaggtgcatgaaaattaaaggtgggaatttcattcaccggtactccattctaatgacattttattgtcaagccatgcatattgctcttagaacctaaggaatttttttccatgaattattttggtccgaaggagtactgggtttatatcagtaagtcatacactgacataaagaaataatttgagagaattcaattaaagttagtcaagctgacattaagttacaaagataatcatttatgattcagctgacagaagcttgagattagctcaaatctggatgcatacagatttggcatacttttttttactgggaatcttggcagtatttaattaaatccagactaaaccactggtattaataatgttttccattatttgcaagacaatcttaagtaacatgctcttttttcctaaagtccattgatctcagaagtttagagatatttggacacttattttatgagatgtgtggatatttatgaagattattcagattaagctatgttcacacataggggagcaataaccatgtaaaagctccaaaaataatctcttactgcatagtcgacgatgaagttagattttaaagcgtgttatgattaatcatatttcccaaaactaagagtagtgaatagcgctcataaaccactcaaaagatgttaaccacccaaaatatactgttataagttgtgcactaattaaacacaagtttctattctagtagcaacatgttgtgtgttttctgcctaacacattgatatggttgtgaaagacatgtcccatgatcgaattattaagctaagcatttgctaatggatccatattctaaaggctcataaattaagattaattaagattatgttttggccagtacatatgtaaattagagccttactaagatcctggatgagggggacttaatttttcaatcaacactcactaagttaagcttgagtttatttgagtattatagtgagctataggtcttgttgtctcagtgacgcataatgttgttgaagacacattgccttgggagctattttatttaatagactcataagtaagtctcgaaatcaaggggagaatgttagctgattttgtcgacttgagtcgataaggattaggagaagaactaaaccaccggtttccttatcctaacaagaaacaaactaagagataaattcttttttttgtgtgatcggcacagaaaacagaatcctaaactaattgagataacccccgagccccaccagtgtcgcttatgtaaagaaagagaaggagggaggctaggtgacaatatgatttctctctaacctcaaaccctaaaattaatggcctgatcgtttagacactggaaggggttcatcaggttttctctgtgcttcctttccatcaacagagaagaagaaaaaacagaagaattggcaaagcttatggcttcagttcatccggtcagtaatcatctcaattccacacttagaatttgtgaccatgtgttaagctaagcaaattagatcctgagaattaaatctaacaagatgatgacacctcccacctcctggttgagttagcactcccatctaatagggtgtaggattggctgctccctggttgctaatctagcttacgcatatttcaataaagctggtggtagtaaagttagaggtgcaacgttcacgtggaagaaagggggaggggggcaacatgtgcaacaataacactaagtccaatggggttgtgttttggtattggttaggatgttgaccttgttcacttgtgcttcttagggatgctagatttgtccaatccccggaaggggggggggtgtagatggtctaatgtcaatggcattgtgtagggagtatgctttgctttgagcttattaattagtcatgtggctgttgctcagagtatttaggttgtttttttccctgttgttgtttcggttttcactaattaaattagcattgtttagttcggcctcattctatctttaaaactagtatatgcccgtgctaacgctacgatctttaatattttttaataaatgactaaaattttgtgttagtaaaaataatcagtttaatgggagctttaattcaaattatgccatatatttaaggcaaattacaaagtaggtacttcacattgttcgtctgaaataccaccaaaatacacactatttctctccaatagcaatttactttggtaggtgttccctgcacctgtaagtcatataataacttgtcaccatgagctgaatcagaggaacgtaaaatatcccttatcctaaagttggcatcaatatagaatataatgctatacctcactttatacatggcaatgtctccaatcatggccagctgcaataaaattagatattaaaccctagccaatgcatattagccattcttcctaaaaaatatatggcaaggtgtcctaccatggcctcttcatttctctacaacagacatttttctaggtataaaataaagcaccttctaacattattggtaccattctgaaaacaatggaactaatgaaaaatcatgctccaattgagaaattaaggcagaaacttgatctttaatcatctcatcacagcacacggaggaaagtacttcacgaaaaaaaaagagaaactttcgcctccgcttctgcctcagacccttaggctgtgttcctagcccaggtttcccaactcatcttcctcactttccacacgtacgcttttcaaacggctaaacggtgtgtttttttgtaaaaagtttctatatgaaagttgtttaaaaaatcatattaatacatttttgaaaaaaaaattagctaatacttaattaatcacttgttaatggaccgttttatttttcgtgcacactgttccagttgggaacaggctccagcgaacagacgaacatagccttagtcttgcggcgatcaatctcgtggacccgatgccatgccccattgttggcggttgttaaatgacaatcccataccgccaacatcttcataaagtctagataataaaacatccaacatagtaataggtgcttaatcttacatattccacaagtgttggtgtatatttgtatgcagatgataaaccctgaagttgggaggaaaatcagactaaagtgaggagaattatgtatccatacaagtagggttgtgaacttcatcgaaacatcagtaaatcaaccgaaaactccgagaaatgaatagaggaaggtcccgagagtccaccgaccgaaggccaggccaggagggcccagcccaggtttgaccgaaccctctggttcggccgaaccccccgatcaccgttcatcctggggtttggcgtggatgctccagatgttctcccaatgacggttgcggtgcagttcggacatttccccttctcacaaccgtcataactgccctataaaaggacctcacttcattcactctcacacacacttccaagcttgagctgaattataagaggctctattgtactatattgtacactagaataggaagagagtagagtagaagaagtcggaagaattccggagttgtcggtaatcttctcctatttcttttattctatttattactctgaattcaatataatattcttcttgaataatttagatttatcttgtgagaattatctcttggttagttcctaaatagcatacgggattattgttcactataatcaactaaaatatagtgattgctttgatgagttataaacactaaagtagatattaattgcttagacgtggtatttaagtaattgttatccagtaattgctgcgtatcccacggtacgtttgaggtaggtgtagaggtggtgacagcccttgagatcacttaagtcctccctttccgggtacgtactagagcgacatctgggaacagcgggttgccagtgcctgaagtattgcattaggattaaagttaagctttccctagatactgtctctcactagtaaatcctctctatcctggcctatcatttactttgtgtccttggatgaaccggaggaagatctgaccatacacgttcatttggattcgatacccttggaatactccgtaggggaagtgctacctcggtatatccgtgcggttgcagattttatctgtacccgtattaaataccaacaagcattcctagtgccgttgccggggaacggttgctgatcatttccgaacccagttcatccttgtatcctttttacttttttagtctaccttcacccctgctatcctagagaagtattcctgtcaaactcttctcgaccatggagcaacctcgttttgagatgtctgctcctcggggcgaattctatgagccacctccttcatcgaagcccatttatacaactggcta

SEQ ID NO: 7209 - DNA, 1797 bp, Oryza sativa
tttagtacaatccggaccaaccctgtccttacccgagtatgtgcttctgcaatatttccatacgggtttggataaggaatctgcattctatctggacataaccgttggagggtcgttcatgcacaaaacgccgtcagaaggaagaacaattttggatcgcatcctagaaaatacttccttcatgacgcagcccaatgaaccccagccgaaggcatccctgtccaagatagtggaacctctaacgatcgagccactcactgaaccatccacttctgctagctcgattgatgaaaaggttcctgagcagccgtttgtcgagaatgaagaaattcaggttccggattgtgccacaattatgttcagggacggttttgacaaagactacggcaataccctgaactattttagcaaaaggaaaccacccgttcctttgtcacctcccaatcctatggaactcgggttcctacgagaaactgtccgggagttaacatccataatgagcgatgaatggctaagggaggtagagctttcatccgaagtaattcggataaatgcgctccccgaatcattccttgccatctggaagggaacgatgtcggtattctctatagtccaactgtcggggccaacctcgtctctgagtcttttgcattcgcttatttaagcgataaggcagtgaccccgataaacaaattcttcaaacatccgaacggaaatatcatttaaggatttgagattgtacaagatgtacttgtctactttgaagaaagggaggcaatcttggatttccacgtctttgaaatccaagattttgacatcctaatcaggctacccattgagcaacttcttatcaacacacctcatttaggtagcctcaaaataacactgggagagaatgaattctcaattccattttcacgggcaaggatcaccttgaccgaccctctcccagaaattgagttagtggaagaggttaccgcagttcctcctcatgagtctcccgaggcccttctggaagatgaggtccccgatttcatcaaggaagaagcagatcccggtgagactctcgacctgccaatcatggaaccgccacctcaacctccgcttgagcttaaacctctacctctaggcctacgatatgctttcctacacaatgacagagaggcccctgttataataagtgacaagctctctaaagacgagactcaacgtcttcctaccgtattggaaaagcatcgttctgtacttggctactcacttcaagatcttagggggattaatctcgcgctttgcacccatcgtattcctattgaccccaagagtactccctccagggaacctcaacgacggctcaataatgaaatgcaagaggttgtaaagaaagaggtcttgaaactcctgcatgccgggatcaatttatcccgtaccatatagtgagtgggttagcctagtccagttgtgccgaagaagggaggaatgacagtcgttgcaaatgctcaaaacgaacttattccgcaacgaaccgtaaccggatggaggatgtgcatcgattacagaaaacttaacaaggctacaaaaaaggatcatttcccgctacccttcattgatgaaatgttggaacagctggcaaatcattcgtttttctgtttccttgatgggtattacgggtatcattaaattcctatccatctggaggaccagagtaagactacgttcacatgtccgtatggcacctatgcataccgtaggatgtccttcggactgtgtaatgctcctacatctttccaaagatgtatg

SEQ ID NO: 7210 - DNA, 1047 bp, Oryza sativa
gaatactagcatttggttccactaacggttgctctactttagcatgaaaagtggacaaatttacttcgttaacaacgcactcaccttgattaatttcagtaccatttactttacctttgatgtcctcttctgatgatcgaggtgtctcgaacttgagtgtgaacaatggaattggtggctctttcatgtctctctcctccttttcgtgattacgcacttcctgcaaatggttagtaattggaggcaaagacatagcgtgtttctttttcatatcctcctctattttactttcagcattgcaagcaagttgtaacaaatgagaaagagatctatatttttcacaagcaagcatgtcctgaatttctttgttaagtccacgtaaaaacctcaattctgtagcttcttcgtattcatctaagccacagtgtaataaacaagcatgcatatcatgatagtatgaagtaataattttggtatcttgttttaaacattgcagtttgttgagcagaatatcagtataatacatgggaacataaacatctctgaaatatcgtttcaagtctttccaagattgtggcatttttttatgcctacaaagatgtttccaatcattagaatcatgtttaattaaaacactagaggcacacataaccttttgtttctcagacaagacatgctttataaattctctatcaaccgctagctcccaattaatgtaagcatgaggatcataatttccctcgaaataaggtagtgcagatttgatattacatagaacattgtcacttaccttataatcgtcatgttgatcactcctcatgtctcgacgaaaatatcgatgttgagcacaactatccccaattatcctgcgtatccctgtcattggtagtagaaaagaagaaaacatacacaaaaatatgccgcgttctattaaatactaggtagtggcagctcaaaaatcacacacacctaagcttttaaccaagctcttacaagatcttacaatgcaagcggaatggggacatacaccgactcaaccaagcaccc

SEQ ID NO: 7211 - DNA, 1821 bp, Oryza sativa
gcggtcttaggccaaaccaaggataaaaagcatcatgcaatctgttacgctagcaaaactctaaccggagctcagttgaattatgcaactactgaaaaagagctgctcacgggtgtttttgctatcgataagtttagatcttacttagtgggagccaaggtgataatttatactgatcatgccgctttgaaatacctgctcactaagaaagatgctaaaccacgcctcttaagatggattttgttgctccaagaatttgacatagaaattaaagataaaaagggagtagaaaattatgtagcagatcatttgtccagattgcacatcactaacatgcaggaacaaccgataaatgatctcttgagagatgacatgctgatgacggttcgcgactccaacacgtgatatgctaacatagtaaactacatggtatccaagtgcataccaccaggggaaaatcaacgaaaactgaagtatgaaagtcaccgtcatatatgggatgagccctacctatatcgggtatgctccgatggcttactacgaagatgtgtgccaactgatgaaggacttaagattatagaacgatgccacgcctcaccctatggaggccattacggtgcattccgcacccaggccaaaatctggcaaagtggtttcttctggccgacaatgtacgaagactcaaaagaattcatcagaagatgcacaagctgccagaggcaaggaggaatcactgctcgcgatgcaatgccccttacatacaatttgcaagttgagatattcgatgtttggggtatagacttcatgggacctttccctaagtctcgtaactgcgagtacattctggtggcagtcgactatgtctccaagtgggttgaggctatgccgtgcagcgccgcggatgcgaggcacgccaagaagatgttcacagaaaccatcttcccaagatttggtacccgcagaatggtcataagcgaccgaggttttcacttcattgacaaaaccttcagagacctcctacgagaaatggaagccaaacacaacgtggccactccttaccatccacagaccagtggtcaagcagaaacatcgaacaaacaaatcaagaatattctgcaaaagacggtcaacaaaatgggaacagaatggaaggatagattgcaggacgcactgtgggcataccggacagcatacaagacacccattggaatgtccccatatcagatagtctatgggaagtcatgtcgactacccgtagaacttgagcatagagcatattgggccatcaggaattcgaacatggattttgagggagcaggagaatggagaaaaatgcagattgcagaacttgaggaatggagagaaatggcttaccacaacgcaaagatatataaagaaaggacgaagcgctggcatgacatgtcataggctctccagaccttccattatatttgagagatgaagtgaataattcaagtcatcaaacaagcataatgaaacatccgacgcctcgagagaggaatattggagacattgctgggcccttagcctgccagtcaacttcagcctgagatgtgcccgtcaaaccactcgaaggcggcgatcagatgtgttacacattcaggagacttgacaaaaatggctaaagatctgcaacctcccaaatattcctaactcatactcatgtgaatctagttcccaggatgtgcactagattcacactttcatcttaagcatgattatacatagcaaacacaactaagatgaaagaaacttaagacttacaacaacttaataattacataggccaaccggccaaat

SEQ ID NO: 7212 - DNA, 8747 bp, Oryza sativa
ccatctaagcaaccaatctagagggttaagcacagcaattctattcttatacccaactacacattttaggccataccggttgaatttttgaaatatcgggagaggaaagtacaaaatcccaccaaattcatttttggttcaaagataacatagggagatggaattccaatattgtctagcaagttttaagttttatcgactcattttcaaaacccatttactaggggctatgtttaacccgatattttagaaatccgtgctaatacataggagtagtttgcaaatggatttcaaaacttttcaaaacactatgttactgttttgctgtgattattaagtgatttcaaataaaattcaacaaaaatagtatttccaaaatgtttcggtcctatagagcaagataagagttttaaaatcaaaacatgagacataaagtaaaataatctctaaagaaggatgagatataagattgaacatgatttttgcaaataatttgtaactgagagcatagcactcaaaataatttttaagaagcaattctaagtgacaacttaaggggctcctgtagtcggtatttgctctgataccatgctgtcataggctctccagaccttccattatatttgagagatgaagtgaataattcaagtcatcaaacaagcataatgaaacatccgacgcctcgagagaggaatattggagacattgctgggcccttagcctgccagtcaacttcagcctgagatgtgcccgtcaaaccactcgaaggcggcgaccagatgtgttacacattcaggagacttgacaaaaatggctaaagatctgcaacctcccaaatattcctaactcatactcatgtgaatctagttcccaggatgtgcactagattcacactttcatcttaagcatgattatacatagcaaacacaactaagatgaaagaaacttaagacttacaacaacttaataattacataggccaaccggccaaatagacttattagagaacagcggaagcttgactacccaaacacaagcacaccgactaggggtataccccattaagttctcatcctagaagaagcaatcggaacccgcatcactcaaagactaagactaaacctgcaaacaaaaggttatatcaacagcaagagtcagtacattaaacaagttaatgtactggcaagcacaagtcaatcctaccatactacatgtaaggcatatattcaaaggaaggcaatatgtagttcattttcagcataaagcaagttttgtttcgcaattcttttgtaaaggagttgatgcttcaattaacaaagacaagttttaagtttcattattagcttcttcataattccgtcataaacaatctcttattgccatacttaataataagtcataatgtatcaccacatacacaactcaacacatttatcaatttcaaaccaatgtcacatgattacatttttaaaacatagtctatactcatgacacatcaccaaagcactcatgaccgtgagcacggctaatcaattagtttaaagaactctgcagagtttgtacagctttacccacatgatatgaactctctagtttgttttgagtttgcaagactccatcacactcttcatgttgaatgtgatctagaggtcataacgaagcctttacactacttagaatctagccttgcaccagcacgatacgtgttcctccatcctaggcatacttggaaatatgtctagaaccgttaagtggcgggcccacgccttaaacttaacgccgtggtggcggacacaacgggaacccacccacgtggcacaataccgttgtattggacagacttagtcacctaaactaccacgtcggggcaaataggaagttcctctgaatcatcgactaattcctcagaattatcgactaactcatacacaccggcctaccagaatgcaaggctagtcctaaatagattaatcagcttaggccatcccatactagcacatgtggatgtacgaataactttaaatgggtgacacaagttcggtccttatggacttgggcaaacactccccctatcggtatgcaactaacactatatgcacaccacttgctgcccaagtgtaaaatcacattttacacattttagttcgcaaatactcatcatattcattttattccagcaaaggttcaagtatcaaaccacattttaattatagatggaatgagcatttgcatatttctaagcatggctaagcaagtagttgcacatagagcatatataaacccatttgagcacaaagagtgtactctaaccatttctaggggttcaaacagcaagaggatcaattattcaaggtggaatatgtagcaaataggtcataactaccttaacccaatttcaaataccgatatagtctaagttcacatgcaactttgtaaacaaatattttcattcctcaaatcatgggattcaatgtgttcaaaggatgggaggagaaaactttccttgatcagagaattgttagcacctaatccacttcttcaccgattacgcaattatctagataaaggacacgatatgcaattaaacaccgaaagagttgaaaatccaaaatgctctaaaatgcatgatttatgcacagtgggttggtactgatctaaaataaatttaggtgaaagaatttttattttatctttatcttattccattagggagttatgaatttttagaagttttatcggtttatagtagtatagtcttaggtagtgttatggaatacttttgtaaagtgatttttactagattagacttcacaggggtgtggagatgtgttttctaagactaacacatttggtttcacaatttttggatttataatgaattctttatgcattttacaagttacaacgtgttttaggcatatagtgttttatatatgtatgactcctgagttataggttcagaacatgctacttcatgtttaagttgaataaaaggaataatttggttaactaaaacatttttatctcacatgtttatggtctttactactatggttcatattttataaagtagagacgctttaatctaaactagcaatatattatattaacctagaaattgttatatgagccaagttcttctaagtttagtggatgaggatggaactatggcttcactggtcaatcaagtttttatttaggtttaattagacctaaagtgtatatatatacttatacatgtttatgtattacttaaacaacactatgtgtttaaattcttatttcactaagttaaggttttgatcaatgttctctacagaaggtgccaaattttattttactatgttgaagataactatttgctggttctatagaaactttgttcatttcatttggactaaaaatgaattttctacaagttttacaaattaatggctgctctatgttagtaaatccttatatgaatatttagagacttttactacacagcaagtatataatattatttcataacttggaaatacatgtgttagtgatcctacataacttaagtttattcaaattgaagctaaattgggttctacatgaatttctaaagtttagcttatctaaaactagtcattttaaagataatagttttagaggcttttgatgcaaagtaagtcattacttttattttacctaatcagagagtgtctgatgatgaatctgaagtttttgagtttgtttcaaaatgagttgaaatgaattttctttgtattttataagtttgtacatgttttatgcatgacttatcttagataaatcttagagacattatttgtacagtgagtgtcaagttttatattcctggaataaagttcataacttcaagaatctacagaaactggaatcacttcaaaatgagctatatttgattttatatagattttacaacttgtgcatttttctgctaaacatataattgtttgggcattttcctaatttttcttcagattttaaaggatgggtccacatggctgtgagggaccaatatgcacaaaggcccttgagttttctaggaatcaacccgcagtcctaggcccatatgtcagtgtgtttctataattgtaaacggatccctgcacttaatctaattcacggaagtcatccctctgctctagacatagcagagctagccatggctgagctcgatctggagctcgccggcggcaaacggtggctcgcttgaggttgaggtcaaaagataaaatgaagagcaagctctcgcgattccattcctctagttttcttggttagaggacatcggagtagcgccgatggcgagtgtgagcggcggtggttttggggtgaaagtgcatgtgcgcatggaagtcgattacgaacgaaaaggatgcatgcatgtggtcttctagacttcaggatgctcaccgtgggtcgagctagggttgtcgaggtcttggcggcagcggtgacttgtggaacggctcggcgacggcgctcctcctcgggtgaacgacgacggctcgaacgggacaatgagctgcttcaagcaagcatgcacgagggttgtgaggtcaaggagatggtgtatgcgcaaggaatcgaacaatggctcaccgaggcagcggtaatcgacgatgacggcggaggcgatcctagattggcgccggtgaagaaaaggatgtgttctccgtgttcttgatgtttccggctggggttcttgaggcgttttgaagaggaggttgaggcaatgacaatggcgcagcagctttctctgaggtgaatgagaatggccggacgacgatgatggttgaagcggcggcgctccggtgcgtgctccagggcgttgtcgacgtggcttgcgttcccggcgatgcactgcacgagaggggtttaggtcaaaagaggaaatgctcggcattgtgtggagagatgggaacgcgaaagagatggaggtgaccttgactcaaacggagatggcgaaggtcgtcgtcactacgaccggcggcgaggttgaggatgacggagaggcagagaacctctccctcggcttcttcagctccaaagtgatgtgtggagaatggcgacgcgtctgggaggagtagagagcgagaaaagggaaaccgagatcgacgacacgttgcggccacgcgtcggctcgctcaatctctccctctctcggctggaacagtggaggaagtgatggacagagtcaaggcaagcttaagaggctgtcaggtgggtccaggtcgtggcaaactaggctagggtgagagggttgggtaagattctgggtaaacttgatttttagattaattttcggaattattttctcctctaactttgaaactacataattcaatgtgtggaccaaattaattagtgttgattttactggaggtaaatgattacacctagattccattttctttggttgcactcaaaaataatgggtggactgctcacagaaattaaacaaagatgggctattagaaagctagattgaatttttaggaggcttaaacagagaagaaaaattctagaaaaattacatttattcatgataactaatctagtatttgaataaattattttccatgttcacttatgtgcagttaaatgtacttttggatgaaatatggttttagccgattaaaatttaatttgatttcttttagttgtctgtttcgaccgattaatttgagatatcaacttgagtgttaacacgttaccaaattacggaggataagtttgtgctaatcattgtccacataaatttttccatgattttatcttgcacaaaatattttagagaattaagatgacctttgtttgtatatgtgttcccacttcataattgcatctaatattattatagggattacattaaacttcttttagactgagaagatgatatttgagtttaatattaagtccacatgttatcactcaagattaactataggtttgtttagtgaaataattcttttagattatgctcatgggagctattatggaatacaagtccaaaactccaaatgcacaaagaactcgagcctaggcatgcattatgtacatgtatgcttggtgacatttctagtctaatgttgggaatgaaaagattttattttgttctcaaattttaatcatgcaatggtttaagttgatcatcacctaaattaaaacggaaatttttggctctcgaaatttggagaagttaacctctaactattttgacaagaaattttaagtcctaaaatttcgggtatgttacagtctatcccccttaaaataaatctcgtccccgagatttgggtagggttggcttaagttatgactatctccagaggattgacattgacagcagataataatttcttttaagttgtatgacagacttgctaccataaaacatttggaaacttttatttcgcgggtgagtggcaagttctactcagttgtgggtttatggaagcttagatagttagttaaattgacactagagaagttagttccaacaagataaatgttggttcatattaacaggagcttataaccagatttctaacttagatgaacttatgtttacagattttccaaagttctggacagcaagcacagaggtttctaaattaaggacaaacgagttcttagttactattacatccatccaacaagttcttacataaatggagtacatggcagccatattacatatattacataccacgattttcttccaaaatgggccaccacatacctagactattccttaagcttgtccttaagtcatactaccgtggcagtagaggttagataggactattgattaatctctcatcctcagcttgaagactcgaccataccattgaacatactctggcggtccatacggtccagtggttccaagtggaggataagcagtcctaacatcgacgcgcgaaggtgggcttctttcaatatacattccaacaggtggtggtatatcttctgctggtgcaagcatggcatcctcaccaaacatgaactccggtgtataatgtccctggcgataccttggcataatgattctttctaaactggctaccctggtgcggacgcgttgcagctcagcaaaggttgagcgataaagcatatctagtgagcgcacaaagtttgcaagttgaaggtatggggtatgtagtcctacacctatttcagctaaccctgggtaggtagtgtgttgagctccctcagttaaggatggaacgtagcagtaaaattcttctatctcaggtagctcatagcgaaggcggatgatagcaacataagcacagttttgcaaagcggacttaatatcccacccataaccagtatattgaaggtctttctctagtggagttctaccccgaatgcttacacgaaccatgactgcggtttgggatgttccaatgggtttcttgaggatatgatactcaggtggataggtgaatcgggcgtactgaagcataagccatagcacatgctgagttgagttccaggtgaacccacggcaatagcagtacggtgtgtacatggtaggcatctataagaataaaatttagaacacggattagccaaaaacctctaaaattaacacttacaaattaaaggttttccttactgttattattaaggtcgacacacatttttttaacaacctatggttatatagacctctaatcattaattctggtcatattaacggtacagggcttactagaatgggatttctattttaggtctaagaagaattatgcaaggttaaaaattttatctttggttttgatacaaatatggcttactatcccccttaaaataaaataatttttttttgcactaggtttttttttttttaacaaatttcagaaggtaggagctaatctgacatgagtgctaggtgctggaattcatcactttactgtcttaatcaaatttttaggtctagctctaaagatacaaaaattttgacaaaaatcagagagatagatgggttagattaggagctaccctgaaggaatcatgactttatcatttgtagtttaggctacacaaatttgtgaaactgacaacctacagatttcaggacagaactatacagaattatatgaatttttatgccatgatgcaatgactcaaaaattcaaccaaaattcgtggagcctacaggttatgtatgaaaactactgtaaaaagatgcatatttaatcaattatggtttgggctacatgaaaaaaaatgaatgcagctactacaaatttccacaatatgattatgctaactatctagattgtttcactatgatgcacgggtctaaaaattatgccaaaattcatgatgcttactgggttagtctacatgatgcatgtaaaaaattctcaggtttatcacctacggtttagtctagacaaaaataacaagcagactgactcaagattccagaaaaaaaaaagaacaaccggcacaaaatgaaactttaatcaagttttaggttgtataaattttatcaccttttagtcgtattatgttagggtggtccagaggctagatgaattttgggtggtccatctaagcaaacaatctagagggttaagcacagcaaattctattctatacccaactacacattttaggccataccggtgaaattttgaaatatcgggagaggaaagtacaaaatcccaccaaattcatttttggttcagagataacatagggagatggaa

SEQ ID NO: 7213 - DNA, 2318 bp, Oryza sativa
ttatgctcatgggagctattatggaatacaagtccaaaactccaaatgcacaaagaactcgagggttaagtttgcttggcctggagcaatttgggatgggtgaccgaccgggaagaatttcccgggtgcacacgagtgaggacaaaatgtgcagaaaagacatgtgttggtctgtgagggcagtctatgacctatgaaagctatcagatgtaagtgggcccggcttgggggaaggcgggacgtgacaaaatggtatcagagccgactctcgcggtttcacgggcgcgtgtatcgcagttgcgcaggcatggtgcgcatggctggtgtagacctggagtggttacacagcatggcacatgcgctgtcattggacacatgggcgtggccaagagaggacgttcctggcctagggttgatcgacgggggcgtcgatctctcttaagggggtgagggtgtaacatcccggcctagggcttaataggattaatagaatactcatatcaacaagttgcaacttcttttccggaagccaatctccaaagaactccagggttaagtgtgcttggcctggagcaatttgggatgggtgaccgaccgggaagaatttcccgggtgcacacgagtgaggacaaaatgtgcagaaaagacatgtgttggtctgtgagggcagtctatgacctatgaaagctatcagatgtaagtgggcccggcttgggggaaggcgggacgttacataacaaaaggataaaaatcaagaaattcaagccaggagacaaagtactgatgttcaactccagggttaaactcttcggccacggaaaactgcgcagcaaatgggaaggaccattcgacgtcatcgacacctcttcgcacggggcaatcacactccgcgatgacttcggtaacatatttaaggtaaacggtcaacgcttaaagactttccttgagccaaatgaaactttagatgaagaagtggatgttgttaaattagttgattatgaaccatgatgatctcatctattgcatgcttaaaacccggtaagttgtcatttttgtgcttagtttaggacttattaggcctaggaaaaaaatggagctcaatcggacccaccaaggtgctggttcggccgagccagggaggcgcccgatcagccccatttttgaacttcgctctcccccgctcgttcctagtttgtttagatgcgcatttggaggtagaacgctcggatctcgctagaacacttcttcttcctctttctctccacctttgcatactctcctctccaatccaacccaattcctcgaattcccactcatacccaccaatggctggcaaatccttgattacattcatcggctcttcatccaattccacgtacgacctcaccggagaggcgacaccggcaaatcaattgatcccggtggaagaatacacgatggaaggggtaaacgctgtatgggctcaaccccttgcagctgtgccaggctcccctgcaattttggagccgatcgacgagctccctggttcggccgaacccttctcagccccgttcggcagcgtgatccctctcccctcgccatgtcacaaggacaaaaatctggggggattcacctacgcgacggccgacaacgggagaactcggcttgttgaaggcacgacggcttttccaagatgacgggaaggccgcgccacctctcgccgagcgctatgtgggcacccttgttaccaaggaaggagatgagatgctccacatgtataccacacccaccgctactccgtctactccgaaggaggagcgattccgcatccaaggagtgagaactcccggcagtgggtatggtaagagtttactacggcctttgatggcatcggaaaaggagggggcagcagaatcccgtagccctccacctatgaaggtgaagcgtcatttgaagccccctccaattgtgagggctcccagccaattccaagaagaggaggtgaaatcgccggagccctcgatccataagctcgccgcacaagtgaagaaactccgcaaggagaacatagagcttaaggatcgcaacgcggagctaggggtagagcttgctgacattagaaataatttcgatacccttagtcgcggtttgtgcgctaaaatcaagcgtgcattcatagagatagggaaggaaaataagtattatgctaattagatgtttcctttcccatgaataaaatagtagtaggtgcttggttctatctttccaatcatgtaagtacttgctatgaataatgtggctcattggtgttaaccccaatgtttgccaaagtttgtttt

SEQ ID NO: 7214 - DNA, 1121 bp, Oryza sativa
  unsure (1)..(1121): unsure at all n locations
tgttctggatatgtgagatcattgcaaatgtgaatctcttccagcggagcttgctcttccggcactcgtaaacatttctttagctgagacacatggaagactgggtgcacatccgcgatattttctggtaactgtaactgatatgcaacttctcctcgcttggcgatgatctgaaatggtcccacatatcttggtgccagttttcctttgaccttaaacctttttgttcccctcatcggagaaacctttagataaacgtaatctccctccttaaattccaggtttcttcttcgggtgtcggcgtaactcttttgtcgtgattgtgctacttttagacggtcacggatcaagcaaaccttttcttcggcttcttgaataatgtcaggtccaaataccgctcgttctccagtctcggaccacattagcggggtatgacatcgtcgaccaaacaatgcctcattgggtgacatttttaggcttgcttgaaagctgttgttgtaggagaattcagcgtagggcaaacatctctcccagtccttgctaaaatccagagcacaagccctcagcatgtcctccaggacctggttggttctctccgtctggccatctgtctggggatgataagctgtgctaaatgcgaggtaacttcctagggcttcatggactttctcccaaaaatgtgaggtaaactgtgtgccccgatcagatataattttcttaggtacaccatgaagacatactatcctggtcatgtataactcggctagcttagcactgctataatttgtcttaacgggaatgaatctcgccgtcnnnnnnnnnnnnnnnnnnnnnnnnnaaatggaatcatatcctgttgcgggtttgggcaatccaacaataaaatccatacctatctcatcccatttccattcgggaatcctaaggggttgcagcaagcctgccggtcgctgatgctcagccttcactttttggcacacgtcacagagtgctacgtattccgccacatctctcttcatgttgggccaccagtatccttccttcagatcttggtacatcttcgtacttccggggtgcaatgaatatgccgattcgtgagcttcctttaaaattaatcccct

SEQ ID NO: 7215 - DNA, 6082 bp, Oryza sativa
  unsure (1)..(6082): unsure at all n locations
nnnnnnnnnnnnnnnnnnnnnnnnnnnnnnnnnnnnnnnnnnnnnnnnnnnnnnncataatttgtcttaacgggaatgaatctcgccgtcnnnnnnnnnnnnnnnnnnnnnnnnnaaatggaatcatatcctgttgcggttttgggcaatccaacaataaaatccatacctatctcatcccatttccattcgggaatcctaaggggttgcagcaagcctgccggtcgctgatgctcagccttcactttttggcacacgtcacagagtgctacgtattccgccacatctctcttcatgttgggccaccagtatccttccttcagatcttggtacatcttcgtacttccggggtgcaatgaatatgccgattcgtgagcttcctttaaaattaatcccctcagtccaccctgttcgggtacgtaaattctctttttataccatagaacatctttttcgtcggttgaaaattcctttgcacgtcctgcagctaagcgttccttcacctctcggacttcctcgttgtccttctgggcttcttctatttgggttctcaaaagaggttgaatgtctagggtgtttatccgtccacgacgtactatatgtaggttcagctgagctatttccctcctaagctcagggaccaatccttccattctcacatgattgcaatggctcttacgactcagagcgtcggccaccacgtttgctttgcctgggtgatagtgaacctctaaatcatagtccttgattaattctaaccatcgcctttgcctcaagttgagatctgactgggtgaagatatactttagactcttgtggtcagtgtagatatcgcaatggtttccaattagataatgtctccaaatctttagcgcatgaaccacagctgcgagttctaggtcatgggtagggtagttttcctcatgtggtcgcaattgtcgtgacgcataggccacaactttcccgtcctgcatcaatactcctcctagtccttgccttgaagcatcacaatatataacaaagtcttttttgatgtcgggaagaactaaaataggtgccgaggtcagcttttctttgagctgctcaaagctttcctgacactgttctgaccacacaaacttcttttccttcttgagtagttgtgtcattggtcgggctatcttagagaacccttcaatgaaccgtcggtagtatccagccaagcctagaaaactctgaatttcagtcacatatttgggtgctttccattccgtgacagcctccactttagcagaatccactgctactccaccggccgagattacgtggcctagaaaagcgacttcttttaaccagaactcacacttgctgaattttgcatataacttatgcttccgaagtttctcgagtaccaatcgcaagtgttccgcatgttcttcctcatctttagagtagattagaatatcatcgatgaataccaccacaaatttgtccaagtagtccatgaacactttgttcataagattcataaagtatgccggagcgttggttaaaccaaacgacattacggtgaactcatataatccatagcgtgttgagaacgcggttttgggtatgtccccggttctaattttcaattggtggtatcctgaccgaaggttaatcttagagaacaccttagctcctttgagttgatcaaaaagatcatcaatccatggtagtggatacttgtttttaatagttactttgttcagtgatcggtagtctacacacattctcatgctaccgtctttctttttaacaaataacactggggctccccaaggtgatgaactggggcgtacaaatcccttctcttgcaactccctgatttgctttttaagttcttctaactcattgaccggcatccgatatggtctcttggatatgggggcagttccgggtatcaggtcaataatgaactctatgtcacgatctggtggcattccaggtaaatcttctgggaacacatcaggaaatcgctgcactacgggcattccctttaggggtagcatggtaaatatacctccggcacgttcggttagcctaggatcttgatccatggttgctctcatatccgatccccagggtgtggtcagggtaacttctctatgtctacagtcaattattcctctatgctttgctaaccaatccatacccaaaatgacattaagagtttggggtattagcaccataagattggagggaaataccacatccctaaggcggatgggtacgtcaatgcaagctatatccactgctatctcacccccaggtgaatgtactaacattggttgtcttagtttaactctggttaaattgtgttgttgactggctttcaaagatataaatgaatgcgatgctcttgaatcgaaaagaactttaactggagtgaagttgagtgaaaatatacccatcagtacgccttggtcttcctgggcctcttcagctcgaacgtggttcacttgcccgcgtccaaatccggtagcggtcctgttagtctgcggagtcctgaatagacctcgtccagcagcaggggtagcagtcccgtgaatagccgttgcattagctccggtgcgaatgggtgtcttgtttggatgaggacatttattggcgaaatgcccgtactctccacagttgaaatagcttcctggccttactgatccagtggcggcctgattcggtgcaggagcgcggttctgaatggtaaccggcctgtggaaattgctggaggcggcaggtcgactggttgtcaccactgttggtctccatgccgaggaggttgtccctttaggacgctggggtgcggtctgaggcgagcggttcatggcaagcctccttttacgattgtgctccacgaccttccggtcgttctccagcctaacgaccttattgattaaactctggaaactatcgtggtcttgtccaatcatgggcccgcgtaatttatcattcaagccttcaatgaatttgtcgatcttttcctcctcgtcggcaagatctctagtcgcgtagcgcgccagctgagtgaaacggttcaggtactcttgtactgtggtattcccttgctgtagtctcctgaactcattcttcttcatccgcatcaccgcagcaggcacgaagttgtcacggaaggctgtggtaaattcctcccagtttggttctccggcatcttcttctcgggcttctttgtacgtgtcccaccagtctccggctggtccttccaattggtttgccgcaaagatcactttatcggcctcacgtactcgaacaagagttagcttcttctcaatgatccttaaccaatcttcagcatccataggttcttcagctgtggcgaatgtgggtggcttggtcctcataaactctccaaagcttgaccctccgcggtcgccttggttgttcgcgatagcttgcagaacttgagtttgggtggccataactccggccagagtggttaagtcgggtgtctaagtttcgtcattgctggttgttgcccgacgtcggcttgccatctgtgtaggttgatggagtaagtatcctaattttctaactagctcctatggctttatcccattaagggagttgtgttgatatgaactttgttttgcaagcatggtggaataaactcatttataacacaacaacaatagatatcataaataacatcatagagtttcacaaatggtacataaatcatgatgcaatcgactgcatacatacgcagtccaaataaggttcatccaaaagatacatcaaactaatcatcaaactactcgtcaatctaggtaagggagggggggtgtctcgcatactatccaaaaatccatctgatacgagatcgaagctgcaaggagtccgtcagtctagtcctccagccatccgcaggatcctggggcaggtagagggtggtcgctggcacgcgcaaacctgagtccccacggctcagaagtagtggcctctggatctggcttgggcctcttgcccggaggtcgtgtgctcttgcgagcagtgatgagggtgcgaggacctccaaggaaggtgatgcggggaacaggggtctcatcctctgaaggatcagtgatgtctggctcgatctctggctcggtgtcggtcccctctgtctcggagtcgacctggatcggagtctccaaactggaacccagctgcggagaaagtgtaaggatcagtggagtgtgcaccatctccgggacaggtggctgtgccgctgtcgggtccactaggtaaggtgctgactcgtagctagcatactagcctctcccagaagagcatggaacgccggtgggtaccgcggggtgaggaaaaagtagcggtcacggcctactgctgtggaagtagaagcccctgtggtgctgatcttggctactcgaagctgctccttcagctggctgacgtgctcctgactctctctcagttgctcctcaagagtatccatcatcccgcggcgatcgttgtactggccagataactgctggaactggtcgccgtggacctggagctgtgccttcagtgagtctatctcactgccccaagcctggtgctcctcctccaactgaagctgctgcactgagaggtcagtcaactcagtctccagctctcccatacgtctctggtggtcgtcaatctccaacagagcctcctcgtagtagtcatctactgcctcagcccatcgtgacaaccgagtcaccatcgggttgtagcagcagggcgtgtcctgaactgtgcaaactgagttgctctcctcccggaacgggtgatgagcaaactaggtactcactaactcagctcggtggatagagctgagtcggaagaaggcctcccgggctgcatcctgcatcgcggtctctggcaggtctcggtggtgacgtgtctgaaagctgtagtccaactcggaagggactcgagggtgaaccttaacccgagccttccaaactgagccacactgtctcactcggtatgacgggaacccagagtatcgcagacgcctcaacatccgatgcagctcgatgacatacccctctgattgaggtaagctcaactcccaggtagcgggtgaatccggatctgccatctaattttaagaaaaacccaaagtcagttgagagtaaaacttgttttgtaaagaaaatagttaagagtaagatgaaaattgtaccgagttttgtaaacatagcgtttttatttttgaaagtattactaaatgggaatttctcccttggccaacttagaaaaggggtggggcgccttttggtcttttcttacagtcgtatggctctgataccagctctgtggacccccgtttttataacaggaatcaattgtgtaaacagtaccatttccctggatcaagtagtctggtacacacgaattcatagctgaaataccaagtgcacatacacgagtgtctaatacgaattattacatcataaccccgcaggcgtagtcttaaatcatcggaccgagcggtccggaatacatccaaaagcagaaatagataaggcagcggaattcaggcagcggcatgccattgccacaggcaacgaccgtactaagacctactgagcgccatcgtcttcatctccctcctggtagtaggcatagggatcctccgaggcttcatctcccgcttctgattaattttatatttgcaagggtgagtaccaaccgtactcagcaagccaccacagcaatgatgcacatgacagaggaattcaaaggatggctatggttcttttgcgcaaagcaagttttgtaattcttttcacaagcctaagacctagcatagactgatcaagttttaataccagtgttcatattaaacaatgacggttctgtccaccatccattgtgatcccaaggatagcttcccgccattgagtcgttatggttttctgaggacgtccacgttccccgcctctcaggaagtggctccatcagcataaaaatcatcatgcaatatcccatcccacacaagttaaagaatttagagtctagccaagtgtaatacatgtcccggtgctcaataaccgcgagcaccgctatt

SEQ ID NO: 7216 - DNA, 5687 bp, Oryza sativa
caccctagaataaacaaaaccccaactagtggacactctactcctggtatcactagtatgattttaggtagatgctacgctgtttaattaggtaacattaggtggttttacaactctagactttgggatattcatatcacctggacactttggaattgttggtttattgtggaattggattcacaccgccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctaggggctcagtcctgcctacctgtcccgggggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtatagctctaggatcgtgtttacaaaatagctttgggcaactaagtgacttttaaatgctgtttactgcaaaacttaacccctatattattatccccttgtacccccttgcattaattatgcatctccggtgtggcttgctgagtactgtggttgtactcattcttgctctatctttctccccccttcagtaagagaagctttggagaagaagtcttaggtggagtcttggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcgttcgggaaaatgcaattttctcggtcgcgacaatttccttgacatacaagtttagaatttaatccgagtcctcttaaagatattctttctatacatggcaccccatacctagtcggactatacatgccgtgtaggtatggggtatccataatctccacagtagcccctgagacctttacagtcgacgaaacaatctcttctcgtagcacaaaatgataatccgagtactccgacttcttctgccttgatctcccgagtaccaaaatcaaagactgtgaaggtctaaaaatagaaaaaaaccgggtgcatcgactagatgcacctaattaggtgtagcccccgactatgtgattagttaaaaaactaaacatatagtcaagatgcaaactacatccaacagagtggtttgacaactgaatatcatatagcaaagcatatgcggcgttcaataaaacatccagccgactgcttttagctttaatataccaaaaatgaagatatgaaaaggcccgagtgaaaaacactctaaagatccataaattcacacatttgataagaatccgagtaaaaactctcaaaaagatccatcaaacgtgatataaatgtgataacataacaagtgatgagtctaactagcttaggctatgactcacaccagaaaaataagcatataacatgccgagtgaatgactgtattaaaaccagtcatctcaataaaacccaaacagccttcgcagcctaataaggcctacaaaattagtataacacctttctgttgggcacctttttatttgcatcataataattccaaagaattatctaaccgcatcaaaaatgattttaacagcatcgggctaaactgtcgtgagcaagtgttgccaaagcaaaaatacctaagtccctaaggatcacaactagcaacgctggtaatagaattgggctgaagtactgtaacatcccggcctagggcttaataggattaatagaatactcatatcaacaagttgcaacttcttttccaaaatccaatctccaaagaactccagggttaagcgtgcttggcctagagcaatttgggatgggtgaccgaccgggaaattcttcccgggtgcacacgagtgaggacaaagtgtgcagaaaagacatgtgttggtctgtgagggcagtctatgacctatgaaagctatcagatgtaagcgggcccggcctgggggaaggcgggacgttacaaaatggtatcagagccgactctcgcggtttcacgagaatttcccgggtgcacacgagtgaggacaaagtgtgcagaaaagacatgtgttggtctgtgagggcagtctatgacctatgaaagctatcagatgtaagcgggcccagcctgggggaaggcgggacgttacaaaatggtatcagagccgactctcgcggtttcacgagaatttcccgggtgcacacgagtgaggacaaagtgtgcagaaaagacatatgttggtctgtgagggcagtctatgacctatgaaagctatcagatgtaagcgggcccggcctaggggaaggcgggacgttacaaaatggtatcagagccgactctcgcggtttcacgagcgcgtgtgtcgcagttgcgcagtaccatttccctggatcaagtagtctggtacacacgaatttatagctgaaataccaagtgcacatacacgagtgtctaatacgaattattacatcataaccccgcaggcgtagtcttaaatcatcggaccgagcggtccggaatacatccaaaagcagaaatagataaggcagcggaattcaggcagcggcatgccattgccacaggcaacgaccgtactaagacctactgagcgccatcgtcttcatctcccaagcagaaatagataaggcagcggaattcaggcagcggcatgccattgccacaggcaacgaccgtactaagacctactgagcgccatcgtcttcatctccctcctggtagtaggcatagggatcctccgaggcttcatctcccgcttctgattaattttatatttgcaagggtgagtaccaaccgtactcagcaagccaccacagcaatgatgcacatgacagaggaattcaaaggatggctatggttcttttgcgcaaagcaagttttgtaattcttttcacaagcctaagatctagcatagactgatcaagttttaataccagtgttcatattaaacaatgacggttctgtccaccatccattgtgatcccaaggatagcttcccgccattgagtcgttatggttttctgaggacgtccacgttcccgcctctcaggaagtggctccatcagcataaaaatcatcatgcaatatcccatcccacacaagttaaagaatttagagtctagccaagtgtaatacatgtcccggtgctcaataaccgcgagcacggctattcgaatagatttggtttactcacactgcagtggatgtacactttacccgcactccgcgactgcccaacacatgagcctcgtcccaacacatgagacgcatcacggcaaagcttttcgataacctcgcattggcagtacccactccatgaacttaaatcctcatgcactctaggcgtccatgtttctagcagtgagaggagttctggcgctcccgggaaagagaagtctctcacgcatattaaattatggttcaagttaagttctctctctcacacactcatggcagtcctaccaatggcgacaccgatgtagggcacgcttctcggccctacctcaacggctgtcccatcgtagcgcacctgcctcactcaggggtgaaccatctatgcaaggatactgcctccgctcggctatctaatccgctaggtctatacccatacaagaagtgcggttgtacgggggttgtttcatgcttaacttcatggctcggttcttaattgaccggggacggtactagccttttccagataccacccaaatcctccgtccgccccagtcaaaaacagttatttaattttatttctcctttcacaaatcatgtcatcaacatcatggcaatgtggcgctcatgtctccacatgccgcatctcaattaccttcccaaaggtaattgccccagcatatagcatttgataaatatgagtatgcatgattctagaatagcatttctaagcaattgtcatagttgactagggactcatacgtaaacattgttacaaagatttaagggtaaacaataatcaaggcatggcataatcacaagtaggatgttcatcattgcatgcaattttatttgtaaacaaaacaatttcgcaattgggatcaacatgttcaaggaatagtgatgacttgccttgctcagagtcttgcgggtcttggccttcgcttggatccgcaactctctcgggctctatagttacgtgcaaaaattgatttgaattcggttagaattcaaataaaaatccaaataaatccaaatgaaagtcgaatgtgaaagtcgattcctttttattaactttactatctgcgaactacggcaaacccaattttgacttaaactattttgcgggtataaatattttgttgtcataagtttttaatttaatctacccgagcattatatccatataataggttagagatttctatcacgagctaaatatcggacgaaatcctagaaatattatatgatttaatttagtctatgactaaaagattaaatataatgcacggctaaaatccctagtaattaaatccgaatttctaccgtgaaccgatgacttttagagattaccaaaaataatctataataatctataagaattcatctaattgtttagttattaattatatctaaattactaccaattttaatctaatctgatcaagaaacatatttttataattaactcggaatttcgaccgaaatactattacgctcgagcaatttccaaaaataatctacgattaaccccgaccatttttatttcctaaatcctcctaatttctcccccaatttcccttctattttctccttttcttcttttctattttccctctttttctctcctctctttctttttctctcttttctcttttcttttctttctctcctcccggctccttcctcctttcctctcttttctttttctctgctccctcccggcttctttctatctctctctctcggctctttgcttccccgggcggcgacggcggtgggcgcgaggtgaggggggggggagacggctcaccggcggcggcggtggcggcgacgacggcgatggcggcgcaaggcggcgacgcacggcgcggcggctccggggcgacggcgcggcggcttcgaaggtggcgg

SEQ ID NO: 7217 - DNA, 11469 bp, Oryza sativa
caactaagtatctttaaatgctgtttactgcaaccctaaccctttatattataactcccttgtactcccttgcatttattatgcacttgtgggtgtgtcttgttgagtacggtggttgtactcagtcttgctcaatttttttcccaaacccagaagaggagtctctggaagatgaaggttttggtgtctagctcgtgcctgccgtcaagcgcctgtggtcgtcgccctagtcttccgctgtttctcgtttgtctttgtgtgtgctgggccttcgctgcccatgtaataaattaactatttacgcttccgcttgttgaactctgaattgtatcaacttttggtgtaccttgcctcctgggacaaggaataatgcacgcacgtaaggaacgcccgttgggttatttccggtcatgacagttctactgcttgggcagcctcatcccctgtaggcaatgaattccatgtgtcttggtacactggaggaagacaagagtactcaggaaggactggttcaggatttttgaacatagaaccagttggcgtgccaacctttgttcgaggtcttgaagggcatggagaaatatttttggcttagtgttcccctgagttgaaaaccagcgcccccaacaacgcacggtttgctcttgtttggctggggcttgaggaagaagatgcggcggaacaaggcaaaatgaggcctaatgcccagaaaagcttcgcaggcatgaataaaatttgcaatatgcactatggagtttgggttcagatgatgcaggctgattccatagaaattcagaattccccgaaaaaatcttgaggttggaagggagaaaccgccatagaagaaatgagcaaataccacgatttcatgtgtatcgggggttgggaatgcttcgccgaatgccggtcaccacccgatgatctccttcgctggaagaacgccgtgcgccaccatctccttcagattatcttccgtcacatcggagggcgcccactgactctcgaagctttctctttctcccgccatgaatgtgaactggatggtttgatttggtccgagatacggctggaaagggatggggaatcggagcggtggacgcggggagaaatttcgtgaagttttttaggatggattggagcggattgatgaaccctagtttggccggcgcagttttgtactgtagcaaggaatggggaaaatggcgagagtctcggcggggaagacgaagagacgttttatttcacttcggtgcttttagggtatcgggagtgctaacaggcctgggcctgcacagtacttcagcccaattttatttccagcgtggctcgttgtgatccttagggacttaggcactttttgctttagcaatttgtgctcacaacgatgtggcccaatgcttttgaaatcctttttaatgcggtttgataattctttggaattaacatgatgcaaacgaaaggtgcccgacaggaaggtgttatacaatttttgtaagccttattaggctgtaaaagctgtttgggttgatttgagatgactaatttattaaaggtcattctcttagcatgttatatgcttaatttggttatggtgagagtcatagcttaggctattagactcgtgaattaccatgattaaaaatcatgtttggtggatctttttaagagttatttactcgaattcctatcaaatatgtctcttttttggacctttttgagtgttatcactcggccctttttgtattttttatccttgatatgttcaagttgagaagcagtcggctggatattttactgagtaccatgcatgcttcgctataaaaccactcggttcttgactacatgtttagtttttcaactaatcatatagtcgggggctacacctaattaggtgcatctactcgatgcaccatgttttattttcgcccttcacagtttttgattttagcactcggcaagctggagcaagttgaattgaggcactcggattactgttttttgttttgagaaggctattattgtcaactgcgaaggtctcgggggctactgtggagattatggataccccatatctacatgacaattataatttagttggatatacggtaccaaatatagatagaatatctttatgaggactcgggttagtttttaacttgtatgtcaaggaattacccgagatcttagtcggttacgattgcattttatctgtaattacatattccgttagggatatggactgtactttgtaaagcggactctttcccctatataaggagggttcgtgtgcctctcggggcacgatttcttttttccagtttatacaatcaataacacactcggcggaataatccccggacaggagtagggtattacttcttgaataagaaggcctgaacctgtataaaatcctttgtctccaaacccatccactttcctagcttgatagccaccccgttttattattgccgaaatcttgtttcgacaatcttactacaccaataagaaaaatccgttccatcgaaaacatggagcttagttgtaaacttattagccatggcaaaaactctagatcggttaaaattcaaagaagaaaacaagactctgatacgacttgtaggatcgaaacacaagaactaagccaaccagagggggggtgaatggttggtatacccaaaaacccaaacttcttgaggaaataaaagttaccctcgaatcgatgtagatcggtctgactgcgcctgtgccgccggtctgaccggtgttgatcgtctggttggactgccctggaatcgcctctgcctcctgaagccgtcgccggtctgaccgccgatgagttgctagttagaccgccgaatccgataaaacacaaatcgacgaactctcaaagtatatgacaactttattgcttctctctgtgtttacaaagtgcaacagccacactccttacaaaaatcttgactaaacttgaaaccctaactaaactatcaactcaattgctctaaaaagcactaccgggaagcctcacgctccctctctatttatacatgaggtaggcagcctaaagccacgaaccaaactcatactagaagtcctaatccgcataggaaacctcatcgtacaagaaacaaactttacataaccaatcataccaaatttggactccttccaaattcgagtctgcatcccatacacacacaatacctccatcgtatgcaatatggaatcttcaccaaccacgtgcattgaactctagcctaagtatcccgcatgatatctgaccatcgcggacattgcctttccacgaagtcgactcccgatccatcgccggcaatactatcccgaggcatcaagtcacctacacatgaaacaaataaagaaaccatattccgagaccaagctatctccaacttgactcattagtagcaaacaactgtattacatacgcatagtatccatctagaagccataatcatgaaacaataacggatatccaaataaacaacctgaaaccgaaaccgacacagagtcggccgatcagactgcaggctccaccagtctgaccgacagcacatgcccggtctgaccggaccacatcacgaccagcagttcctattcacctgcaaattccaatcatctcgaaaaccacttcgtaaataaattccaaatatcaaaaccaataatcttagatgccaattattcatcacagaataataatcaaaaacacctttgattttacacatggcctctcctgtcctccagaactatgcgtctcctgcacatgccctgtatcttcaccatgaagacgagttgctaggctgcaagactactgctcgtgacttcctgagacaaaatacgtaagtgtttttctcttctaaggcggtgttcccacatagttgttcccatccgaaacagtaatcacggaaaacggagtggtccattagcacgtgattaattaagtattagctaattttttttcaaaaagcgtgcgtgtggaaaacgagaaagaggggttgggaaaagggataccgaacagagcctaagggtgtgttcggaagtgcttgttccccaccggaacagtgcccacggaaaatggagcggtccattagcgcgtgaaaagcactaattactataacttcattttgtagcatatttttcagaaacattgcaccaatttccaggtgaaatggcaagaacgaaaaggttgaatgtagtaaaaatcagtgcccaatacaagagtggagatggcaatagcagtgaacatatctagggctgtcaacaagccaagctcgagcgagctcgtctgcccaagctcgagctcgatacaagctcgagcagagctcgagccgagcctattgcaccttcgagcttttaggcaagctcggttcgagctcggctaccgagctcggtcataagtagtataagatatattttagtgataatcccttgataagtgtaattattttctagttaatcacactaataaaagagtaaaaaatgattaaaataaatatattgtgctaacacatgataatttattgtgttaatagatactaatatatatatttatctattagtttattaaatcaataaggtaaacaaacaatataaattgtacacagttaagctcggtagaaactcgagctcggctcggtaaagcttgcgagcttttgcccaagctcggggtcggctcaattggagctcgagccgagcttgaattgagcatagaacgagccaagctcaagctacttgtgaccttcgagctttttttgacagctctaaacatatcccagtgcaagcactagaagataatgagatcgaactagagcagcaagatgatggctccttgaatatgtcaggtatgactacaatgaagatagctaaaaccagtaggacgaactaaatgtttatattgaaaaattgggctcagctactattgttcttgtttaattttataggtgagagtgctaaagaagacaaactttaacacatccactactagagaaagcgtttttgctcccggtttgtaaccccctatactcctagttttacaatcgggagtacgaatccgggactaaagatggatatctttagtctcgggcgaaataattgggactaaaaatccatctttagtcccggttggggcagtgccagtcccggttggtcactgttggtatttgatatggttacagataaaatccgcaagcgcacggatataccgatgtagcacttcccctacggagtattccaagggtatcgaatccaagggaacgtgtgtgatcagagcttcctccggttcacccaaggacaccaagaaaatgataggccaggatagagaggatttactagtgagaaacagtgtctagggaaagcttaattttaatcctaacgcaatacttcaggcactggcaacccgctgttcctagatgtcgctctactacgtacccagacagggaggacttaagtgctctcgagggctgtcaccacctctacacccacctcaacgtactgtgggatacgcagcaattattggataataattacctaaacaccacgtctaagcaattaatatctactttagtgtttataactcaccaaagcaatcactatattttagttgattatagcgaacaataatcccgtatgctaattaggaactaaccaagaggtaattctcacaagataaatctaaattactcaagaagaatattatattgaattcagaataataaacagaataaaagaaataggagaagattaccgacaactccggaattcttccgactccttctactctactctcttcctattatagtatacaatattatagtacaatagagcctcttataattcagcttaagcttagaagtgtgtgtgtgaagtgagggagtgaagcctttatatagaggtaggtatgactgttggcgaaggggaaatgtccgaagtaccccgcaaccgccatcagggagtgatctggagcgtccacgccaaaccccaggatcaacggtgaacctgggctgggccctcctggcctggccttcggtcggtggattccccgatccttcgtctatccatttctcggagttttgggttgattcactaatgttttgatgaagttcacaaaccctccttgtatggatacataattctcctcactttagtctgattttcctcccaacttcagggtttatcatctgcatacaaatatacaccaacacttgtggaatacgtgagattaagcacctatcactatgttggatgttttattatccgaactttatgcagacgttggcggtatagaatcgacatttaacagccgccaacaaaaccccccacacttagcactttgctcgtccctgagtaaaggtcagtgtagaatgaatttcttcaagagatgaatcaagcatataaatcattcacacccatacctatacctgtgaattttatcagtggctatcttaccatcttgagtaattgataaatggaatgatcttgattccagtccttcttgcttctctgttagactcgtggggtttttatgaattttcgcaaactagctcttttcctcatattgacttttctctcttgtctctcaaagatgtatattttctttttggatcctctccaaggcaaagtatgccagaattcatccctattctaaggctgttatgtggagcttggtagggataaactggtgacatacttgcatcatatatattgcaaagtcagaaatatggactcaagaagatcatccgtcatactcctagatcaagggtctttatttgtggttgaaaatggaaatatgttgtggaatgctggaataaagaaatgattctcctttttcctattctttctctccaaattggttctcttggcatgatcatggaaggggcatggctatattttcttttcaactttgctcaatgtttttaggacaagctttatttccatcttcttctttcttttttttcttttttttcatagccatgcctttccctccttttctcattttctttttgccatgaactttcccaagaaaagaaagcatagttcattgtaggagtttatttgaatgatatttttgtggaaagccaacttctagtgtagaagcttagcttaattttatatgtgaaattggaaagtggaaatgatactgactccttgatcatgacagtatgaaagatatctaacacaagtcacacaaatttgacaaaactcaatataatgtcaagcagtcatatgcatgataatgtttgattattaatgtacttgcatatggtcttggtaggtataaggtaaagtcaactggaggatagagtttttaaaatagttctatttttgaaaacaaattcccaagagtcataagaaagttgcaaggattcctttcatcttaatcatctcacataaagcaattacttagatgcataaggttccctaatcatggatggttattcacaagcacaagttcagctgagaataatgaatatacaagatcaatcacatgaagaatttcattagttggaaattttatctcttacttatgcttgaaccagttgttttctgaattttcagctctagtactataccatggtggagatatacagataaaggacgtgcttacctgcttacctgtgaaaactgagagggataggggccagcactggttcggccgaaccactctggtgcctgatccctctgcaactttctgcagagttcagtgcttccaggtgttcagatatttcaacaattctcagggcatatgcacgttagaagctgggatatctcgcccacacttattcaaaacctgaattttcttaaacataaaacaaaaacaaactttggcaaacattggggtaaacaccaatgtgccacattattaatagcaagtgcttacatgattggaaaaataaaaccaagcacctactactattttattcatgggaaaggaaacatctaattagcataatacttattttcctttcccatctctatgaatgcacgcttgattttagcgtacaaaccacgattaagggtatcaaagctattcctaatttcagcgagttctacccctagctccgcaatacgatccctaagctctatgttctccttgcggagtttcttcacttgagcggcgagcttgtggatcgagggcttcggtgatttcacctcatcctcttggaattggccgggagccctcacaattggagggggcgtcaaatgacgcttcaccttcataggtggagggctatgggattccgctgcccccttcttctcccatgccgtcaaaggccggagtaaacctgtcacgcccggaatttctatccaaaattctaaacgcttacatgtgtgtgaaccctcatccaggaatcagccgaggcacacaataacaaattgataatagagtacaattattactctaattaataagcaaataaaatatcattacagaggtagatagttcctctcaatcaataaagatctaagcagcggaaaaaaaaagataaacggcgcagacgactccactccacaggcagcttgaccagggctatacctaatcctccacaccatcagcatcactgtagaactcctcctctgatgaatgattgcaaggtgagtatatgacatactcagcaagccacacagcaaatatgcaagtgcacatgataccaaaggatggcatagtatggtttcatttgcataaataatatttaataaacatttcagaatttaataaaacagttaagtaataattaaacaatattaatccaacgctatacaacataccatgttgcataggcccaaccattctgaacaaccttcgcggctgcacagttctatctccaaaccaagaattaaccattccaaaccaggagctaatcaaattattaccagttatagcatcatttattatgatgggaagtgtgagactaatcacgaaagacattgttacacccgcccataaccgcgggcacggctattcgaatagttttactctggccagaggtgtaccactgtacccacaagacacggccccacgacatgtcaccatgcgcctcaataccaccacggtacctcggaaaggagctgtgacagtacccctcacacaacacaatccaccacagcgcaccgttcctggatcataatcacccccttataaacaaggcatggactccccagtgacccccatgggcttatctccgccacttctcagtctggtgctccacaatgaaccatgctatacaacaggtaaagccgttgcccacgctggcttgtggttggtacggttaatgtttcacaaccgaaactcgtgaaccggtccttaattgtcatgagcacgaccatcaaaaccatgtgctcacaacccacctttatcaaattttatttggcaaattaattaattaaccaatcacgattgaccatcgtgagcttccattaaatatccataagtgatagtgaagtatgatttatcccattaatgagctaatatttctaagcacggctaagcaactataaataacatctagctgaaccaatccaatatataaggtccatgctagtcaaattataacccataggaaaataaagtcatcttcggccataattaaatgggaaaggctcaccacccaatgacattcgaaaacaatgcataagttgaaataaatcaatagctttaaacaggttcaacctgctcaaagggttgtttgggatctgcgtgacttgccttgctggccttggaactcttcaaattcttctcctgcgaaaacggactctccggaaatgtcggaatctaaatagaaaggggcaaaatcaccaaacagcacataaacaagcatgaacagtacatgtggatatttttaacatgtagatctcaattttagaaaaatttagagacttgaaccaactaaatccgagctaagatgaattagttatgaattttcaaagattaaattagattaaatcatttatttagattttaattgaattatgacgcaataatgaattatttttgaaaaggaaaagggaattattgcgtcagcggctagggttcgcggtgaaccgggtgcacggcggcggctcacggaaacgaacggccgagatcgattcatccaaaacggacggccaagatccatcggtccatgaccgggccacggggaatgacaacgatgacgtcagcggtgacgtcaccaccggcggcggctcgggcgtgcatgctcgcgagcgaacgacggcacgacagcgcgaacggagggaaccaacacgtagagggcgacgcggcgaactcaccggtgaccaaaacaacggcggaggatcaacggacggcgacggcgtcgaggaagaagcggcggcgaccttcggcttgacgacggcgacgttgttccggcggtcgacagcgatggtggaggggcggacgaggtcggcgacggcttggcgatcacgatggtgacctccccgagcgacgacgacgaccggagtggcggcggcgcacggctggacgaacggcggcgacggcggcgctaggctacacggcgctagggctctaccggcgacgagaggccaaggcgagggtggcggcgtgtcttacgtgcgtgcattattccttgtcccaggaggcaaggtacaccaaaagttgacacagttcagagtttaacaagcggaagcgtaaatagttaatttattacatgggcggcgaaggcccagcacaccagaagacaaacgacaaacagcggaagactagggcgacgaccacaggtgcttgacggcaggcacgagctagacaccaaagccttcatcttccaggaactcctcttctgagtttggggaaaattgtgcaagactgagtacaaccaccgtactcaacaagacacacccacaagcgcagaataaatgcaagggaatacaagggagttataatataaagggttagggtttgcagtaaacagcattaaaagtcacttagttgctcaaagctattttgtaaacacggtcctagagctatacaatattattaatcaaggccgtgagcccacacgaacctgccttaacccaaggcctacgatgattcagaccgaactggcaacccgaccctgggtcccagctcgtcccaagccaacccaggccaaccattccacattttagttgttaggcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacctccgggacaggtaggcaggattgagcccctagcagcaggacaccagccctgtgccatgacatctcgactaccgggccg

SEQ ID NO: 7218 - DNA, 918 bp, Oryza sativa
acatgtggaagtacggtagtgctttcaacaaaggcccgaagaccggtctttatatggccgaggtgctactatcaaaaccatgcaccccgagcccaagcctaaaaccattttgaggattttgaatagagggggaggtgtgaatccaattccataataatccaaccattccatagtgtccacctaatgttgcctaattaaccagcgaagcatctacctaaaatcatactagtggtaccatgagtagagtgtccactagttggggttttgtttattctagggtgaacaaggtaataataacaataacaataataaggtcataacacaggtacataggcatggctagataaaacagtgataacgcgggaatttaaataaagcgataatgcaataatttaaatcaaaataactttataaactgggattcaatatgttcaaggatgatgtgacttgccttgctcgctttcccaaacgtcggcttcaacttccacgaagagcggatcttccgaagctgcagcgtctacacgaccaacggaaaagaaaaggcttttactctaataaactccatataacaagcaggaacaaagcacaaaaatgggttcttgacttcttaaggaaaaattagagacttgaacggtccaattccgagttcaaatggccaagttatggtcatttgaagtttatatgctctttaaatgaatatttgcgaatttctttatttaaattttaatttaaaaatggatttattgcgtcagccgagaggagggggcgcgcggaccgggtccacgggagtggggcccacgcggcagcctcacggtccacggtggaccgggcgcacccgggctcgcaccggccggtgccgtgggtcccacgcgtcagccgcacccgagggcgcgggcggctgacggccgggccccacgc

SEQ ID NO: 7219 - DNA, 2607 bp, Oryza sativa
  unsure (1)..(2607): unsure at all n locations
cagcgagggtgcggggcgggcccgcccgtcagcggcgcgcgcgcgggganaggccgtatggcccgcgggaaagaggagagaggggaaggaagatgggccggaccggcccaaggaaggaaagaaggactttttagggtttttctttttataaaacctttttaactttgtttatttcttaacaattattatttgtgctctgaaaattccactaaaatttatttacgtattttaggcttttaggaaatacacaaaaatcctccaagccttatttgacttttaactttgcacattttaattgttggaggctttcacacggattttaattattctaggcataatttaaaggatatattttagggtcgttttgggatgtgacacggcgggtagcggcgggcttgggggtcaatttataggggtttagaggtggcggcgaaggcccacggcgaccggcgacgcgaaggaaagtctagggttcggaggagagagatcgatccgaatcaaactcgaatccacggatttccaaacaattttagccgacgattccaaaagagaaaaggtagaggagatcccgatgatcatttcccctctattgatttcaccggaaaaattaaaggggcgggcgaatttggaaggagacggcggcagcgcggcgctagggctcgggcggcgggcggccggaggtagacgacgacctgacaggcgggccccacctgtcagcgtccgagggcgcgcgcacgtggctgctgcgggcggactgggccggcttgggccggggagagagagaaggttttgggccgactttcggcccaaagccaaaagaggattttaaaaaccttttttaatttaaattattcattaaatgtaattccatttattaaaaatacttccttagctcaaataaatcccagaaaaatctaggaattatagaattaagcaaagtatttaatgaaattttatctggccccattttatattggaatttattaattaaaactagatcttctcttctaggcttttaaaataaattctaataattccaatttagacaacaatttatatatttgggatttttagggtgtgacaaaacccttaccatacccaccgccgggagttcgcactccttgaatgcggaaacgctccccctttggagtggatggtgtagcggtgggtgtggtgtacttgtggagcacctcatcccctgccttggtgaagagggtgcccacgtagcgctcggcgggaggcggcgcggccttcccgtcatcttggaaaaggcattgagcctttaacaagccgaactctcccgtagtcggctgttgcgcagggaaatccccccggatttttgttcttgtaacatggcgaggggagagatatcgcgctgccgaacggggggccgaacgggccgagagtgtgcaaaggtgagggaaaggatgaagaagaagtgttatgctgtgatccgaacgttctacctacaaacgcacgtctaaacggactcaggacgagcgggggagactgccattcaaaattggtgccgatcgggcaccgtgatggttcggccgaaccctggtgggtccggcaggccaccagatttttcctaggcccacaaagtcctaaactaagcacaaaaatgacaactatacagggttttaagcatgcaatagatgagatcatcatggttcatctaaagttttatttggctcaaggaaaatctttaaacgttgaccgtttaccttaaatatgttacctgattcgtcgtggagtgtgattgccccatgtgaagaggtgtcgatgacatcgaacggtccttcccatttactgcgcagttttccatggccgaaaagcttaaccctggagttgaatatcagtactttgtctcctggcttgaatttcttgatttttatccttttgtcatgccagcactttgtcctttctttgtatatctttgcgttgtggtaagccttttctcttcattccttaagttcagcgatctacatttttctccattctcctgctccctcaaaatccatgttccaatttctgatggcccagtatgctctgtgctcaagttctacagggagtcgacatggctttccgtaaactatctgatatggggacattccaatgggtgtcttgtatgctgtccagtatgcccatagtgtgtccggcaatctatccatccatcttgttcccattttgttgaccgtcttttgcagaatattcttgatttgtttgtttgatgtttctgcttgaccactggtctgtggatggtaaggagtggccacattgtgtttggctcccatttctcgtaggaggtctcggaaggttttgtcaatgaaatgagaacctgcgtcacttatgaccaatctggggtaccaaatcttgggaagatgatttctgtgaacatcttcttggcatgcctcgcatccgcggcgctgcacggcataacctcaacccacttggagacatagtctactgccaccagaatgtactcgcagctacgagacctagggaaaggtcccatgaagtctataccccaaacatcgaatatctcgacttgcaaattgtatgtgaagggcattgcatcgcgagcagtgatttctccttgcctct

SEQ ID NO: 7220 - DNA, 4159 bp, Oryza sativa
  unsure (1)..(4159): unsure at all n locations
agtagacccgatataggtatggctcatcccatatgtgacagcgactttcatacttcaattttcattgattttaccctcgtggtatgtacttggataccatgtagttcactatgttggcataccacgggttggagtcgtgaaccgtcatcagcatgtcatctcttaaaaaatcattgatcggttgttcctgcatgttagtgatctgcagcctggacaaatgatctgctacggaattttctactccctttttatctttaatttctaagtcaaattcttggagtagcaaaatccatcttaagagacgaggtttagcatctttcttagtgagcaggtatttcaaagcagcgtgatcagtataaattatcaccttggctcctactaagtaagatctaaacttatcgatagcaaaaacaaccgcgagcagcccttttcagtagttgcataattcaactgggctccggttagagttttgctagcgtaacagattgcatgatgctttttatctttggtttggcccaagaccgcaccaacagcgaaatcgcttgcatcacacataatatcgaagggcagagtccaatcaggatgttgaatgattggagcagaaacgagtgcctttttgagaatttcaaaagattttaggcacgcgtcatcgaagtcaaagggcgtatccttggctagcagattggtcaggggtctagcgattgtagagaagtccttgatgaaccttctataaaagccggcgtgtcccaagaaactatggattccttttatgttcatgggaggaggaagttgatctatcacatcaattttagctcgatcaacttcgattcctcgttcggacactcgatgcccaagaactatcccttcacggaccatgaaatggaacttttcccagttaagcaccaggtccttttcttggcatcgttgtaagattttgtctagattctgcagacaatgaccaaaagtatttccataaactgagaaatcatccatgaagacttccatgatatcttcaatcatgtccgagaaaatagacatcatacacctttggaaagattcaggagcattgcacagtctaaaggagatcctacgatacgcatagatgccatatggacatgtgaacgtagtcttactctggtcctccggatggatgggaatttgatgatatccagaatacccatcaaggaaatagaagaaggaatgatttgccagccgttccaacatttcatcaatgaagggtagcgggaaatgatccttttttgtagccttgttgagcttcctgtaatcaatacacatcctccatccggttacggttcgttgcggaattagttcattctgagcatttgcaacaaccgtcattcctcccttcttcggcacaacctggattgggctaacccactcactgtatggtacgggatagataatcccaacatgcagaagtttcaagacctctttctttacaacctctctcattgcattattgagtcgtcgttgaggttccctagagggagtactctcggggtcaataggaatacgatgggtgcaaagtgtgggattaatccccctaaggtcctgaagcgagtagccaagaacagaacgatgcttctctaacacggtgagaagatgttgagtcttgtcttcagagagcttgtcactgattataacaggggcttctctgtcattgtgtaggaaggcatatcgtaggcctggaggtagaggtttaagctcaagcggaggtcgaggtggcggttccatgattggcaggtcgagagtctcaccaggatctgcttcttccttgatgaagtcggggacctcatcttccagaagggccccgggagactcatgaggagaaactgcggtaacctcttccgctgactcaatttctgggagagggtcggtcaaggtgatccttgcccacgagaatggaattgagaattcattctctcctagagttattttgaggctacctaatcggggtgtgttgatgactagttgctcaatgggcagcccgattaggatatcaaagtcttggatttcaaagacatggaaatccaagatcgcctccctgtcttcaaagcagacaggcacatcttgcacaatcccaaatccttcgatgatatttccgttcggatgcttgaagaattgtttgtcggggtcactgccttattgcttaaataagcgaatgcaaaagactcagagacgaggttgaccccgacagttggactgtagagaataccgacatcgttcccttccagatggcaaggaatgattcagggagcggtatttatctgaattacttcggatgaaagctctgcctcctttagccattcgtcgctcattatggatgtcaactcccggacagtttctcgcaggaacccaacttctataggatcggaaggtgacaaaggaacgggtggtttcctcttgctaaagtagttcagggtattgccgtagtcttcgtcaaaaccatccctgaacattattgcggcacaatccggagtctgaatttcttcattcttgacggacggctgctcaggaaccttctcatcaatcgagctagcagaaatggatggttcagcaagtggctcaataattagaggttcctctatcctagacacggatgcctccggctggggttcattggactgcgtcatgaaggaagtgttttctaggatgcgatccaaaatcgtttttccttctgacggcgtcttgtgcatgaacgatcctccagcggttatgtccagatagaatgcagactcctaatccaaacccgtatgaaaatgctggagaagcacatactcgggtaaggaccgggttggtccggactgcactaaattagtgaatctagaccaagctgcaccgattgattcgttttcgatctgcttgaaactgagaatttttactcgaagggcggtaatacgggtgactgggaagaaggcaagacataatctgtctcgcagctttttccagctaccgtttacacatccaacggtagaggtgtaccattggtttgctctctcttgaagaggtccaccgcacagtttcttgtctcatgccacgaatcttaaggcatgagtagacttgttcaaagtctcgcagatgatagtagggattttctagatcaaagccagaaaaaggattttcccttaccatactaattagctcgagacgaatttcatagccagttgtataaatgggctccgattaaggaggtggctcatagaattcgccccgaggagcagacggctcaaccagaggttgctccatgatcgagaagagttgacaggaatacttctctaggatagcaggggtgaaggtagaataaaaaaatgaaaaaggatacgaggatgaactgggtttgaaaatgatcagcaaccgttccccggcaacggcgccagaaatgcttgttggtatttgatacggttacagataaaatccgcaagcgcacggatataccgatgtagcacttcccctacggagtattccaagggtatcgaatccaagggaacgtgtgtgatcagagcttcttccagttcacccaaggataccaagtaaatgataggccaggatagagaggatttactagtgagaaacagtgtctagggaaagcttaattttaatcctaacgtaatacttcaggaactggcaacccgttgttcctagatgtcgctctactacgtacccggacagggaggacttaagtgctctcgaggactgtcaccacctctacacccacctcaacgtattgtgggatacgcagcaattactgaataataattacctaaacatcacgtctatgcaattaatatctactttagtatttataactcaccaaagcaatcactatatttaagttgattatagcgaacaataatcccgtatgctaattaggaactaaccaagaggtaattctcacaagataaatctaaattactcaagaagaatattatattgaattcagggtaataaacagaataaaagaaataggagaagattaccgacaactccggaattcttccaactccttctactctactctcttcctattttagtatacaatatagtacaatagagcctgttataattcagnnnnnnnnnnnnnnnnnnnnnnnnnnnnnnnnnnnnnnnnnnnnnnnnnnnnnnnnnnnnnnnnnnnnnn

SEQ ID NO: 7221 - DNA, 1246 bp, Oryza sativa
aagcatgttatttccatcaatatccctcctaatcattactggagttgcctttctggctttctttattattcgtcgattattttatcagtcctccttctattcgactattacttttgttctcgccgtggctgccttgttcatagagctatggcaaataatctctggtgtgtgttctaactggactaagctggccttgctccaataccatatcaaaaggaatggccatcaccgatgttgtctcatccagaaagcactagccatggtgctgcgcttccgtgctgtgcagcggttcaacgacaaaatggggcagaactcggtgctgcagcctcgtcggttccacaatcctccaatagtgttgccaaagaagatggttcatcgtgcaagccttcacaaatccgccaatgtcccaacacaagtgaaggctgctgtcttagcggcactaaagagaagtaatggacggctcagcaatggcgtggcagccattcagcgtagcacactgcgtgatactgtcatctggtcttgccaaggagatcacatcgtcactgccaatgtcatcctcgtgtggcacatcggcacaagcctttttgagatgaagtacctgcggatcaaatcttctccacggactgctgatatgatcaccgccacccatttgtcgcagtattgcgcatacctagtggccgccgtccccgagcttcttccgaacgacgctacatggaccaaggcgcactgcaaggaggtggcgagagacatcaagaaagctctcgatggagaaggaaatgactttaatcattttgtcgatgctcttggtgcgagctgcaggcacaaagttttgcagcaagggtcaaagctggcgaaacaactggtaggagaagttggaaggctcgaagacggagaaggagagaccaaaggcgtaggcgaggcagcgttgtggaagctcctggcagagttctggtcagagatggtgctctacctcgcaccgtcagacaacgtcagaggccatgccgaggctctagctcgcggtggtgagttcatcacactcctgtgggcgctgctgctgcatgccggcatcacttcacggcccggcagtgtcgccgagccttgagcccggcaatgtcgacgaggcagccgcaggtgatatgtaccgctgcgttagttgtacgtttttcaagttctatgtattcgcagcaaacattcgctcttttgagctaactgtagctgttagtgtcattgagaagattaccatgag

SEQ ID NO: 7222 - DNA, 623 bp, Oryza sativa
ttcgatgcaagggtcggtaactttgcctttgaattatgtttctaaaaaaatcttttttatcccacttgacatgctttgacgtcttcccaaatggctttactgctggacttcttattgtctgatcgttatcctgccaaatctgaagcttcggtgttagatgtgggtttaatccgacccctggagactatctttgaacatatcacttgggtcataactgggaatagctctcatgaacaagcaactcggattcactttctttatgttcagtttactttccactattctcttcatgttgtcatcatttagcattcaaagtattcccttacacattcaaccctgatgtgttattttcagatttctcttatcttcgacctacttctttgaccggtaataaacacccttgctgttatcttctatcaatcacctttttgactttgtcaaccaaatactcttcactccgaaagttgtggatgcttctggtgacgatgtggtcctttggtctgcttgccttcaatgaaacctcgaagtgtttcgccaaaagctgtactgacccgttttgccttttatccgaaaaaaacacatctgaaactctcagtctaaacaaaaggctcttttgcttttta

SEQ ID NO: 7223 - DNA, 1091 bp, Oryza sativa
tgtagccttcatttgccctgaagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggcgaaggtgctactatcaaaaccatgcaccccgagcccagcctaaaaccatttttggggattttgaatagggggggcggtgtgaatccaattccacaatactccaacaattccaaagtgtccaggtgaaatgaatatcccaaagtctagagttgtaaaaccacctaatgttacctaattaaatagcgaagcatctacctaaaatcatactagtggtaccatgagtagagtgtccactagttggggttttgtttattctagggtgaacaaggaaataataacaatagcaataataaggtcataacaaaggtaaataggcatggctagataaaacagtgataacgcgggaatttaaataaagcgataatgcaataatttaaatcaacataattttataaactgggattcaatatgttcaaggatgatgtgacttgccttgctcgctttcccaaacgtcggcttcaacttccacgaagagcggatcttccgaagctgcagcgtctacacgaccaacggaaaagaaaaaggcttttactctaataaactccatataacaagcaggaacaaagcacaaaaatgggttcttgacttcttaaggaaaaattagagacttgaacggtccaattccgagttcaaatggccaagttatggccatttgaagtttatatgctctttaaatgaatatttacgaatttcttcatttaaattttaattaaaaaaaacccatttattgcgtcagccgagggaggggacgcgcggaccgggtccacgggggtggggcccacgcgtcagcctctcggtccacagtggaccgggagcacgcggctggcggcggccggcgccgtgggtcccacgcgtcagacgcacccgcgggcgcgggcggctgacggccgggcccactttgcagccgcgagggcgcgccc

SEQ ID NO: 7224 - DNA, 742 bp, Oryza sativa
tatggcggattttctcttccacccccaagattcttccgggggattttgggtttcaataggattagtttgcatcacctaaacccgaactccatagttcacatcgccaacttcatacatgcctgcgaagcttttttgggcgtcaggccgcattttgccctattccgccgcatcttcttcctcaagccccaaccgaacaagagtaaaccatgtgttgttgggggggctggtttccaacttaggggaactttgagccaaaaatattttttcatgcccttcaaaacctcaaacaaaggctggcatgcaaactgttctatgtacaaaaccccgagcctgcactccccgagtactcctgtcttcctccagtttatcaggacacctggaactcacttccaatgggagaatcaggcgcttgccctaatggaccgtatgctgaaactgaaggagcaaggcctgcaaggagaacagatcacccggcattttatcaagagccggctagctccaattaaagagagatcccgtacggcctttgagtttgatggcaagcatgacccgaaccgtgaagatccagactctcttgattttaaggtcatgaaggagagaatgtacaaaatcttctcaaacgctatcatggtcagctattcgcatttgctaccagtggtgccatacaacgccttcaaccctcttccaccggtatgtattcaaacatttcagccttcctcaaaagtatgcttttatcttctgt

SEQ ID NO: 7225 - DNA, 5950 bp, Oryza sativa
cggcggctgtcgggctaccccctggccgacgcaggctcccccaatgcccttgatttcgtgctccgtggcatgggtcagggtggcggcggtggcagcgccgagcggtttttccgcgtcctcatcgacgagctctggtttgctagtgatttctactactctcccatctcgttgagctccttcagcggatggtgtgccgtgctcaaccacctcttctccgccctgatcgtcgtcggcgctgtcaccgtgggatggatctatcgcacgaagcaagtggtgattttcgacggctcgcaagcgttctactacatcgtcactgtcgtcctcctgctgtccgtcgtgttcatcgagatatgggagatcgtcgccgacgtgtgctccaactggaccaagatggccctgctcgcccactacatcaggcacgactcgccgtggcgccgattccgcttcgtccactcggcgctcgacgcggtgctgcggtggttcaggccggcgaggcggtggcgcgacaagatcgggcagaactcggtcctggagccacgccgtttccgcaagcgaaacgggtttctcgccgagaaattctacggccgcgccggcctcatggagtctgtcggggtctctttgatagtcatagaagcgatgtacaggtccttccggaacatttacggcctgcggacgaatgaactagcaagcagacgcaacagcgaatcggccagtcggcggcaacgccgacagggtgaggtattcttccctgagacggttccagttcgagttcgacaccgtcaccgacaagatcctcgcttggcacgttgcaactaggctcttcgagataactcacgcgcgtacttcaccggacaacaagatcgtcgcctgccatctgtcgtactactgcgcgtacctggtggcggccgtgccggagctgcttccggactgccctgcgtggacccaaaaacggtacaagaaggtggcgaccgacgtgcgcgcggtgctgggcagtcacggcatcgccggcggtagtacggcgtcggcgagcgacgcgcagctttcgcagctgggcgaccgcgacaaggtgctgcgggatggagtggcgatcgttgggcgcctggtggaggagttcgccgagggcgagggcgtggacgaggagttggcgtggcagttccttgcgaatttctggtcggagatggtgatctacgtggcgccgtcggagaacgtcaaggggcacgttgaggccatgggccgcggcggcgagttcgtcacgctcgtgtgggcgctgctcctgcacgccggcatcaccacaaggcctccggcgcaagcagtattataccgtagggaaactgtgtgaagagtctcttttcagttatacttacacaaattaaaacgagtatgtgtgagtgtgagcaaataatcgatctactagatctagatcgacttgtggttgagattattaattatgcatggggcatggagtgtgcgcgtacgtagtggttgccattgagtctagctagtattatggattgtgggatcgatggcacgatccaaattagttgtctccatacttttaagcatccattagtattgtaattttgttgagattctcaggaagaaaactcaggaaattgcggcccaattcttgtgttatctctctgttatcgaaaattgctatacgtacgacattttgagtacgatcttcgtacgatcaaatgggcggctaacgtggacttatggagcatgtcagtcttgtactcgttctgatgcatgtcatcgtcatcgccagcgccacgtagggcaagaggttggcggtgatggtggttgtgatgtgttcgatgccggcgccggaagtccaaaagtacaacaccagcacgatcgcggaagtccaaaagttcaaaggttaattagacccataccactgcaactttacgaaattgaaaaaataccactactattcgtcatatcggctatatgccgctggaaatttttaaaattggaaccattccacttccgtccctttttccgtgctctctctcacaccgtctccattcggtcctcatccccctccctcgacgtctcggacctcgcccacgcgctgtcacgcccagccatcgcggcgcccaaggatgtccaagccgtagccgcacttgccgccgcggcggacttcccgagtcggacaacgccaactcgatccaggtccgcctcgctgccgctgctgtggagatcgaggaggtccgggtgagccggatcgacggcggcgagggcagcgtcgacggcgagtggacatagcaggttggacttgacgacgagggagtcgcagaagctacacctacaataaaatggctacttagctcagtggctttgcacgctcgactacgtctcactctgcttccagagaacaggttctcaattatctcgcacccccccaccccacttcacccacccaacaaagaaaaagaaaataaataaatgaaaatgaattagagtgcttacttttcaggtcatcgaccaagtcttctgtctgtccatgcctatctgtcgatgaacacgcccaaatagtttccgggacacttattggggcattttacacttattggggctttgtttttctttattttgagatacataaacgtactcattggcttttcagttgtcttttaattcattgctagctgtatttaatatttataagattttgcgtgaaaattaggtgtaattattccaaataaaaagatttctaggattcagatttattttataccacaatatataagcattactactctgattctcttagcttctatcatatcaatgtttttagagccaatcaaatgcttcagaaggacatctaagaaatttaataatcaaatattgataactgaagtgactaatggaaaatttttggcccgagtagtacttactaaagagtaaactgtgatcacggtacataaacttgcacgatggatacaaataggaacaacaacttataaatcgtttctatacaattactagtccatgcgaacttgagccaaaacaatatacgcaagcaaaattgatttaacacggtgcgccttgataacatctttgcatgctagcggtttttttttcacaaaataaaatgtttgttttaaatacaatcagtactctagtagtgtaaagcaacctacaagatattgcaatgaaattattattgctgactgctatattctgcaaaactgaaattgatctagtgtgtgtatgtctgcacattgttctggtactacacatttgattaattttacacgtgtggattgttttagactaggttcgtacaggctagacaagttattgcatctgaatgggcatttgtcaagtttataccccctgagtgcaatttggtctttactaaacacataaaaatccctatattttgagaaagagggagtaggagccaataatgattggctaagataaataaatatgcggataaattgaataacagatgttgtgagattggctgagatgaggaggtaggtacaggagtggctatattttgagataaaaattaattatcaaaggtaccagctatatttgagaagaaaggagtataatacatagtacaagctatatttgaaataaatgatattctatgattatatacacactttttagcggatctattccgttctaatatttccaaattctaacctcttgccacataatttacaaggatatattttaatatatgtttttttttaaaaaaactttataacaaattccttcgtgagagagtacacaacatgtgtggtgctgcactaattgatgggtccatctgttgcttggccgtgtttcctgacatcaacctaaccatgtgtcggccgtccggcttgactccttccgagaagcttcactgtaataccaggcactccgccgcgtctagactcttgagaaggatgaaaagaagataacagaatgaaacaccacatttgcagcgatgagcgcgtatattcctctgctgctcctagatatttgttcaccacctgtgctaatagaccccgttcgtttctattaggaggtgttttagggctgttcactttcatgccattttcaaccttaccaaattttagtaaaattgtcaaaaaagtggctacatttagtttgctgccaaattttggtaactatataagaaatcatgccaaaagttaccaaaattttagcaactatgacattagatcggggtgtcacatcgggtattatatagggtgtcgtatggggtgtttgcgtactgataaaaaaactaattacagtatccgttagtaaaccgaaagataaatttattaagcctaattaatccgtcattagcacaggcttaaaagattcgtctcgcaaagtagtcgcaatatgtgcaattagtcattttttaagcctatatttaatactttatgcaggtgttcaaacgttcgatatgacatggcgtaaaattttaaggtgggatctaaaccggcacccttaggctgggttcattacttagaggttgggaacccatctccccgcatggaaaacagagcagtccattagcacgtgattaattaagtattagctattttttttcaaaaatggattaatttgatttttttaggcaactttcgtatataaacttttttttttttggaaaaaacgcaccgtttaccagtttgaaaagcgtgcgtgcggaaaacgagggaaatgggtggggaactagaaattccgaacacacccttagagcaagtataatagtaggctataagccggctaaatgctgatgtgaaggagggaagagaggagagagaggagaagcatgctgtaaacttacagccggcttggatacaagaaccaaaaaactctgtgagagagacaagtgggccatgtattaattgtaaagagctaactattatatgggtaggctcaaagaagactacaaataacgttatagccaacaagtcagctgtattattagccttgctcttagagcaagtttaatagtatagcccactactagctccaattcatctatagccaatctaatagccaattcatagaatagttgcttattatactattaatgtatggtcccacctgttatacacacattgtctcttggagtccgtgctgcagctgacaacagatctgtagtccgctgctcttctcttttgtcttttatctcattaaaatatatttgtagctagctaatagtctcctattgtacttgctcttagtacacttcctcgttatgggtgagcaactcactcgttttccattattacacttcctaacttgataaatcatatgttttgtgcaattattttttatataaaagtttcttaaaaatgaagttatgtttttactttattgtaattaactaatactccttccatcccagaatataagcgtttttggacttcaacgtagtctttgagatactactttgaccaacaatatttataaaaataagatatttaaataaaaatgggtgcatattatgatagttttttcaatgataaatctagcaacatcaattttacattattgatattttttattttttatattaatagtcaaagttcaaaatgtttgacttgacacttgttgacgaaaaatatgcgctcggccgatggtgctaggtctgtgttggcgcgaactaaattgacgaacacaacggccgaggagatctgcttagctccagtgcaggtctaaaggttgatgagatgcgggcgtgccagtcagtttgatcctgtaactgaaagatatactaatagcagatcaatgagccgatcggctgacaagccgatgaagtaattccagccgatgccgataccagctgatagcgatattggccaatcgactatatatggttgatgtagaatatgacacttgatataaataaactaataaagacaatcgactgatgataatataacaaaacaacaaatacaatccagtagaaacc

SEQ ID NO: 7226 - DNA, 17914 bp, Oryza sativa
catctagataaaatattgtggctagattaccattgtgattagcctaatgacctacttggcttagttatttatgccttgtttgatatctagcatgatagaatttatgagtttttcttgtcctatcatgtcgcaagtaggttatgcttgctgtatatgctttcaaataataatgcttggaataaaattaatggcttagtatgtattatttccaacattccagaaacctttagaaccattggtcatggctgctcatgctgttgatctgatgaggcctgagaagtttgctggtgaaaactttaagcgttggcaatccaaagttcgtcattatctggtgtcgcagaacttgtggtatgttattccacaagtgaggccgctgacccaacagcagcatgcggactttgagaccagtaatgatgtggctttaggtgtcatgctttcgctcctgtctgaccagctctacgacgtgtatggtgcttacaccagcgccgcagagctatgggaggcactggaccgtaaatattcggtttcagatgcaggacgttggatatatgtcgtggagcaatatcatgactttaagatgattgacaaccaatcagtggtgaagcaggctcatgatcttttaacgattatgggtgagatgtctcagtttggtgctattgtgaatcctaagtttgtggtggggggcattattgccaagcttcctccattttggagggattttgccactgcacttaagcacaaacgggaggacatgatggttgatgacctgattgccacctggatgtggaggagaaggcgcgtgcgaaagacacgccgactatggcacaagaagggacatcaaatgccaacctagtgcagaagtcaaatgcaaagaacaagggcaaacaagcagtgcagaaccataaggccaaaaacacaaccaattttaagaagaaaattacttgctatgtttgcggcttggaagggcacaaggccaacaaatgccgtgacaggaagggcaagaagaatgttcagcaagggcagaaaattgccaacatggttgtgagcgaggctgggtcttcagggtatgattctactcctgttgcactttcagcgtatcaatcctttgattggtgggttgatacgggagctaacattcatgtatgtgctgacattaatttattttcttcatatcaggctgcaaccggttcctccatcttgatgggcaatggttcaggtgctgctgttcttggagtagggaaggttgatctgaagctcacttcagggaaaatcatctctttgaagaatgtgcagcacgtaccatcaataaagaggaacttgattagtggctctctcctttgtcgagatggctataaattggtttttgagtccaataaagttgttatttcaaaatttggtttatttattggtaaaggctatgagtgtggaggcttgttccgcacatccttgttagactcctcaaataagtttgttagcaacattctcagtaattttaataaagatgctgttgtttggcattcaaggttatgtcatgttaattatgatagcatttcacgtatgagcagcttgaatttaattccaagcttttccatagtcagaggttcaaagtgccaaatttgtgtgtaagcaaagcaacctcgcaagccatttaaggcagtcgaggaaaggaatttggcgcctttagaactagttcattcagatctctgtgagatgaatggagtgatgactaaagcagggaaaagatactttctatcatttattgatgatgctactaggttctgttacttgtacttactaaaaactaaagatgaggcattgagctactttaaaacctaaaaggccgaggctgaaaaccaactagaaagaaaaattaaacgtctacggtcagatcgtggtggtgaatatgtgtcagatgagttctcccaattctgtgcggatcatggaataattcatgaaattacaccttcctattcaccccaatctaatggggtcgccgaaagaaagaaccgcactttgactgacttggttaacgccatgttagacagtgccggtatgtctaaggcatggtggggggaggctgtattaaccgcctgtcacatcctaaatagagtgcccactaaaaatagtgagatcactccatatgaaggatggaaagggagaaagccatcactatcatatttgcgcacttgggggtgcttggcgaaagtcaatgtaccaataacaaaaaagcgcaaacttggaccaaagactattgattgtgtctttctaggatatgcacataatagtgtggcctacaggtttttagtagtgagatccgatgtaccggatgtaccgataaacatggtaacggaatctcgtgatgcaacattttttgaggatatttttcctatgaaaggtacaggaacatcatctagtcgagcaaattcaacacctgaatttcctgtatatgtagaacaacatgaacatacacatgtggaggatgacaatgaaatggctctaacaaggagcaagagaccgaggattcaaaaatcctttggtgatgacttcattgtgtacctcgtggatgatgtgccgaaatccatttcagaggcatatgcatcacctgatgcagagtactggaggatgcagttcgtagcgaaatggattccattttagctaacgaaacttgggagatcactgatcgaccatttggttgcaagccagtggggtgtaagtggatctttaagaaaaaacttagacccgatggtactattgaaaagtacaaggtaaggcttgtggcaaaggggtacacgcaaaaggaaggcgaggatttctttgatacttattcacctgttgctagacttactactatccgtgtgcttctgtcgctggctgccttatatggtttcgttgttcatcaaatggatgtgaaaacggctttcctaaatggtgagctagatgaagaaatctatatggagcagcccgatggctttgtagcactcggacaggaaggcaaggtggttaagttattgaaatctttgtatggcctaaagcaagctcctaagcaatggcatgagaagttcgatcgaacattaacatccgctggtttcattgtaaatgaagctgataagtgtgtgtactatcggtttggtgggggagagggtgtgattttgtgtttatatgttgatgacatactcatatttgggaccaatattaatgtggtgtctgaattaaaatcatttttgtcccaaaaatttgacatgaaggatttgggagaagctgatgttatttcaaacattaaattgatcaaaggcgaggatgggattatgctttcgcaagcccattatgtggagaaagtcctaactcgtttcgggttgatggactgtaaaatagctccaacgccttatgacccaagtcttaagcttcgaaagaacaaaggactaggaaaggatcaattgagatactctcaaatcattggctctctcatgtatttggcgtgtgctaccagacccgacatctcatatgctgttagcaagctgagccggtttacttctaacccggagatgatcattggcaagcactagaacgcatattaagatacttgagaggcacaatgtcatatgggattcactataccgggtaccccgctgtgcttgaggggtatagtgactcaaattggatctcggatgccgatgagatcaaggccacgagtggatatttgtttactcttggtggtgctgcagtttcatggagatcttgcaaacaaacagttttgacaagatcaactatggaggctgaacttgtagcacttgacacacccactgttgaggcggagtggctgcgtgagctcttgatggacttaccggtaggtgaaaaacctatcccggcgatccttatgtactgtgataaccaaacagttctcataaaggttaagagcacaaaggataatatgaagtcctcaagacatgtgaaaaggcccctaaagtccgttagaagtttgagaaactccggagtgattgctgtagactatgtccaaaccgcaaaaaatctagcggatcctttcacaaagggattatcacgaaatgtgatagaaaatgcatcaagggaaatgggattgatacccatgtgagtcacacaacagtggtaacccatcctatgtgatcggagatcccgtgaagtaggtaatgggtaaaaacaaactgttgggtgacaggagagtacaaaactttcttacccgttcctgtcgaagatgcagtactctcattctgtatggtagggtgacatatgtcttaatgtgctctgaggttctcttagagacgaggtactgtcctacagggtacacttggaatagcacacctatatgagttaactgtggggtcgcagttttgagacatgggaactctctaaaaactcatgaaaagacacaggggcatgaccgataaacgccccaaccagaggcttggttcctggtggcctcgtatcagtaatgacttcaaaataaacttgtctacggaaagctagcaattcaaggtctgtccattgtctagctgtagatgggtggaacttaatgttctagacagtatgatcaacccttaatgggtctactgttgaaacgctggtatacaaacaacaaatggcagtttgtcgtaattaatcgaggactcaacatatggcattgaaattggtggggattgatggaaataacatgcttggaaacattgatcatttcatcaatttaaatgcctaatgcttagccgcacgatcagcatgtgttggatgacaagatgcttgcatacaacaacctctgctgatcgagtcaatcacctgaagacttggttctcacgtgaagagagaacgtgcgcttgtggccgtttggcggctgcgtttctcacggagccgatccggctttgacgcggaggagcaacggattgagcgtgggctgccgttcagtgttagctctatataggagtcaaggagacgtctttgaaggacacagaacacaatagccatctactctgaaattcctcaactgccgtcgtgttgcgtcgccgtcgatccaagccgaccgtggtgctcatcgtgcaacgagcattccggcgagcggtgtctccgagccttcgccgcattcgcacctgcacgggggcggtgtaaaggtttctgggcagcgtatttctacgcggccgctcgacatcatcgattgactgcactgcttcaactcgctgatctccgtcgatccattcagtgagtgaattctttcgtttacaaaggaaaggaaccagtgcatttctaatctagttttgttcgtacctgagttttgtatatgcatggtactgttcatctagattaaaatattgtggctagattaccattgtgattagcctaatgacctacttggcttggttatttatgccttgtttgatatctagcatgatagaatttatgagtttttcttgtcctatcatgtcgcaagtaggttatgcttgctgtatatgctttcaaataataatgcttggaataaaattaatggctaagtatgtattatttccaacagatataaccaaattgagtgtttcaagcgctcccccaacgaagtgccaataaggaagacaggagtagtaaaattcatttgcaaaggccagctcattaataaggatttggaacatgcggtcatggtcgttggcatcaccgagcatgccatggagcacaaaaccaagagccctttgggaaccatcctccactaagggatgtccagcaaaacgccgtctcaggctcttaaacaaggagaatgataggcaaagctccttgagtcctgactgagataccaatagaggatcaccggacaaccacatgttccaaatccggtctgttgttaacaacgtaaaggaagtagtagtgcccagggaggagaccttgatacgatagccatctggggttttctctaagtgctgcttctcttctcccatagttatgtaaggaggagggcttccattgttgtctttctcattatacacctgcgccatataccccgagatgaccttcacatttcggccaagagcaaatgagcacctcgctctctgaaaggcagccaatttgaccaaaaccttaatattgcagagcgcacatagaggcagcatgggacaaaaaagtagcaagtagggccaggtgtatgacaccagccttgttgtccatatagagtagtagtagtataacaccagccctgttgtccatatagagtaggcagaaagctccacaaaagtccgggagatgcttgtaccaccaagaagtgatcggccgtcggtagacaccgaaaggaaggccgtgtcggtattgatcttgatgatttgaatgaggacactccatcgaatgagggatcttgtgaagaaaaaaggcaagcactgcacaccatcaacaacattgtacccatgataatcaactaatcatcaacacgacaagcatcagataggtaatattggattttttttttgcctgaaatttctatatgaatgtaatttgttcagataatgtaacttgttttagttctgggttctttaattggtaagactactatctgcacgagggcagaactatactgttgagaaatctagctactatcactgaattaacggttggaaatacctgttgagattcatggttttggaaggagtagtactggggatatacatgagggcagacgacactttgagctttcaccttcgacatatagtgtgatatgattaggctgtaagcggaatgaacactacggaggcgccccactggagaaaccggagtgccggatggcggcaccggtggccgtatgtgataagcgccacctgcagcacggcgaggacgccggtggaagccattaaaagagagacgatgaggtactgaccgtggatgaatacgcttagatccatgatgatgatcagcagctacaataaatggctagttagctaagtggctttgcaagctcgaccttaagctagctcattccgcttccagatcgaacaggttggtatgtgtactgtttgaggggaggctgagcctgatattccttctgtccgttcacgcggaccacgcctttctctcgatgaacactccaaaatagtactatagtttccaggaaacttactttacaaatgtcatgatgcatctcctaatcgccagtaaataaatagagtttaggcccctttgattcaaaggaaattcataggaattttagatgatctcattcctatagaaaattttcctatatagccatttgaatcaaaggaatggatcttatagaatctgtggagattatggataccccatacctacacggcatgtatagtccgactgggtatggggtgccatgtatagatagaatatctttaagagaactcgggttaaattctaaacttgtatgtcaaggaaatatccgagatcctagtcggtcatgattgtattttatttgtaactacatattccgttagggatatggacggtattttgtaatacggaccccttcccctatataaggaggggtctgagtgcctctaggggcacgatttcctcccagatcatacgatcaataatacactcggtggatcaatccccggacaggagtagggtattacttcttgattaagaaggcctgaacctgtataaaattccttgtctctaaacccatccgcttttccagcttgatagccaccccttttagtattgccgaaatcttgtttcgacagttggcgcgccaggtaggggtagcgtcaagttcttcgccgactagtgcgatgggtttcgtttccggcatcgacgacttcatcttccctcctgggcaggcgtttcgtttcggcagcctcgacttcatcaccaacgacttcggcaagatttctctcctcaactcggattcgaaccagtcgggaagaggccagatctccgctccgttcggtatcccgaactcgcccgagatctaccccaagatcatctctaccgagttgacttcaaaccacttggacgagatccaatctacttcaaaatgacccgatcaagacaatggggcctatccgccaatcctgatgaaactccccgatgatttggctgctgtcttcaccacaagggcgtcttctccccgtaggcctaggcgggatccggcttcagccccggttcggcctagctccagggaagtcggcgtcatactccagccactcggcacggtttcgacgaaacaactggacggctacctcagctcccccggcgtcgactcgcgaccaacggagatcgtggagtacgacgacttcggctaccgctatgactaccgcaacctcaacgacttcgacgaaggctttgaagacaactacacgcctctctacttcggcatcttcatggctgacaacgagatggaagaatagcgcaaagcccgagaaacagaagagctacgcgtacaacaggaagccgaacgacaccgactagaagaggagcgccaagcacaagagcgagaacggctgcagcgtgaacaacaggaacgcgaacgggctgcaaaggaggctgaggaccgacgacaacgggccttggacgccgggcgacgagcacgagagcttatcgggcagcaagacgtcgagggaactgcggtttttcgcacccctcaacagaacgcggttgcagcgatcaccctcctcgacaccctcctcaaggaagacacactcaatcaagctaatcacgtcgtcaacatcttgaaccagaccaagaccatgatcgccgcctcggtcccggttaactctgcaagcgtctgcacgctgactggcagccgagttcctcatcttcgatctcaagactatcaccaaccgagcctcagcgtcgccggcacgggatccagtcgcaggagcaggggtcacgacgagcgatctgtccattcacctcccgaacggcacagggagcaccgagttgaacggcgacgctacccacctcgcaggcgccccgtcgatcttcacgatactatcaaccagcgtcgcgcggcacaaggctacgcaccattcaccaaatcgctacgacgacgacgtggatggagtcggtgcctttacaagtgacctgtgtcgagtggattggccagccggcttcaagccgactagaatcgagaagtatgacggcaccactaatccagagtcttggctcaccgtctacggtctcgcaattcgcgcagcaggaggagacaacaaagccatggcaaactacttgcctgtggctctagcggattctgcccagtcctggcttcatgggttaccccgtggcacaatcggatcatgggcggaacttcgtgaccacttcatcgccaacttccaaggcacctttgaacgccctggtacacattttgatctctacaacgtcattcagaagtctggagaatcccttcgagattacatccgacgcttttctgagcaacgtaacaagatctccgacattaccgacgacgtcatcatcgctgccttcaccaagggaattcgtcacgaagacctagtcagcaagttcgggcgcaagcctcccaagacggtcaagcagatgttcgaaaaagccaatgagtatgccaaagccgaagatgccattatcgcgtccaagcagtcgggcaccacttggaagtcgaagaaagatacgccgactacaggagggagtggaagtgctaatcacaaggatcgcaagcgtaagcccgaggaacttgtggcaactacaacactatcctcccgacaacgttcgcgcgtcaacacttttgacaagatcatcaactcccaatgtccgcatcatcccaattctaatcacgcggccaaagattgcttcgtctacaaacagtttgcagaacaatacaccaagaacgcacgtaaggcctccgacggagatcaaagcatgtcaaagaagaaggatgatgacgatgatgtcccgactggttttcaagaccatcgcaaggaactcaaccacatctttggcagacccctagcttatgaatctaagagaaagcaaaagctgaccgaacgggagattaacactgttcagcccgatacgccccaatatcttcggtggtcggagacaacaattaagtttgaccactcggatcatcctgaccgagtggtccacccggggcggtaccccctggtattagacccagtggttcgcaacgtcgagctttgcagatccctcatcgatggtggcagtgcactcaacatccttttcgccaaaaccctagacgacatgcagatccctcgcacggaattaatgccgagtaatgcgccctttcacggagtcattccagggctatctgccacaccactcggccagatcactcttctggttactttcggcactcgggagaacttccacacagaaaacgtctgcttcgaagttgctgatttcgagacagcgtatcatgccatactcggacgcccggcgttagccaagtttattgccgtcccgcgctatacctacatgatgatgaagttgcctggtcctcgaggagttatatccctgcggagcgacatcaagcaagccgtcacatgcgacaaggaaagctgcgagatggcccagacccgcgagatcacgctcgcccgaaaagaaattcgactggctgcgtccacagcaagcgaaggtgaagtgcctgcaaccaagatgccgaagagcggagaaagcgacgccaagaccaagaaaattcccctagatccctctgatcctactaagactgctgtaataggcgctgagttagattgtaaataggaaagcgctcatcacctttcttcaaaataataaagatatctttgcgtggaaaccatccgatatgcctggtattcctagagaggtgattgagcactttttacatgttaaggaagacgctaaaccaatcaagcaacaactccgccgttttgcgcaggataggaaggatgcgatcaaggaggaactggccaagctgttagcagcaggcttcatcaaggaagtccttcatcccgactggctggccaacccagtcctagttcagaagaagacgggacaatggcgcatgtgtgttgattacaccgacctcaacaagtcatgccccaaagatccctttgggttgcctcgcattgactaggtagttgactcaaccgccggctgcgagctactcagctttttggattgctactcaggatatcatcagatccgactaaaggaatctaactgcttaaagacttcattcatcacacccttcggggcctactgctacatcaccatgccttttggattaaagaacgcaggagcaacctatcaacgcatgatccagagatgtttttcaactcagatcggccgcaacgttgaagcttatgtggatgatgtagtagtcaagaccaagcagaaggatgatttgattatggatctagaagagacctttccgagcatccgcgctttcaggatgaaactaaaccctgaaaagtgcatcttcggagtactatcatggaagctgcttggatttatggtgtcccatagaggcatacaagccaacctggagaaaatcactgccatcctcaacatgaaactgccgagctcccagaaagacgttcaaaagctgactggttgcatggcagtgctcagccggtttgtttcgcgactcggtgagccggggatgcccttttctaagctgttgaagaaaacagacaatttccagtggggacccaaagcacaaaaagcctttgaagacttcaaaaaacttctcactactccaccagtcctagcttcaccacatccacaagagccgctgttgttatacgtgtcggcaactttacaggttgtaagcacagtcctgattgttgagcgtgaagaagaaggacatgttcaaaaagtccaacgaccaatctacttcgtttgcgaggttttggctgactccaagacaagatatcctcaggttcaaaagctattatatgatgttttaattatcgtcaggaaactatctcactacttccaaggtcactcggccacagtggtcacatcgtttccactcggggatatacttcataatcgcgaagcaaatgggcggatcgcaaagtgggccttagaattgatgtccttggatatatctttcaagccgcgaacttcgatcaagtcccaagctttagccgacttcgtcgctgagtggactgagtgccaagaagacatgcccaaggagaagatagagtattggactatgcattttgacgggtcgaagaggctcttaggcactggagcgggggttgttctaatttccctgaatggagaaagactgagctacgtattgtggatatatttttttgcatctcacaacatggcagaatacgaggcgcttcttcacggactaaggattgcgatctctttaggaatccgacgcctgatagttcgtggagattctcagttggttgttaatcaagtcatgaaagagtggtcctgccttgatgataacatgaccgcttaccggcaggaggtacgcaagttggaagacaaattcgatggacttgagctcatccatgttcttcgacataataatgaggcagacgacagactggctaattttggttcaaaatgagaaacagctccttccgacgtatttgttgaacatctttacgaaccaaccgtaccaaggaaataaacaattaaagccatggacactcaagacgtaagcatgattgaagccgactggagagagcccctcataagatttttgaccaaacaagaactccctcaagacaaggatgaagccgagcggatctccaggcgcagtagactctatgtcattcatgagaccgagttgtacaagaaaagtccatcaggaatcttgcaacgctgcatgtctttggaggagggaaggcaattgttaaaagatatacattcaggcatctgtggtaatcacgctgctgcacgaaccatcgttggcaaggcttatcggtagggttttttctagcccacagctgtgtccgacgttgacaaaattgtgcgaacatgtgaggattgtcaatttttcgcccgacaaactcatctaccagctcaggagttgcaaaccatcccgttgtcttggccgtttgcggtttgggggcttgacatggtcggcccgtttaaaaaggcagtcggtggttatactcacctctttgtggctgttgacaaattttccaagtggattgaagctaaaccggtcattacaatcacggcagacaaggctagagatttcttcatcaacattgtgcatcggttcggggtacccaatcggatcatcactgataacggcactcaattcacaggcggagtatttaaagattgagaaaatccatgaaatgccattgacaagcactctaatcccagaaatgccattgacaaacgcaacttcctcaaaatgccatcgtacaagcgtttttctccctaaaatgccatcacagccagtgctgttaactcctctccgttaagttgtatgaaaagacattcttacccctgggcaacctttgtgctaaaacaacattattttgtattgtttgctcacagaacattattttgaattgatgcatatttaaattcacagacgtgtattattttgctatcaatcaaattatttagaaattaaattcataaattttggcatcaaaattatttcagaaattttgctatcaattatcagggttgtgatatgagcaaaaataggggcatcaattatcagggcaacacacacagaaagtaccaatcatgatcaacatgaattttcacaaaataaagggttcacaatacttagcatcacaacccaatatcacagaaagtaccaatcatgatcaacatgaattttcacaaaataaagggttcacaatacttagcatcacaacccaatataaagagtacttagcatcacaacccaatataaagggttcacagtacttagcatcacaacccaatacaagagtactttgcatgcatgcttaatacatcttagttcagacaatacatgtgacagtaagaaactcaatcaattattctcctcttgcttctagtccccattgctggactactcttcttgcttctagttctcattgctggactgtcctgtggtacttcattattcttcctccttttggcaggtggagtagtaggttgtactgttggggatggttttctcttgattttcttgtctttgtcctccttttcacccttcttccccttaccctcccccttccccttcaccttctacttctccttctccttccccttccccttccccttccccttccccttggcaacaggtgcagcaacttgttgtagtggcacaatggtcatagagctgaaaaaaaagttatttagcaatcaatttaagttggcattaatcaagtgcaatgggtacagtaaaaaacataattggttaccttggtaaggatgggaaaggcacattattagactcaagtccagaatcactaattgtcccaacaacggcactttaaaatcatatattacacattagttaagttgctgcagcctaggagcaataaaaggttaacaaagtggaaagtggaagatagaaatttcaccttgataggctacccaagatttgacttgacatagcagtaggatcaatgttttcagtggcaacagtggcagcagaagtagattttggttttgatttccttttcagttttctacaggaaaatgaaaataagtgaagtttgttggcaaaggaaatcaacatgaagatatggatatagaaatcacctttgttttgccactaaagcataggcctctttggcttctggatctgcttctttgcaacttgtccatctatggccataatttttgcagataggacacttttgctgacatttggtacctgcttttctcttgcccttcttattcccctcaaccccacctttgtgccttaaagttttgggcctccctgcagatctcttcaatattggaggataaagaaagaaatcacgtgtattctttggccactgggaaatgtcagttagagctggaatgcgggctgcatatgtggctttaaatctggccacactatagcattcatcaacataatcatgcacctgcacccccctaatagatgtgatgaagcacaaggcatgagcacaaggctttccagacacttgccactctctacatgtacatgtcttctcttcaagatcaactacatgcctcttaccaccttttgtgaaaaatgcaataataagattatgtccatcaacattaataatgggaattgcaggtataaaaattcaatacgacatacaacataacattacctgggtctttatcagtaacctcggcaatgaaatcatcacttctatctaggtcaaagtttagtcctctacttttctcaagaagctccttcatgacacaaggtagaatgatattaccttccaatttggctgccaccttcttcctcacacgaaatttatccatcaccttttttctaatcttatcaaccaattcgtatggcataagacctttatgctttctgatccaattgttgaagcactccgctaaattgttggtgatgtaatcaaccttagagtgcgtggagaactcgcttcgcatccataacctacaaaataagcaaagacaaaatattacattcagcttcagttcacgtactgaaaaaacaagtattcgactaaaaaagataccttttgtggtgggttttcaagtatgctatagcttcagactttacttcacctattaaagccatatgttcatcgaattctgtaggagtccatgcatatgctgctggccataaatgttcctcaaaaactttgccatggaacttgagcttgaaattggacacaaggtgtcgcatgcattccctatgctctgcataaccaaatacctcttcaatagcatagtcaatgccttttcctgcatctgaacaaattgatagtccagctggttcaccaatagcttcatgcagtttctccatgaaccaaagccatgtctcactagtctccgagtcaataataccataggctactgggtacagccaattgtgtccatcaatagcacatgcagttgctagctgacctctatactttcctgtcaagtgtgtactgtcaattgctaagtatggcctacaacctcctaaaaaaccttgaatgcaagggtgtagtgccacaaatagccttgtgaatctcttcttgtccttgaatgtcatatggtcaatggcgactatacttcctggggacctcttctcgatctctgccttccaaccatatagcttgtcaaagctactatcccagtcaccatacaatttactcattgctaattccctcccagaatgtactctcttgtaggggatggttaccttatgtgtgtccttaatcctccttcgcagttccatggccccaacactagcatcctcacgtagccaccccataaccttatcacaaacccacgctctctttgcattcctgaccttctcgctttttctagtactaagaaaaccatggtacatctcatggaccttaatctgaaaaagaaaaaagatgcaattagataagaaaataacaaaatatgcaatgtaacacatacctgcactgctggaccaccatgaatagttgatgcatgaagcctccatccacatccttctttgatacatctagctctgaatctactaggatcagtttttttaacaaaaaactcgaattctttcttaatggaatattgagccacagccaatctaaactcacacattgaaggataaatagtctcaacagtcatgggtgggttctctttgtcatatgcaacttgtgggattactggatctgcctgagcatctcgtgcaatccactcttcatcatcactatcagtgatactcagatcatctcccccttctacctcaggcacattatcagtttcagcaatagagtcatcactctcagatgaagagtcatcactctccgatgaagagtcatcaataccaactgagtattgtttctcatcatctacacctacatgctcatagtgcgggaatggattttctaggtatgcatcacttttggatgcctgactagtgctgccttcctgagtaaaaaatgcctgagaggggactgaaagtgatggagtgcaaggcacaataacttgggacagattaatttggtttcccagagtgattaccactttaccccttttagtatgatgaaagcactcaaacattgctgtcaagtcctgatctttgcatattggaatgagttctttgctactagcatgaatataatgcaaacattcagtttcatttaaagcccatggattttttcacaaatatcacccagaaaatctttgaagttagttacgtctgcatcaataggccatttgaaagaaaaaccacccggaaattcaggcctacatgtcttgcccattattctcacgtcaagtaaataagtagaagatgggtccattctgttgatgaacacatcgtcgatgtgtgagaagaaaaatgtgaaaaatgtaactgctctgactccctaatacaagtatattactcatagggcataagatgaaagacatacccatccggaatccaagatgaatccatcccctcatgttcatgctccccttcactgtgctccaatccatctataattccaccacaatatctcattcacatcagtgtagtgcagattcttcaaatgaagccaaacaaaagaaggaaaatggacccccctgagagggatgggccacctgctgggactattatgccgctgccagtgacctcctcgccggcccctgtgaccaccgtaccggcgcatgcagcccccgcaccaccccttgtgccggccgcttgccacctcctcgcctcccgtcgcctgagagactaccgccgacgcgccgacgcctggagccgccgcgccgtcacctggaagcaccacatcgcagtcgagggccgccacaccgccgactgggagccccgcgccgcctggggccgccgcgccat

SEQ ID NO: 7227 - DNA, 6192 bp, Oryza sativa
  unsure (1)..(6192): unsure at all n locations
cgcggggcgcgcccgaactcggccacgccggcacagccgacggaaggcggcgcgcccgtgcccctatggtcgccgcgctcgaccataggcacgggcgcacgacggagcggcggcgtagagaggggaagggaaggggaaaaagaagcggcggtccacggctcaccccgagtcgactgcgacgacgtaaacggcgaccggagcggaagaagacgccggctcggctcgggtggacggggtcgacggtgctccggcggtcggcgtgcgaaacgtaggggtgcacgaggtcgccggggatgcggtgaagccgaaggtggcgacgccgaggcggaaggtggtccggggcgacgacggcggcggaccggagctcgccggtgacagcggagagagagagcgacggcgcgagctcgattccgacggggagaaaggccggcgagtgtcggaatcggtgaagggaggcacggggaaggtttatatagggttgggagggggagagaacggccggatgtgggggaaacgggcgcggaagatccggccgccattgatggcgccggcgaggtttaggggaaacgtttccgaacaaatccgagggagagagggagggaaaaatggggggaaagggagagggaatcacggggagtgatttccccctctttattgcgcgcggggacggcgggatgcggcggaatccgcggcggcggcggcgctagggcacggacgaagcggcgggtgcggcgcgaggacagggatgacaggtgggcccacccgtcagcggcacgcgcgcggggaggaggccgattgggccgcgggggagaggagagagagggagggaggtggaccaatccggcccaaaaggggaagggggggaaaaagactttttagggtttttctttttatgaaaccattttaactttgtttatttcttaataattattatttgtgctctgaaaattccactaaaatttgagggctccttttagaccaaggagaatttaacaaaaattctccgggccacatttgaatttttcttgtacgtattttagtgtttgctaatttcttttcgaattttaattaattctattattccttttagagaatgatttttatttcgggatgaatttatcaggacgtgacagaaatatccgagatcctagtcggttacgattgtattttatctgtaactacatattctgttagggatatggactttattttgtaatacggaccccttctcctatataaggaggggtctgggtgcctctaggggcacgatttcctcccagatcatacgatcaataatacactcggcggatcaatccccggacaggagtagggtattacttcttgatttagaaggcctgaacctgtataaaattccttgtctctaaacccatccgcttttccagcttgatagccacccccttttagtattgccgaaatcttgtttcgacagaatcctatgaaattcctatggaatgcctaatacaatgtaagtttgggaggaattctaacatgaggtagaacctcatggaaactttcctgtgagtctttatctcatctaattcatgtgtttttcctgtggtccaatcaaacgatcattactgtgtttttcctgtgttttgcaatcctctgttttacacttaagggccggcctgtttggcacagctccagctccagctccacccctcctggagctggagctcagtcaaacagtttcagctccaccaaaactgggagtagagttgggtggagctctctcacaaaatgaattagagttgtggagctgggtttaggcagctccacaactctactctagacccaactcttggagctaaatttaggagttggagttgtaccaaacaggcccttatattcctatcaaaatcctatgtttttcctattcctacgttttttcaatcttgcgattcaaaggggcccttagatacaacaattcgtcaaggaatccaggaaatatggaaggtgtgcacatggttttggtgaaccaaaacacagtgaaggacaaaagcatatgagtatatgtcagatctttataccttgggagattaattttactgtacctgagaaagtacggtatctaaattttagagggttgctacaaaacaggatcccgttgcaacgggatagacatattaactattatcttgcacgagtatcacaggtataaggtcctaaatatcataggtaccggataacagacatcacagatatcgggtaccatgtagctggtaccacaataggtatcaccgtatcaggtatcaggtactgtcacatagaagggtatcccgttacaacgggataccgttgtctaggttttctgaaattttacactaatattattttacctcgaagtatttagtatctgaaggtatcaaatttacataagaaaatatgacacattccggtatatattttcaaagagggataagtccaatttatgccctcaaacttatgtttgtctaaaatacaccctgaactataaaagcgggtattatacaccctgtaactatcaataccggatactttacccccctagagctgtttcagactggttttcgatggcacgtcaacatgagtcccaccagtcagatgatctctctttcgtttttttttctaagctcgctgaggagcggaagaagccagcgagcttcctccctctgtcggttccttccctggcatcctccctctgtccatcccaggtgacccccctccctgatccatcaacatccatggtgaggcgggggagatgctgcggcgagcgacggtacgggatatgacagggcagtgcccggaacagcgagaggtcctggtggtcgccgtcgcctccctcatgaatcacgagcttgctgtccccgaacgggagaaatggacctcgctagagccaccgcaggaggaggaatcatccctgtggagcgtcgctgccgcctggtcgaggacgaggagtcgctcggggaggaggagctcgagcttgccggtgataacaagcgcacatccgtcttcgtttccgccgtgatggcggcgtcacggcccctgccccggtactcgcgtctctgtcttgtccaagctcgcgccaccttttatctccccatcttctctgatcttggccaaggaggctggctctgccatcctcttcagcggtgagggaatagtgggagggacgagaagaaaacgcaatggcagatggatgcagaagttggggatggtacggatggatgcagagattgggattagtgcaactggtgtccacgagctagcttcgccattgccggtcgcctcgctcctcctctacgagctttgcctccggcgagtccactcgcaaccttgcctctgtgaactcccaagcttggtggcttgagagagaggggaaggaggtagcaaaaggaaggtcagagttcggtgaggattccaacggcggcaagccggcgaccatcgaggggagctctatagcggcgttccacagtgataattccgatggctgtgaccctcggggtgtaggtcagcgacagcactccacagcacaggtaaaattcggtggcgccgtggcaacgctcctctacatcgccgtcgagatatgcgagaggaaagatagagagatgaggggagtaagaggataagacttctgactggtagattaggcccactgttttttaaatattttttcattaatcggaatgccatgtcatttgctatgtagaccaaaaccgcctgatctaaaatgaggggatcaattgaaacgattttgatagttagagccttagaggatgttgaatacctggttttatagtttagggggcattttagacaaaggtaagaatttgagggtgtaaaatgaacatatccctgaaaagtactatcagaaaagtactaccagccaccggcgcgttgtgtcctcgtcggcgtgttcgtcttcctagacgttttctgttccattcggcgagatcgatactgcagtcgccggtcataaagcggacttcttgcccccgtcaccccgggagaaaaagccgaggcagcagcaggcgtccactagtcatcgatcagccagcgcaggcggaaaagcagcggcggcagagaaaagctcacgcgtggctcccaactcccaaggaagaatattccaccgagcacctagcttgtatcacgtgaatccaaattcacgtgatttttgctatacgcgcacagagccttctaccaggagattcctccatcattgcttcgtgcacacgagaagtgcacctagaggttcacgtttcagctaagtttacaccaacttcttactggcagctttagaattaattcccatgacgagtttaaattatgttcaaccgttcctataccgagacacaagattctcactacagatgatgcactatctgaattcgacataagtactaaggattggtccgacgatgagaaaaaaaaaggattgtaagactatagcatatattcatttcatctaacaattatttgtaggaggtatttaaggagaagacagtcataaagttgtggttgtgtcacgaccggaaataacccaacgggcgttccttacgtgcgtgtattattccttatcccaggaggcaaggtacaccaaaaattgatacatttcagagtttatcaagcggaagcgtaaatagttaatttattacatgggctgcgaaggcccagcacacacaaagacaaacgagaaacagcggaagactagggcgacgaccacaggcgcttgacggcaggcacgagctaaacaccaaagccttcatcttccagggactcctcttctgggtttggaaaaaattgagcaagactgagtacaaccaccgtactcaacaagacacacccacaagtgcagaataaatgcaagggagtacaagggggttataatataaagggttagggttggcagtaaacagcattaaaagacacttagttgctcaaagctattttgtaaacacgattctagagctatacaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgacatagttcccaacccatcctagccataaacaagagtaccgacccaaccccacctacggccggaacccccgggacaggtaggcaggactgagcccccagcagcaggacaccggccctgtgccatgacatctcgactaccgggccgtagctcgtgtagccttcatttgtcctagagatgtccatcgacctgctatattattatccccttgtacccctatattattatccccttgtacccccttgcattaattatgcatctccggtgtggcttgctgagtactgtggttgtactcattcttgcttaatcttttcccccccttcagtaagagaagctttggagaagaagtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgccttttgtattatgtttgtttggtgtaccccggcatttcctgggatggggattaatacactagcgttcgggaaaaggcaattttctcggtcgcgacacaaagggccggtgtcctgctgctaggggctcagtcctgcctacctgtcccgggggttccggccgtaggtggggttgggtcggtactcttgtctatggctaggatgggttggaaactatgtcatgtcttccgtccgtatgccgtggtggtatgtggcacgtggttacacgtgagaaagatgtgtcttgtgggtaaagatgtacacctctgatcagagtataacctattcgaatagccgcgtcctcggttatgggcaagccgagcaatgtannnnnnnnnnnnnnnnnnnnnnnnnnnnnnnnn

SEQ ID NO: 7228 - DNA, 1567 bp, Oryza sativa
cggcgcggagggtccggccgccatcaatggcgccggcgagatttgcgggggcaaatccgcccgtttgaacgcgagagagagagggaaaatggggggaaagggagagggaatcacggggaatgattccccccactttattgcacgcggggacggcgggatgcggcggaatccgcggcggcggcggcgctagggcgcgggggaggcggcgggagcggcgggaggaaggggatgacgggtgggccccacccgtcagcgagggtggcgggcgggcccgcccgtcagcggcgcgcgcgcggggagaggccggatgggccgcggggaagaggagagagggggagggagatgggccggaccggcccaagggagggaaggaggactttttagggtttttctttttataaaacctttttaactttgtttatttcttaacaattattatttgtgctctgaaaattccactaaaatttatttacgcattttaggcttttaggaaatatacaaaaatcctccaagccttatttgacttttaactttgcacattttaattgttggaggctttcacacggattttaattattctaggcttaatttcggggatgtattttagagtcgttttgggacgcgacaagaactgatggagcgcatgataaagctgaaagagcaaggcttgcaaggagaacaaatcactcggcacttcataaaaagtcggttagctccaatcaaagaaagatcccgcatagcttttgaatttgacggcaaacacgatccaaattgtgaagatccggactctcttaactttagggtcatgaagaaaaggatgtacatgatattctcaaatgctatcgtcgccagctattcgcacttgctgccagtcgtgccattcaatgcctttaatcctcctccaccggtaagtaatcaaacacttcaacttttcacaaaatacggtcttatctgtttgttgaatcagttaacaataaaagatatcacgcccaggaatttgctttgatgaagtcggatcccccaatcgctcaacaccaatcacctcaccgccaaactggtcagggaagcggaggaccaagaattcggtctgaaacccaaccaagtgcttctgatccagttggccagtcagattctcgcaagaggaagctggttttaagtgacgacgaaggcgataataccggaaaggagcgaccggaagacctccgaagccaactaatacgaagaagaaaaacaccagtcgtcctgtaccaaaaatcagaaagtcttccaggtacaaatcaaataacaaccttccttgtattaatattctcccatcatgaagataacaccgatggcaaaacttgtaggaaaccatccgacatagatccttctgagaaagactctgacccgactaacatggaagcagactcctcaaaagaaaccgggccgactgcaaaagataccccgagtaataatccgctggccagcgacaatgtaaaacccagcaacgaacacacgaccgcaagccagtcggccgaagctagagtcggagttaaccaggagcccccgactggaaaccagtcggatg

SEQ ID NO: 7229 - DNA, 2303 bp, Oryza sativa
tgaaaaaggcgctcagccaagccacccgcattataaatgtaagctctttggcgcctgatctcaaccatctcgtttgccatttagtccaggcgctaattaaactgtcttgcagaggattcatcttaggaacgaagctaaaacggcaaccttagagaggttagtccctcatctcgggaccctcgaagccaccaggaatcagctgcacgagacaaaagagcttgccaggaagaatgaacatgatctgagggatcggattgctgagctccaggaatccaattttgaactgagcccaactaacttatgttgttatctttgtaatcttgattaaccagagtcaatgtagtgcaagctgccaagatatctcaactagagaagcaaattcaaactctggaaaatgataaggcagaactagcaaaacagagggactcatctttaaaggaggttgaaggtaccaaataatcagtacctcaaaagccattatcttctatatgctgattcgttaatgtgaatctattgatgcagaccgcaagatcaagtcccaggcacagtttgatgtcttagtcgacaagatcaataggcttgaaggggccagggacaaagtcgctaatgccgctactccactcatccaagccatgttcttcaataacgccggtccgagtacacttgatgttgccgaaatcttcgacaagctgagagtcgctccggatacttacttcaagaacatcaaagaagttggaagtatgggagcaagtctggcattggcgatgaccaaatccctttatccaagagttgacattgatgccattgatggctttgcagatgggatgagcgaagaagctgctcttgacctcatcaatgatgcgcaaaaagccgctgacaagattgctgctgacgtggttgagagattccaagatgtcgaccttcggccgactgggtctgataattctgatgatgaaaaaactgatactgattgatataacaatgattttgatgattaatgatgatggaggctcaatttgtacaatactgatgaatttatgccatgcttggtgttccatacttagcttttgatttcttaaaagcctttgtcaagccttattgagcctaaaacccgcaaaagctattaaaaaccttcagtcctcattgactaagtcgaaagaccaaacagggcaatgataaatcaagtaagcaaattgaattgataaaaatcacactccattattatcatagtagccccccgactgaaaacttcaaggaaaaacttgaagttagcagtcaaagaggaaagatacaaacgaaatgcctaagcataaaatcgacgaagatgttcaatattccaagaattattgatgagagtaccatcttcgcgcttgaggcgataagaacctggccgagtgacttcagcaattatgaacggtccttcccataagggagataatttatgccgatcctgtgtggtttgaattttcctcagaaccaggtcgccgactaaaaaggctcgcgatcgaacattccgattatgataacggtccaacccttgcaaataccgagtcgactaaattaaagctgcttcacgggcttcttctagtcgattgatgtcgtctactcggccctcttcataacactcctcgttgaagttccgaaatcgtagtgattcaaattccacttcacttggcaacattgcttctgcaccataaaccaaaaagaacggcgactggccggtagcccgactgggagtagtgcgtaaagaccaaagtacggatggcagctgatctacccacttgccagcatagggacgtagtcggtcgaaaactcgtgcttttatcccttgaagtaccatgccattggcgcgctcaacttgtccattactcatggggtgtgccacagaggcataacaaattttaatgccaaagtcttcacagaagtctttaaatgctccgccagtgaattgagtgccattatcagtgatgatccgattaggaaccccaaaccgatgcacaatgttgatgaaaaaatctctagctttatctgctgtgatcgtgatgaccggtctagcctcaatccacttggagaatttgtcgatagccacaaagagatgcgtgtaaccgcctactgcccttttaaacgggccgaccatgtcaagcccccagaccgcaaacggccaggacaacgggatagtttgcaactcttgggttggcagatgaatttgtctggcaaaaaattgacaaccttcgcatgtccacacaatcttgtcagcatcagacacagctgtaggccagaaaaaaccttgccggtaagctttg

SEQ ID NO: 7230 - DNA, 9463 bp, Oryza sativa
  unsure (1)..(9463): unsure at all n locations
caaaaattttatgagaggttctctccagtcggtttcgatcatgcttacgccttgagtatccatggcttcaattgtttcttttctgggaacggttgattcgtaaagatgttcgacgaacacatcagaaggggctgcctcccgttttgaaccaagattggccagtctgtcggctgcctcattgttatgtcggagaacatgggtgagctcaagtccatcgaatctatcttccaacttgcgtacctcttatcgataagcggtcatattatcatctaaacaggaccactctttcatgacttgattaacaaccaactgagagtctccacagacgattaatcggtgaatgcctagagagatggcaatccttaatccatggagtagcgcctcgtattccgccacgttatgggacgcagaaaaatgtatccacaatacgtagctcaatctttctccagtcagggaaattaaaacaaccccagctccagtgcctgtaagcctcttcgacccatcaaaatgcatagtccaatattccatcttttcctctggcatgtcttcttagcactcagtccactcggcaaggaaatcagctaaagcttgtgacttgatcgaagttcgtggcttgaacgatatatccaaagacatcaattctaaggcccacttcgcaatccgtccgtctgcttcgcggttatgaagtatatccccgagtggaaacgatgtgaccaccgtgaccgagtgattttgaaagtagtgagataatttcttgacggtaatttagacaccatataataacttttgaacctgagaatatcttgccttggagtcggctaaaacctcgctaacgaaataaattggtcgttggactttttgaacatggccttcctcttcacgcttgacaactaggaccatgctcacaacctaggaggtcgccgacacatataacagtagcggctcttgcggatgtggcgaggccaaaactggtggagtggtgataagtttcttgaagtcttcaaaggctttttgtgcttcggatccccactggaaattgtcagtcttcttcagcagcttgaaaaagggcatcccccgctcgccgagtcgtgagatgaaccggctgagcgccgtcatgcaaccagtcagcttttggacgtctttttgggagcttggcgatttcatgttgaggatggcgttgattttctccgggttggcctgtatgcctctttgagataccataaatccgagcaacttccctgacggtactctgaagatgcacttttcagggtttagtatcatcctgaaagcacgaatgcttgcaaaagtttcttctaaatccgcgatcaggtcatccttctgcttggtcttgacgactacatcatcaacataagcttcaacattgcgaccgatctgagttgaaaaacatctttgaatcatgcgttgataggttgctcgtgcgttcttcaatccaaagggcatggtgatgtagcagtaggccccaaatggcgtaataaacgaggtcttcaagcagtcggactctcttagtcggatctgatgatatcccgagtagcagtccaaaaaactgagtaactcgcagccggctattgagtcaaccacctggtcaatgcaaggtaacccaaaagggtcttaaggcaagacttgttgaggttggtgtaatcgacacacatgcgccattgccccgtctttttccgaaccaagactgggttagccagccagtcgggatgaaggacctccttgatgaagcccgctgctaacagcttggttaattcctccttgatcgcatccttcctgtcctgtgcaaaacggcggagtcgttgcttgatgggtttggcgtcttccttaacatgtaaagagtgctcaatcacctctctaggaatacccggcatatcggatggtttccatgcaaagatatctttattattttgaagaaaggtgatgagcgcgctttcctatttacaatctaactcggcgcttattacaacagttttggtaggatcggagggatctagtgaaatcttcttagttttgtcattgccttcttcggtctttgacagcttggtcgcaggcacctctccttcgcttgccgtggtggcagccagtcggatttcttcgcgagcgagagtgatctcgtgggtttgggccatctcgcaactttctttgtcacatgtgacggcttgcttgatgtcgctccgtagtgatatgaccccttgaggaccaggcatcttcatcatcatgtaggtgtagtgtgggacggccatgaatttggctagagccggtcgtccgagtatagcatggtatgctgtcttgaaatcagcaacttcaaaacaaacgttttctgtgcgaaaattctcccgagtgccgaaggtaactagaagagtgatctggccgagtggtatagctgacaatcctgggatgacaccgtggaagggtgcattactcggctttaattccgtgcgaggaatctgcatatcgtccagggtcttagcgaaaaggatgttgagtgcactgccaccatcgatgagagtccgtcggagcttgacattgcgaaccactgggtctagtaccagggggtaccgccccgggtggaccactcggtcgggatgattcgagcggtcgaacttaattgctatctctgatcaccgaaggtattggggcgtgttaggctgaaccgcattgatctcccgttctgttagcttctgctttctcttagattcataagccaggggtccgccgaagatgtgattgagttctttgcgatgatcttgaaaaccagtcgaggcatcgtcttcatcatctttgttcttcgatgtgccttgatctccgtctgagggcaatgtccgcgacggtcagatatcatgcgggatacttaggctagagttcaatgcacgtggttggtgaagattccatatgcaatacgatggaggtattgtgtgtgtatgggatgcggagtcgaatttggaaggagtccaaatttggtatgattggttatgtaaagtttgtttcttgtacgatgaggtttcctatgcggattaggacttctagtatgagtttggtttgtggctttaggctgcctacctcatgtataaatagagagggagcgtgaggcttcccggtagtgctttttagagcaattgagttgatagtttagttagggtttcaagtttagtcaagattttggtaaggactgcggctgttgcactttgtaaacacagagagaagcaataaagttgtcatatactttgagagttcgtcgatttgtgttttatcggattcggtggtctaactagcaactcatcggcggtcagaccggcgacggcttcaggaggcagaggtgattccatggcagtccaaccagacgatcaacaccggtcagaccggtggcacaggcgcagtcagaccgatctacatcgattcgatggtaacttttatttcctcaagaagtttgggtttttgggtataccaaccattcaccccccctctggttggcttagttcttgtgtttcgatcctacaagtcgtatcagagtcttgttttcttctttggattttaaccgatctagagtttttgccatggctaataagtttacaactaagctccatgttttcgatggaacggatttttcttattggtgtagtaagatgcaatcttacattatggttgaggattatgatgtttggagaaaagttgctaatccttatgtgattcctgaacaaattaatactgctgctttaaaaactgagtttgaacaaaaatgcaaagctcgcaatattcttttgactgggatttctcattcggattatgattgtgtttctcatcttcaaaccgccaatgagatttgcaattctttgagaaattttcatcaaggaacaaccaatattaaagaacttcgtcgggatcttttcaagaaggagtacattaaattttagatgaaacctggagaagttttggatgactatctttctaggtttaacaaaatttttagtgatcttagatctgttgattcttcttatgatgttaattacacacaatcagaggtttctcgccactttttgaatggtcttgacatgtctatttgggagatgaaagttaaatctattcaggagtccgttgatatgtctactttgactttggattcggtttacacgaaacttaaaacacataagatgaatgttctttctcgtaaagttgattctaagtcggatgctttggtttcttgttcgacttttttggatgttggtgcttctacatcgaactcttctattcttgctttaattaatgccacgtccgatgatcaactcgaacagttcgaggaggattatttggctttggtttctaacagaattgcttgatctatgaataatgtcaggtataggaaaagaggtgtccaaatcgttgttttgaatttggtgctactgatcatcttcattcgcattgtccaaagcttgggagaggcaagagagatgataatggtggagacaataaggcgatcaaggtggatgaaaacaacaagaaggagaagaagaaaagtcgcaagcaaaggctaattcaagaactcatagaagctttggattctgatgagtcataagatgaggacaagagcaaaggtaaggaggttgttgatctagcttttattgctcgtaatgcaaattctgatgtggatgaatctgatagtgatagtgaagaaaagcttagttatgaacaattagaacatgctgcttttaaatttgctgagaaacttaaaacattttctattaatactttgcgagatgtcaattctattaattgcaagaaattggaatatgagattgaaaaatctaaaaatttgaagtcttcttttgctcttggatttgctttgcatgctcgtgttattgatgaattggtttcgacaaagaacgttttgacaaaatacaaagttgctttaagtgcaagttctttgttcaatgttttatgtgcaaaaagggctaaacaaaacaaagattttttgatttctcaaagttgttcaaattgttttttgaatgagatgaaattgaaatatgctttaggatgtgttgagcatatagaaaacattgtgaaaaccaatgaagtgctttcttgccccaaatgtcgtaaaagcaaaggtatcatggtagattgtgaaaattgtgctaatttgaaaaatgaggtttcttatttgaaaagttctttgcaaagattttctgatggtaagaaacaacttgacatgattttagatcagtctaaagtgactagttacaataggggtgttggttttgatgttcgtgactatttcaccaaaaatcaacccaatgttttgagtataacagaatgcagagaaattttgacaaaaccaagtgcaaagaaaacaatttttaaatctggtggaattttgccttctctttttgcaactttaaaagaaacaaaaataaatatttcaaaaccatctacttcacaaacttgtcgtgagaagtatatttgtactttttgttgaaaagatggacatttggttggtttttgttttcgtcttgcccgtaaacagaaaaaggaaagagaaattgcttttgcgaaacgacgatggcaaaaattgggttttggttcgaggagcacagccagaccgacactggccagtcggtcagaccggctagcggtcagactggcctcgtggtgattttgcacaaaattcagatcggacttttgtggagcgacaaggtaattatttaggtaagtctggttctgattttattagtgcatatgtacctactggttctactggttgtgtgactcagtgttggattccaaaatttcttatttctaatcccaacacagaggcctcgacatcttcttgtttgtaggtattttggtggcatactccccatgagtgttcagtgttgagatgacaattgcttttcaaaataacatcaatttatttttgaattgacataattccgttctactctctcgtttattagcttttcatatgctagagtttgaggtagttgttttggttaatataagtggatatatgtcaattcataagaattttggtgatatcattggcaattggatgtctttttcaaaatctttgatttcttttttatttttcttgggggagaattgaggttattttgagggggagttagtgctttttaataaagccttttggcatgatttgagggggagttttgtacctcatggttttaacaagcaaaaatatgacaataagaaaaattgagaaaagagatatttgttttatacatatggtattttcttgtgcatgctagcaatactatgaaggtttatttgtctctagaagcttgtatgtattctagtctttttatgagacttagatttttcttttaagggagataatgcatgacacttaaattctatacttgaattaagaaaatatgcaatattgatgctagcatatgatttgatttataaatgctttatatatatgctttattgaattgttatttctcaaatagctttgtaattgctctttgtgcaaagagaataaaaaatatctatgagagaaaaaaatgaatactgaatccttggaaactgaaaggaccttgatgtcgcctagagaggggtaataggcgttcctaaaaattatcacaacttcatagcatattagagagatgagaactttcggttcaaataggaacttccggtatgggattggaagttcttgtctcaaccgaaaggttcagcggataacggaataaaacactagctatgaacttgtagctcgaataaagaaaatgtatatgaatcaaaaggtgacaaataaggtatttaagcaagatataaggtcactaactatattaattaagcatgcaagtagatcgggtaaaaacaaactcaagcacaatataggagatggcaagaacgagcaaccaagagaggagacacgttgatttgtttcccgaagttcggatctacggatcctacgtctccgttgaggggccacaagggccgggtctatttcaaccctttactcacgaggttgcacaaatgcactcctcggtttcactcttgatttcttcccttgcggaggcgaaatcgaagccttcacaaactttccgtggcacaccacaagcttgggtgctcaccggcgacgcctagccatccaggagaccttagtccccaagagtaacaaacacaatcaaagatttgcttgctatgaactcgagtgctcaaagtatgaagtgaaactcacaagctctcaacttctcaatctctcaatcgaactctcttcccttcacaaattcctctcacaaagaggcaccacaaaggatggagtgaagctcactagctctcaactcctcactctctcaatccaactctctttccttctcaaatccccctcacaaagtggcaccacaaaggatgggaaatggagatggctatttggctttggatgtgtctaatgttgcccaagaatagcaaccactcaaaggagagatggaggagtttacatacccaagcccctaaaaaactagccgttagaggccaagactgtaatttttggaagttccgaaaagcattttcggatatgtctgaaaatttacagaagccaatctcagatttgcacccatttttggaatttctgaaatttttggagttttccaaaaaattttcggagttttcgataatttttcggaatttccgaaaagcacagagtaaaacgactataactttttgctcgggagtccgttttttctgatcttggactctatggaaagctcacttagaggactacccaactcaaccaagaataaggtctaaaaccactcaaaggattggttaaagcttaggtttctctcaaggtaccaatctgataggtcactttgagcaccgagacatacacaaacgcatcgacgttgcatccctcttaatagtacggcattcctatactcaaatgtaaataggaagataattataccaataggaatgccttctttccatttccttcctttgtcataagggatgccaacgccaaaaccgtttcaccgtatattcttcaaatgattgatgcggttacttatagcttcaaatagtctcgcacggtccatcatgacaaagctgtcactcgcccttcaccaccggatttggttcttcggcgccaagccccttgcttgcccttcacctccgcatggtccatcgcgaccgagcatcgcttgcccttcaccgttttgccatagtagccacttcgtatcccacatcttcaatatctccactttggcatcaacacctttgcaatccttgggacctatttctctcattcaactcaataaaattattagtcccaatgatccagttgtcaacctccacatgttgaccaaccgattgcatctataaaaggatatgaataaatgatgagtattaatcaacaccttaagtgccatatactcaattatatgctcacatgtaaagatctcaattaaataaaagtgaataacttggatcaagtacatgcataaccaaggtataggatttgctccccctaaatgtatgcatacaaaatatttttgtgagaaacaaatgtatgcataattagagataaaagattgtgaacttaccctatacaagaatagaagttattgatcatatgtgtacactaagatagaagcataccttcatcatctccatgttctcaatgtgaaaagagactaaacaagaaatggctcaaacaaaacattagtctcacatgcttatgtaatcacatgaaaatattatatatgaatatatcaatatgagcacggagagaaagaatgacatatatagcttgatctccatgcatttcatccttctgatttcggtacatgtcacgaccggaattaacccaacgggcgttccttacgtgcgtgtattattccttgtcccaggaggcaaggtacaccaaaagttgatacatttcagagtttatcaagcggaagcgtaaatagttaatttattacatgggcggcgaaggcccagcacacacaaagacaaacgagaaacagcggaagactagggcgactaccacaggcgcttgacggcaggcacgagctagacaccaaagccttcatcttccaggggctcctcttctgggtttgggaaaaattgagcaagactgagtacaaccaccgtactcaacaagacacacccacaagtgcaggataaatgcaagggagtacaagggggttataatataaagggttagggtttgcagtaaacagcattaaaagacacttagttgctcaaagctattttgtaaacacgattccagagctataccatattattaatcaaggccgtgaacccacacgaacctgccttaacccaaggcctacgatgatttagaccgaattggcaacccgaccctgggtcccagctcgtcccaagccaacccaggccaaccatnnnnnnnnnnnnnnnnnnnnnnnnnnnnnnnnnnnnnnnnnnnnnnnnnnnnnnn

SEQ ID NO: 7231 - DNA, 6577 bp, Oryza sativa
  unsure (1)..(6577): unsure at all n locations
nnnnnnnnnnnnnnnnnnnnnnnnnnnnnnnnnnnncggctattcgaatagattatactctgatcagaagtgtacatctttacccacaagacacatcttcctcacgtgtaactacgtgccacataccaccacggtatacggacggaagatgtgacatagtttccaacccatcctagccatagacaagagtaccgacccaaccccacctacggccggaacccccgggacaggtaggcaggactgagcccctagcagcaggacaccggccctgtgccatgacatctcgactaccgggccgcagctcgtgtagccttcatttgtcctagagatgtccatcgacccctgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggaagtgtgaatccaattccacaataatccatccattccaaagtgtccaggtgatgagaatattcccaaagtctagagttgtaaaaccacctaatgttgcctaattaaccagcgaagcatctacctaaaatcatactagtggtaccatgagtagagtgtccactagttggggttttgtttattctagggtgaacaaggaaataataacaataacaataataaggtcataacaaaggtaaataggcatggctagataaaacagtgataacgcgggaatttaaataaagcgataatgcaataatttaaatcaaaataattttataaactgggattcaatatgttcaaggatgatgtgacttgccttgctcgctttcccaaacgtcggcttcaacttccacgaagagcggatcttccgaagctgcagcgtctacacgaccaacggaaaagaaaaaggcttttactctaataaactccatataacaagcaggaacatagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaattaaaaaaaagatttattgcgtcagccgaggggagggggtgcgcggaccgggtccacgggggtggggcccacgcggcagccccacggtccacggtggaccgggcgcacccgggctcacaccggccggcgccgtgggtcccacgcgtcagccgcacccgagggcgcgggcggctgacggccgggccccacacggcagccgcagggtgcgcccgaaggcggccacgccggcgcagcggcgggaggcggcgcgcccgcgcccctatggtcgccggcggcggccataggcacggcggagcggcggccgagagaggggagggaaagggggaaacgaagcggcggtccacggctcaccccgggtcgacggcgacgacggaaaaggcgaccggagcggagaaaggcggcggcgcggctcgggtggacggggacgacggcgttccggcggtcggcgggcgaaacgaaggggtggacgaggtcggcgaggatgcggtgaagccgaaggaggcggcgccgaggcgggaggtggttcggggcgacgacggcggcggaccggagctcgacggcgacggcggagagagagagcgacggcacgagctcgattccgtcgaggagaaagggcggcgagtggcggaaacggtggtggggagctcggggagggtttatatagggttgggagtgagagagggcggccggagaaggggaaaatgggcgcggaagacccgcccgccattaatggctgtcacgcccggaaattcactagtaatttccgaactgatttgtgcataaaatcctcgtccaggaatcagccgaggtacacaaactgacaatttaatatacaaatccatcataataactaaactgataaatacttacttaagaggcacttagtcctcaccaagaagaaaaactgcagcggaaaataaaatctagcgaagctccggctccactcccacaggcagctcaactggggtataagccaaacgtcttctccttctggatcctttttcttcaactgaggttgattgattattgcaaaaatgagcatatgacatactcaacaagccacacagcaaatatgcaagtgcacaaggattccaaaggatggcataatataggctcatttgcaaaagcagcatttagcaaagagttaagagtagtaaaacagtagagtaattaattaaaaattttaatcaacactgaacagcacacccatgctgtacaggcccaaccatcctgaacaaccatacccggctgtacagatctaactccaaaccaggagctaagcaaattattatcaggtattaacatccataattattgtgagaggtgtgagactaatcacgaaaaacattgctcaacccgcccataaccgcgggcacggctattcgaatagttttactctggccagaggtgtaccactgtacccacaagacacaaccccacatcatgtcaccatgtgcctcaataccaccacggtacctcggaaaggagttgtgacaataccccttgcacaacataacccattacagcgcacctttcctggatcataatcaccccctcaaaaaccagaggcatggactccccagctacccccgtggacttctcgccacttctcagtctggcgcactataatgaatcacgctacacaaaagataaagccgttgcccacgctggcttgtggttggcacgataaatgtttcacaacagtagctcgcgaaccggtccttaattgtcatgagcacgactctcaaaaccatgtgctcacaacccaccattatcaagttttagttggcaagtaattaattaaccaatcacgattaaccatcgtgaactatcattaagccatccttaaataatagtgagtcataagttatcccaatagtgtgctaatgtttctaagcatggctaagcaatcataactaatatctagctgaaccaatatataaagcccaactagtcaagttataataacccaaggtatcaaggaataaagtaatcaatgcaaattggccataacaaaggaataagttcacaccacccggtgacattcgaaaataaatgcacagttgaaataaatagagaatttaaatataggatcaacatgctcaaaggattgtgtttaggatctgtgtgacttgccttgcaataatcggtcttcaagtaatcttcttgatcacttccgacgcactcacgaaccttcgcaacgacggaaacgacaagctaacacgcaaaacgaagaaaaagactaataaaaaccaaataaacagtacatataaagtaaacaaacatgtagatcatgattttagatgaatttagcaacttgaaccactcaaaaccgagttacgatgatttagttatgaatttccgaagatttaatctattagaaaaaactggaaaaggagaagatgatgacgtcatgatgacatcatcaatggccggaccaagatggcgacctcgccggagatagagcgaccggctgcggatttggaggacatgaacacgtagaggacgacgagacgaacccaaagatactcaccctcgtgccaaacgacgaccgacgacggccggcgacgaggaggcgacggcggcggctcgggttgcacggggcggcggagctccgatgaccggcgacggaaaaggaagggtggccgagcttcccctcaccacggcgcacccaacggtggtgacggcgaccggcgacgacgatggagacggcggcgcggcggcaccggagatggccggcggcggcggtttgcttggcggcggtggcgacgggactccggtgaccggcgacagcggggagagagcggccgggcttctccaccctctcgcgcacctaacggtggtgacggagctacggagcacggaagaggacgggagagggggcaaacgaaagaggaggactagggggtcctatttatagccttggattgaagagatcggactcctcccgcaagaaatcgatccgggaaatcaaaaactcggttttggagataaactcaaaaacgagttcgattcggataaaatactcaacgatttgctccgatttttggggtaaagatagaggaggataagaggaatatttcccctcaactaaattggaaaaaggagcaacggggaggcgagatttaacggaggaagcggcggctgcacagggcacagcacgggcggctcggctctgtccagagctggaagatgaacagtgccagggagggaaagtagactttctgctgggcttctacttccaaagactgattaaaggagggacaaaaagcagacttcgggaaagagaggaaaaggaatgcaggctgagaggagactgggccgagagtgagaggacttttcctaattcggcccgaaaaggaaaaggtgaattttaaatacttttccaattaaattaatcactgaaatgatctttgaattgttaaaaatacttcctatgctcaaataattccaagaaaaatcttgaaaatacttggacactcaaagtacttaacaaaattataattagaccatttaatgattaatttaatatgtgggtaattactgaaatgctctttgtaagattaaaaattaggaattgagctccgaaaaatccgagaatattccagagagtataattaaccatggagaatttaataaaaattaaatccatccatgctttatatttaggaaattttatttcccacatttaacttcacttgtaaattaaagaacatttaatataaattctattattaatttattaaataatttataaatcctgaaacgaaaatcaggatgtgacaaatctaccccccttacaaagaatctcgtcccgagattcggaacggctagaaagaaaagggcataggtaaactgcagtctatcttattccataactccgataattattctatggttttaaagaaagctactgctgctttggaactgatggctgagctgtatcccttgagacgcaaccggcactgcatttgctcctgtgaggacaatgttgttgacttggccttgtggctgttgacgcttcggcttcggacactcttttacgaagtgacctggctcataacaattgaaacacacccgatgctcccttccattactgttatcttcttgagactgatcctgctgaaatgacactgattgagtagcttgctcatcattgtcttcattgcttgcattagtctctgagttgatctcaccactgatgcccaactgttgtgactgttcttgacctgcagaaaaagattcaccaatttggagtggcttgatacgctgcctctggctactatcctgtgcctcctggaatacaatcattttccttttacggttatccatcctgttcttcttgtcttcaagtcgaattgctttgtcaaccaactcctgaaaatcctcatagtcatgagagatcaacataactgacagctcatcctttaagccttccaaaaacttctcctgcctttcctcgtcagtacgcacatcttctagagcatagcgagctagacgattgaactcatgaagatattccgtcacggtacgatccttttgcttaagtgcccggaactcacgcttcttcaaagcaacaacacctgcaggtatgtgtgtcttcttgaatccttcgataaactcttcccaagtgattggttgtccttctgctctgttcatccggaaatgatcccaccattctgatgcagattagaaaaggtagaaggagaggggttacactaaagacaagaccttaaccaggttaacactgatctgatgtgtgtagaccattatattgttcaagttgattaagcaagcaacctagtatagttacacactcatcaatgaactactccaatgatgggaatgcaaccatacctacacacaaagcaaacaacaagcgttctaccctactaactattcctcaaagacactttggcggcataggttctaagataggttccaaacttcactctatctgaacacttaagattcgactatcatcttattattcctcgatccacttgacttgcagaagttgacaacatcgacgtcttcgagtttctccatcaagattaacgactactcaagttgaaagaggaagggggaagaacgacaaaacgatttgcaaagaattctagataaggaagaaaggaaaattttcacaaattatgttttcggaaaattagtccttaaggtttgaccatttggcttatcctacagtcaagatggctctgataccaacttgtcacgcccggaaattcactagtaatttccgaactgatttgtgcataaaatcctcgtccaggaatcagccgaggtacacaaactgacaatttaatatacaaatccatcataataactaaactgataaatacttacttaagaggcacttagtcctcaccaagaagaa

SEQ ID NO: 7232 - DNA, 861 bp, Oryza sativa
tagattaactctgatcaaaggtgtacatctttacccacaagacacatgttcctcacgtgtaaccacgtgccacataccacccgggtatacggacgaaagacgtgacatagttcccaacccatcctagccataaacaagagtaccgacccaaccccacctacggccggaacccccgggacaggtaggcaggactgagcccccagcagcaggacaccggccctgtgccatgacatctcgactaccgggccgcagctcgtgtagccttcatttgtcctagagatgtccatcgacctccgacttcgtccatctccatccgtgtacttttgtttataaccagactgagccacaaactaagccttacccactagacatgtggaagtacggtagtgctttgcaacagaggcccgagcttaatccttatattggccggggtgctacttcccacaactggcatgcacccaaaccccaccggaaaacaggttttaggggttttgaaagaggaagagaggggtatgtccaattccaccataagccaaccattccatagtgtccaaatgatatgagaattcccaaagtctaaagttataaaaaccacctaatgttgcctaattaatcagcgaagcatctacctaaattcatactagtggaaccatgaatagagtacccactagttggggttttgtttatcctagggtgaacaacgtaatagtaacaataacaacaatgataaggtcataacaaaggtaaataggcatggctagataaaacagtgataaggggataatttaaataaagcgataatgcattaatttaaatcaaaataattttataaactgggattcaatatgctcaaggatgatg

SEQ ID NO: 7233 - DNA, 412 bp, Oryza sativa
  unsure (1)..(412): unsure at all n locations
actatagggcgaattcgagctcggtacccagaggagttaacagcactggctgtgatggcattttagggagaaaaacgcttgtacgatggcattttgaggaagttgcgtttgtcaatggcatttctgggattagagtgcttgtcaatggcatttcatggattttctcaatctttaaatactccgcctgtgaattgagtgccgttatcagtgatgatccgattgggtaccccgaaccgatgcacaatgttgatgaagaaatctctagccttgtctgccgtgattgtaatgaccggtttagcttcaatccacttggaaaatttgtcaacagccacaaagaggtgagtataannnnnnnnnnnnnnnnnnnnnnnnnnnnnnnnnnnnnnnnnnnnnnnnnnnnnnnnnnnnnnnn

SEQ ID NO: 7234 - DNA, 1373 bp, Oryza sativa
ttcttgtacgcattttagtgtttgccaatttcttttcgaattttaattaattctattattccttttagagaatgatttttaattttgggatgaatttatcaggacgtgacaaatccaccccccttacaagaatctcgtccccgagattcgaggaggctagcaagaagataggttgggcggtcttctcttcttgtctgacttcttgcgtcgcgtcttctataacgaacttgcctagcaaaacttctccactctggactgcttggctcgatctcctgttatagatggaatcgtctcttcacctgacttttccctggttgcacctctagctgacttcgactgggctgcggcattggaagatggggcttcagttccagaacttcttataactcatatctttggagtcaacctcatacaggttaccacttcatgttatgcgtcaacactagcttgtcattactaggataccatgtttgtcatcataagaatatcatgcttgtcatttacttctaacttgccaccaactgcctcatattagctttcctgctctccgggtgctagctacttctgctattcgatgcaagggtcggtaactttgcctttgaattatgtttctaaaaagaaccaacttatcccacttgacatgctttgacgtcttcccaaatggctttactgctggacttcttattgtctgatcgttatcctgccaaatctgaagcttcgttgttagatgtggttttaatctgacctctgtagactatcttcgaacatatcacttggttcataactgggaatagctctcatgaacaagcaactcggattcactttctttatgttcagtttactttccactattctcttcatgttgtcatcatttagcattcaaagtattcctttacacattcaaccctgatgtgttattttcagatttctcttatcttcgacctacttctttgaccggtaataaacacctttgctgttatcttctatcaatcaccttttgaactttgtcaaccaagtactcttcactccgagagttgtggatgcttctggtgacgatgtggtcctttggtctgctgcctttcagtgaaacctcgaagtgtttcgccaaaagctgtactgaccgtctttgcctttgatccgaaaaagacacatctgaaactctcagtctaaacaaaagtctctttggctttttaatccaacacagtttaatggctttcttttccatcaacaggttggttattaactcgaggttagaacatagttcctctgaaatcagaccctaggtctcctttgtcagtaaacaattatacacataatcccatatccacatcttccaaaagaatcctaatagaacttgtctgtattacacattt

SEQ ID NO: 7235 - DNA, 5030 bp, Oryza sativa
atttttcttgtacgtattttagtgtgtgccaatttctggtcgaattttaattattctattattcctcttaaaagatgatttttatttcgggatgtatttatcaggacgtgacaaatccaccccccttacaagaatctcgtccccgagattcgaggaggctagcaagaagataggttgggcggtcttctcttcttgtctgacttcttccgttgcgtcttgacaaacttccagcaaatctttacctttcggaactgcttggcttgacctcctgttgcggatggaatcttctcttcacctgacttggtccagggtgcaccttttggctgactcagactaggttgcggtagttcagtaatgcttccgttccagaacttctcatgattcatatcttcggagtcaacctcggacaagttatcaacttcatgtcatgcgtcgtaacctgcttgtcattactaggataccatgcttgttatttgcttctaactcgccaccaactgcctcatattagcttccctggtctccgggtgatagctacttcctgctagttgatgcaagggtcgataactttacctttgaattatgcttcccaagagagccaacttatcctacttgttatactttgacgtcttcccaaatggctttactgctggatttgttattgtctaatcattaccctgtcaaatctgaggcttcgttgtgagaggtgattttaatctgacctctatagactatcttcgaacgtatcactggttctataactgggaatggctctcacgaacaagcagctcggattcactttctttacattcagtttacttcccattattatcttcaggttatcctcagttagcattcaacgtattcctttacacttttaaccttgatgtgttctttcccattggatcatctcccaagacttggcattacctggtaaccggtgcttgcacttttcacttcgtgtagcatctgataccgagttgaagatttcactccttgccttcatagaaacacttttacctaggtcatcttgcttacttaatgacaaggtgactgttgcggggcaattacaatcaggggtcttccttgagcgatgcagagcatgtttctgtttatcaatcacctttcggcctacttcttttatgctagagaacatctttgccaatttcttttatcaatcatctttcggcttatctctaacaggtggtattctttaatgtggattgcggacgcttctggggatgatgaggtcctttggcttgctgcctttcggtgaaaccttgatgtggttcgtcaaaagctgcactgactaccttcagggaaatacattgcctgctatctgtatctataccactagggtttaattgccgatggtcatctttagtgcttcctcgagatggggagcatccaaattgttcttctgccacatcacctttgacctttttctgataccagataaactaattaccaaccatcgactattatgttcttcaaacattgatgtctcctggatctccttaactgttggcaggtatatccgatcttatcaatgtagaggcatggcgggtacccttaggggtttcatccaacaatccttatcttgatctgtaaaaggcgtatcccaactcctatcctcaactactgtctcgttggctttttaacccaacccagtttaattggttttcttttccatcaacaggttggttattaactcgaggttggaacatagttcctctgaaatgagaccctaggtctcctatgtcagtaaacaattatacacatgatcacatatccgcatcttccaaaagaatcctcttaggacttgtttttattacaaatttctcccatattacatgaatacaaggcactgccttaaacaaaaagggacggtgcttaacatcggtacattgtatcctcaacatgaatcatccctaagcatagcaagctcactgtttatagacatgaatgtatttctgtattacatgattgctgccaactttcgattacaccatgataagtagcggactgaaaaccacaaacatggctgctcattttgattctggagagatatagctggcattgttccagtgactgcatcctcgattggttctgtgatgatgtgataggactgcataatgctatcattcacaggagaagcttccttctgattgctggttgaagcggatgacggtcttctgcttggtatcgccctccggatgttgattgcccttggctcggcctggagtaggtcggggagagacacaacttcttccatctacgacaattctttgctgaggctgtcggtgcagagaatggttgctatgatttattgccgagtcaggtgcagcaggaggagcattggtgcattgtttctgctatgggttatgattaacacgaggcctcacgggtatggcgtttgctccagtgaccacaaggccgagtgacttgtcttcttcttgcataatggccggagtgatgacgcaggttacgcttcggctgtggacaatctctggagaaatgacctggttctttgcagttgtaacaaatcaacgtcttctttgctgagttgtccgtctgggaacgatcgttctgactaggagttggaattggtggttggaaatccttgctaacattggcatcagtggtgccattattgctatcaccattggagtctttctcagagtcaaaattgctagggttgtcattctgggtgccttcattgatactatcgtcgatatcttggtgaatgatgttgacattgcacgcttgatctaagtggtcatgaatggggcaagaaccatggttgttggtggtatcatcatcattagtattgctagtgttgttgtctgcattgcgtccgtcttcttggggcaggaactcttgatgcacaacagaagatccggtgatctgaagtggctcagtgcgctgtctttggttaccacatggaattactgggatgttgacaatccttctcttgcagttcgtcatccgattatgctcactttcgagttgcacggctttgtccacaagtttctcaaaatcttcataatcctctaggagtagttgcactgcaagctcatcttttaacccctggagaaacttctcttgtttgtcttcatccgtttccacatcttctggtgcatagcgagccaaacgatagaactcgtgcaggtactctgtgacggtcaaatctccttgcttcaggtagcgaaactctcgttttcttagtgtgaccattcctgcgggaacatgtgatctcttgaatacagatgaaaactcgttccaggtgatagtatgtccttctggccgtgatgcttcgtagctatcccaccactctgaagccggtccaaccaactgatgagttgcgaagccaacccgctcctggtcggtgcactgaatcaaccctagcttcttctcgactgtgcgcaaccaatcactggcttccataggatcgacggcaatggcaaaggttggaggctcagttttgagaaattctgataacttgcactgttgctggactgtaggtacttgaacgttggttgcccctgctgggttgttccaattctgtaatagttgaaaggctgttgccaacatgttggtttggttaaccacaatttggattagctctggtgaggttttgttgatgcttttctcattcccattggcttgggttcttgagtcatcggatccatcattcccatagcctttgttaccagtgttatccatctgtcacaaggtagaggttgagaggggaagcatacaaggaaagaatagaccagaactagggacaagaccttaaaggaactaactctttttgttgatgtgttgtttgtttcacttattctgcaggttgattaagcaaacaacctagcatggtcacatcacaacccaccgatgcagaccacgcactacacacacaagcaaggaaacacacgactaacaacactatcctagaggacggcttaggttctgcgactggttctccaagatcttcactcctgcttcacagctggcttcattgcttccttcgcttcgctagcggaccctgcggtcttccggagcttcggcagacaattggcgacatcttcttcttcgcaaaactaaccatctagtactggttgaaatttgaagaaggaagaaagagtaaatattttgcaaatagcacaggggaaaggaggaaaaagggcctttcggaaatagtttcatttataaaatatgtccttaggttttatccacttggcttatcctacagtcgagatggctctgataccagcttgtcgcgaccgagaaaattgccttttcccgaacgctagtgtattaatccccgtcccaggaaaagccggggtacaccacacaaacatgatacaaaaggcacatctttattatatcgataatatttacattattacaaaggcacttaaggcctgacaatcaaaaataaacagcagcggactagcgggcctacggctccatcttcacaggcgctcaactggggtataagccaggactccacctaagacttcttctccaaagcttctcttactgaaggggggggaaaagattaagcaagaatgagtacaaccacagtactcagcaagccacaccggagatgcataattaatgcaagggggtacaaggggataataatataggggttaagttttgcagtaaacagcatttaaaagtcacttagttgcccaaagctattttgtaaagacgatcctagagctacacagtattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacatac

SEQ ID NO: 7236 - DNA, 3891 bp, Oryza sativa
  unsure (1)..(3891): unsure at all n locations
acttgcactgttgctggactgtaggcacttgaacgttggttgcccctgctgggctgctccaattctgtaatagttgaaaggctgttgccaacatgttggtttggttaaccacaacttggattagctctggtgaggtttcgttgatgcttttctcattcccattggcttgggttcttgagtcatcggatccatcattcccatagcctttgtgtcacgtcccaaatcgactctaaaatctgtcctcgaaattgtgcaaaagaataagtaaaattcatgtgaaagcctccaacaattaaaatgtgcaaagataaaagtcaaatgaggcttgtaggatttttgtatatttcctaaaagcctaaaatgcttaaataagttttagtggaattttcagagcacaaataataattgaaaagaaataaacaaagtggaaaaggtttataaaaagaaaatcctaaaagaagttcttttccccccccttccctcttgggccggctcggcccacttctccctccctctctctctctcttctcccgcggcccatcggcttcccgcgcgcgcgcgcgccgctgacaggcgggcccgcccgccactctcgctgacgggtggggcccacctgtcatcgcctttctcccgccgcgcccgccgccgcgtccgtgccctagcgccgccgccgccgcggattgtgccgcatcccgccgtccccgcgcgcattaaagagaggggaatcactccccgtgattccctctcccgttttccccgatttcccctctctctctccctcggattcgttcgaatcgtgcccgcattcgtcgccggcgccatcaatggcggccgaaatccccgcggccggtttccttcctcctcggccgccctctctccctcccgttgctataaaatcgtccctcgtgctccgctcttccgtttccaccgctcgccgctcgctctcgccgtcggattcgtgctcgcgccgtgctccgctctctccgccatcgccgccgagctccgttccgccgccgccgccgctccggacttcctccttactcggcgacacctccgtccgcttcgccgtgtcgccgtcaacctcgtccgcgcctccgtttcgctcgtcgaccgtcggagcgccgccgtcatcgtcatcccgagccgcgccgccgtcttcctccgctccgtccgccgtttccgccgccttcgctgtctcggggtgagccgtggaccgtccccttcgtttcccccttccctcctctctctcgggtgccgctccgccgcgccggtggtcgccggcggcgaccatcggggcgcgggtgcgcgtccccctcccgtcggccgtgccggcgaggccgccttcgggcgtgccctcgcggctgccaagtgggcccggccgtcagccgcccgcgcccgcgggtgcggctgacgcgcgggacccacggcgccgaccgccgccagccgcgtgcgcccggtccaccgtggaccgtggggctgacgcgtgggccccacttcccgtggacccggtccgcgcgcccgctccctcggctgacgcaataaataggatttttaattgaaaattaaatgaagaaattcgcaaatatccatttaaagagcatataaacttcaaatggccatatcttggccatttgaactcggaattggaccgttcaagtctctaatttttccttaagatgtaaagaacccatttttgtgctttgtttctgctgttatgtggagttatttagtgttaaagcctttttcttttccgttggtcgtgtagacgctgcagcttcggaagatccgctcttcgtggaagtcgaagccgtcgattgggaaaacgagcaaggcaagacacatcatcttgatcatattgaatcccagtttataaaattatgttgatttaaattattgcattatcgctttatttaaattcccgcgttatcactgttttatttagccatgcctatttacctttgttatgaccttattattattggtattgatattaataccttgttcaccctagattaaacaaaaccccatctagtggacactctatttatggttccactagtatgaatttaggtagatgcttcgctgattcattaggcaacattaggtggttttataattttagactttgggaattctcatatcatttggacactttggaatggttggcttatgttggaattggacacacacctctcttcctctttcaaaacccctaaaacctgttttcggtggggtttgggtgcatgccagttgcgggaagtagcaccccggccactataaggattaagctcgggcctctgttgcaaagcactaccgtacttccacatgtctaatgggtaaggcttagtttgtggctcagtctagtcataaacaaaagtacacggattggagatggatgaagtcgggcgtcgatggacattctccagggcaaatgaaggctacacgagctgcggcccggtagtcgagatgtcatacggcagagggttggtgcccaatgctaggggctcagttctgcctgcctgtcccgggtatcccggccgtaggtaggattgggtcggtactcttgtctaaggctaggatgggttggaaactatgtcacgtcttccgtccgtataccgtggtggtatgtggcacgtggcaacacgtgaggaagatgtgtcttgtgggtaaagatgtacacctctgatcagagtaaatctattcgaatagccgcgccctcggttatgggcaagcctagcaatgtacccaagtcagtgttttaattcttaaaatttgctcaacaactaaaatgtggaatggttggcctgggttggcttgggacgagctgggacccagggtcgggttgccagttcggtccgaatcatcgtaggccttgggttaaggcaggttcgtgagggttcacggccttgtttaataatactgtgtagctctaggatcgtctttacaaagtagctttgagcaactaagtgacttttaaatgctgtttactgcaaaacttaatccctatattataattcctttgtactcccttgcatttattatgcattcgtgggtgtgccttgttgagtacggtggttgtactcagtcttgctcaatttttcccaagcccagatgaggagttcctggaagatgaaggcttcggtgtctagctcgtgcctgccgtcaagcgcctgtggtcgtcgccctagtcttccgctgtttttcgttgtctttgagtgtgttgggccttcgttgcccatgtaataattctatttacgcttccgcttgttaaactctgaattgtatcaacttttggtgtaccttgcctcctgggacaaggaataatgcacgcacgtcaggaacgcctgttgggtgatttccggtcgtgacactttgttaccagtattatccatctgtcgcaaggtagaggttgagagggaaagcatacaaggaaagaatagaccagaactagggacaagaccttaaaggaactaactcttcttattgatgtgttgtttgtttcacttattctgcaagttgattaagcaaacaacctagcatggttacatcaccacccaccgatgcaaaccacgcgctacacacacaagcaaggaaacacacgacaaacgaaacactagagggtggcttaggttctgcgacgggttctccaagatcttcgctcctgcttcacagctggcttcactgcttccttcgcttcgctagcggatcctgcagtcttccggagcttcggcaaacaactgacgatatctttttcttcacaaatctgaccaactagtactaattgaaatttgaagaaggaagaaaagagtaaaccttttgcaaatagcattaggggannnnnnnnnnnnnnnnnnnnnnnnnnnnnnnnnnnnnnnnnnnnnnnnnnnnnnn

SEQ ID NO: 7237 - DNA, 588 bp, Oryza sativa
  unsure (1)..(588): unsure at all n locations
nnnnnnnnnnnnnnnnnnnnnnnnnnnnnnnnnnnnnnnnnnnnnnnnnnnnnnnagtgttttctaggatgcgatccaaaatcgtttttccttctgacggcgtcttgtgcatgaacgatcctccagcggttatgtccagatagaatgcagactcctaatccaaacccgtatgaaaatgctggagaagcacatactcgggtaaggaccgggttggtccggactgcactaaattagtgaatctagaccaagctgcaccgattgattcgttttcgatctgcttgaaactgagaatttttactcgaagggcggtaatacgggtgactgggaagaaggcaagacataatctgtctcgcagctttttccagctaccgcttacacatccaacggtagaggtgtaccattggtttgctctctcttgaagaggtcaccgcacagtttcttgtctcatgccacgaatcttaaggcatgagtagacttgtcaaagtctcgcagatgatagtagggattttctagatcacagccagaaaagggattttccctaccatactaattagctcgagacaattttatagccagttgtataaatgg

SEQ ID NO: 7238 - DNA, 3738 bp, Oryza sativa
agacagtataatctggagcgagggtaatctggtcattctggtaaaaattaaaattctaacggcgtggactaaacggtaagtttactgtgatggcattttagggagaaaaacgcttgtacgatggcattttgaggaagttgcgtttgtcaatggcatttctgggattagagtgcttgtcaatggcatttcatggattttctcttaaagatttatgtgaggacttcggcatcaaaatttattatgccttcgtagcgcaccccatgagcaatggacaagtcgaacgtgccaatggtatggtacttcaaggaataaaagcacgggttttcgaccgactgcatccctatgccggcaagtgggtagaacagctgccatctgtactttggtccctacgcaccactcccagtcgggccacgggccagtcgccgtttttcctagtttatggagcggaagcaatatttgccagtgaggtggaatttgaatccctacgtttttgcaacttcagcgaggagcgctacggagaagaccgagtagatgatctcaaccgactggaagaagcccgtgaagcagctttaattcagtcggctcagtacttgcaaggcatgcgccgttatcataatcgtaatgttcaatcacgagcttttttagtcggcgacctggttctgagaaaaattcagactacacgggatcggcacaagttatctcccttataggaaggaccattcataatttccgaagtcactcggccaggttcttaccgactcaagcgtgaagatggtactcatattgacaactcttggaatattgaacatcttcgtcatttttatgcttaggcattacgtttgtatttccctctttgactgctaacatcaagtttttccttgaagttatcagtcgggggctactacaataataatggagtgtgatttttatcaattcaatttgcttacttgatttatcattgccttgcttgatttcttggcttagtcaatgaggactgaaagttttttaataatttttgcgggttttaggctcaataagttttgacaaaagcttttaagaaatcaggagctaagtttggaatatcaagcacaacataaattcatcagtattgtacaagttgtgcctccatcatcatcatcattgttatgatacaaacatcaatcagtatcagttttttcatcatcggaattagtagatccagtcggccggaggtcgttgtcctggaatctttcaactacatcaacggctatcttatcggcggctttctgcgcatcgttgatgaggtcaagggcggcttcttcgctcgtcccgtctgcaaagccatcaacggcgtcaatgtcaatcttcgggtacaaagacttggtcattgccaatgctaggctcgctcccatacttccagcttccttgatattcttgaaatatgtatccggagcaattctcagcttgtcaaagatttcggaagcgtcaaatgtactcggaccattgttattgaagaacatcgcttggacaagtagtgtagcgacgttggcaacttcatctctagcttcctcaagccttttaattttgttgaccaagacatcaaattgagcctgagatttgatcttgcgatctacataaatagatttatatcaatgagtgggcataaagaaaggaatggtttttaaagtataggttacccgcaccttcaacatatttcagagccgaatccctttgtcttgccaactcggccttgtcattctctagagcttgtatctgcttttccagttcggatatcttggcggcttgcactgcattgcttcttgttggttgatatcacatggatggcagcataagtaagttagacaaagattgtatttaccttttgacgaactgctcatctcaaagttggagtcttgaagctcggcgatccggtccctcagatcatgctcagttttcctggcaagctccttagtttcgtgcagctggtttctagtggcctcaagggttccaagatgaggaactaacttctcaagagtcgtagtcttcgcctcgttcctgagatggattctctgcaatgcgaatttatcggcatttgagcaaagtggctaataggttgattgaagctgtgtataaggaggcttacatttacgaggcgagtagcttggccgagtgcctttttcagcaggcatacttcctcatcttccttttgcttgtttatcacaattccctgaggttgcatgtcgtcatcccaccacttgactaaaatgggtgggcgagaatgctcagctgactgtatctggaggacttcttcttcgtcaccgatcattgggcattaggcattcatgaataaaggtgaaacaattgaagaaagtctgtcagatcaaaacgggttcggaggatgtgtttacctgtaatgatttccggtcggggacgagcaggcccttgtactttaacaggagagctggaccttggatcggcgctggcatcctttttaggagggctgtcagcttgagcttctacatcaggaatatctttatttggttctgtacccgactagtttccagtcgggggctcctgattagcaccaattccagcttcgaccgactggttcccagtcgggggctcgttgctgggttctacattgtcggttgccggttgtttgtcacttgggtgatcctctgcagttggcccggtttcttttgaagggcccgtctccatgtcagttggcttggagtcttttccagaaggatctatgtcagacggcttcctacgaatttgagttatgccattagtgctatttcaacagtgggtgagcagcaatacaaggaagatggccaaatgatttgtacctggaagatttcctgattttcggcatgggatgacgggatgttttcttcttcggattggtttgccttggttgttttccagtcacctctttattgccagattttccagcatcatcgccctcatgatcactcagaaccaatttcctcttgcgggagtctgactggctggctgatttcgaggtgtttggttgagtatcagaccgaatttttggtcctccactcgcctgaccagtctgccggcaaggtgatcggtgttgagcaatgccccacgtcctgataaatccatcccgaaataaaaatcatcttctaaaaggaataatagaattaattaaaattcgaaaagaaattggcaaacactaaaatacgtacaagaaaaattcaaatgtggcccggagaatttttgttaaattctccttggtctaaaaggagccctcaaattttagtgcaattttcagagcacaaataataattgaaaagaaataaacaaagttgaaaaggtttataaaaagaaaatcctaaaagaagtcttttccccctcctcctcccttcttgggccggctcggcccattccttccctctctctctctctttccccccggcccatcggctcctcccccgtgcgcgcgccgctgacaggcgggcccgcccgccgctctcgctgacgggtggggcccacctgtcatcgccttcctcccgccgcgcccgccgtcgcgcccgtgccctagcgccgccgccgccgcggattgcgccgcatcccgccgtccccgcgcgcattaaagagaggggaattactccccgcgtttccctctcccgattccccctcttttccctctctctctccctcggattcgtccggattcatcccgcgaagtacgccggcgtcttcaatggcgcccgagatctccgcgcgcgg

SEQ ID NO: 7239 - DNA, 778 bp, Oryza sativa
  unsure (1)..(778): unsure at all n locations
nnnnnnnnnnnnnnnnnnnnnnnnnnnnnnnnnnnnnnnnnnnnnaacttcaaatggccatatcttggccatttgaactcggaattggaccgttcaagtctctaatttttccttaagaagtcaagaacccatttttgtgctttgttcctgcttgttgtttggagtttattagagtaaaagccttttcttttccgttggtcgtgtagacgctgcagcttcggaagatccgctcttcgtggaagttgaagccgtcgtttgggaaagcgagcaaggcaagtcacatcatccttgagcatattgaaatcccagtttacaaaattattttaatttaaattattgcattatcgctttatttaaattcccgcgttatcactgttttatttagccatgcctatttacctttgttatgaccatattattattgttattgttattattattaccttgttcaccctagattaaacaaaaccccaactagtggacactctattcctggttccactagtttgaatttaggtagatgcttcgctgattaaataggacaacattaggtggttttataactttagactttgggaattctcatatcatttggacactttggaatggttggcttatgttggaattggacacacacctctcttcctctttcaaaacccctaaaacctgttttcggtggggtttgggtgcatgccagttgcgggaaggagcaccccggccactataaggattaagctcgggcctctgttgaaagcactaccgtactttcacatgtcta

SEQ ID NO: 7240 - DNA, 1135 bp, Oryza sativa
cttgagggtggaagagaaaatacgccatagaagaaatgagaaaattccacgacttcatgtgtggggggggtcgggaatgctttacccaacgccggatgtcatccaatgatctctttgcccggagaacgccgtgcgccaccttctccttcaggttcttctctgttacatcggagggcacccactgactctcgaagctttctctctcttctgccatgaatacgaactggatgatgtgatttggtccgagatatggctgggaatggatgggggatcgatgcggtggttgcacggaaggtttttgtggagctcaagaggatggatcggagtggatttgttaaccctagctttcgccgttgtggttttgcactgtagcagagaatggggaaagttgcgagagtttcggcggggaagacgaaacgacgctctgacttcggcgtttatttcgctagggtatcaggagtgctaatgtgcctgggcctatacagtacttgtaacaccctgaaaattcgacgacaaaaatctaaactctaaaaatacggattttcaaaaactttttaaattaattgcatcatgccgatcttattcgcctattttatttgaatttgatctcgaagtttattaatcgtgagtaaagattagttgtggataggaataaataaagtattatcgcgaccatatttggatcaattaaatttaaatatgatggaataagaattaaccctaattaaaaattcaaataaattatataaaaataaaatatgagtaatattaatctagggtgaattcattagttgagataacacaaatattgagtaaaatgcatatatccaaaaattaggaattgtggaatcaaatttatatgggaaatacactaaaatcgggataaataggaaaagccactattcattgccccctaggtgttcggtcgcgttccctagccctagcccctactctgccgcgttgccctcgcgccccgctcgccgcgcgccggtccgccttccctctgccgtcgccgtcgccatcaccgcgcgtgccgccgtcgtctcgccgcccgcccgtcagcatcgccacctgcccgcgcgccgacgttaccgagccgccccgagcccgcgccgacgccccgtgccgcgcgtgc

SEQ ID NO: 7241 - DNA, 403 bp, Oryza sativa
cgctccagaagccggccagcttgagcgccatcttggcgaggccgagcacgcagaaggcgatgaagatggccttgttgacaatgcccagccacccggcgaccgggatgcacaggtagatgagataggccaaccaggcgtactgcgcgagtagctccaagggtggccgcaccctctggccgtcgatgctgacgtctccggaggcagggaaggccgcggacatggcgacgccggccgacgccacgtcggcgttgcccttgatgaggatgatgagcgctatccacaggaggagcgtccacatgttctggatgtctgggttgctcttccctttcgccggggcggtgccgtcgcatttgctctccgtgctcctccgcagaaggacggagatgatggaggaggtgagcgg

SEQ ID NO: 7242 - DNA, 599 bp, Oryza sativa
ctgcaagttgattaagcaaacaacctagcatggttacatcaccacccaccgatgcaaaccacgcgctacacacacaagcaaggaaacacacgacaaacgaaacactagagggtggcttaggttctgcgacgggttctccaagatcttcgctcctgcttcacagctggcttcactgcttccttcgcttcgctagcggatcctgcagtcttccggagcttcggcaaacaactgacgatatctttttcttcacaaatctgaccaactagtactaattgaaatttgaagaaggaagaaaagagtaaaccttttgcaaatagcattaggggaagaagaaaagaggaactttcgcaaatagttttatttataaaatatgtccttaggttttatccacttggcttatcctacagtcgagatggctctgataccagcttgtcgcgaccgggaaaattgccttttcccgaacgctagtgtattaatccccgtcccaggaaaagccggggtacaccacacaaacatgatataaaagacacatctttattatatcgataatatttacattattacaaaggcgcttcaagcctgacaataaaaataaacag

SEQ ID NO: 7243 - DNA, 725 bp, Oryza sativa
  unsure (1)..(725): unsure at all n locations
nnnnnnnnnnnnnnnnnnnnnnnnnnnnnnnnnnnnnnnnnnagtcgtgctcatgacaattaaggaccggttcgcgagctactgttgtgaaacatttatcgtgccaaccacaagccagcgtgggcaacggctttatcttttgtgtagcgtgattcattatagtgcgccagactgagaagtggcgagaagtccacgggggtagctggggagtccatgcctctggtttttgagggggtgattatgatccaggaaaggtgcgctgtaatgggttatgttgtgcaaggggtattgtcacaactcctttccgaggtaccgtggtggtattgaggcacatggtgacatgatgtggggttgtgtcttgtgggtacagtggtacacctctggccagagtaaaactattcgaatagccgtgcccgcggttatgggcgggttgagcaatgtttttcgtgattagtctcacacctctcacaataattatggatgttaatacctgataataatttgcttagctcctggtttggagttagatctgtacagccgggtatggttgttcaggatggttgggcctgtacagcatgggtgtgctgttcagtgttgattaaaatttttaattaattactctactgtttaaaaactcttaactctttgctaaatgctgcttttgcaaatgagcctatattatgccatcctttggaatgggtaccgagctcgaattcgccctatag

SEQ ID NO: 7244 - DNA, 1484 bp, Oryza sativa
aaaaccatagtgctgtatgtgtacctctcttgtccagcggtatcccatatttcaaatttcactattgttgagtcctccaaagccaatgtttgtgataaaaatgatgcaccgacagttacctgaaattatttgaggaaataagtttaaaacaatcgaacttctgaaagtaagaatcatgcatctaaggtgaagaataacattatcaactgaaactaagagactcaaaacagtaatcaccttggaagtgggatcaaactgaccacgaacaaagcgaagaacaatgcaacttttccctacaccagagtcaccaagcaataccaactacaacatcaaaaggatggacacgttaaagaaagctgctagtaacatgatatagaggcattattgtagtaataaagggcaaaatgtgcagtaaaccttagcacgcaagtcctttgaatcagtagcggagttatcgttgctaatattgttcaaccctccagtgcttcgagctggatgacaaaacagtgctatgtgttaacaaatggcggaaaatggctaattcttctactccagctacaaactttccccagcccccactcacatacatccacacacgatcctcccattcatagagatcgtgcagacaccctgctctaacctccaattaacccacaaattgacttaaattcactaaatcacagttcaaaaccgtccagattgcgcgaattttcgccccgatcaacgctgtgaccgaaaacatttatccccaatcagctttcagcataaaaaagctggtccctccctcccattttccaaagcagcaagccacgaatcgaacccaatttgaaaacccccacggcaacacctgcttacctaacactcggtaccaacaatatccgcagccgaaacatagccaacgaggaaatctaatctaaaaaagggggatggaaacgtgtgagagagagaacctggcacggaggaggagcaacccatcgccggcgatgctagccggcgtcgaggtgaggcaaagggacgcggaggcggcggtggtcggtggccggaggtgaggcgggcagatcgattgccgcgtcgccttctctctctctctctctctctctctctctctctctctctctctctcccctactcgagtctgttgatccgcgcgattgtgttggtttggtcggtgaagccgaagaggggggaggaggtcgttgccgctggctagtgggccccactggtgggtcagggtgtcagtgtcacacggcggagatgcgattttatccacagaattttagtgggcttaggctgaatttatttgtggggcctttttgcatttgggctcatgtaggcctatcactcctgtcaaatccccctttggaatttccggccggttttggattttaggacgagtttcacgaactgtcaagtcatagagctttgcttagaagtttgcaggggacaatggtgtgttattgtccgaatttctgggaattcatccg

SEQ ID NO: 7245 - DNA, 15826 bp, Oryza sativa
  unsure (1)..(15826): unsure at all n locations
nnnnnnnnnnnnnnnnnnnnnnnnnnnnnnnnnnnnnnnnnnnnnnnnnnnnnnnnaatttctgggaattcatccgttgagatttcagccacaaaaaaatgtgaactgaaaattattttgttcgagtatatgacaatatctatgacacttgcaagacacaagttctctgctcctactttggaacttcagtgacggagctgcagacaaagcacaattgttgtatattaagagagaaatgacgtgatactatttcggaaatggaatgggccggtttgataacataggccaaaaaataaggtctgttcagatcgtagcaaataaaccttaccaaattttggcaataccgaagatgtcgatattatcaaaattttgactggaattcatatgtatttattaaatttggcaacaaattagatgtagatatttttttacaacttttaaaaaaatggtatgtttgaaaatggcatcaatctgaacagcctctatatattctgtttcatttttcctaactgaattgtgaagccgctgcgagttttacattttttgcagcactgagaaaatgtgaactgaaaattattttgtttgaatatatgacaatatctatgacacttgcaagacacaagttatctgcacctagcctcctactttggaacttcagtgacagggaggtgacggagctgcagaaaaagcacaattgttgtatattaagagagaaatgacgtgatactacttcggaaatggaatgggccggtttgataacatgggccaaaaaataagatctgtttagattgtagccaaataaatcttactaatttttggcaataccgaatatgtcaatattgtcaaaattttggctggaattcatatgtatttatcaaatttgaaaacaaactagatgtagacatttttttgcaactttaacaaaaaaaaatagaatgtttgaaaatagtatcaatctgaacagcccctatatatccggtttcatttttcctaactgaattgtgaagccgctgcgagttttacaactttttcagcactgtaaagtgcaaggtctagctagttaatttgcgaaacttcaagtaaactatggtgaaacttcgatgcttccctcgacacttttgccagaaatttggatggacgcatttcgtctcctcatgtctggatcaaagcatgcgacatcgcgtgcaacaacacatgtgcgtaaagcgtctgtggtgacctacaattctacaaagttggatcgcaaagaacactcatcaggcagtagtgtgctctgctcgtgcaagaatgtttttcttccactttcactttctccaccaaatcctctcctgcatgtatgcagcaaacctgatacaagtgatgatatgtctgaagaaatagaggaacgaaagtgatgtgtcaaggggggccatgcaatgcgatccactttgttctttaactttagcttaaaggacttcttttttgtttggctttcaaccctttcatcatggtagaagaagggacaataaaaaagtaaggtcaagctagggatatattttatttgtggtattttattcaatcctggattttggtggttctgaatccaaaactaaggtcaatcttagaagatagtagtatttttaattggaatacaagcatagtggaaatctagaaaagaaaaattatatattgcatggttgaggtatcgcagtaaacagttaacactattgtgaggtttcttcagatcataggaaggtaaacagtacgtcatgatcagctgacattttgtgttagtacgggtgcctctgtttttttcccttcttatctctatcgcccaaattgttgcttgcaaagtctagatcacgccaaataaaactgtctgtaactctgtacgctggtttggagcttattgttagtcaagatcattgtgtggtactaattgaaactttgatctcttcgttgtgatgcatgatgctgaactcaatggtgttagttaatgcgtcgaatcatcttctgtgatttatctagcgaattcaaggaagtacagttgagacttcaggaccaaggcctctaaccaccggtttctgactgtgtgcaatttgattacagatttcaataatttcatacaagtagcccccataaaacaaagaaagaactgcatgaattgactcttttgtaatcagcaaagttaacaataataacaattaacaaacgaagccatacagctggcataagtctgtgtttagttccacgctaaaattggaaatttaaagaaattggaatgatgtgacggaaaaattgaaagtttgtgtgtgtaacaaagttcgatacgacggaaaagttgaaagtttgaagaaaaatgttggaatctaaacaggcctaagaatgatgacgatcttgcagttggtagcaggaaaataatgtgctgcaatactagatcagatcagtaaccagttgattgttggccttgcaagttagtactgacacttacctgcaggccacccacattcagattcagttggtcacttgagccaaaagtttgtgatctggccactctcacggtctcaccagacctgaagctgccaggatgagtgaaagaatggaagaaatggtccaggatcatggttggcagccactcatccagcatatgcaggtatgtggcacacacagaagctacctgccatcagggaaatggctgtcagaaagtggacaagtttggagtgccaaatctgggattaaagaaggcccaaacatgtgattaaagggtgaaatgagcaaggcccactgcccttaccaaagtctgaaactgtctttgtttctttccttcttgttttttgatagattccctagtgaaaagtgatcccctgttctttttattgcgggtaaataaaaaatggaaacataaagaagaaagaagaaagtcaaaaggaaatttgagctaaagaagaaaaaggttttaaagggcagtgcaaagattgcctttcaatttaggcgggagtttacatggatcatgtctagttgcaatccaattcagacagaacctgaattcagttgcagtgacatttccatgaaagtttctcaaaaaaaaaaaaaaaaaaaaaacatgggagcattgaactatacttaacttcactgcattgcgcaaacgtagcagacagttaaatttacaagacattggccgtcttttagattccaacttttttttttcaaacttcaaatgttttgacacatatacagagcatcaaatatggacgaaaaaagaacaattgcacagtccgactgtaaattgcgagacaaatcttttgagactaattacaccatgatttgacaatgtgatgctacagtaaacatttactaataacagattaattagacttaataaattcgtctcgcagtttacaggcaaaagctgtaatttgttttgttattagtctacatttaatactttaaatgtatatccgtatactaaaaaaatttggcacacgaactaaacacaaccaaagtgttgtgatttatgacggtctgcaagtactattcaaataagaatataagatcaccggtgaccggtcggttggttgtttctttcaaaattttgatttccttgaaaattagcacggttgccagctcgattcaggtcaatttgtccaaagatccgactaggacaagctgaccaaaccaacagtattcatgatattgtttgaatattaatgtgtttctcatccaatgaggctggaacagagaacagaacgacccaatgacatggcgatgttatcctcacagccagtgatacatactccctccatcccaaaatgtttgacgccgttgacttttttaaaaatatctgaccgttcgtcttatttaaaaaatttaagtaattattaattcttttcctatcatttaatttattgttaaatatacttttatgtatacatatagttttacacattttacaaaagttttttgataaaacgaacggtcaaacatgtttaaaaaagtcaacggcgtcaaatatttaggaaatgagggagtatattatttttaacatttccctaaaatataaaagcaccatattgctgccatattatgatattatcgaataatgtaacatgaatgtagataaaattaaaaaaaaataagtctagtgcacaacgaccggcattgcaatccggtcagaccaaggctgtgtttagttggatccaaagtttatattttggttgaaattagagatgatgtcactgaaaagttgtgtgtgtgtgacaggttgatgtgatggaaaaggactgaagtttggattcaaactttagatctaaacacaacccaattcttccgattcgtaaacccacgagacaaaaaatataaaaacaatttgcgtaatcagggcggcaatgcggcatgccccaaaccataattaaagaaaacaccgactcaattattcaattaactaatggaaaatcagcacaccgacaagagattcatatccagcagttgttcgtacaggattaggttatccactacttccagaaattgaattgcagtccaacattttccaagtttcagctttcagaagtccgtgtttttctgacatgttgcctgagttaatcaacgccatatttaattgccatttgggagaatattcttagtcaggcacacgtatgaagacaaaaacagagcatgaaaaaaaatagttttgctgtgtgttttgtttcctccatttggcaacggatcaacgatgcaacagcatcagggattaaaagaactgcacaaattaattaagagcagaggccatcggaatggataaccttcggatatataagaacaaaatgattattaggatttccatgtgagattagacagtggaagaaaatgatatttaaggataattcaccaggaaggtttcaatcatgaacaggacacgtgtccccatggagagagaccatacccctctgaccctgtagtccaatcccgggactaattgttcgtagtctaaatatgcttaatacggtcatattccaaagctagtgcagtctaatcgctttctttattctcttatcaattgccgcgttcttcaaacatgggcgtgttagtgatttggattgcttcaatggtaggtgaccgtgtggcacgccaaacctgcaaaatgtgggcgaaaaggacgtgggcatttcattccggataacgaagaccttgatgaacattgttgactccctgtctggaacgctgaaatttttgttattttttttcttattcccatgtgaaaattgcacagaacatgtgtagatcacagagctagaattgctgtatacaaatattgccgaggtgatagttctggatttcacaagttgcaggtagatcagaaaatgcagttgttctgaaatggtctacgaatcagagttaacgtagtaaagacgaaaaggtttttggatttaccgaccctttattactgtctcaaatgtcaaaagggatatgaatgatggtaacgacggcctgcacacgcatggccaaagcttcacatcgaaaaagatgtgtgtcttcaattataaaactattaatcgccgcaataatctgaaatttgaagattaatcgcaacggcaatgcaaccaggtagcacacagagaacatcaaataatatcgcggagaagacttcttacacacagagctgggagaatatccgaatccgaatcaccgacgtagctatccgtcctcgtcggcgccacgtcggacggggaagaacgagatcaattttgccgccacgaatcgtttgaaagaaaattaaactactccgcgtttgaggaaacttttctttgcccctcacgaacagcacaagaccaacgaagatttaatcatatattttaatttacaatcgcctggttaaacaccacgtctttgatgaaaagcaacgcgaccaagacagaactagtccacgattcaaccaacatctctgactaggcacgcattttgcgaccaaaagatcatcactccatcagtccatttcatccgctaatactctagttaaaatcaaatttcgcttaaccagtcaagaattgatctaaaaaaaatgacgctacaacagaaggggtaagtttggacaaaaattgatcgaaagcataacaacacgtttggtggatgcctctgatcttctaagtctaaagtcctcggtatgtacatgtcgtcagattggcctctgagctctgtcgccggagacatggcgatcacatcaccgagcaggcgttggggttctcgtcgctgaacagctgcggcgccggcgacatgtcgagctggtaggggtacggcgggtacgacggcggcggctggtaggtagggacgtcgttggggtgggggtggtagtagccgccggcgccgccggcattggggttggcgtagcccacgccgtcgccattgccgccgccgtagtactggtagtagctggggggaggtccctgctgctgcgggtacgcgaagtagccgtggccgtacggcgagacgtggtacgtgctcgcctcggccggcgccggcgccatggacgccgcggcggcggcggtggacgggccggcgacctcgatgctcttgcctttgtccttcttgtcgccgccggcggcgtctttcttcttctcgccgccgtcggcgtcaccgcccttgtccttcttcttctcgtctttcttgctgccgggcgccacggcctccacggcgcggttgagcttctcggtgagataggtcagcatggccggcacgtccattgtgcccgacaccttcacctcatccttggcattgccgtccattaccacttccttcacccctgacacatagcaaaagccagaaggcgtcagttttggagccaaagcaacaaaacaaacagcagaacgagagtagtacaaaaactgacagaggaaagattaattaaaaaaataaaatcctcacctttgatcttgtagatgcgtcgcctgatgcggtcggcgcagccatcgcagtggaggcgaatcctgagcagcaccgtttcctgtaacaacaaagcagagagacattttgagttctcaggtcaaacgagtagttgggaggagcagagaagcgtatgcgtatggcgttggtagggttgcctcttgtgtaccgacctctttgggtttcttctcctctggcggttgcttcttccccttctcctctttcgcctgggcgtccttcttctcgccgccatcgtccttgacggccttgggctcggcggcgggtttcttggcggcggcgccaccgccgccggcggagacaacctcgacgggcttcttggtcttcgcctcgatcctcgccttgagcgcggccgcttcggccgtccccgccacgacgaccgtgttcgtcgccacgtccgccgccaccgactccacccctgcgatcccagagacaacccaaaaattcagacacccagacaccaaatcgaaccccccaaaaaaggctcaaaaagaaaaaagagaaagaaacgagaggcggcagcggcgaataatcgagaccgagatgcgtaccggccaagtgcttgatggacttcttgaccttctgcgcgcagccggcgcaatgcaactccatcctcagcaccaccgggtcggcggtggcgcccgccttcggagcagccttctcatcccccatggatggatttttccaacctcctcctgtgctcgcctctggaagtctggaatttgagattttgagttctgacgaagcgaataaaatggcggcgctgggtgggcggggataaatagggggagggagacgagacgaggaagcggaggcgaagccgactaggcgacggagacgaagaagaaaaaaaaagagagagaaagagaaagaaaccgtagacgccgcggtggggtgggtggggccaccctgtcagtccgctcgcccgcccgccgtgcggatccgtgtacgcgtcgggcgcaagtttcctttcagtggccggtaatttcccaccagcaaagccagcctgcctgccgcggctggtgctttggctttggctacggtcacctgcgatgtcatgtcacgtggcgtcatcgcgtagattttgctggtgcctttgctgctgtgtactcctacgtagccagtgtactggactttagtactagtacagtactacttgccttagataggatcaacagctgtttggttggatgtcaccgaccagatactgtttggtactccacaactcaagtttgtacagtactaccttgtcacaatgttcgagtttctatgcggccacggctcatacgtgacagagatacagtactgtcctttcttgccacgtagcttcagagcaaaaactatggtaaaacacggtgatcaatcaagtaaatgttggcattagttgttttttttttttagaaaggggtcgttgatatttccagtcagaggaggatggtaattgcaacggctttggttccccttttcttcagtcctcgcgtacgacgttttccctttttaagggaaccacacgtacgaggcgacgatttgtgcgacgaaaattatcgtgtgccgtgtgacgatcgctgtgacgataaggtggaaggcgacgtgtgccgagatggtcgtgggccctggcccttcccttcttttttcttcacttttctcgaacaaaaatgggccctacgtgcgggaggcggtgtacgtgtccttcgctggaatccagtggcggaagccgcgctcgctttggaccaagtagggcccatcaagggcccaagtgggtgtgggcccacgtctcggaaaccggcgagccgctgcagcgacgcgcgatggttcagtttctcgaacgttctagaactactagtactggcttgcgatgagctggtgggttggataagaacgacctaagttggtgggctgccgcgtgcggcggtgaggtcagttttgggctgacgtgcctaacgctgtgccacttgggccgaaaaaacgctttttttattcggcaattcggtgtattttaaaagacctaaacgcacgtggtgttatccatgtgtactgggcctgtattgggttcaactggaactttgggcctgaattcaacgtgtagtatgacttattaataacgttgtttattattattattattattattattattattattattattattattattattatttttaagataatggaagtatataggctttacaacttctctaggaatacatgcaaatcagcagtaggatttgagctttaatggataaaatcatgcgctaatagctttatcaccattgtggcctactttttactactaaacaaatattgattttgaatttattggccatttatctatacatctccctgccctcttacacatcttcatcctcaactctagcttcctccatcgcctacccactctacgcaagtgtagcggcttgcttaatgttgccgtcgtcctcgccctcccaccactactaccgagggtggaggattgaggatggaggaatagattagtggttggcacttgggaggatattgcattgaggatggaggtacggagtagtggttgggacgtgggaggaaggagaaggagagaaataaagtgatggatttccgaaaaaaaaaagtgatggattgatacataggtctcactgttatagacccaaatgaaaagtgtagatgaaaaaactgcgagtctggcttaccaaatagccaaatcaggagaggaattagctatgtgaatggttggagaggctgatttcgtcggaaatgctcgcgcttcccaagttctcattcctactaggctttgggttcagacgatgaggccacctggcaccgcactaggctttgggctcatttcaggcgccggcagccggcgcgtcacggagccgaaaccgccaaatttcataagaaaaaaaaataaaaataaaaagaaagaaacaaaaacgcaaagaggagaaaagaagctcgtctccgcgtctctgcccgccctctcgtcgatttctcatttctttctctccctccaatttgccccctctttgtcgttttagggtttccgcgctccaactcctccccaattctggtccccgattcgcgcgatctcggccacccatggtctccggcgtcgcccaccgcccggacgacgacggcgggcgcgccgcctcgacgttccagcgcccgccgcagccggccggcgcgcggccgtccctggccacgccgccgccctcgggcggagcgcaatccgcttcgacgagcggcgggagcgcgggctccccgtccagccgcagcgagcagcatgtccccgcagccgcaggcatggcggcgggggcggcggcggcctctactccgattagtgagaataccttcctccgcctcaacgaccttgacatccacggcgacgatgcgccttcctcacaggctccaacgaggtcagcgtttggtttgccagttttcgccgcggggttgcgtttttttcccaatgttattacaagattttaagattttgagaatttggttggtttttgtttttctctgtagctgtacgctacttaaaatgctccggagatgcaccgggtggttaaaattgtccgtagtgttgtaattagctgtgtttgggctgcaaaatgcttagggaagtgtatcctgccatcactttgatgtgtggttgcaagtaagattttctggggatgcttatacgattatgctctgtaggtttaccttgctgaaagtgttaattctatatatatacggagtagttctcatctgtagtctattacacgtgtatactgtactcacgatgatcagtaaaacatcagtcatgtgacctcttttgctacatagattccagactgtagaacactgctgtttggatgccagtgcatgtttttctgcattatgaatttggaagtacgacttggcagaagttctctacctcttaaggctccttttcaaaaaataaatcccttcattgttatctagttttgtgcatttgcaataagggtttttgctatgaataaaattattcagcaagaagaagaagagaggagcacgagcagttggtcctgacaaaggtggcagggggctgcgccagtttagtatgaaaggtgtgttaaatcccatttgttccctattagtacaccatttgagtttatttataagcaccacaagtatgtgctataaaaactcatgatgacactgtttgttcttttgcagtttgtgagaaagttgaaagtaaagggagaacaacatacaacgaggttagtgctttcctctttctaccgagttcatgtatcttgttctgagcatctgatggcatcatgtacgtggtcacatcacatggattgaagcagcaaattgagatcacaaatgttgcatgtgtcagctccctgtttctttgcatagttgtcttcttgttaactctatccttgaagattcaatcagttatttcaagaggacttaggctatgtatgcaatgtaaaacctaatagcaatatatgcacagggcaggactagctattgctccaataagccaacatgttcatattgtccgtccacctggtggtattgtcaaacaattcattatctataaaactgccatgttccgcatcatgatttggggctataaaattggtaactcactcacatgtcttatgtaacactgctgtttgatcagcttgctcagatcttactatggtgatgtgttgtaatatgtgacatccaccatattgatcattgtaaatccgctatacatatcaccctcttctactgttatatttaaactaacaatctgtctttgcatctattcatgttcatgtttggagttcctcaaaattgctaaaaactatcatattttgtctctctggcaaaaagttgtaataattttggctatgcatttgttgatagttttcaatgtttacccttattggtgaagtccaagtctcatagtccttctgacttatctttatcaggtggcagatgaacttgttgccgaatttgcagatcccaataacagcattttgccaccagatccggataatcccaatgcagttgagaaatgacttgcctgcatcaccaattatttcttaagtcagttgtatgctcactttgtgttaaatgcagcaacaatatgacgagaaaaatatacggagaagggtttatgatgctctgaatgttctgatggctatggagattatatctaaagataaaaaggaaattcagtggaaggggttgcctcgaaccagtataaatgatattgaagatttgcaggtttttcgtcttcttttcccactggttatcgacatttgatgtacttttggtagtcatatttattaatttatttatgctcttttacagacggaacttgtaggactgaaaagtaggattgagaagaaaaatacatatttgcaggagctgcaagaccaagtaatgatatagctcaacctgcttttctttagtcatgtccaatgcaatatataaaatgaactgttctactgagctagcagtgtaccatagtcttcaaattgtgtggctttagtggtagatactgtgatacacataatgcccttactcggtaacattgtttttggcatgttaagtttgtaggtatgcaaaagttgatacaaagaaatgaacagctatatggttcaggaaacattccctcgggtggagttgcattaccatttatccttgttcaggtgaatagttcataaattctttgtcttctattctcttgtttcatggcactgtttcctgcacatgacttcaggctaaatgacaagaatgaatcatgcagacacggcctcatgcaactgtggaagttgaaatatcagaagatatgcaacttgtacattttgactttaataggtaaaacaagaatcctgttattctctcccatctggtcacacctttacaatttatctagcaagccacacctttctctttctgtttccatttttctattctttcatgatatgattgcagaaggtcctcactggaagggcatcctcttatctcatttaaattctggcagtggtcttttaacccttaaaatataatataattcactctgtaaaaaagaactaaaatctcagctgctatatcaaatttggatggtagagatttttgtctccaaacctctagtgatgggacggtacaagcggaagtgtaaataatgtgacttttgaaaagtgttgttagcttttattggttgagctaagtcatctagttttagtccaattacaggtcgcaggtcctcattatcctagtgacatttgccatatcactaattcttgaataatagggagacattggcatcctaaattgggaagatgagagcccaagtgtgaaattcattttacttttctaaaagagtaaattgcattcacggtacaagaatttgttaggtgggtgcattctattgtaagaacttgaaaactgaacaaactggctcaccaacttgactagacggtgcgcttttggtcaaggtgaataccacacggaattttcggccacgttagcaagacatgtcattcatgtaacatgtttttgcttcttccttcaaacgacagatagactgaaggttcattttagcaaatatccccagttcaatggtaacaatatcaaatcaaaagctctataggtctagatttagctttgatagagggcactgtaatctcttgattgatgcatgaatcaattcatagttatactgtcaattgaacaatgaaactagacagtagaaatttagcttgatctaaaaggccaacgcttgcttcgagaagactagcatcaccatcacccgccaccaccactgacgaagcacacagtaacatctttgagttagctagcctgttcgatttttgcctatatatttccaaagtttgatcatgtgaacaggaatgatatgcattgccacatcttgccgtagatgatctagcttcacaagattcatagttcaccaaaagtaatggatcaacctgggagtcgtgaattcataataaatggaaagaagcagacattatatatcatctggaacaattagaacatgaaaaatagtcgggagtttgtttcaaaattgttgggatgggagataagcgatttgtgtgcctgatgtgcaatcgacagcgtcccttgctgatgtggcaaaaatatgtaatgtggccttcactttgaacaaatatgcaccatatagccaagttaatggactaatatgctcaaatttcaagttctagtactaaaacacgcccacctgacaagttcttgcaccatgagtgcaatttactctttctaaaaggaactatcaaatgaatgaaacatatcaaaatatgccttttatttttgttgaaagaaataatttgatatcggtgcagcctcttagatttcccttagatcagcgtaagttcttgatatttacatttctgaaactgcagcacaccatttgagttgcatgatgactcatttgtactgaaagcaatgagttcttgtggagaagaacaaatcgacggtattcatgatctaatttcaaatgaaggtgagagctcaagcatgccaaatatttataggcagcaagtgcagcaacctgcaagatcaactaatggtacagctagattgccaagctcaccccctattccaggaatactgaaagggcgagtgaagcacgagcattagtgtagtgtgtttgttgattgttgtctggcgtgtttggtttattattttttatttttttgtgtaaatggcctgtaaattagtgggcattggaaaagtagtttattccgatttaacgctgcagtctgattggtagagtggcgggtgccctgaccagacctgtatcactccccgagtaacttctaaccggcttttaatctgttccgccatggttgagaaaagacgtcttttaacgtcatgtaattgtttaaagcattttgaagtagttagcatttgatctgagtgaaatttcagccttttgcatgcttattgtaggcatatacatttgtattggatatttgccttagttatatgatatactactacttgtcttagcaaaattttccatacttctatatcgatctgattcccttattgccttttggttttggctatgaaggaaacaagggaatatgggatacacgaacaacttctttgtgaacatctttacacgctggtgtgattatcctcaacttcaggtgaccagaaaaaaactgcaaatgcatctcggttgaacaatcacacgttcacacttcattaaagcttttggagtggtggttctctaggcctttcgtccgccaatcagccaatgtattttgaagagtccaccaattttccattgccattagagcaagtttaatagtatagccaactactagttccaattcatttataatcaatctaatagctcattcatacaatacttacatactacactattaatatctggtcccatctgtcaaacacacactgcgtcttggagtccgtgctacagctggctacaaatctgtagcccgctacctttctctctcctcatttatctacttaaaatatatttgcagctgatttatagcctgctattgtacctgctcttatggaaaaaggggaaatttctaagattgtttatcgacaaaccatcgattctaagaaataccattgatactagcaaaatatccatatgttacaacgggctctaattatattaaatgggttatcagctaactaaaattaatcatcattctccagctctgattaacggtgatataataataaattatcactttaaaactctggttaaagatgatacgataaacaatgtattatactgttcaggaagcaaatagtagcacataagataggtggaagtgacaaaaccattaccactaataaattttatgataatatagatagagatgtaagctctacaaaa

SEQ ID NO: 7246 - DNA, 839 bp, Oryza sativa
  unsure (1)..(839): unsure at all n locations
nnnnnnnnnnnnnnnnnnnnnnnnnnnnnnnnnnnnnnnnnnnnnnnnnnnnnnnaatacacactttgtaattttatgaacataagtgaaactttcttacaagttaaaataccaccattctctcttagactgtgtttagttcacactaaaattaaaagtttagttaaaattgaaacgatgtgacagaaaagttgaaagtttttgtgtagaaaagttttgatgtgatggaaaagttggaagtttaaaaaaaaatagaactaaacacggccttaataacaaagtgatcaaagcaaatgtgaactcgtgaagttgacgtcgtcctcaccttcatggggttgtactcactgtacgaagccctcatcggtaagcaaatagctttgactgccaaagttggcttttttcctttaagctaaagaaaaaccattgattggtttgattggcttatttaacttgatgaagattttctgtggctggtactcatcagcccaataagcaattcaatgggttttggctgaaaagcctcagcccaaacatccatccaatgaggccctgagttcgtgcaggcatgatgcatgcttgtggtctcacacggccgagttcgcgctgaaggtacatgagatatcgtggcccaataaacttacttagcttcccgcccacacgcgcattggatttggatcctctgactttacatgggtaaagttagagagctagagtgctgttgctacagtgaaacactacgtattactgtttctgatgtagcacagacacattttactgttagggttnnnnnnnnnnnnnnnnnnnnnnnnnnnnnnnnnnnnnnnnnnnnnnnnnnnnnn

SEQ ID NO: 7247 - DNA, 722 bp, Oryza sativa
  unsure (1)..(722): unsure at all n locations
nnnnnnnnnnnnnnnnnnnnnnnnnnnnnnnnnnnnnntctgtatctatgtgtgctggtactgtaatatctgtatctacatcgggtctacactcagtttgtagctgactttgatcagcttacgcctgaccgtgttcggtggactccctacactcagcacgatgtcaatgatcgtgcaccgcacggtctcgcggatctttgcacgcgagatatgcaactctggatgacgacttgtcacctcgtggtggacgtgcacgtcgagccacacaatgtccacagggttctcaaacagttgggcatgtatcaggacttccctccgagagatggtcgtcctttggctgatagtcttcataggttagttcacatcacagttgtttaatcctacattttttaaaataaatcactgcacaacattttttctaatgtgtgaatttgttgttgtgcaggtactccagaaaggggctcgggctttcctacgagctagttattgtgaccacggttcagccgacgatacaagagtgggagcacgcagctgataacttggcacttcagacacctccagacgatgggagttattatggagcttaccttcgttggtaccgcagtgttacacgatggaggtgttttcctccacaaggagatagcaccgtcccccaccaggcagcgattactgacacgtttgcccctcagcctagatcagcttacaactcaatggtacgtgtt

SEQ ID NO: 7248 - DNA, 820 bp, Oryza sativa
cgaataatacccatttttatataaactttttacatataaattagtgtaaaaaacatattaatatatattttaaaatattttgaactaatatttacttcattcgtttcgaaataagtgcacgcctctaattcaaatttagagaattgtacttattttaggacggatgaagtaattaattgtacactaatgagtcattatatattacaccactacacatgcaacactacactcacaccccctacgaacgtcccctaacacatactctaagagacgaaaactaacggcatatacctaatctcactaaaatcatgttaaaatctcacctgcatgtgcgtatttctaatatttatgtgcaacatgattttaaatcctagtggatggaatcatacacccacgactccaccaccacactactagtgctttcccaatgaatcatcatgttttgcttagtggggagaaattcacttccttctgaacccataacaatcaaccacaattgcatcataagagacgaaaaccaacggcatatccctgaaaatcttgttgaaagtccacctgcatacgtgacaacatgatttgaagttttgaaccctgataaatggagtcacatacccacaacttcactaccacatctttaatacttccccaataaatcatcatattttgtgtagtgggaagaagttcacctccttccgaacatataacaatcaaccataacgccgtcatatcaattggatttatgtcaatccaattcgagaaccttttgaaaaactggggtagtagatgtggagcatgaatgggtaccgagctcgaattcgcc

SEQ ID NO: 7249 - DNA, 7043 bp, Oryza sativa
  unsure (1)..(7043): unsure at all n locations
ggaaaacaaagaaagttgtgttggacaaaaatgaacttgaaaaatacatcttgataggagaaaatttggagaaagaagttgaagaagaaatcttaaaagtggtaaaagccaacacggatgttttcgcatggtcaccggaagaacttgaaggagttgagagaagtctaattgaacacaatttagcaatcaagccagaacacaagcctaagaagcagaagttaagaaggatatcgatagataggcagcaagcagcaaaggcagaactagagaaattgttgaaggctaaagtcattcgagaggttatgcacctcgagtggctagcaaacccagttttggtgaaaaaaaagcaaatgggaagtggagaatgtgtattgacttcacagatctaaacaaggcatgtccaaaggacgattttccactcccaagaatagatcagttagtggatgccaccgctggttgtaagctaatgagttttcttgatgcttactctgggtatcaccaggtattcatggtaaaagaagatgaagaaaaaacatcattcataacaccttttggaacatactgctacataagaatgccatttggtctgaaaaatgcgggtgccacatttgcaagattgatatgcaaggttctggcaaatcaacttggccgaaacgtagaagcatatgttgatgacattgtggtgaaaagtaagaaagcttttacacatggaaaagacttacaagaaacgtttgagaacttgaggaagttttcagtgaagttgaatcctgaaaagtgcgtgtttggtgtcagagctggaaagttacttgggtttttagtatccaaaagaggaattgtgcaaaataggaatggagccacccaaaaatacaagagaaatgcaaagattaacagggagaatggcctcgcttagtagatttctttccaaatcagcagaaagaggtttaccctttttcaagacattaagaggggtaaacaactttgaatggaacgaagaatgccaaaaagattttgacgatctcaaagattaccttcataacatgccaactttgtcaagtccacaaaaaggagaacctttgttgctatatgtagctgccacactggtgacagtaagcgcagtcttagtacaagaacagggtaacaagcaaatgccagtttattttatgtccgaagcattgcaaggaccaaaaacaaggtatacagaagtggaaaagatgatatattctattgtgatggcatcaagaaaattgagacattatttcttatctcacgacataacagtaccatcaacttatccaataggagaggtgttgtcgaacaaggaaatagcaggaagaattgccaaatgggctatggaacttttgccttttgacttgaaatacacatcaagaacagcgataaagtcacaagtgttggcaaaatttgtggcagaatggaccccagcagagttagagaaaaagaaagaagaagaaaagccgtccaagctgagataagatcattgtgctccaaaaattccttttcaagctccggagtgatgaggctaggagcaatttcatttccaagctgatgaagagacgagcgatacttaaggtcatcaagacacaacttagaacctcgactgctagtctccccatccgcgcaaaaatcaggcaaacccatcaaccaagtgccatttttcgaacatcgctcgctgaaaccaccaagtatatcttttatcaactcgggagaaggggtcattctgtggcttgatcttcaactatgttttttctggattggaaattcagattaacaacttcaggaacgttctctgtttgaacaggattgacagggttcatgtccacatcaatagcatcaatgcaaataggttcctcaacctctttggcagcagaagtaagaacgttcaagggagcagagaggtaatcagctgcagctgaaagagaattaacgttcgaaacattcccaatctcaactgaacttatctcactgatagcaggtagctcataagacagaatgttttcatcctcatcatcactatccagagcaattcgaacttttttcaagttcgagtcaacaggagaacttgaaggcatctttttacgcttcaaagcaggactcgagttttcttgcacaaaaggagcagtgtgagtatgttcgctcgactcagaggagccgctgtcatcagacgattcatcacttgaatcagactccccatccaagctattctcctcattatcagaagatgaagatgcagcatcttttggattgatattcgagtttttcttctttttcttcttcaaatcaggatgaactcgaaccatcatatcttggccgagggcacttagaatcctgttttgttttctaccttgctgaaccgcaagatatgtgccatgctctttcttggtataagggccaatatatttcttgcttggcccatccacgtccttcacaatttttgctgcaaaaaaaagaaaaaaagagaagaaaaaaagaagaaaaaaatgaattacatatatatatatatataatgcttgaaataaaaaatacatatacaaggtaaacacttactattcgcagatatctcgaaaggaggaagcaaagaactagaaccctcaggaatttcaccaagagataaagtccagttggcagaaagaggtcgaataccaagataaatgaactcctcgaccaagtctcgaacactaaatttagagacaagttcttcaattcgagggcgaatgtcagcaaagtcttttgacaaagtaacagctggatctgagatgacactcaaagatttacaagaaaacacaaaagggcatttttccatggttttcagatctgctggaatcttatgatagaaccattttgactgccaatgagttccccatttggtccacataacagagacaactggccaaggacaaccgcgatttaagcgtggcataaagttaacacacccaaattgggagttttgccttgtatagcgccgaatggtgtgaaaataagcaaaatcgcatccatgcggagtaccaccgcaactccgaataatccattcaaaaattccaagcttaacaagggtgtttggtgtaagctgagaaaactcaagtccatatagcctaaggacctcaacaagaaatgcactgcaaggaaacctgaagccagcttcaaaaaaatcatcaaacaccaaggtgtagccggcccgaggtgaaggactcaactgtcacgcccataaatttagcccaaatttccagactattttgtgtattaaatccctgtccaggaccagccagggtacacaaaacgacaagtaataaacagttccaaacgtaaataaagcgaaaattacttacagaagaggcacttagtcctcacaccgaaacaaaaacagcagcagcgaaaaaggcaatcctagcggggcttcagctttactccaaaggcaaaactcaactggggtctgagccttggtcttctaatttcatcttcagctcagaagcactacacttctgaaaagggggaataatagcaaggctgagtacaaccaccgtactcagcaagccacaccaacgatgcagatgtgcaaggggaacacaaggactgtttatggctatttgcataaaggcggttgtaaagcattttattgaacaaaacagtaaaacagttgagtaattaaagtaacattaaatctccactgatcaacgctacaccacgttgaacaggcccaaccaacccacctgaactacagtgcattgggtcgatttattaagtgtgagactaatcacggtgaatttggtcaaccgcccataaccacggtcacggctattcgaatagttttactctgatcagaggtgtacaactgtacccacaagacacagccccacgacacgtttccgtgcgccgacatgccaccacgacataccagaaagaggccgtgacaggacccttcgcataaccccctctagccaagcacaccacacctcaggtttcacccccgtccccagcaggcaacgggcagtcccctctcgtgcctaggtgaatccggaagcgacagaggccgtcgcagggcccgccctgctccatcacgcccacccttgcctggatgcgtcaactagaagaaagctacactacaggcctagccgttgcccacgctagcttatggtaagtacgagaaattcttccaggatttcccgcgaaccggtccttaattgccatgggtacgactagcaaaaccatgcacccatagcccaccattcagttacattttagttggataattacgaccactgaaacatggccaggtgtctcgagcatgcaactcgttctgttgctaaaaaggtctaatactgcaattatcccatcaactgagcaagtggtaattaagcatggctaagcatatagttctagctaggtcacataagtaacataagctagtcgatttattatccaatattgacaaaggacagatataaagtaaacatggcacaagcaaacagataggtaaaaccctgatcccatgtaattagcaaaacatgcatgtttatttgcaaacggtaaaaaatttataaattgggatcaacatgctcaaggggaatgtgtgacttgccttgcttcttcacaacaatcttctgaactctgatccttgcgactgcgaacttccgaaacaacagaatctactcgctggcacacaaaacgagaaaaaaaactaataaacaccaagaaaacagtatataaaaagtaaacaaacatgtagagctcaattttagatgaattttgcaagttgaatggctcaattcggagttcgaatgaattagatatgaattttagaagttttgagccattttaatgaatttctataattaataccaatttatcgagcaattattaaatatttttccaaaggaaatgataagcgctgacggcagcaaggggaagggtgccgacaagcgggccccacacgtcagcgagactaggggagggcgcacggtggacacggtccaccgcggcaggggcggcaccgtggaccgagaccacgggtgtggtccacgagcgcgaccctcatcgacaaaaggggaggctggctcgccggccaacccaacaaggcggcggcggcacacgctggacgaccggcgacggcggcacgacgcgggcaaggggacggcggaggagggggaaaaggaggggaaacagagggagagctcaccgagcgccatggcggcgaggggcaacgggcggcggcgatgccttctcgagaagacggcgggggcggcctcgggcaacgaccagtggtgcggaaaggatggccgaggcgcgggacgacctagggagggtggtagagaggttaggatggggacaagtggcccgagacggtgtgaatcgccggccggaggaggaggtgagaggtggagcttaccggcgcgcgaggaggacggagctccggtgggttcccgacgacgagaagcgaacgccggacctcccctcgtcgctgcgaagctgatggaggaaggtgcgacggccggggatgtctcggagtggcggcaagcggcagctggaggtggcaaatggcagtggcgtctcgggttcacggtgggagcagtgcttcgggggtgaaggagggagatggagtggatgccgagctgcgcacgatggctgcggtgctggggaaggcgacggcgcagcgcgaggtggaccagagaggcgatgcggcgcggctggaggcggcaatggtgacggagagagatggtgaacgtggcggcggcgtttcgtaggcggataggggaaaaagagtaggggccggggtagagctcggcacagcgatgccgatgacggtggtggcgcggcgcggcggcccctaggcggccagtagcgggcggctgaagncggtgagtggcggtagtggcttggcctcgcggtgggaaggtggttccggcggtggaggaggaaaatgaagtggatgccgaggtgcggcatagcgcggcgaagccggtgggaccaacggcggcgtgcggccgtggctttagcggcggtggagggcgactggagggtcgccggcgagcggcggcgcgcgggagcgacgcggggagagcgagggaggcgatgggaagctcgggggaggagggaaaacgaacgaggggagcacggggagggtttatataggctcgggagggtgagatggagccggggtgagttggatttgggcggcaatggccgatggatggaggtggcggcgacgtggggaagtggcggccggattttgcgggagaggtgggggaatgaggaggacgtggggcggcagagtcccacggccgggtgcgggcgtgcggagtggaggaggtgggcggattcggcggcaatcgtgggcggcaacggcagccatggcggttggccggaggtaggaggaagagctgacaggtggggtctcgggtcccacctgtcggccagagggagagagaggaggtcggttgggggacgcaaaaaaaacttcgagagggaggcgatctgggccggaggcccgaggggagaagggacggggcggccggccttagagagagggagggcgcccaggccgcggggaggcaaagcagacttgggccgaaaccggcccaagggaaagaaggggaatttaaattggttttctttttattttaattgattaaatgaactttgtattgataatgttacttgggctccgaaaattcgcgggaaatttcagagagtattttagggcacaagaatattacaaaatattcccggccaatgatttttaagggggaattttaattctcccattattttacttgattaaattgatttaacttatatttaatttctaaaaaatacattatttaataatttttaatcccgatcgaaaatcagggcgttacatcaactcaccagcaggacgaatgactagattgagactagcaatggcaccttttgaaacaagtttattgagccgcttttcagagataatcgatggaccaagaccggaaagatgttttcttcgctttctgttttgaggccgggtttttggattttcccatggtcgctgagaagac

SEQ ID NO: 7250 - DNA, 10807 bp, Oryza sativa
  unsure (1)..(10807): unsure at all n locations
nnnnnnnnnnnnnnnnnnnnnnnnnnnnnnnnnnnnnnnnnnnnnnnnnnnnnnnataataaataattaagatagatacaaaaactcacatgtgctttcgcccaaaacagggggacgacagtttatcccttacatatttctgaccacggtttcggccgaaaacatcccgcccttatccgtgaggggcttgttgtagcaagtggtaaactttgccccccccccaaaaaaaaaggcaaaaacacatttcgcccaaaaagtctacttaaagataaaatactcagagagtttcccctaaaatataaaaactcgaatgaagttctcctctttatagaaaagttcttttaggacatgttttacccaaaggaaacagcgttacgaggaaaagtacattcgagttaatgtcaagtagacagatgtattcgagccaacatcatccacctgacattatttttcctaatagttgtatccgagcaggtttctagggagtgacaaggcgccaagataatgggaaagtatattcgagttttctggtgcggccaagacagctgaaataacaagaaaagaaggaaaagtcttatcgagtagttgactcattcgaggaaaataaccgtggggaccacttcgactactctaaccagctggcaccagatgtcgcctagggaccaccagcaaagtactattatacccctagggcctatggatcactaagagtaatacggtaactttatgtaagcccatgatggcaaagatgtaaatatttgtggtgatggtcgaacactatgaaaggccgaccagagtcctacagcaagaatacaatgaaatagagaaaaagtaccttatatgcatcctgacatctactcttaggctcactctcaagggtaaacaggaatctacactttctcgtttacacccaactctgttggtgccatgaggtcgtgacaatctcggatgcgagtaagccttgtacatctctggaaaggactccgacatggacctgaagtgattccacagttgcttttcactcatctgcttcttgtcccgtgactcaaccctgatgcagttcagaacatggcataggtagaagacctcctcagggctaagttggaaccagtgcttctgtgccgcagcaatttcgacggcgtggccaaaggcagcacggtttaggatcacggcttgttttggctcaactccaagaatggcaccgccacctggacctgacaaaattgccacaggctttgagcttatgaatgaggcattgagctcagcaacaatgactgacatgggattagctgctgctagtgctaagaagtccttgccatctttgcccttcttccatcttggacctgacaaatccatatgctgaacacactcgcagaggatggactaaaattgatgcgtggtcaaatgctgtagtgaatagcaacgacaataaagcaataagtaaacaaagttgtccaaacaaatacctcaacaaatggagattcactacatacatcactaatttatcgaacatgttaatttgtaaagcatagatacataaataatctgccaaaatacccctgatacggccctacctctcatactctctccactctctcctactcttccccgtacataagactttgccttgagcatctgccgagtgtgtgatactagtacgttgtacggtggactttaagctcgccccctcgtgcttggttaacaacatcacaagattgctccatgtgctaattaaagacggttcccgctcaccgctgatttctttcttctcttcttgggttcttgatttctcgtgaacagaatcatagctttccgcaatcgtaatcagccatggcgatcatagtttttgccagcaatcctgacaagaacttctccctgaggaacttgatcaccgggttggtgctctgctggatgaagccgacgacgtaggccgccgtgatcagccggatgccgcgccaccgcctctcctcggcgtacttctccagcgccgccttgacggcctcgtaccccgggtcgtgctcggcgccgtcggcgaggaaggcctcgctgaggcaccgggcgaggacgacgccgtcctcgagcgccgcgcagccgccctggccgagctcgggggtcgtcgggtggaaggcgtcgccggcgacgcagacgttgcccctgctgatgctgccgcggacgagcgcgagcggcgaccggaacctcagcggcgacgacaccacgtcgctcatctcgctccgctcgatcacgtccagcgcctccgccgggatcctcgccgccctcagcttcgccaccacgtagctccgcatcttggccacgctctcctccgcgtcgccgtctgcacaccacacgtgacagattgatcagcgaattaatccgccattgttgctgctcgtcaaggggaagtaactagcaatggtccgcaccatccggggaggggtaccaggtgtagttccagtagacggaggtgtcggaacaggggagcacgccggagcggaagccctggccgatgaactgcaggatctccgggccgaatccgtggccggccgggtactcagcgaggcccctggtggccgagcgccctgagaggatcggctttggcaggccaagccacttcgccaccaccgagttcacgccgtcgcagcctatcagcaccttcagaaaaagcacagtaatgcatcaggccatggctgctcttagtgagaagaagagaggtacaagtgatgatgaacaatcaaggttgcatctagccattgttgatctcacacacctttgctcttatcgttgagccatcggacaaatgtaggagcttgacattgccgtcttcctcaatcgagacgatcttggaagagaacctgatggtgccttccggcagttcgttctccagagtctccagtaggaagttgcgcttcacgcaccgaatctcatgcggtccactgacgaagtaacgacacaacgacgatttcagttttcaggtgtttactcgtataagtatgattttgttacaaaattttaacattcaggtctcagctagcggtagttgcagacactgtaccttttcccttgcatctttagactcaacttcgcggcaggctctcccgtggatgcagagaaggccaacagcctgccaacaagcacgacaagtcacaacttcagtcgatcacaaactctttagtcttaagagttacagattactcctgcaacttcagtaggttaatcgaagggtaaactcaaaagatgggctggaaggagcaagagacagtgtaagcacacaagttcagagctcagacacggagtgggattgtggaaaaagcccaaaacttataaggtctagtacatcagaccaggcactggcagactgacccagcatatggacctaaaatcaggttcatcagtacggcccaggatggcctatcaaacgagctgggctgtaaatttgatttcgcttaaacgagaattattatactcgcgttaggatttgttgtgatttcgtgacggtcaacggactccactgttcgtctgttccactgtctctgtctggctattatctggatctacaactagaagggaagggattggtaaagcaagtggctgctcacctctcgtagagcagatgatgctccctgatcttgtcgccgacaccaagggcgtcgagcgcgcggaaggcgttcgtccatgtcgtgaacgcgaacccggacgcccgcagcgtcgccgacgactccagcaccaggctcctcacccctttcctgcacacgggacgcaccgccggcccagctcgatcatcagctccagatcgatccgcgcgcgcgcgcgcaaacgcggagcagatcaaggcgaaacggtcggcacagaggcttacctgtgtaacccgagcgccgtcgcgagccccgcgaggccggcgccggcgatgacgatgccctcgacgcccgagccctccattgttcgcgaacccccacccgcggttggtgtcgctcgcaagtggaaacagagtgaggatggtcgaaggctgtactgctgctgaaccagttcagggttttctatgatgcgccttcattttgtagcaaaacggtcgaggggtggttggattggacggagaagaccggattccaacgaggcggcgcgtccatccgtcatgccagcggtgaaacaaactggaacatggcggctttcacgaattcttgtatgactagtacacatcgaaatattggtcaattggtccatgttagtcctctcgatcgatttggtaacgttgcgcgcaagtctgattacagaggatccagcattcccgggttcaatgattggcacaaaggaactgtcagggctgtttcgtactagaatcgtagtacgagtacagccacgagggcggcttgtgaataaacccaaaaagaattgttgaggcagcaggtatgctcgcaagcagtgcccattcccctccgggttgacacgggaattttcgatatccgaccaaaaacccaaatgcactcgactttatttttctgcacacaaaaaggagcgtttcacaggtttgggatcattgacacgtgacggaacagtaaaacagacggagcacatacagacaaacatcacaaacagcacgacgatatgattacaggttgcagacttgcagctgggcggcggccaaaacccaaatcacgtcaacaagcaccggaactcgagagcgtgccgcaatcgtagtcgggcatcatgagcagcgtcttggcgagcaccccggacaacagcttgtcacgcaggaagcccacggcggggtggtcgctctgctgcacgaaccccaccgcgtacgacgcaccggtcagctgcgcactcctccaccgccgggcgtccgcgtaccggcgcagcgcggcctcgacgacccggtgactctcctcggcggcgcagtcgccggtacggagcagcagcgcctcgccgaggcacctcgccaggacgacggcgtcctccagcgccgtgcacgcgccctgcgccaggtccggcgtcgtcgggtggagcgcgtcgccggcgacgcacacgttccccttgctgatgctcgcgaacgggagcgacagcggcgatcggaaccgcagcggcgccgcgagcacgtcgttcatctcgctccgctcgaccgcctcgagcacctgtggtggcacgttcgtgctccggagctttgtcagcacgaactgcttcgtcgcggctgaactcttgtcgacatccttatctgtcaaaagacacggcattaatcagtaatacgattcagtgttcatgtcctccttgcagccgatcgagtgttcgacacttggatcttggcagctcaggtgactgaccatctggggaaggagaccacgtgaagaaccagtagacgtcggtgtcgttgcagggcaccatgcctgcacggaatccctggccgaccaactgcagaaacctgggctcgaagccatggccgtccgggtacttggcgcgtccgcgcgtggccgtgtgccccgagtccgacggcttcgcgagccccagccatctcgccaccaccgagttgatcccgtcgcacccgatcagcacctgcatccatcgccaccatctcctcctcagcaaccgatcgatcgacagagacagcacgcacgccatgtgtttttacctttgctctgagagtcgatccgtcagacagatggaggatcttggcgttgccgtcttcctcgatcgagacgatcttggaggagtagcggatggtgcctcttgggagctcttcctccaacgccagtagcagcgcggtgcggctcacgcagcgtgcctcatgggttcccctgcgtcacaggtgttttcaggtgtgcgcatcacacgacaggggggaaggggagtagacagatatatcttctcagttctcaccgtttgccttgcgccctcagatcaatttcttgcactatttctccagtagctgaagacatgacattcaacctaagaacaaacatggagagaaaaaatcaggcttatccgtactgtacaccgtatgatacagacatacagtaacagttacagttagtgtgtgtttagttcacgctaaaattagaaatttggttgaaattgaaacgatgtgacggaaaagttggaagtttgtgtgtatgaaaattttgatgtgatggaaaaattagaagttcgaagaaaacgtttgtaactaaacgaggccttaggagttaggacttctactttaggacctcggtcaccctgctgagtcaacccaaggcctcagggcaagtactatgagccccttatcactaatttcaagaagtcatgtagacttatatgatgatgtggagagaagagaagagagaggggagcagccacctctcatgcaaggggcaacctccacaccaatttcaagaaatgagagaaaaagagataagttgattggttgggtgtagtgtaagtagatgcaatctattgtatgtattacatctaaattaatgtgtagatgatttagacaaaattagatgtgaccactatctctatcataaaacttgccctcacacattcagataatgataaagtggcaggagaaaaaagttagtactactgtactctgacctggaggtcaagatctcagtgactcagagtctcctactgcctctgaatctgttacatacctctggatctgctggtgctggctcctcatcttgtcgcctaccccaagggcatcaagcgcgcggaaggcgttcgtccatgtgatgaacgccaacccggacgtccgcagcgtcggcgacgactccagcaccacgctcctcagtcctttcctgcacgcagtgccgcacttcgatcggctcccatggagttggaacacgtcgctaggcactcagaagcaaaaaaggttgtgtacctgtgcagtccgagggccactgcgagcccggcgaggccggcgccggcgatgacgatctcccggccgtctgcctgttcttgctgcatgcttgcaactggctttgtgcgaatgcaaactgacttggctgcaggaaagagatgagaataaatgctgtgagcaaatcgagtgagcgccaggagtttaaatatgattgctgcgacggcgagggtgagtgagcagcaggccagcagtgaaggcactttgacgtcatcgctgatgatgatgcgccactacggtccggtgagagtggacagacgtcgaacgggacgtgccttctcattgttttacaatatcttggacacattttttgcggcaagatagcagcctccagggaaaaagtaaatgggaatataaaacgttatggcattggttaaagtcaaactatttaagtttaattaagtttaaagataaatatggtaaaattttcaaccaaagataataaattatgaaaatatatttaattattgattcaatgaaactaatctaatattataaatattactatatttgcctataaatttagttaagcttaaaatagtttgactttgaccaaagtcaaaacgtcttataactataggaggagtagtaaccactgccgccacggatgcaccttcatcaaggttttacttgacaaaatgacaatggtctcatccagcacagacccagggtatggtgatcatttttatgtcctcaaacttgctgatagtgaaagttttagagcctcatgggtaagccatatgtttaggctgatcaaccaaagcctttttccaattcaagcaaatcaatttcattggttaacttatttagttgaatggcttaatgagtgatcctatgtggttggtggttgtagccagtggtggatccagaaaaaaatagcagtggggtctgagcaaactagataagttacagtcccccctcccatctacatatggtaaaaaaaatgtagtgggtctttgtggggtctttcatagtctttacgtcagtagtggaggctcgagaccccgccgctctcatgctggatccgcccctggttgtagctacagttgtagcattggcactagagagttcataggattagctaccaccaacgatcctactctcctgttggccccgctatatttggcaaataaacctcatcccaatcatcaagtcgtatgggcttcgggattgagatcacatgcagccatagctaggactgcaagttagtgactccatggtatctcatccattctttttcagatcaaaagtgcaaatcaagtgctacagcccgttactatagcggttgcattgcaccgttacgatgggatttggttcatgtgcaatccctgtgactacaacttaagcagtcatactattgttcctactatggtcaactgagactttttaattcttccatttttgcgctcaacaccttatccctactagtgtcctagaaatatagattcccatccttatccacaaaatttagacctaaacccatacatgttttgaggcagcttttatcacaaaatccaattccatcatttgttcagacacatgggtacaaaatccatttcgtaatcttattaacttgggtacaaaactgagttcccacgttttagagcttgccacagtcatagtccgccattttcagaagccttccggcgagcactccggccaaccacttgtcccgcagaaagctgatgaccgcattgttactctgctgcacgatgccgacgacgtaggctgtcccgacgagctcgacgctcctccaccgccggattctagcgtactcacgtagactcgcctcgatcctctcgctctcggcggcgccgccgccgccgagaagggcgtcgccgaggcatctcgccagcacgacgccgtcctcgagcgccgcgcagccgccctggccaaggtcaggcgtcatcgggtgcagcgcgtcaccggcgacgcacgcgttccccttgctgatgctcgcgagcaggagcgacagcgggggccggaaacgcagcggcgacgcgaccacgtcgtttatgttgctcctctcgacgacctcgagcacctcggttgggatcttggagctcctcagcttggtcagcacgaactgcttcatcttttccgcgctctcctcgacgccattactttctggaacggcaactaaacaccgatcaatcactgatcacctgtcagatcaccattgttgacatagttgacacttgatagtgacgagactgaccgtgttcggaaggagaccaggtgaagaaccagtaggcatcagtctcgttgcaggggatcacgccagcacggaagccatggccgacgaacatcttgaaccttgggtccaatccatggccatcagggtaatgcgcgaggcctctcgtcgccaagcgccccgaggacgacggctttgtgagccccagccattttgccacaacggaattcaccccgtcgcagccgatcagcacctgcacccccgtcattaatttcagtggcatttgctctatgaatgaaacacagtttctagggaattactctgttttttttcctacctttgctctgagaattgcggcgtcggcaaggtgtatgatcttggcgttgccatcctcttcgattgcaacgatcttggaggagtaacggatggtgccttttggtagctcttcctctagtgctcggagcagccagtcccgcctgacgcagcgcagttcattgggtcctctgcatccaagcgaaggatccaaaatttcggtacggttcaatacaagaacgtgtggcccgtggaagcaaaacgacatgcaagtatggcctagagtgtaaggtgaatagtcatcagtagagatcagtgggagagaacatgacatcttaccgtttcccctgcaccgtgagatccgctcttcgtgttatctctcccgtagacgaagagaagacatgcaacctgtgaacaattcagaccaagaatcagtcactattttacattttcaccacacctacaagtgttcctctctttttctacatactcctgaagatgcagatgaagcttcctgatcttgtcgcccaccccaaggttgtcaagcgcttgccacgcgttcgtccacgtcgcgaaggcgaaccccgacgcccggagctccggcgacgactccagcaccgagcacttcacccctttcctgcacgcggagcagatcatcatctcgagttaacctgcggcagccaacacacagagcaatacgcatcaccggctcaccggtggctcctctcacctgtgcagcccgagagccacggcgaggccggcgatcccggcgcccacgacgacgacggcttcctcgccggcttccttttgttgcatgcttgatcgatgctagattctcagtagtcagtactccccctgagtactcttaatcaattgggaggccagtgtttaattaagaccaaacactaactgagtaaagcttctttgctcactgaaatctagtgctgctcgtggccgcatatatagataggctagcaagtgtttgggacctgggagactgggagtgatcggcactggacttactgaagcagatgcgacgaaaaagaagtcaggttggtggattcgaccttgtacacgaacatgcggaaattggattagcgagggcagtcagagtcgtgacggaaatgggaattttgtacggcccaaactgttggctagtgtgtttggatgtggaccatatttccttcctttttttttaatggaataagatcactttgactccctcaactgacctggatttttcacattttggtccttttgaaaaacttatttcataaatagacccctgaaaaaacttatcccagaaatagtcctttttggggcgccagagtggctggcgccgtcgttcaacaggacggcgccagcctggcgccgtccccctgccgacgtggcggggcgatgctgaggtggctaggggg

SEQ ID NO: 7251 - DNA, 1038 bp, Oryza sativa
ctggcgccgtcctcctgccaccgtggcgcacgcgaaccgacgtggcaggaggaggctggcgccgccccaaggaggagggcgccagcatggctggcgccgccgcctccattcctgtttctctgtatggagttgcaacggtgtcatttttattttattttttcggatgttttttcacactcaggatcacgatacaaccaaccacaaaaaaaatttaaactcgaactaccacttagctaagtttgaaaatatctagcataccacttagtctactttgcaccttcactaaaattagaccataactcctttagtaaaaccctttgatcagcatgttaaacataatgcactctaccactatatgaaattacttaatctaattcaaaatataaccatatgaaatgacatatataagttaaacagtacgtagagatgcaattttttatttttatttcatttttttgatatttttttcacacttaggagaacataggaaccaactgtataaaaaataaactcaaacagacaaaatatgtgacatgtagaattttccaaaactctaccgaaacggacaaaatatgccatctattaaaataggcataactttctcatacggactcggaatcaggcaaataatatatgcacggacatctatagaaaaagttacatccgattctcccccgctttgccgggttcgacgatattaaaacctccaaattccgcttgcaagattgtgttttcgaggaaagaagtttttcggtggagctttggaaaattccacatgccacatatttcgtccgtttgagtttattttttacatggttggttcctgtgagttcctaagtgtgaaaaaaatatcaacaaaataaaataaaaataaaaaagttgcacatctctctcctctgcactagttcggaaagagaggagaggagaggaaaaattatacatgtcacatattacgtccatttaagttcaatttttctatggttggttcttgtgtgtccctaagcgtgaaaaaaatatcaaacaaataaaacaaaaata

SEQ ID NO: 7252 - DNA, 8054 bp, Oryza sativa
ccctctttttcttcgtgcgtggggagcggcgtccggatttgcgccgcctctgccgccaccgcagcagtagggattcgggtttggtggtggcggcgctggagaggcatcggtggtgcgttcgccgcgggggatgatggcggctgggctagggccgcgcctcgccatgcagcagcagtcgacagtcttcgtgccgcctccaccgtcgcagcagggttcggcttcaacgggtccgggaatgaagcggcgctggcgccacgggagatggggatggtggcgaggccgcgtcagccgtgcagtagcagccaactctcgcgccgacgccggcaccgccgttgctgcagcaaaatctggagtggcgacggtgtccccttcgccacgggggatgacgatggtggtggcgccgtcgaaggcgtcgcgcggccaagcaagaggagctcaggagggcatggcggctagagatccagagctccgaatcggccatgacgggcggctagaggacgagttgcggcagcagggcggcaacggcagcctgatgtggtcgcagcagcagagacggtaatggctcggtggaaggcgttgccggagaccactcgtcacttcgtgccgccgcctcgaggccaagacgagcccaccgccaccgcaaaaaacgaaggcgacgcgcaaccttgagttgctcccgcgcccgtcacccgaggtccaccgcccaccgccgccaccaccacctgctcgccgccgctgccaccgagcccccgcctgccgccggctcatgtcaaggggggagagagagagagagagagagagagaaataagggagagaggaggaagaagaagggtagcgagagagaagatgacatgtgggacccacatgtcagtgggtcctataatttttttgtgtgaatgacaaatggccccgcatatatattttttattttagtgccacataagcgccacgtcaatgccacgtggaataaagatcaggtcaacactgccacgtgcgcgccacgtcagcaaaaccgccctcgaaaaccactcaaggagtcaaattgcaccggttttgcaagttcggggtgaagatttatggtattacgattgagagatacgatttagattcggtggtcaattgacggagtcaaagtgatcttattccttttttttattggagtaggccagcacaggcccattcgtagacagcctgggccgaagtttttggggccgataggaggagccgcgggtcccacaagtcagtgtcctgttctcggtagaatacaggagcaccgggagcgtcgcggctgtgaccgcgaaaaggaccgtgagtacgtgtctccatgaaccgtaaatcgctctcgctcggaagaaaacacggaggaaagcggcaccggcaacgcgtccgggacaaagggccggcttcggcacccggcactgcagattttgatctattataagtaggtaagcgggtttatcacttttgcctctatcactagttcgctctcatgaataggacgagaaagagatgatagggaaaaaaaacgagaggagaaaaattaacgtgactgtgagaaggagggggagagatggagaagtatacggcgttgaggagtcggaccaggtccgtccaactgtccaagcgagtgcgaccacgattgagactaccggtcgtgactgaccgtggagtcaggttttctcacctgtattgatgaccttctttcatttttcatgtttttccctcaacactcaaaattttctctaatgagttaagttctactagcttcgtactccctataacaaaaaaaataatggtcaaagtacagctttaaaaatcataaaagttaatacgattcatattttatatttttgacacggaataaatatttttatgtcctattgataaaattgaataaccgtgtcttttatatttaaagcccttaacctttaatttctttctattattttatttgttatacatatcatacaattaataataccccgtatctagaatagtgtaccatgtaccatattcgtgtctgtatccgtatgggagtgtccgtataacatagctaaccctcatttgtgttttgtgccaactgtatcacaaaaatcagttccatcatttgttcatgcaacccacatgtaagtacaaacaacgatgtatttggatcgtgggattggattctaaactcttgatgagatataaattaaattatagctagttaatgtatatctataatcaaatttacttttttcgttgtaacttgtagaagttaaatttgatcttgcatgtttatggatttgtttatcacattttaatctatcatgttgatttttttttattttattttataactatttagatgacatgcaaacaacaagatgatatccctcaagagtttagaatagtttctagtttggaccgtccatattttttatggataattgctcatttggctctgttttgaagcataactaccaatcagactctacttattctaatttgctcatttgacccctttttcaaaatcaaagttaccatctaaccctactttctctatgatgttagggcttcattcaagaaaagggaaaaaaaatccatttactagtcaacctgatcaaaatacccttgatgacattcaaccatatccattcattagctcccaaccctatctctctatgttaggtgaggcagtgacgacgcacacgtagagggatggcacagtggtgccagcgtcgccggtgtggagagggagggagcggtggttgcgcatgaagaaagggagcgacgacgaaagctgcacacgaacggagcagcgataacggcgtgccaagagagggagcggtagcgcacgcctcgacaatgatgatgaggagcgatggcagctgggcccgggcgtcagagctaggactagggcgggaggattcagtaggggatgggtggcgaagctcaggctgaggcgggtggatgcgacggggaaggagtgtggagctcgggctgaggcgggtggatccagcggagaaggggcaacgatggctcgatgatgatgaggaagagcaccaaaggcaaggctcaggcggcagagttcgggctgtagcgatgggtaggcgatcaatccggtggcggctgagtatctagctacagatccggcggcaccgagacgtgcggactgcggatatggtggcggcatcgtggcagtggtggaattcagtgggtgtgggttagttgtcggcaacaacgacgatgacgccatggcaaagaggatggtggttgcattgacacgaaccttcttcctctctcccatccacaagctgtatgtattttgggtggatgttatccaaaattttgttaaattttattcatatttttctcaatctaaattaaatatgtcaaacatctatcaaatttaaagtccattttatcaaactaaagtcaaatttaacaaaaacaatttttgacaaaaatatgccaaatttgatgaaaatctgacaaatctaagtcaaacttatcacaaatcagtgaaacctacgctaagtgcattcattcatttgtatcaggggtcaccgatatggccgaaattatttgaatttttgaacaaaattttatcaaatttgaataaatagtaccaaatgagaaccaaaatttctgaaattttgttatggaattttgaaccctgccctcaaccactgatagcaaaatatttttttattagaagcagaattcataaatcaatagttggtcacttgtactaatgataatacaataatagtgtattacgagtagagagtctagagagtagagaccactgtaaaaggatcccggtacagaaggccaataaccattcacattttagagcttgccacagtcatagtccgccattttcagaagctttctcaccagcgctccggccaaccaattgtcacgcagaaagctgatgaccgcattgctgctctcctgcatgaagccgaccgcgtaggctgtcccgatgagctcggcgctcctccaccgccggatcctcgcgtactcacgcagacccgcctcgatcctctcgctctccgcaccgccgccgccgccgccgaggatggcgtcgccgaggcatctcgccagcacgacgccgtcctccagcgccgcgcagccgccctgccccaggtcgggcgtcatcgggtgcagcgcgtcgccggcgacgcacacgttccccttgctgatgctcgccagcagcagcgagagcggcggccggaaacgcagcggcgcggtgagcacgtccttcgcctcgctcctctcgatgatctcgagcacctcggctgggatctccgcgctattcagcttggtcagaacgaacttcttattcttggcgagagcatcatcatctggagcagcaaccaaacatgcgtgcaccggttaattcctggtcaccaatcgattcaccattcgtgacagtgtgtcaatgacagagactaaccgtgctcagaaggagaccaggtgaagaaccagtagacatcagtatcgttgcaggggatcacgccgagacgaaagccatggccgaagaacatcttgaacttgggatcgaagccgtggccgccagggtaacacgcgaggcctctcgtagccaagcgccccgagtaggacggctttgcgagccccagccattttgccaccacggaattgaccccgtcgcaaccgatcactacctgcatccgcgccattaacaattcaagaattctcagttcgcaatctttgggattcactgtgttttttcttcttctacctttgctcggagaattgcgccgtcggctaggtgtaggatcttggcgtcgccgtcctcttcgatttcaacgatcttggaggagtagcggatggtgccttctggtagctcttcctccagtgctcgcagtagccagtcccgcctgacgcagagcatttcgttgggtcctctgcatctaagccaacaatcatgtaagcgttgtctagaatgaacggtgtatataatcagtagagatcagtccgagcatgccatctcaccgtttcccctgctcattgagagacgttgcatgtgccatctctccggtgaacgaagagaagacatgcaacctgtgatgtgaaaaattaaggtctaagatatggagatggaaatttgcctccagagaatacaacctcctttcttgcatttcacgtaacaatttaatatgatatattaatatgtgatatgtcattgtataaacatgcaggttagaattcgatctctaaaaatatttataaataaataaaaatataacttgtacgtgtaaattcacggtcatatttgtctttttacaatatgtaggagctaaatttaaacatacatatttgtgaaatagaaaataaggaatactcaaagaagtttgagaccatctagcagaacacaacacgagattaatttaaaataaaatataataattttaaattagaaaaatataaatatgtgagttcaagtatcaatacaattttgaaataactgtaatccggaataataagaaatagtgaaaacagatcaatattgaacactatacaagactaactaaaatcggaaaaaaaatgaaaacaaaattagaaatttaaaaaaaagttcaactaggaacacgatttataaataacaaaaatttggagtaaaaaataaataatattgaaaaaacattctatctataacacaacagtgacaatgatgataaaagagaacaacatgcgagccgtaaagaggaagagtggtgacggttaatgggaaattaaaaaacaatatctaactaatgattaggttcagtaggggagaggcgacgggaaggtcgtataagagtagtgttgtgctggttgacgggactattagaaagtaaaaaaagaaacctaataataataatcatgtttaatttctaaaatctcaatgacaagaacatcgggcatgccgtgaaggagtctagtgacggcatttgaggggacttccaaaaaaatatgggcttgttcagattgtagccaaaataaaccttaccaagttttggcaatgtcaaaattttggtaaagtggtaatattgctaaaattttatagcaggatttcttatgtattgatcaaatttggcaacaaactaaatataaccattttttttggcaactttaccgaaaaatggtatggttgaaaatagcatcaatagatagacaaagaagtgaaagtcggtggtgggtgtgacttttaaaacatataaaaataaaaaaacaatgatgataagatttattttaaaaatcttaaaacaacgagattattatttagcaaattttaaataaattagataattttaaatgagtgctagccgtgtgtttacgcagactaccagctagttctaatgatatgtaataattttctcgtcaaagatatatcttcatgcagtgttttaaaccaggtgcgttgtacttactcctgaagatgcagatgacacttcctgatcttgtcgcctaccccaagggcgtcaagcgcttgcaacgcattcctccacgtcgcgatggcgaaccccgacgccctgagctccggcgacgactctagcaccgtgcacttcacccctttcctgcatgcggatcaatcaagcaagcaagcagatgatatcagctcagctcaagttaacatgcagctgccaacacggcgacacatacagaaagccaacacattctcagggggctcagggggtgtttgggagagaggggctaaactctcaaaaacataagtccctctggttttgtgagaggggctaaaatataacaccccctcagtttcccacctgtgcagcccgagagccacggcgagtccggcgattccggctcccacgatgacaacggcatcctctccggctctctttcgttgcaatatagttgatgccattctactagctagtagatggtgcaggctaactgggggtcactgttttataaacaaaccaagttcacataggccgtgtctagatgttttggcaaaaaaaaaaaagtttgacgtatacggacacacatttaaagcattaaacgtaaactaataataaaacaaattacagattccgcatataaactgcgagacgaatctattaagcctaactaatccatcattagtaaatatttactgtaacaccacattgtcaaatcatagcgtaattaagcttaaaatattcgtctcatgatttacatgtaaattgtgcaattggtttttttattcatatttaatgctccatacatgtgtccaaacatttgatgtaaaaaaaattaaaagtttgaaggtaaataaagacagtcgtactagtcagcttctgtaggctagctgtagccacaagcttcttacacctcacgtttttttagccgcacctcacgtttttctagccacaaaagtccttattgatccacgtggctacagcctacgggctgcatcaatcaagttcgtactcctcctagtattccctcgaaaataaaccaaactcttacaacaatataacacattctaggacgattagtttattttagaatagacggactctctctccatcccataaaaaaccaatataatactgaatgtaacatatattagtattacgaatttggacatatctctgtttaaatttgttgtactgaatatgtcacatttaattttagactcggtttttatgggatagaggaagtaggtgcttaggccctcgagtctgtgattaatgggcaaatcatactcactccatccaaaaaaaaggcaaaccgtggattcccgtgctaacgtttgactgtctgtcttatatgaaatttttttataattagtattttcattgttgttagatgataaaatatgattaatactttatgcgtgacttatctttttaatttttttcataattttttcaaataagatgaacggtcaaatattggacacggaaacaagggtttgtctttttttaaggcggagggagtatgccatacctagcttgacaattgatacccctgacactgattgaagcattgtgtggctgctgtactctagaaaattgatattttgccattatcgaaacggttcgctggagtg

SEQ ID NO: 7253 - DNA, 1140 bp, Oryza sativa
tcctagaatttcccatgttctctccgtctcaacgtgtggaattgaagtactagtataacggaattgagatattacggctgcctcgaaccacaaagcatctaggagtatatgttaagacagagagaacacatgaatatattttagacggagataacgcatgataaagtagaggagagaacacgataaagatatgacaaagatgtcctttatcttcttatttatttgttctcgtaattaatgaactttctgagtctcttttagatgcaggcaatcaggttatattaaagggataacgacgacaggaggtacaattcttcattctctgatgtatgcaaataacctaatcactgtgggtcaggcaaatgatggagaagctactagaatttttcaaactgttcaaacttgttgtgctcaatctgttcaaactcctaactgggggaattttctattttctttagctcaagcactcctaatcaacaaaaacatcaaattctcaatatttttcatgtccctctgatagaaaattccactaaacatcttggtcaccctttgattattaacacaagaactagagcttctgcttataagtttattatttccaaattcaaagctcgtcttacctctcttaaagctaacatgctctctcatgctagccacttgtctttaattaaatatgttttcgcttcaatccctatttactgtatgtccacgattttacattctaagagcttattgaacaagttgacagctattattagcgcggttttggtggacaagagtgcataatgaaggctctaagaaaggtatttcctggcggtcttggaatgatttttgcaaatgcatctcctaatactatttctcagctttgggatgacaggacatgttgggaactgagcaaactcaatcaaatatttgatcagccaatggtacaacatataatgaaagttcagatcgttcctcgggacaatgaagacaaaatttgctggattcataattcttcaggtgaatgtacttcaaagagtgcatacaagcaggtatataatctatcacattcagttttcacaattgttacttctttgcagcttaatattcttttgaaaatctgttccactaagtgcattcctcctaaatttaaaactt

SEQ ID NO: 7254 - DNA, 6694 bp, Oryza sativa
  unsure (1)..(6694): unsure at all n locations
nnnnnnnnnnnnnnnnnnnnnnnnnnnnnnnnnnnnnnnnnnnnnnnnnnnnagctttgggatgacaggacatgttgggaactgagcaaactcaatcaaatatttgatcagccaatggtacaacatataatgaaagttcagatcgttcctcgggacaatgaagacaaaatttgctggattcataattcttcaggtgaatgtacttcaaagagtgcatacaagcaggtatataatctatcacattcagttttcacaattgttacttctttgcagcttaatattcttttgaaaatctgttccactaagtgcattcctcctaaatttaaaacttttatttggagacttaatagaaaggctcttccaactgttgccaatcttcacttaaaattctgtgacattcctgatatttgctcttgtttcaattcttcagaaaatgaggttcatcttttttttcactgttcttttgctagagtcacttggcatatttcagaaatcacttttgttaatcgcatcactgatttaatgtataatgtctctgatattttagcttacttgcttgtcacaaacaaatctgagaacatcctacaaaaaacttgtgtcatgcttaggtttatttggatagctaggaatgactttttttttttgccgggacggcaagaacaccggccgtagtatattaagaaagaatgaccagtattttaagaataaaaaaaagaccgcaaaaaaaagagttttatttgtatcctcaagattcagaacagtagttacttgacataacacttaggccttagctacattacagacctgcaaaggctcccattccttttggaactcttccaattaaagatgatattgctgctgcctctatcaaattgttgccaggaactagatgttatgtagatgcttcttggaaagataatctgtttgggtttggtatctttattcatgactctctaaatcatcaagctatttttgttcaagcaaaatcagatctttatgtgtcccttattcgggcagaactagcagctttttaagttagctattttcatttgtgttaaacttcacattgcaaatccagtttttctttcagataatcaacagttggtgtttcttctccagcaatcaaattacataaatcaaaatcatcattggagccttttaccgctgcttgcaataaagctgcgttaattttcaggtggtgcttcaatcaatactacatggattccaagagaaatgaacaaaatgattgattacttatctaggaaaaggccagagaatcaagggttgttttgcctatagcaagctgtcaaaaatattaatcatgtttgtaatagcaaatactagttccaccaaacaaatcctgctttttgcctcttgagcagctgaaaatgttgttagagtgcgcagcccggcccaccaaccgtgggccacccaggtcacattgggtctgctccaccacagacccaaccgaagccataactttaggtcctaggattacacaacccaaaagactagtctgatggggtgaggaccgccccaccttttaagtgggactaaacccagcaatctccctcgtcacacatcgggcccaacaatctccccgtcacattaacccatgtgacctcgaagacttgttacctggcctcaggcccaacaatctccctcgtcacattaaccccatgtgaccccgaaaacttgttacccgggctctccaccatgtgacccatggaaattgttccgggttccaaaccggagctagtcttttgggttgtgtaggctcaggacctaaagttgtggctccggttgggcctgtattggagcaggcccaatgtgatctgggtggcacatggtcggtggcccaggctgcgtactctaacaaatgtatcccttgtgcacgtgttgtgcttttaatgtttgatgtaacaagttctaaaagaaagaacatgataaagtacagggagaaggaatgagagataataaattattccttacacttcctccgtcccaaaatataatagattttatatggatgagacatatcttagtactataatttaaacaagtccagattcatagtactagaatgtgtttcctcatttcaaaatcccttatacgttgggacaaagggagtataagaggcactaggttcggcaatagcaaaaaaaagagaaaagttttctgttttttcgtgcgcacttttccaaactactaaataatgcattttttaaaaaatctagatgcgtgacccacacaattgtgtggctagcatctatacaaaattatctatttttaaaataattttacataaagtttattaattagatatctcgttgtcttaagattttgagaaaccaaaccttatctccccgaattaaatttgaaaatgtactattcatttgttttttctctcagaaatattcgggatgcaatttttttacacaaatatactatcgatctcgcagaaccattaagtgaaaaatgacgtgggtgtgacgacacagatagtgtcgtgcggtgacattgcgagaccgagctgtctcgcatatggaaatagcgagaccgacgtccatgtcgaacggctccaatttaatttgtgattaattacccaattaatgactaactaataataattagtgattaattattttaattagcaattaattaataaattgctaatcaggataattaattaatttgaagcggccaacctgttcggtctcgctcgctggtaatgcgagatcgagcggtcttgcaccgtcactgcgtgacacagcgcgatctcgcgccgtccgtgccgtcatgcccatattattttcaaccaacggttatacgagataacggtatatttctatcaaataaattgcataaggaatatttttgagggaaaaaaaaggttaatgaatagtatattttcaaagttagttcttaaccttcctgtgtttctaattttatagtttttaaaaatcgtacctattgctacccttactcctatcgctcccttcgttatttgctcgatctaccattgtttttatttatttttatggaacctttaaaaattaaatcttatagtttttaaggtttattatctcattagtttttatttttataatttttataagtcccgtcaaacaacgatacctttgtatactcctctaatgataatacaataatagtgtattgcgagtagagagtatagagaccactgtaaaaggttcccagtgcataaggccaataaccattcacattttagagcttgccacagtaatagtccgccattttcagaagctttctcaccagcgctctggccaaccaattgtcacgcagaaagctgatgaccgcattgctgctctcctgcatgaagccaaccacgtaggctgtcccgatgagctcggcgctcctccaccgccggatcctcgcgtactcacgcagacccgcctcgatcctctcgctctccgcaccgccgccgccgccgccgaggatggcgtcgccgaggcatctcgccagcacgacgccgtcctccagcgccgcgcagccgccctgccccaggtcgggcgtcatcgggtgcagcgcgtcgccggcgacgcacacgttccccttgcggatgctcgccagcagcagcgagagcggcggccggaaacgcagcggcgcggtgagcacgtgcttcgcgtcgctcctctcgatgacctccatcacctcggctgggatctcggcgctcctcagcttggtcagcacgaactgcttcttcttggctagagcatcgtcatctagagcagcaacgcaccgatcaattgctgatcactaatcgattcactgttcgtgacactgtgtcaatgacagagactaaccgtgctcagaaggagaccaggtgaagaaccagtagacatcagtatcgttgcaggggatcacgccgatgttgattaatttcagctgtggcccaatgcaagccgattctctcggagctgaacgggaggatgaattagtctagcaggagtttgttagagatgcaaataagtcgcaaatcagttaatcgtgaccgagtctagcgctggcagtggcgcgggtgtgtgcatggagttcagagaaaagcggatcgtgggatggcgcgattttgcctcggattcctattttttttgcgttgagtataagtagttctcttagctctttattctttttgtaaggtttacattcagttgaatgagaaaaacccagaaaaaaattgccccatacattctcgcaagaattctttctctgaaacttctcctctgctctgtttgctgctctgttcgttgttgccgctgcagttcttgccgtgccgggcgtgaacagtctgccagcaaggtgtttgatcggagtttttttgctattgccaacaagtggtatcagagcactcaggttgagggctgatctgacaccatggcgttggttccggcgggagcgggagcggatccggcgagggggagctcggggagtgctttctcctacccacaactcacggcaacgaactacaccagctggtgcattcgggttcaggcgatgatggaggaccagggtgtctgggacgccatcgagccggcggccggggtggccgtcgacccaagaagggacaagaaggcgaggtcccatctgttgcagtcccagccggaggacttgctgatgcaggtggcgaagaagagatcggcgaaggaagtgtgggattgcttgaagacaaggttcgtgggcgcggaccgcgttcgcgaagcgcgcttgcagacgttgaagggtgaatttggtgccatggtgatggacccaggggaaactctggatcagtacgcgggccgcatcaccgcgatgagcgtgcgtcactcggcgttgggctcgacgctgggtgattccgcgatggtgaagaagctgttcgacacggtgccggaaaaattcgtcagcctcgtcgcaggtattgagcaattttatgacattgatactatgccatttgaggaggcagtgggtcgactgaaggcctacgaggagcgcatgcggaagaagaaggctgccgccggcggggtcaccaccgacgggcaggtgctcctcactcaagcggagtgggaagctcacttcaagaagaacggcggggaatcctcgccaccacagaagaacaaaccttcaggtgaaggtgctgggcgcggccagggcggtcgcggtcgcggcagaggccgtggcgcaggcggacgcggcgggacgccgcggggcgactcaggtgcaggctctggcggcggtggccgtgacaagagtcacatcaagtgcttcaattgcgaggagtacgggcactactctaaccaatgcccacatccgaagaagaagaagggagaagcacatcttgcacagacggaggacgccgggcctgccctgttgcttgcggtgacggaggatgtgccagagcgcgcgtcgtgcggcttggtcgtacgcgagcagcgcgtgtggcccaagctgctgctggcagacgctggtggacatgctggcgatgtctggttcctggacaacggggccagcaaccacatgaccggcgatcgaagcaaattccgggagctggacgagtcgatcaccggacgggtgaagttcggcgacgcttccacagtgcagatcaaggggaaggggtcgattcttttttcatgcaagaacgatgatcaatggctgctacaggacgtctactacatccccagtctgcaatgtaacatggtgagtttgggccaactaacagagaccgggcatcgcgtggtcatggatgaggatgtactcgaagtgttcgacaaaagtccatggcggctggtgatgaaggtgaggcgcactgtaaatcgtctttaccgaattgagttgaagctggcgcatcccgtgtccctgctgtccagcctcgacgacccggcttggctgtggcatgcgcggctgggacacgtaaattttcaagcaatgaaactgctggtggacaaggagatggcgggggtgttccggcaatcgtccacccgaatcagctgtgccaatcttgcctggtggcgaaacaggccagggcgccgttcccggcggcggcgcacttcagggcggaggagccgctcgagctgctgcacatagatctgtgcggcccgattacaccgaatacgatgtctggtaatcgctatttttttcttatagttgatgattattcccggtggatatgggtgttcgtactcaagacgaaggatcaatcgctcgatgctttcgtaaagttcaagccactggccgagaacacggctgggcggcgcgtgaagacgttgcggtcagaccggggtggtgaattcctgtcaggcgagtttgcacaggtgtgcgaggaggcggggattcaacgtcacctgacagcgccgtactcgccccagcaaaacggggtggtggagaggcgcaaccgcacggtgatggccatggcacgctcactactgaaggggatgcgcgtaccgggcaggttttggggggaggcggtgcgtcacgcggtgcatctccttaaccggctcccgacgaaggcaatgggtgatcgtactccgttcgaggcatggacggggaggaagccacagctgggacatctcaaggtgttcggctgcacggcacacgcgaaaaacacgcagccgcacctcaagaagctggacgacaggagtgcaccgtacgtgtatctcggtgtggaggaagggagcaaggctca

SEQ ID NO: 7255 - DNA, 11262 bp, Oryza sativa
caagctatcgagaagctgccggccaacctgcgtgggaagaagcaatgcagagggagatggaggcaatcgagaagaacaaaacgtgggagttggccatgttgccagccgggcaccgagcgattgggctgaaatgggtgtataagctcaagaagaacacggcaggggagataatcaagcacaaggcacggttggttgcaaaaggatatgtgcagaaacaaggggtcgattttgaagaggtgtttgctccggtagcgaggcttgataccgttcgtgttgtgcttgcagtggcggctgatcgccgctggcaggttcatcatcttgatgtcaaatcggcattccttaatggtgaacttgaagaagaggtgtatgttgcacaaccggaagggtttgctagatcaggaaaagagcatcttgtgctcaagctgcataaggcattgtatggactccggcaggcaccgcgagcctggaatatacgcctggacagaagcttgagggagctcggctttgatcggtgtacgcaggagcaggcagtatacacccgaggcagaggaagtgatggcataattgtcggcgtttacgttgatgatctcattgtcaccggagaaaatccctctgaattgaaggttttcaaggaacaaatgatgggggagtttgagatgagtgatctcggtttgctcacatattatctcgggatagaggttgatcaggatgagagtgctaccacattgaaacagactgcatatgccaagaaattactgtctcagtttgggatgatggagtgcaactcagtttcaattccaatcgatccgagatcgcagctgagcaaggatccagaaggtcacccggtggatgcaactgagtatcggcggatcatcggtagtcttcggtatttgcttcacacgaggccggatctgtcatatgctgtcggggtggcaagcaggttcatggagaggccaaccgtgatgcatttcaaggctgtgaagcaaattctcagatacatcaagggaacgatggattatggtctcgtgtatgctgcaggcactggggcactgaagattacagggtatactgacagtgacctcgccggggacttggatgatcggcgcagcactggtggaatggcgttctacatcaatcagagtctggtggcgtggagctcgcaaaagcagaaaactgtggcactatcgtcgtgtgaagccgagttcatggcagccacgacggcggcctgtcaagcgctctggttaagattgttgctagcagaagtggcgggagtggaggagaaagcagtgaagctcttcgtcgacaataggtcagcaattgcattgatgaagaacccggtgtttcatgggagaagtaagcatattgacacccgttatcacttcatacgggagtgtgtggatggcgggcaaattgttgtggagttcgtccggactgaggagcagcgagcggatgcactgacgaaaggattgccggcggcgaagctggtgacggcgagacaccttcttggtgttcgttcactagggtcacggcagaattaagggggagattgttgattaatttcagctgtggcccaatgcaagccgattctctcggagctgaacgggaggatgaattagtctagcaggagtttgttagagatgcaaataagtcgcgaatcagttaatcgtgaccgagtctagcgctggcagtggcgcgggtgtgtgcatggagttcagagaaaagcggatcgtgggatggcgcgattttgcctcggattcctatttttttttgcgttgagtataagtagttctcttagctctttattctttttgtaaggtttacattcagttgaatgagaaaaacccagaaaaaattgccccataaattctcgcaagaattctttctctgaaacttctcctctgctctgtttgctgctctgttcgttgttgccgctgcagttcttgccgtgccgggcgtgaacagtctgccagcaaggtgtttgatcggaatttttttgctattgccaacagccgagacgaaagccatggccgaagaacatcttgaacttgggatcgaagccgtggccgccagggtaacacgcgaggcctctcgtagccaagcgccccgagtaggacggctttgggagccccagccatttcgccaccacggaattcaccccgtcgcagccgatcagcacctgcatgcgtccccgccattaacaattcaagcatcccgggtaatacttttaatctccaagatagatatatataagctgtaacaaaaataacaaatcaaactctcattagtatacatatattcacagttaaatttgttgtttttgttacttccttcgtttcacaatgtaagtcattctagcattttccacattcatattaatgttaatgaatctagacagatatatatgtctagattcattgacatcaatatgaatgtgagaaatgctagaatgacttacattatgaaacggagggagtagaacttataaaagttgaattttaacttgcatttttgtggatatatcatctatcttgtaaattttttttaatttttttcatgatcattcagttgacatgcactaaacgagtggacatccgctcgagtgattagaatccatcttatcccccgttcatataatcttttggattcactgtgaaacacttttagcaacttaggtagatatccatccatttattgcatgtcaactaaatagttataaataataattaaaacaacttgataatattaaaatatatcactctactaacagacaagttcaaaatcaacttttacaagttataacaaaaataacaaatgaaactctacatagtgtacgtatatttcacagtaaaattgctacatcttataaaagttgaatttaaaattaaatatgtttatgaactgatatattacatatcaatctatttatcagtttttctaaaaaaaattataattattttgttgatatgcaataaacgagtagacattcaccgagtgattagaatccatctaccgatgtacggattcactctgttctttttctacctttgctctgagaattgcgccgtcggctaggtgtaggatcttggcgtcgccgtcctcttcgatttcaacgattttggaggagtagcgtattgtgccattgggtagctcttcctcaagtgctcgcagtagccagtcccgcctgacgcagagcatttcgttgggtcctctgcatccaagccaaatcggcgtgtaagcacggcctggagtgtgtagtagagatcagtctgagcatgccatctcaccgtttcccctgcacattgagagacgttgtatgtgacatctctcccgtggacgaagagaagacctgcaacctgtgtgatgtgaacgattcagatcaaaacatagagatggaattttgctctaggaaatgtccacttgtttcttgcatttatatttttttcaaaaaataattaatatacagtatatcactcaaaaagtacaaaattaaattaactactacaatttctcaattaagaattaactactaacaaattaaaatgtacataatattcatatattcacgtacggccgtatattcttttttttttgcaacttgtagagctcgaattagacatacatggtaataaagtatacacatgaatttattttgtttcatctaaaaataaattatgcatgtttgagtgacatgcaaaaacgaaataacaaaggtgtatctcctgcagtgtttaggtctttgttaagtcttgtgcgacttcgtccactcattaaggcgcgcacgttttttaatatttaactctttaaatgcgcacgttttttaatatttaactctttaaatatttgaccaataaactataaattaaattttattcgatgaaaataatattattggattgttatttaaatttactttcatataattataattttattgcgacaaacattataatatatgagaaatttaaagttacaaattagttttaaaaattgcgccaagtttaaccgcactttagtgagtggacgaagaaagtacactagtacttactcctgaagatgaagatgacacttcctgatcttgtcacccaccccaagggcgtcaagcgcttgcaacgcattcctccacgtcgcgatggcgaaccccgacgcccggagctccggcgacgactccagcacccggcacttcacccctttcctgcatgcggattaatcaagcaagcaagcagatgataccatctcagctcaagttaacctgcagctgtgccaacacagagagcagtctatatccagttatccggcaaacgcatcgctcgccgcgccgcgcgctaatagctaagctcccacctgtgcagcccgagagccacggcgagcccggcgattccggctcccacgacgacgacgacgacgtcctcctcgccagcttccttttgttgcaacacggttggtgccatccttgtgtttggatttaagccaatatcatgcagtagtcagcttctttagccacaggccctcttattacttattaggagacacctcacgttttttttcagctttcttagccacaaaattctctattgatcctcgtggctgcaggctgcatcatgaatagcctatctcgcacgtgtttggatcctggagtcctgctgtctgcgagagtgatggcctctagccgtagcttgtgtggctgctgtactccggtgagtgttgacatgtttcccttaccacctataactgcacggttaccgcggggtatggtaaggttatcaatagtagggtttttgagcaaattcaaaaattctaaaaaaatagaaaaaaatcatggatgtagttcttgatttttaatggtagatggtgaagaattttttttttgaaaaagagtaagataaaatcaaatttgagggcaaaaccaataattgtttaggaaatggaaaaaagaaaaaacatgtattggccttaatttttgcattttacatccaagctaggttttcaggtatcctatatattattataattatccttaatttctacacacatttaagtgtttttaaatttttttagcatttttttcataattttatgttttctacaaatatcgcggttaccgctcaaaccacgcagtaaccgcgaaactgctaattttttaatttaaattttttgaagacgaaattcagacagttttcaacggttacagcgcggttatcatgataaccgtcttaccggggtgggggcggtaacctctccccttaattttatgttttcataatttttttcataataaatgataagtgcaaataatcacacgatgaagtagagaagataaatgggagagagaatatgctgtatctcatgtaagaggtaatctataggagcaaccttttccaagagccatgacccactaataggcatatatagcgtgccttgacgactgaaattattgctaatgaaaaaaaattgaaaatattgttcaccatttttttctcgaaaatataacactgttgaatttttcacaagattagatcgtcgtagcaagaacggcatgcaaacacgtaacgagtttgtctacccaccatcagatttggagcacaatgcgcgtggatccagctcctctgaccttggatggaaaaggcagagaataagggcccgtttagttcataattttttttttccaaaaacatcacatcaaatctttggacacatacatgaagcattaaatatagataaaaagaaaaactaattgcatagttatggggaaaatcgcgatatgaatgttttaagcctaattagtccgtgattagccataagtgatacagtaatctacatgtgctaatgacgacttaattagtctcaaaagattcgtctcgcggtttccaggcgagttctgaaattagttttttcattcgtgtctgaaaaccctttccgatatccggtcaaacgtccgatgtgacacccaaaaatttccttttccctaactaaacacaccctaacagtaaaatgtgtctgtgctacatcagaaacagtaatacgtagtgtttcactgtagcaacagcactctagctctctaactttacccatgtaaagtcagaggatccaaatccaatgcgcgtgtgggcgggaagctaagtaagtttattgggccacgatatctcatgtaccttcagcgcgaactcggccgtgtgagaccacaagcatgcatcatgcctgcacgaactcagggcctcattggatggatgtttgggctgaggcttttcagccaaaacccattgaattgcttattgggctgatgagtaccagccacagaaaatcttcatcaagttaaataagccaatcaaaccaatcaatggtttttctttagcttaaaggaaaaaagccaactttggcagtcaaagctatttgcttaccgatgagggcttcgtacagtgagtacaaccccatgaaggtgaggacgacgtcaacttcacgagttcacatttgctttgatcactttgttattaaggccgtgtttagttctatttttttttaaacttccaacttttccatcacatcaaaacttttctacacaaaaactttcaacttttctgtcacatcgtttcaattttaactaaacttttaattttagtgtgaactaaacacagtctaagagagaatggtggtattttaacttgtaagaaagtttcacttatgttcataaaattacaaagtgtgtattgaggttcgtaaacttgttttatcgtattattctagtccaaaacaacttggtttatcgtatcattcttgtccaaaaccttgtttgacctacttagcatgctacgtggataatgacatggcacttttttttttccctttttttctcccctctccctcagggaattttttttatttatacttttttttattaaaatatttacaaaaataatttgttgtttcgaaaatttacaaatctaatcgcctgccgccctttgagagggcgatttttaaaaatcgcccttccacagggcggcaagggacctaaatgtaaattttccagcataacttgttagctctataattttacaatttaaaattatattatataaagtcagatgaaataaaactttatatcaaaattgtagagctcaaggagatctacaactttgtagttaataactttttcatttaagatgttttagatatccaaatattcgttacaaaatataaaacacattttaaaaaatctcagatctacatttcaaacgacattagatggagataaactttatataaagttgtagatcttgatgagatctataactttgtagtttatcacttttccatttaaaatcatttggagtatcgaataagcattattagtttttaagcaattaaaaccggtgggaagggtttgaacacaaataaaaattttgtatttaggtcccttgccgccctttgagagggcgatttttaaatatcgcccttcttaagggcggcataagggcggcatgcaattagatttgtaaattttcgaaacaaaaaattatttttgtaaatattttaataaaaaaatgtataaataaaaaaaattcctccctcaggagtccggaccggtttgctgcccgccgccggcatgtgggccatatttccttttccatggtagtaggccagtacaggcccattcctaggcagtcccggcccgcaaatttatcggcccaatatgaggggtgtcgggtcctacaagtcagtctccttgctcgttctagcgtgttcggtgttcctcgatagaaaagaggactgggggtttagctgcgcgctctctccctcccccaattttctctttcctcatctagggtttccgcgtcgccgcggccgcgagtcgccatggatttcgacgagtacgactacttggagaagacggtggagggctccggggcgccgtccaacggcgccgccgcgcccagatccgaggagaaggagcgaagctctcgccgccggaacggcggcggcggcggcggcgacgaagagcgcgacgatggcgagcgcagatccaagcgctctcgctcggaggagaaccgcgaccgcgacaaggacaaggaccgggaccggcaccgcgaccgcgacaaggaccgggaccggcaccgcagcagccgggagcgtcgcgaccgcgaccgcgaccgagaccgggacgagaaggatagggagaaggagagggacaaggacaaggagaggagaagccgggaccgcgagaaggagaaggagaaggagaaggagagggagagggagagggagaaggatagagagcggaggagccggagccggtccgagcgccgccgcgacgacgaagaacgtgaccgcgaacgctaccgcgagcgagactaccgtgaccgcgatgtcaggtgccgattcatgaccttacccacctgtattggtgccgctgtgttatgaactgagtggtcttaacggacttgccgattgcttgattccaaaaagctgccatccataatctcgttttcaccacgtttgatgcgcttaggcatcgttgtctccaacaaaatcaattttatttttctacacttggtcatgatatattgtaatattcgcggaggattgcatgggatggggatagcaacatagtttgagtgtaatgagtatattattatggggtgcattgggacttttcttcttatttgtacaaatgcagcatcaatttgtaaattgcgtgtaatagttctgctttcatcgtttagcataatttatagcagatgatttgataactcttctatcagagtattcctattgcttcctataattctactgctattaacagttttttgtattatatacctcgacttcttgtaaattcctacaatttgaacattagtatgggtacctgcagattcaatttgctagagccatcttctgtggtcttgatgttgagcctgacctaggatatcaggtgatttttttttaatactactattattagataggagttagtgttctatgttagggttactatgatagggaaattcaagatggatgatacaatttatgcttttgagtggtggtctgagagcaatgatggtgccatccacgcataaagttttgttgcatccagaacatggagctgaactgtacttcttgtgttgcagaaatgctggtgagcggtgttttgggcttcttcactgaagcattgtgtcttattgttaaggggactcagtattcggcccgctgcacaaacaacccttattgctttttacccttttcaggagatgtcaactttgagttgtcagagttaagagttgtgcgaaacctggttagatgatggttcagagcccactcaccgttctaaaccgcatgcatccatgcagaagggggggggggagcagctgcatgcatgcatgtgcaacactgggtcaaatggtttagtaaaaccgtttttgttcacccccaatcatggtgatgcatgtctatgccttacaacaaagggctttttacactacattttttgcttatctccaaggcatgtcttgttacgatgtgacttgatagaatgttgatgggccacatattctaatgaaatgtctaactcgattagtcagttatgatctataatgatggctgaactatgctcagtgaacgttgaaagttattcttcctggacccctagatctgacacattcatttcttcaattattattattggataacttgttgggtagttaagcgttgtgatcttaacaaatcttgttatttaggtgagaccgttagaggtagggagagaggattgagtggtgatataaatttatattagtatggatggacactaacatgtagggaatgattgatattgagaaactgaggtagtattctttttatgaggaactccattactgttggagctgatgattaatgtgggcttgtattatatatatatttttctatattttcgtatcaatgcttatgacagttttgcttattgtctgtgcaaacgtaggaaaaaaaagggtggagagcctgaagcagatccagaacgagatcaaaggacagtatttgcctaccaggtgcattttagtgtaacatttgaatttcactttgtgaccaggaaaatgctgaagccttttctatttgaaactaatgtttgtgagcataatcacagttatctctgaaggcggatgaaagagacgtgtacgaattcttttcaagggctgggaaggtgatcctcactttgaatttgcttgtatcctctttagtagtaaaatattttatgattagcagatgaacatttacggcctataattgtggtttggtgggaaaaaaagttcttctgatggttgctgcgcatttgttcagtctcttgtcattgcatcaaatcaataactgtgctgacattgattactttttgtaggtccgggatgttcgcctcatcatggaccgaaactcgcgccgttctaaaggagttgggtgagtttttatagtgaattctgtgcaacatatcagatcgttgttttatttgttacctgttttttttccttgagttgctaaaagaggggttttattttcttagtggcttggaatatctagcagtttgcttataatagccaaatatatctattgtttacacatttgatgggagggaggcagggtgttacttgtgtttcctgttttagaatctccaaaagatctgattagactttggtgttctactgattgttaccttggtcgtttggtgcctcccatggattcataacctgagatctagagagggagggtggggcttgattttaggttttacagtatcggaatgaactcgttagtttgtgctcataatgcttctggttttgtgtccaagtggcaatattgacttactgagaatgagggagatggacccactgttttggggttttagtctgtgttgctaagccatttgtttgtagcaagcaaatagcaaatgcctcctagctttctgtaaagctgctccagttttgtgctcatgtggcaaatattgtgatttaggttgttggattcaatgttaggcatgtttgcacgtgagtgtaggtgtgctgtaaggtccattgttggtgggcaacaagggaaggagatgaactgaatcagaaggtatgaaccagagtggagtagatgtctcacaagaggctgcaaagagatcaaatgtgtgagaattgttttttgggtggggggtgattggtagggtatttcaaatgttaatgaataccgaccatatttgtcaatatttttctggttgctgttatgattacacaagcatttttaaactgt

SEQ ID NO: 7256 - DNA, 706 bp, Oryza sativa
tgtaatttgcacttggtcataatattgaagccagtgatttgtttcagttatctgctgtctatgctatgttttctcctttagaaggcaactgttataaccatagttaattgttatcaccaatccatctgggattgcagacgttattcaggaaaaaatcgttgaagaagaaggactggatgctcttctgtcacttctagaaacatcagaaaataccacaattcatcgagtcacagctggtgctattgctaatttggcaatgaatggtaatgcctattccaacctctcatgagatttattttccacatttggtcaaaaggggctattatttcattgtatagttggctcactgctgataatattgcagcatggaagtagttgttaaccggtgtgttctatagtctttcactaaatgtcttccgcacatgccaaatggcccagtcattgactgaaggaaaattccccaataggtttccagcatgagatattctttttacatatttgaactatatctatattattagtcaaatttatattgcgatatttataaaatgaacaggcaataacttgagtattaagttagatccttgtaagtgcaggatcaaaccagggactaataatgaacaaaggaggagctcgattattagcaaatattgcgtcgaaaactaatgatccccaaactctgcggatggttgctggtgcccttgcc

SEQ ID NO: 7257 - DNA, 593 bp, Oryza sativa
  unsure (1)..(593): unsure at all n locations
nnnnnnnnnnnnnnnnnnnnnnnnnnnnnnnatgggccaaattaaggctcggagttattactgcctctgacgctcacaacgtcatttccaagcctcgatctggcagcaaatggacagacatgaaaatgtcctacttccacaccttgctctacggtggacacatctatgccggtccgggccaggataatttctggtgtcatgctgccgccttcttcttgaggaagcctaaggccttaactgcctcggcttgggtaagctcggatgaatcgcgaatatcacgacggaaaatttgcgaacagactgggagcaggttttcttcccatgtcttatccattgcgataaggacgtcgttaatctccttgataatttcgtctcctgctggggttacatcgcgttctggctggcgttctgctgagaagttgataccttcctcaccctcggtattaacatggtcgatggcggcatccaggcgctcacgtcgaggccagtattttgctgcctgcttcacgaccgtctttaggatcatctgctcttcatnnnnnnnnnnnnnnnnnnnnnnnnnnnnnnnnnnnnnnnnnnnnnnnnnnnnnnnn

SEQ ID NO: 7258 - DNA, 9612 bp, Oryza sativa
cccacatttcactatagaagagaaaaaagagagtctataaaaaaaacagatctaaaaatctcacaacggcacggttaatttatataaaaccggcaaaaatcctgccgttgacttactgaactaaagaacaaccatccaataaggaaaaaactcctaaacaaagctttaaggacacgctaacagaacgacgacatcgcccaatccaaacgaatataaggttttcacccgaagaaatcttttgatgtggagttgaatgaggactccatagcaacgccttcaagaaagtgaacagcgtcagaggatgtcgccgccgctagcaccgtcaagccaagcaagactttcaccttggagtcctatccaaccatatgccacctgcacatcgaaactacttgcactatgtacaccacctacacaccacaacaacccgcaccacgactggacagcgctgttgatgacccgctcctccacctagccgggccgctgagcttcaccgagtcgtggagctgaaccatcgctaccaccaaacgccaccatatagggaccaccatagcacctagatccggatctggatctgcaccgttgatgaaattgccgttagaatttcgatcatcccgccacgataaatgtattatttatcctatagcacttaatggagagatgctaagtactaacggaacattaacgacgatgatatttttgagacaaattaaatcgctgatgcaatgacatttcatgaaacttggacttatttgaaattgtgtgcttgtcaattatatttatttggattttctcttagattaattatgcatcctccgttcctccagccgatcgatcgtcccgtcgatacaccagaaaacgaccagaaaacatttttttttgaacaaggtaacgtggctatgcatgccgagaagagctgagggaagcaggaagaagcatcccctgctattattacacccccagaagtcgaaaggcgcgatagccatgaaccgtccagcgcacgcgcgcgcctcgaccgctcactcctctcccgcgctgaccacctctgcatgcgctctgtataagcacggcccgcaacgagccccaccattgcacgatactggacccctcgtgatggacacccgcctccccctcctcctcctcctcgccggcgtcgtcgccgccgcggcgccactgctcgccaccgcccagctctccgccgacttctactcctccacctgccccaacgtcgagaaggtcgtctccaccgtcatcgagcgcaagttcaaggaggaccctaccacctccgccctcctcctccgcctcctcttccacgactgcttcgccaatgtacgttcacgttctacgaccttgcccgccgccggcaatggcggatgctgacttgcatgtgatgttggatgcgtgcgtgcgtgtgcgtgtgtgggtggtgtaaggatgcgacgcgtcgatcttgatcgacccgctgtcgaaccagagcgcggagaaggaggcggggccgaccatctcggtgaagggctacgacatcatcgacgagatcaagacggagctggagaaggagtgcccgcaggtggtgtcgtgcgcggacatcgtggcgctcagcacgcgcgacagcgtgcgcctcgccgggggccccaactacgacgtgcccaccggccgccgcgactcgctcgtctccaaccgcgaggaaggcgactcgctccccggcccggacatcgccgtcccgaagctcatggcgcagttctccgagaaggggttcagcgccgacgagatggtcgtcctcctcgccggcggccactccatcggcaaggccaagtgcttcttcatcgaggtcgacgcggcgcccatcgacccgacctaccgctccaacatcaccgccttctgcgacggcaaggacggcgacaagggagccgtcccccttgatcccatcacccccgacgtcgtcgaccccaactacttcgaactcgtcatggacaagaagatgccgctcaccatcgaccgcctcatggggatggacgcaagaacgaagcccatcgtggagtccatgggtaaaaagaccgaccagttcgacgccaccttcgggaaggccatgacgaagctcagcggcatgaaggtcatcaccggcaaggacggcgagatcaggaaatcgtgctccgagttcaacaacccggtgaacaccgacgacggcccgtccgtcatccggatcagctcgctgaaccccgaggagatgatgggctcctttgcgccggccaccgggaagtccccctccgccgcctcggagtccaggaaggtggcaccaggcggcgccatggaggaaaggatggcggccggtgaggcgaagacggatgcttcaggcggcgccatggcggaaaggttggcggccggtgaggcgaagacggctgctgcggcctccgaggatgaaaaccaagcggcagctggtggcgccgccggcgatgaggcggcggcggaggaggaggggaccaagtccaacaagaagaaggccgagcgggtgaccgcagaagtacctgccgacgaggcggcgccggcggcaaagaagccgagggcgatgggcggacaatcgttcagcatggccggcgccggcgccggcggcgagccggcgaagaagtcgacggcgatgaagagccaatccttcagcatggcgggccagccgcaacagtagacgaagaagaagaagaagaagaagaagaagaagaagatgccgcgctgctagctgagccgttcgcacggcggcctgatcgagcgcgcattgccatttatcgtttttgattttctcactctctctctcgcctgtttgtagaagggacgagcatactactaccgctaattactaggcttaattttgcaagtaatgtcgtgtcgagttttttttaacagcgaccaaaagctcgatgatattttctcttttcattttcccttttttttttgtcattcttgttaagaattcgttgccaactcaatctggctggcaaataaaagtgtattaaatttcccctttttatatagagagacaggtacacaattgtaattgtttttttagatcaaccaatgcatgtgaaacgatatacgtgctactaccatgtaagcttggccaccgtttcttccacctcattagttcctaaaaagtcagattgtgaaatatgattttaaagattattttaggccgtttttaaagtcgtcttcttagacatgaaaacaaggctggttaacgaaaatgattaatcttaaaattctaaatgagatgcaacttttcttctttcttttaatgaaaaaaaaacaatggcaagcgggttacaagtgtttactctagattcagatggacattgactaatttatttatgaaaaatatttacacattacaaacagggactagcacaattggaattggaacatctcatctcactgtgggattctgatcaagacggagtagatatcaacctaaaatagagtacctacgcagctagtctaagttcaaatctttcctttggatagagtgctatatagcaaagtgaacttatttttaagcggagtaaaattgcaccggttttgatagacatctatgccgtcaatagcctaggagcgcacacacgtgactagaagcccatggaaattaaggcctaaaaggccaaactacggtccatgaggggcccgctaaaccacggccctctcgtgccggtattcggcccatcaactattcggtccgcgccacgcgcacggcattttcgctcgtgtcccgcaagaggcatgcacccctgctgctcgcaagctgcctcctcccgtttctcgccggccggtttaccctctcggatctctcccaagtcacaagcaccggacccgtagaagagccgaggagctcgtcgatcaagacgcctgcctacacgtacgtcctccacgatgacacgtgcagcaaggctgccagcgtagcacacatcgctacccctaccttttgcctccaaacaattgtcaatcacatgcatcatgtgtttggcatggaatgaaatgattgatgcgcgagtctcgtactccctctatcccataaacctaacctacttagagcaggtacaatagcgccgttaagaaggctccaaaacttattaatcagcctaataccagattagagaaagaaatcgctggaagagaaacaagcggatgcttgttttagcgccggcgcttgcacagcgccccacgctgtatcggtcacgggagatgagaaaaaatttgttatgtaggtcccacacaaaaaaaaacttgttatatttaatgtatgtatgctttaagagcaggtacaatagcaggctattaactagctataaacatattttatggagataaataattggagagaagagcagcaggctatagatatgtagtcagctgtagcacggactccaagacacaatgtgtgtatgatatgtgagaccatatattaatagtatagtaagaaactattgtatgaattggctatagatgaattggagctagtagtgggctatactattaaacttgctctaaccaaggcagcttatagataatttgtagttagcctgttgtatgagttggcttcttaagttagctctatcttaacatgataaaattttggagcttaccgcttgctgcactattgaccttgcagggatgagacattcattggagaggtaatgtcctatccctaactagattggatttttggaacggaataagttggtacttgtaggctcaatgctagaggatagtggctgtgttcgtttcccccaattaggaactagtgccctacgtacggaaaacggagcaatccattagcgcgtgattaattaagtaactttcgtatagattttttttttacaaaaaaacacaccgtttagcagttggaaaagcgtgcgcgcgaaagggattgggttgggaaccctaaggccgtgtttacttcttgggtgtaaaatttttgaagtatacgtacacacatttgaagtattaaacgtagactaataactaaacaagattatgcctgtaaattacgaaacgaatttattaaacctaattaatccgtcattagcaaatgtttattgtagcacctcattgtcaaatcatggcgtaattaggctcaaaagattcgtgtcgcaatttacacggaactatgcaattggttttttttctacatttaatactctatgcattgtccaaacatttgatgtgatgtttttggctaaaatgtttttagatctaaacaaggcctaactaacaaacgcagcctaagtcagagctttttttttctttagtactatatcctttccagagtatgttatcttgaaattggcatttatgttccattattataatgcacagtatgggggttccattctgatacatcatacattcacgtggtcttcacaatgctacataaaccttcgcggacaagttttgaaaatggctgaatcaaggcaaaacataagcacgattgattcccaaagagaagcagattaatttgctacaacttggatgatctcacttgggcgataagctgccttctcagaatctttcctgaagctgatttgggcacgctgcccacaaaggtaactctcttcaatcttttgtagtacgccacctgataatgcagttcattagtgaaatatattagcacctttgtgtcaaaaaaaagtatattagcacctagggtagtatgcagtcgatggaaaacacaaaatacttgttcattcatggattgcaaatgttggatgctaataccagtgtttggccagcacagcaaactattcttgctatttagatcttggatttttaccaggtacatgtatagtcaaagtgggtagaactctaagaaaaatatgaatgaaactcgatgtactaattgatgctccatgtttcattaacattagtatctggacgagctttacccaaattgtctcatgctgctaaaaagttccactagtctacaatcccaattaaacaaggttccaacttccaaatcagcctcacctgtttttcaataaatttttggacatcaacttctgtcaatgaactgtcaggtgaccgaacaacataggcaatgggaacctccccagctttagcatcaggaaaccttggaaacaagtagagctccgttaagaaacaaggcacaacagagagagaacgatccaaaacaacaatgttgtaacaagcgaacagtttatatcataaggagcaagaaacacttaaatttttaggtggttcaacttacgggataacaacagcatctagaatctctggatgagatagaagtaacccttcaagctcggcaggtgcaatctaaagaagtaaaataaaggagatgattagctatttccatatattggacaaaatatgacgcgtgctcaagcaagacaaaacacaagcattaggttggattcctgttatgattgttatagtggatactaaaacaagaaggatcttattcagacaactcccatctataaatatgtgctttggtaaatggtaatagagaaaaggcttttcagtgtattgtaatctcagtagatgcaatctatcagtagagtaaacaaaaaagacaggaaattccataaaaaagaaaaggtgaggttatggtatgctcaagacaaaaatgttaagatacatgacgaacggagcccagaaataatcctatattattctctctttggtgttctgattgtaaccagctctattctatatgattctttctttagtgaatggaaagagctcctgctaagcatttttttaataaataaataatatatgcacgaaattattctagtaagccacgacaatttcagaaggtttggtgtgctatatcaatctatccttgcggcaaactctgaattgatcctatatgtatatgatctttcaagtctgcttataaaactcatcagcacgagattcaatgacataatttacatagtattagcaagggccctgatgtgactaacataagtagaggggctgaccagaaattttttttggacaaaaaaaagtatttagggaaaaagaatcaatttctttacctggaaacctttgtacttaatcagttctttaagtctatcaacaacaaaaagctggcctcctccgtcgaagtatccaagatcaccagtgtgcaaccacccttgcttgattgtaaattcagtagcttgcacattgttgaaataccctacaaacgcaacattcagataggtaagcaattgttttgttctattattattgcaggacagaatgcataagatatattgggatctattgtcagtgaaaaatagtgaggtctagtaggtggaatattttcaaatattttttgtatgctcgacatcactagtctttgttaaattgtgcattgtcaatgactcaatgtacaattgaaaacaaagaatacaaataaatagctacagttccattgtaatatgattatagtattagactgatactggtatttgaaatagttattttgagaaccagtgtataataattgatcaaatgtataattcaaattttaccttgcattacatttggccctcgaacacaaatttctcctacttgattgggcggtagatgttttaatgtctttatgtcgacaatctttgcctcaactcctgagacaagcgtgccagttgacccaaattcacgagcctgtcctttttctgggtactcgagcgatatgattccacaagtctcagtcataccataaccctgaaagaggagcataacatgccatacaacttgagatataaaattcttaaccttactagttgattttacagatacactgtagcatcatggaagaaaagaatgccaccacactaatcatgttcccacaaggagtgtggtgcaacaaactaccaaaccactttaagatagttctgtgatcttattgcagtggttgcttaggtgctagaccatgacggtgtatgtctttttttttttttgaccaaaactggattacggaaataaatccagcctctgcatcaaagatgtatccggacaatgtttattacagctatgtcaacaaaaaggccttagctgtcataagttgcagtttgaagacacactagaaatgcctgcacacctcttgagtctagaacagttggctacagaccagaaatcacatcttttagagcaagtttttacatcttgacgagttgtcttggtgttggcctgtggaccacatcagactgaaattagcacatacaatataccaaattgatccaaacagatctgataggactagtttacgaatgaaccagttcaatgcccactgcattaggcaaaatatccattattattcagatattgcaagttgacattcttaatttcctatcaccaacacacacgcgaacacactttaaggatttaagtataaatatagaaacaaaaagaaattaaatgtcctttgcctcaatgaggttatatttataggacaaaattgtcagtctcccgcacttaaatgtcattttccagcttctatcgaatcaatatttttttagagattttttacccggcctctacatccaaccggatatatgcaacctttttaaattaggaacttagcctatcaaacaaggaacttagccctcaaataacacaatctgaaattcactcctatgcagatttgaactcaggaccttggggtgctactcaggtcactgcaatcactaggctacatgccctttcacatatgaacactatattacgccctggaaggcacaaccaagatcagaccccacaaaggcacagccaaagaaagacttaatttcgtagtcattccaaatcaaaccaggtatgtccttataaaacgtacggtcagaacaaatgttgttatgaattcactgcccaaacgtaactctgaaccattatttcgtgttaggtttgaggaatgcaatgggttggtcaatcaatgacttgactaatcccatcgtaatcacgggatgatgccatgatggatcaacctatcctgtatggattgacacctcaaagcaaccaaccataagctaatttcaacaattcatcagcatatattatgaaagtaaacagtgaaaaatatcaaatgttcagttcaattagtacctgaacaatctcactgtccgggaatttcttggccacgacctccatcacatccttgccgagcggcgcggcgccggagccgatgaacttgagagagctgagatcgtacttaccggccttcccgtgcttggcgagcgcgataatgaccggcggcacgcataacaggtgcgtgacgcggtgcctctgcacggcctccatcagggagttgatgtcgaaccgcgacatggcgatgatggcgttcccgcgatgcagctgcgcgtacgtgatgacggacaggccgaagatgtggaacatggggaggaagcagaggaacacgttgggcccctcccggcgctcgtcttggtcggaggtcaccatcctcgccgcggcgatgaagttgcggtgcgtcaggatgacgcccttgctatcccccgtcgtgcccgacgagtaaaggagagccaccgtgtcgctctgcttgattggtggccggcggtgatccgcctccttcacgccggcgacgaggttggtgtagagcgtaacgctggcgtc

SEQ ID NO: 7259 - DNA, 2236 bp, Oryza sativa
ggccggcaccgacgcgctcgccatggcttcccccgcctcttgggtttggttggtgcgggagaataggagggctttgttgtggtgagtgctgactcgagggtgcgttgaattggaatttttttgagaaaaaaattaatattatttttatggaaaatcgtaaaagtagtggccaaccggggaaaatcgtgaaaataggtccctgtcgaacgggtgcaattcgatagggcacctatcgaacgacgggcagtcgacaaagctctgtcgaacggctggcgttcgacacgctcacctgtcgaacggagggagttcgacagggcccaccacccggcgccgcgaggcctgttgaaccgggggcgttcgacagggccctccaccgaccctgtcgaacaatgggcgttcgacaggccggtttaaagccccgtccacccaggccgcgagttcgatttgtgaccacatcgccagctgccgccaagagtcgccacatcgtcgccgtgagcgccggagggagcgaggggaggggatagcaggccggagaggaggccgaggaggcaccggccgggaggaaagggttggcgacgccctccagcagtgaagttaaggtatacattagtaatccctaagtacaatgcatatgaaagtttaataaaaaaattggtttaagagttgttaattgtttcgcattgttcgatgttagtatgtatggttagcacatatttgttattgctaaatgttggtagaggtatttaagtaattgtacggttaaattagttcttagttagtacatattattgatatgttgtgtgttaaaataggtacaaaggtgttatattttatttggattattaaactagttgtttgttactaatagttgtaaattagtacacggcaatatagtataagttgtaatagggtaattatcgaatgattaaatgattaaacgtgagactatttgtcatgttttatcaggatgtcaggtgatatgcccattcgtctgtattatggcgatgctcctatacaaatatgtgatagcggggtggatttgactgtatatgccttccatgatactagtctgaatgcaccggagcatatgggtttgaacgacgtgttagggtggttgtataatatgtttggggtagatccagtgcacgataaatttgtcataagtgccgtgtggccagtgaggggtcaacatggatggcagtggagagtagtggaggttgcgtcaactgggagttggaggaagtttgttagtaaagtaagggagaaaggctatagcctggcaatagtggtgcagaagacaacatgtgttgatcgatcgggggagtcaagtcatgccgtggtggaagaaactccgttggaaggtggacaagctgaaaatgtttggcagactaagcaaggtcgaggggaagaagtagtagagggtaatacacaaggagaggtcattgttcgtggtactaatcgtgaggccaacgacttggacgatgaagaacctgattcgcctatgcgtgttgatgcagcgaaggagaatgaggcggtagtggatcagatggaagtggaaaacgaggaataccttgcgcttgtagtggaaggagaagatacaacactgtgggacaacgaaaccaacatacccgatgattggacgaccatatcaatgagtcgtatgaaggtaaacgatggtttagatgcccactggtgttatgatagtaagcaggtgaaagttggacagatgtttcatgacaaaggtcacttacaagatgcggtgaagaggtgggcatttgtccagaagcgtgagttcagggtgaaggtttcaaataggacgacgtatgacgtgaagtgcatacagggtggatgtccttggagagtgcatggttacaagccacaacatgacactttatgggtagcttcgagggttgagcaacatacgtgtttgttggagaatacccgtctggtgcacagaaacctgacagcggcatttgtggcacaaatggtatattcaaaggtggttagaaaaacatctttgtcccctttcaccataatgcatgacgttgagaaagagtacggatatgagatatcgtacgacaaggcttggagggcaaaacagaaagcattggagatgaggtttggaacttatgaggattcttatcacaatcttcccccactattggaggtgatgcaggcaagaaatccgggcacacacatggctattctcgatgaggtgaatgaatatggggagaat

SEQ ID NO: 7260 - DNA, 6015 bp, Oryza sativa
ggattcttatcacaatcttcccccactattggaggtgatgcaggcaagaaatccgggcacacacatggctattctcgatgaggtgaatgaatatggggagaatgttcttcgtcgggctttctggtcatttgggtgcatgatagaggcctttagaaattgcattcctttgctctgtgttgatggcactttcatgacaagcaagtacagaggaacaattctaaccgcgatcggagtcgacgcggatagccatgtcgttcctattgcttttgcatttgttgaaagcgagaacacatcaagctggctatggtttttgcggcacattaaaatgtgtgttgttgaaaacagaccaaatgtgtgtgttctgcatgaccgacacgccggtttgctatcagcgatacagaagcttcaagaagatgtcacacagtccgtgccatggccagatttacatagcagatgatgcatgcgacattttggggctaatttttatagacaattcaggagtaagagattgatggacctgttcaagaagttatgcaagcagaatcaacaaagaaagtttgatgccatatgggatcaactggatcgtttgaccactacacacatggaagaggttaggaaaaaacctatagttgccagacaggaggagccggagggacttgaacccattcctaatgaagcaccaagtattactcggcgcaggaagcgtggaagggtcacgaagtgcttcacggagtgggtagaatttgagccaagggagaaatggtcgttgttgtacgatacagatggatcgaggtatggtgtgatgacaacaaatcttgctgaagtgtataactgggttatgaagaatacacgacctctaccacttgttgctatcctggagggcatcacgaggggtacacagaagtatctctgtaaaaggtattccatggctagtctgaacctcagcaaacccagtgttaagtatagccccgctattacacagtacatggatgagaaaagtaagaagggaggaatccacagagtgtggcctgctgggaatacagagttgttatttgagatacgacttcgtgacaagagtggtgtcggcattgggactactgacatcacattggaatgcacgttgtggccagagtatcacgcttgcaaatgcaattgcaacaagccttacctgttacatcggccatgttcccatgttcttgctgcttccgcaaaagggggtgttgatggaaacatttttgtttctccctactttagaaaggaatcgtgggaggcaacttggcgtggtgaattgcgtggttggcgtgccgtgtgcgatttcactcgtcctcctccagggcaaaccaattgggttcctgactcaaatttattagttgatactaagggtcatcgccagtcgcgcaggatcaagaaccttatggatgaagctggagtgaaagatcgttctcgtcgtaagaaagcttgcattctttgcggggagaaccattcccgtaaagattgcagcatgtacaatgtagggcaagatgccacaggcgctgatgttcgtcgcgttccaaaggggaagtcgaagaagaaaaataatccttagttcgctattatccttggtggactccctactttgaagatcgttatcgttcaatttacgtttattgcgtctataattttaatttgaactttcttgcacttttattacccgaatctatttgtaatggccttgtaattttcattttgaactgcactgcacttttaatatcgtcatgtatttgtattggaattgtaatttaaatttcgaactgcactgcacttgtaatatcataatatatgtgtcgtgggcttgtaattttaaattgaaatgtactgaactgttcttatctgtatctatgtgtgctggtactgtaatatctgtatctacatcgtgtctacactcagtttgtagctgactttgatcagcttacgcctgaccgtgttcggtggactccctacactcagcacgatgtcaatgatcgtgcaccgcacggtctcgcggatctttgcacgcgagatatgcaactctggatgacgacttgtcacctcgtggtggacgtgcacgtcgagccacacaatgtccacagggttctcaaacagttgggcatgtatcaggacttccctccgagagatggtcgtcctttggctgatagtcttcataggttagttcacatcacagttgtttaatcctacattttttaaaataaatcactgcacaacattttttctaatgtgtgaatttgttgttgtgcaggtactccagaaaggggctcgggctttcctacgagctagttattgtgaccacggttcagccgacgatacaagagtgggagcacgcagctgataacttggcacttcagacacctccagacgatgggagttattatggagcttaccttcgttggtaccgcagtgttacacgatggaggtgttttcctccacaaggagatagcaccgtcccccaccaggcagcgattactgacacgtttgcccctcagcctagatcagcttacaactcaatggtacgtgtttatttgtggaatttgagcaactagttcaatatttttaaaaagttagcaagtagttcagtatgtctaataaatgtgcaattggttcaactagttccttttcttacataaatgtggaactagttcagtatttataaatgatgtgcaactggttcattatttctaacaaatgtgcatcttgttaaatactcttaataaatgtgcaactggttaaataattttaattgccttgattatttgtggaacatgcggaatttgttgagcacgttcacgtggagtccgacaccctgctgcaaagactagaggcgagacctccagtcgtcaggcctgacgacgtggcgagcatccttcacaacttccttgcacgtgctgccgcactactacgtcgtgtctcctgtcggagcgcggcagatgtggtgcagacgtcgggccgacggccatcaccaccactaccccgacgttccagcgtggatcggagtggtccatcctcttcacgtcgcgggtacgaagcggcccacacatctcacggtcgtccttcctttcagcacaccccagcaccggagtacaccagggggtcagccggatcaggggtacccacgtcgagcacggcaccaccacgtccgcaggtattccaaactccgccttatgttcacccctcgcagggagcatctgggtcggcacacttcccttacatgccaacgggggacaacgtgttgaacacaccagcatggggacttcatatcactccgcgtgcgccagagcagggccacacacagcacacatgtaagtcattttaaacaataacacgctttagtttctaattatatgtatcgttactaactacgccatattttttggtttcttcctcttgtgtaaacagacgatgagtacggttcggcgtcgacgcatcacggaatgcctgcttactcccctcgcacagcattcattgaggacttcttttccactgatcctccccagggggaagtagggatggattactggcacgcagcacctcaggtcacacagccgacgcaggagacggaggccggtcaggggccagacgtgacaccacagtaggcagctagagataggcacccccctgataatttgacatatcccactgagcagattaggcgtagaaagaagggaggacctagcaagcgtgcgaagggcactgatcgtccttgacttatctatttgtattaaacttttagtcatttatgttctgtctgtactatttgagaaacactttacgattaacttagtactatcagtactatttcataaacttcttcggataattactcagtagcatacccttcgaatgaatcatgacaaattatcattcaaatatacaaaaaataatgaaactaaataattcaaatattttaaccaacaaataaatactacaatttctgaccaaacattatcaaaaccctaaatcatatacatataacattacaaaaatattttcctttcttacacactaaaataaattacatattattaaaaaaaataacttattacaaataaatggagaacgcgaccctgtcgaactgcgccagttcgacggatatcctgtcgaacaggggcagttcgacagccctcctgtcgaacaggggcagttcgacagccctgcctgtcgaacgggggctgttcgataggtcctgtcgaacggcagccttccgatctcctcgccagtcgcgctctggccgttcgataggcgccctatcgaactgcacccgttcgacagggacctactttcgcgattttctccggttgaccactacttttgcgattttccataaaaataatattaattctcaaaaaaattctgttgaattgtacatttgtagaattgtagtactgctcctttcccaacttctcttttactaacttcacttttccaaacttttcatgggcatatttttcaaattatcgaataataatatatttttatataaactttttacatataaattagtgtaaaaaacatattaatatatattttaaaatattttgaactaatatttacttcattcgtttcgaaataagtgcacgcctctaattcaaatttagagaattgtacttattttaggacggatgaagtaattaattgtacactaatgagtcattatatattacaccactacacatgcaacactacactcacaccccctacgaacgtcccctaacacatactctaagagacgaaaactaacggcatatacctaatctcactaaaatcatgttaaaatctcacctgcatgtgcgtatttctaatatttatgtgcaacatgattttaaatcctagtggatggaatcatacacccacgactccaccaccacactactagtgctttcccaatgaatcatcatgttttgcttagtggggagaaattcacttccttctgaacccataacaatcaaccacaattgcatcataagagacgaaaaccaacggcatatccctgaaaatcttgttgaaagtccacctgcatacgtgacaacatgatttgaagttttgaaccctgataaatggagtcacatacccacaacttcactaccacatctttaatacttccccaataaatcatcatattttgtgtagtgggaagaagttcacctccttccgaacatataacaatcaaccataacgccgtcatatcaattggatttatgtcaatccaattcgagaaccttttgaaaaactggggtagtagatgtggagcatgaatgagcaatagagcatataggttgtcttcgatggtgggtgttgggaacccatcacccacgtacggaaaacggagcgattcattagcgcgtgattaatcttttgtatataaactttttaaaaaatcacactgttcagtagtttaaaaagcgtgcgtgcagaaaacgagagatgtgagttaggaaaagggacatccgaacactcccataatagttaaaccaacacattcatgatcgaacaaatggaagtggaatgaaaacgaagtcgaagtctgcatcatggagatacctagggtacagtggataggaacgaccgtctagatcaaaggtcatattcaatatgtatgcacgagattcaactttcgcacatagatttatactcctactttttaattttaaaatatactccatccgtttcacaatataagtcattttagcatttctcacgttcatattgatgtgattaacatctagattcattaatatcaatataaatatgaaaaatgttagaatgacttatattgtgaaacaaagaagtagcaattacgattggatacaacatatcctactactatcaatgtggtactgttctgatttctatcaatgtggtactgttctgatttgtagtaatatatatcatgtttgatgctgaggccgagtttagttccaaaatttctctttaaactttcaacttttccatcacatcaaaacttttctacacacaagctttcaa

SEQ ID NO: 7261 - DNA, 6902 bp, Oryza sativa
ggacagagggagtaatttcagttcggcgagagccgccgcccatggctatatacggtccatacggagaatgcagcacgcgatggagatcccctcttgctcgtcacaaatctgaatatacggtccatacggagaatgcagcacgcgatggagatcccctcttgcttgtcacaaatctgaatgcacgagggagagagtgagtgtcaacctcaaccggattgatctaggtgaagtccaataaagctttgaacagttcgtcattataaatcccgatacgcaactactgtttggctaatttggtatttggacaactatcttacggtccagaaaaatggcaagtggcattgtggcgacctcatgttggaggatgaaagggatgtttgaacaaatctcttactaggccattccattgtttcgcttattcatacgttgattcgaaatcacttattagcaaataaaaattatctgcgagtaaaacttttatatatattcttagcgattcaaaagtaaatactaaaaataaactaggacgaaaaaatcaaatttaaagtttagcttataagtataaacgcaagcgaaaatgccataatttgcagccttgcactgcctgcaaaggtcttaaaaatcgtcgtcctggttcctggcctgatctccacagtccaaacgacccacaactcgcaaccctaacgcccctgaaaatgtcttttcgattcgtctaaatgcatgacaccaccggcgcgacaactagcacgggttagtgcaggaagcatcacacctggagtatcatcaactcatcatgatcaaggcccagcgacaatataaaacacagagtaatcttgtcccaaatcccgaagtcaacacattgttttagggggtgtttggttgattgcttcattttgccacgccacatttcagtcatgccacagtttttaggcgtgtgtttgtttcaatgccacagttgtgtcatgccacacttttctacccttaggtcccacatgtcatatttagatggtcccacatgtcatactcagataactagagctaacattgccacacttgtggctaactatttcttggccatacttttgccacatgctacaacttacctaagcttagttatggcaagcttaggcatcaaccaaacaacccattagttactactccaaaactcataaacgtgtctacaatgacataggccagggattagttactcccgattcccggagtcaactaatgactggttcgcattgtttagttactccaaatctccaatattccaatactcaaacggtgacgacagttcactggtaaatattaaaacaaggataaaagtagaagttgagctgttaactcacagtttcttatatgcaggggtgtgaccatgtctgtacatgtatagagattccaaagttttctgtttacatatatgcacaatttacaattgctgacacaatgcgagcagcgaattagactgaatgagtatttacaccgtggcatggatcatttgttaatgactggacggcttgggacttttaaaataagtcccattgccagtagatcttctccacaatgcctccaccgctccgcaccgcgacatggagggtctctgatgctggaggaacaccccacaacaatggcactgcaacagacatggtcaacttctcctggaggccatctttgcttgccttctctgccgtgacaacctgcagattggcgccctttactcaattcacagtttagtatccaaatgtaaagttctaaaaaaaatccaaatgtaacaagagctgactagatagatgtttcctcctttaaaaacattgacaatttagcatttctactcaaccttttattaagtttttttttagaaaaaacttagctacacctggcatgtttccttgggcaccgttatgtttgcttcgcaatctacttcagtataaaacgccacatcattgtccatgtgcgccatttttaaatctttttttttctcagaaagaaggtaatctgttggtaccctttacatggcttatttcaaatatggaaagatagtctatgcggtagtcagaatgaagatataaaactgtaaggagcaaagtaccaaaagatttttttttccatgtaagactgttgcacatacctcaccaccatgctccaatactgtatcttccactacatcacttagcatttcaatagagcgacaaaagccaaagatgcatagtcttcttcccatatctagaccctgaaatgagaaatgacatcaagaaaagaaagcaacagcatgataggcaaataggcaggaggaaataattacatttgttgctgctatgttaaatagtgctccaaggcaaagactttgatttgggtccatgtacgagctctcctgaaaccgttggatattttgtataccttttacttttcgttgcctcttctggtcaaaatataacaaaagaagtgagtacagataatatgggaaataatggtgaatacataataaaacttgcagttctatctaaaatcaacatcttttaagtaattatcatttcataactagcacaatttaagtaattcagtacattactatgattcggtctaaactagcacattgggcacagatcataattataacctgtcagcttgagatacatcgtgttcttgagatgattcacactgtgctagatttcatactggattacttgtaatcgacttggaatttgtttcagttggatataatttcaggtcaactgaactgaatgcgagcacaaatactaaaaagatacggctatccataaatatggcatgctttgtttatgcaataagatactccaacattacatgacagacgtacactactctatggtgttagcttggtgccaccatgggagatacaaaattggtgctataatgtatgtgatactgcttttcaaggattcattccccttcaatttcttgctgacatgacacgtttccataagtactgctgcatatatccaaatgtttcatgaacagaggtgtgaaagagcttatatttcatagtggaacatttgatgctggtcaggatgctgaaaaagtttttgttgtttgatactccctctgtcccaaaatataagcacttttagcatagtgacaagtcaaacatttttaatagtctaatcatctatccaagtctatgattgaattatatgaagttaggctgtgatgcactatgcaaaagagattgaaactgatttaatgtgaaactatgtctccctggaacagaacattcctgatcattgaacaatagtgtctgcaatatctataacatatctcactcctgaactgaagatgcaccctagttttactgacaagaataaatttactactgtctatgatgcaagagactttgttttcctacttgaatgtcaagatattctaatataccacatagtttattactgaaaaatgaacgattaatgaaacgagcccaagttgaatgattcggcacctctgatggagtaattcgacgaggaaccagggaaccccctatttgaacaagcccatcagaagtgaacagtgtgactctatcttctggcacccactgaatatctgttaagaaacagagattgaaccccaaataaagccacgccataaacgcaagtataaagcctctcacaaagtgaaataagcaaaatctgcagaacaatgaatgagttcatcatcatatcacagactagtaacagctgggaaatcaaccatcacccccaccgcaagactagcgcaagtagcccccagctcattgctcgccgtcgaatcgaagaaccattcgaattcggataccaaccagaacgatcagggagagtgtgggggcatgaacttaccgaggccagtggtgagatccaaggactgatcccatgggtagggcccatacagatcctcgggatcgtccttcccagctcgagctcgcagccggtggagcgagcgggacccgaagcggcagcggcggggagaccggggcctcccgccgcggagaggggaggagggcagcggcctcctggacgccagcgagcgggggagggaggaggatgcggctgcggcggaatcggccatggcggacgaggtgggggcgatgagatgcgcacgggatcgcggaaaaatgggtggattttttggggaggcgatgcgtgcgcgctctttttttcttgtggtggccggcgcttggtctcttggtcggtttttgttcttggccacaggaggaggatgttggatctgggccgttggttggtagctttaagaaagaatgaaggggtcagattagcccgtacccggttggggtgttttatccggtgtgtaaggtggtctgcggtgacaacaaggacggtttcagcggtcttgcttccctttttttttaagaaaaaaataacagttgttaacccaaagttaaaccaatcattgtcacactataaaacaatatagctttcctaaccgtttttcaatcaggtttagtatttagttctcccttgttccctacgagagaggatttggcttcctttaatggcaaaacatataaagtatggcgttattaatgaatctcctctttatcactttttgtgcagaaaaaaaaaattatagagatgaacatggacaactgcttgtacggtgaatccatcaaacataaaacatgtaactaagctacagtgaaaccatcaaactaaattctagggagtatttcatacaaaacataaagtgaaatgtggactagttagaaatagttgtactatatgactggtgttactctctagtttgtatccaataaaagatatcacaatgccattaaatagtgatgaatatactataaggtggtattttgttaatctaaacgaaatgaggaagggatcaaaattttagtctctgatcctaaagtgcacatatttatggaatattgcaagtttagtctacatcttttaagggataatccaattatccaattgtccaaacaaggtttgggggggggggggggggcattatttgcccaagtagtcgagtttgtgatttgatgtattatatcggaacagtttagcctatttcagcatagtgctattttatatgactatattaacatacatttttcatatttctaaacaaggttattttttttagagttataagtacattatagagaatgtatttgtggaggtgagcgtgatattgcatatgtgcacttatgcatctataatctctgtcgtgtatttttttttaaaaaaaaaatctaaatcgccgacttttaattttctcgaaacgaaggagggggggtcggagttttaatcccgaccccatttgacgttttctttcttaaaaaaaaaaggaactgacgtcagtgtggcaacgttgttcgggctggtctcccctccggcacgtctcaagccaggcgtaccaagcaaccaaacaggcgccgtcgcgggcatatccgataaccgataaaccccctcccacactctccactctcgagccatggccctcgccgccgccgccgccgccgcggcagcggccgtctccttcccgcccttgctctcccgtcccgccgcctgcgtgctcctccgctgcggccgccaccgccgcctccctcccctcctcctccgcgccgccttctcctccacctacagcgccccggacttcaacatcaccttcgcggagcccaccgcccccgccccctcaaaacccaaaccctcatcccccgccccgtccgcggagcaggtggtgccgtggatcgtgcgtggggaggacggcaagccgtccatgcgcaccgcgccgccgccggacgtcctccaggccattgcgctggcggaggcggaggccaagaaggccaagaaggacccccgcaggagccacaagggcgccgccgcccttgccacccccgtcgccaatgccaaggtgagggagaggaaggccgcccccgcgacggcgccgcccaagttctccaaggccgcgaggagattctacaatgagaatatcaaggagcacgaaccgcagcggctcgccaaggtccttgccgcggcaggaggtagtcttcctatcacgcatgattttactgaagtgcttgaattggacagaatcaattcaatcaaagttatattacttagttacagcaacacatcagttgtctgaatgctggcctgattgctccttccagtggcctcacgaaggacatgcgaggagctcatcttccaagggaaggtgaccgtcaatggttctgtctgcactgcaccccaggtatgtttttttttttagctttatgaatgatgaaatgctacttctctaagtttgttgcatgtctaagtaatgttttagctcttatcctcatttatttggtgctggtctgagaccagctatcgtactattgcggtaaaatataaattgttttaatttagctaggtcattttactatgaattttgatccatgtgcttcaaatgtattcatagacaagtttattatttgttacatatgattcttatacattcttttttatgtagaccaaagttgacatctcaaaggattctatctatgttaatggaaaccgcatttccaagaagcttcctccgaagttatattttgctgttaacaagccaaaagggtcagctcttatattccattccgctatcttgttccatcaaagcatttttgaaatatatatggaggcagcagtccatatgagcaacatatctaaatgttatttccaatgtactgcaggtatatttgttcctgtggtgaaccaaagtccattatctccttatttgatgactatttgaagggttgggtatgttcttttttttttatagtgatggtacttcctaatatttgtgaaatctttcacctcttatgctttatagctaggacttacaattttccattttcaattaacatttgcagaacaaga

SEQ ID NO: 7262 - DNA, 1343 bp, Oryza sativa
atttccaatgtactgcaggtatatttgttcctgtggtgaaccaaagtccattatctccttatttgatgactatttgaagggttgggtatgttcttttttttttatagtgatggtacttcctaatatttgtgaaatctttcacctcttatgctttatagctaggacttacaattttccattttcaattaacatttgcagaacaagattcaaccaggagtaccaaaaccgcgcttgtttactgtgggtcgtcttgatgttgctacaagtggtttgataataattacaaatgacggtaatttcattgtatttcataataaatacttgggaatcaatattttgaccatccaatacctaaagttagtttgtttctctttcaggtgagtttgcccagaaactctcacacccttcgtcaaatataatgaaggagtaagctcaacttcttgtgtccttcgaagtacagtaatacaaaatcacgtactaggaacactgtagacactatccagatcttttgtagaagaaaatttaacagtctgttggtatcactctcatttatttggagaaacgcctaggggtcttccggctagctccacaaggtggtgggctagccggcctgggttcgaagcctcaccttttctatttatttgatattaggccattccctaatattcacatttttttactctcatttattcattatcaatatgcactggtaattgcgaaaagaaatatctgaaatatcatttttatcaaatttcaaatgaaaccaacattgactttgagttgtttgatcttgcagatatgtggtaactatagatggaccagtgcacagaaatcaccttatagctatcagtgaaggcacaaaaattgatggcgtcaaatgtatacctgatctagtggaaccattggatgtacaatccaatacaaaaaggacccggattagaatagcggtacttatattttctattatacctcattttattagattccggattgactttactgtctgtttcatgaattccaaattcttcataggataatgtagaagataggcaacttggctctttctgttcagtgaaaaatataccctagcaatgaatctatcctatcattcctttatgggatatacaacatgatacatgacacacgaaaggtctctttagatagtatcttgcggtcaagatttatttttaaatgtcatgacaagctaaagtggttagtgattatgtaaagttcactttaaatgtctaacaggcagttggttggatcgataatttgcctcacctgcttactttttcaaatgattgaaaccgtggaaaccataagaaactggtaattctgcaaag

SEQ ID NO: 7263 - DNA, 3216 bp, Oryza sativa
tccggattgactttactgtctgtttcatgaattccaaattcttcataggataatgtggaagataggcaacttggctctttctgttcagtgaaaaatataccctagcaatgaatctatcctatcattcctttatgggatatacaacatgatacatgacacacgaaaggtctctttagatagtatcttgcggtcaagatttatttttaaatgtcatgacaagctaaagtggttagtgattatgtaaagttcactttaaatgtctaacaggcagttggttggatcgataatttgcctcacctgcttactttttcaaatgattgaaaccgtggaaaccataagaaactggtaattctgcaaagcttaagcaataatatgtttcgcattgttcaaaactagctaaataattttaacatgttaccagctaatttggaaccatttcttgataatatttcagccctgtgagtaaaaaccagtgtagaaggaaaagtcactactctgggcaacatacagtattttcaatgacatcaatatgttatggacttattgctcaaaattcttgcatgtattcttaactaaagcaattctatagagatgtaaacttgcaaaggcatagcatttggtcatctactcattggtatgctattttttttaatgtctggcaggttcatgaaggaagaaatcatgaagttcgtgaactcgtgcagaatgcaggcctagaggtttgtttgtatgctcaatattttttttctcaagttttccctttatgttttattgatcatatcttaacatttcccattgtgcaatatcaaatttggtaactcaagtaatttggttctagaatcaagagcaaatgttgtttgttaatcccttatctgattgaattgttagaaatgaggacgattaatgatcagtagcactattgacaaattaacagtatgttttagaagaggattgaaatgcatcttatgtgcttcagagtcttcttttcaacagaaatattattatgatgatcgaatattacaacgacagagattagcagtgtgctaaagacatagtgtacttactaaaaaaatgtcatacacctagcacattgcgcttcagagtttttcttctcaaacctgcttatgatgatatactacattctactatatagttcttagaacagtagcttttgagatgcctagcatgtttattagttgatattatctcaaagcactttgcagatctcaattcttgtgcttctacaagcactacagtgcataagataaattgtactaactgtaatacctgtacaacggaacatcacttgtctgaaagattttgttcacatcagcttgggatttcttcctagtcttaggtgtttctaaaaacaacagtgaagtctaagaagtgcacttatcttatattcttatgggtgaggtaggcatatatccttgtgtaccagtaagtgcgttttttgctggaattgtataccttggaatgttttcccccctctgggaagtagctgatattttatccttgttcttgataggtttatgccttgaaacgtgttcggataggcaggttcaggcttccaccagatctcaggtaatgcagtttaccacatctgtatatgtttgaaatggaccattatacatttacactgtctttttagcatcttagcacctactcgacatgacatgttcttttcatgtaaaagatatgaacactgaacactatatactgtaagaaaaagatcatgtctatgaaacatcgcaagaaagagcatggcactttcttgctgtaaatgatatgaacaataactatatcataagacctgtcaaatattgtgaggtaacatggtgctgtatacttgatagcatctgccagcaggcatgctaagacctgtccagtatagttggctgattcaaagataactggtatgccatcattttagaggcatgattccatgcacaaaatgataaattaatttggtatcctggacctttttgttttccatttattcttacagactgggaggaaaaataacactgaatattaacccttgttggatgttacatgttcagaattgggaagtttgttgaacttaaacaaactgatctcaagtcactggaaggcaagaagtagagtgaaaacctgggtccacgggtgctaatttcgacggtaatgtggatccgcacaactccatcgaagaatagcaattgctccttctcacgtcaaggtgaaagctactccacaccaatgcctgtacgttaagttggtgcggatggtgaagatagacaaagacatacttttggcttgaagaacacacaagctgcttggaagaacattttccagtgcccaacaaggcagcagtgtttggtggtggagatgggatattgtcaggttgagggttagtgatagaggctacactttatcaatatatatggtggtggagatgggatattgtcaggttgagggttagtgatagaggctacactttatcaatatagatgctcttacgtgaggtacaggaggtatacgaaccattttgctacacgattcaacacttatcaacaagtagcaatccaggaggtatacgaaccaaattctctcgtaatctgtattttgagcaggaattaaccatgttatggttctgctacagctggaatattattgtgattgacaaaagcatgttcctttttattcttgaacattttgccaatggtagcaatgctacccaaaaaaagacattgtataagtgggtatttgaaagttgctaaaaaatggagtaaatttcataacacctcacgtttttatgatcaaagttgtagacaatcacacgtgtgatgacttgcgacatataatcacatgttttatggcctaaatgtttcataaaacctcactctgatacaaatttcaattgatttcaggatatcagaaacaatatttcttaaagtagcgaagagttaaactgataaccttaatcaagaaatcaacgactaaaagttttgtatatattctatgttttaaaattttaagtaaatatttgccaaatatgtatatgtgtggtgttttgtgaaacttaagaattacgaggttatgtgcaataactggggttttatacaacttcaaccaaaaacatggggtttgctgaaatttagtaaaaaaaaattgatattccaaaaacttacaaaagaaacgtgagatagttgggctcgcatgggcctcagctgg

SEQ ID NO: 7264 - DNA, 6884 bp, Oryza sativa
cagctgggccttgggttagttgttggcaacgaggaagattagtttaatccgacccacgcatcgccatggaccatcttctccggctcagatccgtccgtcccccggagcgccaggccgccgccccgctcccctctctcctctcttgcgcacgacgcagccgctccccctcacgcgatcgctccccgtcgccgccgccgccggcgtcggcgacgcgctcggtcgctcgcttattctctctccctccccgcgccggcggggcgcggttctccgagcccagctgtgcgtgtatcgtttgatgcccataggaagcccccgctgtaagtgtgatctaagccttcctcttctcctacttcttcagtgagagtcgtcagtggttgctaagattgctaggcaggctcccgcatcggcggaaatgcggcgccccctgtgccgtgtagccgctagatcaggcgccgccatggctaattgctgcctcgaatggctcgctttgccgcgggtggttgcctgatctgatgtcccgttgtttttgtcttcaatgagctgccggatcgatgaatctctgtttcctctcgttgatcctgtttctctctgtcgaactggagctcccggtggtgtgattttgtttgtttaatcatctgcgtatcattatctcctttttcaccctcttgctttgcttggcaggacgggtagagatgaatttcctctaccggacttcgcagcctgttgcacccgagcttccgcggattccagagcaagatcagcaaagggatagcctacaaaagccagttacaactctggagggccttattgccgatgatccatatcacccctcccctgaagatgaagatactgataatggagatgtagatatcggtggggactctgcagatgcagattcaaaaaattcagttcctactggaaagcataccgatgttttggatgacgaaggatggatcacaattccgaacagtatgtgccctttgacttgcccgtctttattttcatttaaagtcattactggttaataagaatccatttgttaggaatatctctacaagatctgctaaatgttctaaggaaatccatatttttctgaaaattttccttttgaagtgccatggaacataggtcatgcttttagaagtgccataagcttgtaacaattaatcctcttacatctacggtcagtaacatcttcaatttacttccacagaggagcttcctgataactggaatgacctttcagacatgttgcagttacagcctttggaccgccccttcctttttcctggtaaatgcatttttcctatgacttagtctagggggtctggcacaagtgcatcatgattctgcctgttttctagaatctgaactagttcagttatcaggtgagcaggttcatatattggcgtgcatgtccgcttcgaagcaagaaacacaggtcatatctccctttagaattgctgccgtgatgtctaagaatggaaattctttgcaatactccacaaataaatctagtcatgccacagaaaatggtgatagtaatgtaaagaatggagagaatggttcccaggttgttgaggatgacatgcaaagtgttgaactcaacagcgaaatgtctcctatgacacaagatgacatgcaaaatgttgagctcgacaacgaaatgtctccttcaaaacaagatgacatgcaaaatgttgaactcaacaacgaaatctctccttcaaaacaagatattttggagaccgaatctctccttcgattggaagatcacaagcaacaaattgaaagtatgcttcaaagattcaaaatgtccaatttttttgtccgaattgcagagtcagatgaacctctctggtccaataaaaaactagctgtatcaaaggtgccaaaagagcaatcatattcagacaaccaggaaaacaataagggttcaaggagtaatgcttataataccatttctgataaaggagtttttgatggtagcacatctggaggaatcgctcgtggtacagcaaggtgctatgctctgcaaaatggagacatcgtggtatgaatgatccttctgtttagttactgggtgatactataactagaacttttgtataatgtatgcacattggaagtttacttatgagcactgcataaataattgcaagttggatgctttaatcataataacttcaccaggcataaacatggtagactgttctcatgtgctacctatttgcgtcaatcttagcagattgacataactggctaatacctcatgcccatgccttttagtactctcttcattttctgcaactttataaatcacggcattgagcaatgttctgagatctttagaagtcatatagaattaccttcggtgaaatcccctttttcagaaagaaaggaagcacacgtgtatctgttgattaattttagatgttatacatatgctgattaatcactcatgttctttgttggaaggatgcaggttgttttgcaagtgaatgttggtgttaacaaaatggaagctccagtgctagaagttcttcaatttgagaaatcttcatcaagcaattatataaccaagaatctggtcaatggactttctagtggtgatgaggatccatgtcaggagctgctaagctggctgctccctttggatcgcacacttcctccgcgatccttatcacctcctactctcaatcctagtgcatcacacaagcaatcttattctgcttctggttctcaaattttttcattaagtcacttcagaagctattccatgccttcagcctcctccactcaaccacccaacattaggccaccaccaatttctgaaagtcaagaatttgtgcctgaaaagcctgcgaaaacacctgatattataaatgatggacaactttcctttagaggagttccattggagcctgaacggtattccgtacgttgtggtctagaaggtgtatatctaccagggaaaagatggcggagaaaagttgagatcattcaaccaattgaggttcactcttttgccgcaaaatgtacttcggaaaatcttctgtgtgttctaatcaaggttacgcgaacatccctaaccattaatatctcctacttagagaagctttcaaacctaatgcttctatcttcaaatttcagaatatttctccacagcatgtgaaagatatagttgtattggtagatgcaattacaattgtctttgaggaggcatccaaaggaggtgctcctttgtcactcccaattgccagtattgaggttgggcacgggcatagcttaccaaatcttgcactcaggtatatgcaatttctcattgatttcactctctatccaccatttcagctttatgcaaagaaattgattggttcaattccccctcggggtccatcaaatccaggagtttgagtttggcctcaaacaagttggtcttgtatggcctagagccctagagtactgggttagtcaaagcaggactggattaattccacatttcccttttactttcaccagattcaagtatatgctagtagtagtaaacatggttgtatgttgagtatttcttactctaaacattgaagtttatgtcagattctagaatattccatctttcttaaatgttaccttttcctttccaggagaggcgaggagcactcttttattctcaagccagcaactatgtcgtttagggaccggaggaccaacaatgatgcacctctgactttgtcactccctaagatgaatggaactgccacaaatgtttctttggctaaggttggcgagaccattggctctcttatggatcagtatgctgtacttgtatcatatcgctgcaattacacaggtaaactacttaacagatgggggtaagtgacttggaagaagcgttgaattgttatttctgacttccagccttctttcctgtgtagaatcaaaacttttcttcaagcaggccaccagctggcgaccctgtgttgctagtgaccttatgatctctgtatcatcagaactgtctttgcgaaatcctatttcgagtgctcgagttcctcaactcccagtgcaggtaattcctatgcttttttaggtatattatgcagattatccatgtttcattttgatagtgcaatccactgttaccttccaggtcttaacccttgaggctactaatatgacatcagaaaaccttaccgtaacggttcttgctccagaagcgtctggttcttcttcagttgtatccttgaactcagctccaaccacaccaaatagttcgtatgacaatcttaatgagtctgtgagaagatctggcttgggtaaacatcgagctggttttcgaagaatgaattcagtccttgctggctcaccaaaagaaagtgacaatggaggaaatagaattagcacttctggaggctgtactcatctgtggttgcagagtgcggttcctttagggtattgatcctcacctgcttttctttctttgagtgacacatcccatgtaccttgtattccctccgtcccaaaataaaccaatctcgtactggatgtgccacatcctagtacgatatgtccagattcattgtactaggatgtcacatcccgtatggggttagtttattttgggacgtagggagtatttctatacactaaagaataacatttgttgtcaccattgtggtaggtgtattcctgcacgttcaagcaccaccgtcaagcttgagctacttccattaacggatgggatcattacactggatacacttcaaataacgataagggagaaaggtatactttttcttgcaagcatagtaaaaacacagagaaagaaaaacaaattagtggcattggaggaacacttttttttttaacaatctgtcacaatgtgaatatcctagattccttaggatgttgacatataattatttcctgttggaattgattgtaaaaaaagaaagaagtatgtagactatagtggaatttattccatgtttcctgcttgttttgtttgatatctttctactacaggtcttacatacataccagagcactccttggagatatatgcgtcagctgccaattcaacgggaagttcatagagtcaatatcagagtgtcaaatggtgcaattactgtcttggtgaattggggtctggggtctcaacctctgcgcagagtgtgaggtcactggatcaagtgtattgttgctcatttgtatccgatttttgacgtagaagctcctacagcacgatctcgaagccaaataacgctatttgtacgtgggaaggattttgctgcctacagtggagaaatgggcacaatgatctgtctatagactataaattgggtttccaaatccattcatacacgggggttgctgagctgctagtgttgtctatacaggctcatcgaaaatctgtaatgtttgtgttgcatagttcagattccatttttgtggtgttcatttttgttccgtgtaaacctggacagtgcccatcttttgttcgacaatcgacaggcagatgtatcatgcatatggtgtagcgaggaaggagaaattcgcagatgtatcatctttgctcgtggttcatactgaattgctatactagcgcattgcagattttgtgagcattgttttcgttaccttaactgagatcctccatagataattcagtgccacttactaagtatatactccctccatccagaaagaaaaacaattgaatgtaatacattatagtggtacaataaatctaaatagatatatgtttatagatgtatatttagattcgtaatacaacaaatctaaatagatatatgtttatagatgtatgtttattttcgtaatataaggatgtgtcacatccgttactagattggctttttatgggatggagagagcatatcttattgaagtattgcttccgttttgttattttaatggatgatgccgatatttttttaacattttgtttgaccattttattttattaaaaaaattaactaaatattttttattttgatgcgacttagtttaacattaaaggacctttaagtattacttatatttttccatatgtgcactaattttatttccgaataagacaaatattaaagtgttgtgacaaaatcaatgatacctctattagaaaacagacagctcggaaaaaaaagaaaacaaagatagtacataaacaacattattttaaagaaaagaacagtacataacaaaatttttacacttctttaaaataggataatggtggtggcaataaatccgtaaagttacaaattaaccttgaacctcttaatattaagagctcatttaaaatatgctgccacgtataaaatcgaactaaaggtgaacattcctcataaaaaagatgtgtaactcgcgtatattttgttttattcgtagtaaagctcctgcattcatttagtttaacataaaacagctagaaaacatttacagaaatgaagtagtaataattactgttcattagttatgactctctcacgggcaaacagccaaacatgcacagcagtatgaaaaagaagcaaatgcaacaaaagatcgcttggctggtggtcgtcacggggagtagtgtcagtcgtgagagacatccagcaaactccaacatccattctccgccgttggatccatcacctcaatcaacatcaaccatcccaccctctcaaccccaaacgcaaagcacacacccccctgcattaaataattcaaaccgaggaggtggagcgtttaggaaaagagccgccgcctccttctcctgcaagccactccgtttccgtctccgcccgcccgcccgccgtcgtgcgcgcctcaactcaaaaaccccaacccaacgcctctctctctccatctcg

SEQ ID NO: 7265 - DNA, 4357 bp, Oryza sativa
gcccagccgggcgttccaggtcggtcgcccctccgtcgcgcaggccctccccgtccccctcccgcgcgcgccccgccgccgcagacaacgacgggggttcaggtacgcgctcctctgctgctccgcgcacccgtgaatcatcggagattgcacttcatcatcggtgtattgggggtttttcgctgttggtgcttttcgtcgaagcccgtccggtgaatgatgcatttcctctgttcgaggagccgtggaagcgcgtctcgggtttttcgctcttcgtcggtttatcgggaaactccaaacgttacggatacttgcaacggcgacgggaatatcattgtcgctggagagatgaccatttatgcatttcagcattggaaattcgctatcagttatatattgtactcattaaatcgcacacacatgaatacaagtcatatatgttcgcacacacatgtatacaagtcatatatgttcgctatcagttatatattcgctctgaatttacgccatttccctggtgctgctagccttctagcacagtacattctgctagatatctgtaatcgatgctgttttctcacattctgatgcggtgaatgtagcttaatatgctttacagtcgtttatggagttgatgtcaatatggtatgttttcagaattgataaagggtgtttttcacagattcgtgcagagtaagagttgctgtaaggctccggccgaagaattctgaggacttagctcatggcgcggacttcgatagttgtgttgagttgcagcctgaggtgagcatcctattttactctctgcgctttgtacctcattataagtaattaacaacttaattacttattctgcttgttttttattgtgtgcagtgtaagaagctgaagctaaagaaaaacaactggagctgtgaatcatataggtttgatgaggttttcagtgaaaatgcttcacaaaaacgtgtatatgaggtcgttgcaaaacctgtagtcgaggcaagtcgtacatgtcatcacccttttatttacacatgtaacgtactactaactatgagcaacatattttcattgcaaatgcttatgtttgtctgttttctatgtagttacattaacttcagttggtagaacttgattattatcaggaagtgattctcttaggtgccaaatagtgtacaacaggcctgcaactatgccttaagaacgcttttctgtattgctagtaggaacaaacttttatgtgtatacaattggaatttccctttagcctgttactagcttatgacccatttgcatatgatattttgttatattggcctgagagaatgtagaaactattctgataaatctcgcagagcgtgttagaaggatataatgggaccgtgatggcttacggtcaaacaggtactggcaagacatacacagttggtcggcttggaaatgacgacccttctgaaggtggaataatggtcagagcattggaacatatcctttctgtcatgtctttggagacagatagtgtggcaatatcatttctccaggttctattctcaacaactgaagttatttgttttgtacatgtatcattatttcttattgatcgacattattcttttttggcatggaatggtggaattgttttaactttcttattagctaggattcttcaaactgtctcgattaatgcaggaagccaggaacagtcatatttatatgctaaggcttatatgattatcgtgccacattgtcacaatcatttttgaacagattatgtaagacatagcaccagtttttgtatttaatacatgacatcaaataggtcatgtataacaatatgtgtttgaacactttcactcactttaatattatccatccatagttccaggtagtttgccatgttaaacgtggacgacaaagataaaggcatttttctatcgtgctagataaattgcataaaaaactgcacaaatgggatgaagtgttatagttcatggtgtactgcaaattgaaccaaagtgcaccatggttcatttaatgcttaagcttctatgtccatattttttttctcaattatataaaattatttgaatattcattagtggtcccttattgttgtagtatgtttttccatactaatgtatacatgtttatttggtttatagctttacttagaatctgtgcaagatttacttgctccagagaagactaatattccgattgttgaggatccaaaaactggtgaagtttctttgcctggtgctgcaaaagttgaaatcagagatcttgaacatgtttttcaacttctccaaattggtgagatgaatcgtcatgctgctaatactaagatgaacacagaatcatctcgtagtcatgctattctcattgtatgctccttcttccttgctgtgggtattctgttttaagttccaaagtaaattacatgcccatgcgaatttgatattcttttcagattcatatacagaggagttcaagaatagaagatggaagtaatacctctcttcctaatggtactgacaacctttttcctgataatttaccgcttgttctcaagagcaagctcttgattgtcgaccttgctggatcagaacgtatcgataaatctggtaggtcttaccatataattgaaacaaaccttttcatttcgtatgttgtattgtttgtttgtaatattaatcttttgtctcccaggaagtgaaggtcacatgattgaagaagccaagttcatcaatctgtcattaacatctctaggcaaatgcattaacgcgttagcagaaaatagtcctcatataccaacaagagattcaaaacttacaagaatactgcgtgattcatttggaggtatgatttccttttggtatgattgaatttcttgtgtttgtccaaagtataggtgcctattagattgtttgaatttatcacatttgttcaaacatcatggttactttttctccacatcactacatgtgtaacactgtaattgatttgctcaaatctccaaatgcagggactgcaaggacttcactcattgtgacaataggtccatcttcaaggcatttctcagaaacttcaagcacaattatgtttgggcagcgagtaagtgtagattggtcaatatttcattgctctctctctctctctctctctctctctctctctctctctgcacaataggtccatctgtaagatactaagatctgtctacgttgatgaatttttgctcactttccctattccaatttgtgcaaaattggcctctactgtatggaacctattcttgtaaatggtattcagagcttttcccactagatatatttttagttaatcccactagatatatgatggttagttaatatctgaactctactccatcccagcccattaaattatgccatgcacctgtcttataccaacataatgcacctagtttcatggagttggaaacatcatttcaactgcttctaactggataaattactagagtgaactgagcagcattaatttgcacacagtgcaaactgtgcatgttgcattacatcagagacttaattcatgcatgaactaaactacttgttactggttcctcttgaaatgaattcaatggctctcgttgtttaaaattgcaactctgcatttactcaaagaaagaaactcatgttgtctagttgttttatatcgtttccttcttcttgttccttttttgttataagttataacaccacattaagtcgttcattatgtgatttcaggcaatgaaaatagtgaacacgataaggataaaggaggaagttgattatgaaagcctatataagaaggtagaacatgaagttgatcatcttacgtcagagatggagaggcagcaaaagcttaaaaacagtgagaaaatgcagttggagaaaaaactgaaagaatcagaagcatccttgaatgatttaaaagtgacctctaacatgcaaattgaggtataactttcatagactaattgtccaaaaagcatagactatgaagtttgcattgtatattaattttgattcatttttgtcactccacaaaaatctaccagtttgggtgccttttgtttattacagaaccttcttacttacctttgtccttcctattgggtacatgaattgaagtaaatatctattgtaatttctgacaagtaaattggttgtatttttgtttgtgctttccatataattattaattgtgagcattcaggaaaaatcactttcagtacataaaacttgcttcagggcattatagatataatgtaacaagtgatttattttcgcagaatatggcgatggaaaagcgtcaattggaatctacaatcaag

SEQ ID NO: 7266 - DNA, 2609 bp, Oryza sativa
gacctctaacatgcaaattgaggtataactttcatagactaattgtccaaaaagcatagactatgaagtttgcattgtatattaattttgattcatttttgtcactccacaaaaatctaccagtttgggtgccttttgtttattacagaaccttcttacttacctttgtccttcctattgggtacatgaattgaagtaaatatctattgtaatttctgacaagtaaattggttgtatttttgtttgtgctttccatataattattaattgtgagcattcaggaaaaatcactttcagtacataaaacttgcttcagggcattatagatataatgtaacaagtgatttattttcgcagaatatggcgatggaaaagcgtcaattggaatctacaatcaagagattgatgctggaccttgagaaagagaaaggcaaaaataatattttatctgagcaaattattcacttagaaacatcattggatgagaataaggtagattttctttgccatattatatatttctctcatatgtaatgtttatcttgattttgtacttagtatttgatgtagttctgctgacactgagatgtcctatttcaataatttcacagttctaacacaagttttgttgttagtagcaaaaacagcttgagaacatctcaaacacaaatattcttgccgatacaactaaatctcatgagaagaaaataagagaattgctgaagcaacttgaagatgaaagatcacgttctgctagcatgaacgaccatttaaatgtactacaacagcaactgagtgatgctcagaattattttcaggtatactttcagaatttacaactgtagctataatgcagtcagataattcatagtaactaatagtctaatacaatataacagtcagataattcaggtatacattttttgtttgtggttgcatcttgtttggatataatatcctcattcctcaaccaggactactctccatacttgaaatggaaaaacattttagactagacatgccttgggttctctatagtttttccttttttttcttcactattggccttttggcagaatgtcattgcgcatgtccctgcaataatttaaggtttgttggaggacttgtttgcatccttcaggaattttgaaaaggttaatatgaggatatcccggttgcagaaaaatatagcctgtgaattggagaagcagctctccagaaccactgaagaatttgccagtcaaataagctcactcgaagaaagaattgctgatctcatatcagagaaggtatggcaaacacgggacagcacatctaaacatatggagatgtttaggttttctcaaatctgaaacaattttaatgtacctttttatttaattattcttctaggagttggtgtatgaagagctgaaatctactcaagaaaagatgcaacaggagatgagacatagacagggccttgaagatgaaattctaaggttgaaacaatctttggctgataattgctctgaagaggtaccacacttgcattataatcttgacattctgatgctcattttccaatcatatcttatgtcaatctctctttttgacagtctaaagcattatgtggtatggttagatcaggatctggattaggtagtgtgccttttatgtctaagtcaggaaaatccagagagttgctatctagccagagaagtaacatatcaaagatatttgaagaaggtacttttatttgtggtacaatatcagtgtagctgttttttgtgggtagccatcttgacattatttttggtccaactggcattcagtcggtcttccaaatgtcctggctctgttgaagtctgatgaactagaggtgcagatccatgctgtcaaagtagtagctaatcttgctgctgaaggtacgggactttatgtaaaactctgaatatttttcattcactgcctttccttgtacatttgcatggaaaatattcctgaaaagaggattttttttccctaaaaatatgtggatctcttttggttataatatgtgaaaaatgtgaaagtggcatattgttcaaattctgttgacgaacatattcaactgttccatacgaattgtaatttgcacttggtcataatattgaagccagtgatttgtttcagttatctgctgtctatgctatgttttctcctttagaaggcaactgttataaccatagttaattgttatcaccaatccatctgggattgcagacgttaatcaggaaaaaatcgttgaagaaggaggactggatgctcttctgtcacttctagaaacatcagaaaataccacaattcatcgagtcacagctggtgctattgctaatttggcaatgaatggtaatgcctattccaacctctcatgagatttattttccacatttggtcaaaaggggctattatttcattgtatagttggctcactgctgataatattgcagcatggaagtagttgttaaccggtgtgttctatagtctttcactaaatgtcttccgcacatgccaaatggcccagtcattgactgaaggaaaattccccaataggtttccagcatgagatattctttttacatatttga

SEQ ID NO: 7267 - DNA, 4795 bp, Oryza sativa
cgactctagaggatccccatcgagtcacagctggtgctattgctaatttggcaatgaatggtaatgcctattccaacctctcatgagatttattttccacatttggtcaaaaggggctattatttcattgtatagttggctcactgctgataatattgcagcatggaagtagttgttaaccggtgtgttctatagtctttcactaaatgtcttccgcacatgccaaatggcccagtcattgactgaaggaaaattccccaataggtttccagcatgagatattctttttacatatttgaactatatctatattattagtcaaatttatattgcgatatttataaaatgaacaggcaataacttgagtattaagttagatccttgtaagtgcaggatcaaaccagggactaataatgaacaaaggaggagctcgattattagcaaatattgcgtcgaaaactaatgatccccaaactctgcggatggttgctggtgcccttgccaacctatgtggaaacggtacaacctgtctttattgtatccattatagcaaaatattccttttaatatggaatttcaattttcttgaacggcagtgggtgtcatatttttattcaaatttcaatttcaattttaatgagttaactatttttgtttgacaatgttgctagcagcgttccaaataccagtattccctaacttaccaggcctggttccaccgattaccagattttactagataaaattcaaatccaaaatttgaattttttttaccagtaccggagggtaactgtgcagttacctgctgaaaaaaaaaaatctaaatttacaatttgagtgtttagtttgaattcatatccttctagccagtagccactaatcctccggcgcatcaggacagcttatcagggccttttttaacgctgattgctagtagttctgaaatgaagataaaaaggtggatagcgatgcagaatgtaaacaagataaagtcatgattttacggatcaaacttgttaattggtgcaccggatatttgtcaagagctgataagtacatttctttaatttattttgttttagaataatgtaattttagttgggcaattgtcctcttgtgacttgtgagggtgcaccacttgtggcttcttgaacagcaatgacatgcaactatcgagctagcattcctttggaatggaaacaagagagctcgtgtatgtagaacattgattgataatgagtgaccaataccatgtactccttttctttttttttttgcagaaaagctgcatgttatgttgaaacaagatggcggaataaaagcacttctcggaatgttccgaactggacacaacgaagtcatagctcagatagcacggggaatggctaattttgcaaaatgtgaatcccgagtaataagtcaaggttagtacattctctattactcatttgtgatggatatattcgttcatattattctgtaattgtttgttgttttctatgagcttatggtttgaatatcaaactccacatggttgcatgaatatcaactgcagaacagtcctgaatttatttggatagttatgacgatctgggtgtagttgaaaagaggtaaaatgcggcagaggacaatctgaagtgtgatacactgatatgatacaacatgccaacagggctagagcctgctgaaattgcgtacatacttcttgaaaattactatagtagatctatgcatataacgcacatgttcacaagaacacgaaccgatattacaccactaatcaattaataatatcctggtaggcttacacaatcatatatgctaaatatgccttaacatggattgcattgtcacatgttacatatttttttaccttgaacactatggaacactactgtcctcagctcttttctcctgaagataactatgcaaacttgagagggaaaatccaacttttttgccattctacccaaaataggtcacaggaaagggagatccctcctcatcgaagaaggtgttcttaattggatggtggccaattcatccgcgttttctgcttcaactcgaagacatattgagcttgcattttgccatttagctcaaaatggtacgtaaactgactagctgccgtcaccttcgatccctccctgtgtacaatcaagctcacgcattttgagtatttgaccctcatcactgatgttcctatcacatgcgcatattcgcagaagataacgcccgtgacattattctaaccggagggatcaaggagctccttcgcatatcaagggaatcatccagggatgatacgcgtaacttggccaaaaaggcattaaattcaaatccagcttttttcaaggagatccaatgatttactttacatgtaatggaaccatgtatagccccttcttattaggaaatctcgagggaactgtgctttctaaaacaagaatttctgcttttcaaacggatgataggggtataaatcaagtaatgagatcattttcctgggcaattacgattgccccaaaattcgacaacatttctttaatatttgccatcacggcacgatcaattgaaacaccaagagttaaaatatttgcccgccgtacacttcgagagcttatagataatgtcttaagcaaaaacgagtgatgtatgcgaacttagtgttgaataacccatgctataaagtacaaaaggctgcatgacataatgttacaggagaccgttacacagcaatagagcaagaatcttcagcgatcaaccgaaagttgctgtccgctagctcgggaacttcgttgagtactgctgcggagactgacacagcaaaagagcaatcagcaaacccaaaatttagaaagggaagattgacctcaattaaatgttgtattccataccataaatgttgccgtaatcatctttcccgcaaaccacctcccatgaagtgctttctgtgcactcatggcagctgttatactgtcaaatcgaaggtacacaaagccagaagtattcctgcaaaatagttgcaacaataccaaataattagggcatgtacaatgcaagccacaagcaactatggtctcaggttgccacataggataaggccacacaaaaaccacgatatctacaatggagaccactgcagagtatattttgtgtttcagcccctacctatttgtgttagtccctatgatatttgttattataaaattaactattttagtccttctaacaacaaaaagaaatagatacccctaatctatatatggacccactgtcagcctctccaatcctcttccctttattttctcctcctaccaaccggctctgccttaccctcttcctctccaacgcctcctcttgttgcctccacttctcctctcgtgcgccggcacagcgccgatcctcttctcttgcgccgacgcagcgccggcttcttcttttaaccgccgagttcttcccccaggccatcctctccttcttctctgccacgcacacgcccttctccggtgcatcctactttcttcgccgccaccctgcgcacaaggtcgccagatccgggcacgggctcaccggatccgggcgcgggctcgccggatcctgcggcgacggggagcagcgctcctctttgcatctggcggcggcggggaacagtggtgtcatcggcggcgctcctcttcgcatctggcggcggcggggagcaacggtggcggcggtgagcagcgacgactaccacggcgaccgaccggacgaggcgaagcacggggctccggctccgccaacgcgtggccttgggctgtggcttcgcggctcccgagcccaggcacggcgcttcgaccggttcctctgcaagcgcggaatcggcctgcagagccacggtccccactgacatggatgcgcccgtccgatgtggaggtttgagaccacaggccagggtcacacgttgtacatggccttaggctatccttgtaaaattggcaggcttttcaaggtaaatcaggtttgcacacggcaataattgcactgcagtacgaggagcaaaagtacactgcacctttctgaagttgcagtacacaagaaaattgaaagataaaagcacagtaaacagagcctttggatatgttagcagagaatagagaattattcccctaacactctacaagtacatgctggtaactattgaatactatattttactagattactagattgtgttgggacttatgtactgggaagctgtagatggttacaataatgccgtatgcaagctgttacagatttgttgactggtaattagtgttgaacaaacttacttgtccacaaaaatgtgttttacttggccaaacttggagcattcttcttggacatcatctttgatatccaaatcaaaatcagggtccgtctgcaataaagtaagtttcaattagtttttaatcaaccaaacagaaaggatacagaccagtaaagattttttttaaaaaaggtatggactgttggtgaacccaaaaaaaaaaagaatgcagtagtaagaacaaacctccacggatggatcaaacatatttttaagcaataggcattcactgggtggggctgtctcaatggcttgggtagtaattggaagagacaccccaggaactgaaccaagaccaggcactgtaggcagtacagatgcagcgactggaggagcaccaagaactgatgcaggtggtaatccaacagaagtgttcaaaccagtacccgctattccaacagtcaaactgcagacagacaaaaggaaggtaaaaaattcagagga

SEQ ID NO: 7268 - DNA, 1852 bp, Oryza sativa
  unsure (1)..(1852): unsure at all n locations
nnnnnnnnnnnnnnnnnnnnnnnnnnnnnnnnnnnnnntactgggaagctgtagatggttacaataatgccgtatgcaagctgttacagatttgttgactggtaattagtgttgaacaaacttacttgtccacaaaaatgtgttttacttggccaaacttggagcattcttcttggacatcatctttgatatccaaatcaaaatcagggtccgtctgcaataaagtaagtttcaattagtttttaatcaaccaaacagaaaggatacagaccagtaaagattttttttaaaaaaggtatggactgttggtgaacccaaaaaaaaaaagaatgcagtagtaagaacaaacctccacggatggatcaaacatatttttaagcaataggcattcactgggtggggctgtctcaatggcttgggtagtaattggaagagacaccccaggaactgaaccaagaccaggcactgtaggcagtacagatgcagcgactggaggagcaccaagaactgatgcaggtggtaatccaacagaagtgttcaaaccagtaccggctatcccagcagtcaaactgcagacagacaaaaggaaggtaaaaaattcagaggaaggccaagtgttcaaaccagtaccaactatttgtagttaatatatgccacgcacattttttgaattggaaatgcagtgaaaaattaaaaggttatggctaacatgtcttgtcacgataacttgatgataccataagaataataaggtactgtggcatgttctcggcatttctcaatcatggttcactctcttgaaatttgtagtagtcaatgcgattgacatttgatgttagaaatggagtaaacaaaatattaacaatagcgatgtacaccaaagaattggaagaggtccttggagaatgaccttgacaagctatatacatatggaaacagtgttgatgtagtggtggatgaatcctgacgataatatagtaaaggtcaataacgaatgattttgatacaaatgacagcaactctaacaagcaagataattgacgttctggacatttgacatcccagtattctaaatatgaacttaaggctctgcagtaccatcaacaaattacagaaattacctggttgactgagcaacacactattaaacaagctactacctccatcccaaaatataagggattctatagtactacttgtgccatcaaacgagctaacccctaaccaacctcccgtccataccacatttaaagaggggtatcatggtcttttttttcttcctatttatactacctctgttttaatagatgaccctgttgacttttggtataattagtgtaaatatgcctataagtcatacttaaagatttctttaatgataaaacatgtcacaacaaaataaatgacatttttatataatttttttcaacatggccaaacatcatgccaaaagtcaacggtgtcatctattaaaaaacagagggagtatttatgggacaaaggttatatgtaagattgaatatgactgatgtagttagattgacatggccacgagggcaccaaaaagatagtttaacccattaagctcacatatatatacctggtggtaacgccgctacggtctaatttctgcatcaaaagagctcttgaactagcattcagtgcctgcatacatcagcattcagcaaagtcatcacagacacaattgagatactgttgcaatatgcataagtatgtggcatttaaaaacagcctcaaacattaaccaactaagaatgaacaaatgaccatgcaataaaggcttgctatagtagatatgctaggtatgcagagtgctcagtgtatactaaac

SEQ ID NO: 7269 - DNA, 2408 bp, Oryza sativa
taagattgaatatgactgatgtagttagattgacatggccacgagggcaccaaaaagatagtttaacccattaagctcacatatatatacctggtggtaacgccgctacggtctaatttctgcatcaaaagagctcttgaactagcattcagtgcctgcatacatcagcattcagcaaagtcatcacagacacaattgagatactgttgcaatatgcataagtatgtggcatttaaaaacagcctcaaacattaaccaactaagaatgaacaaatgaccatgcaataaaggcttgctatagtagatatgctaggtatgcagagtgctcagtgtatactaaaccatcatatggtaaagttcttgcacattactccctccttcccaaattgatcatcatataatgaaattcaaaatttcccaaattgatcatcatataaccacatgaacatggatttcatcggaatacaattaatgcagcaagggagaatgtgtgcatgctaagggtgtaattggcatggtgttttaatcaatgcatgcgctgtgggagaatgtgtgcatgatgtcttgattgatgtgaattaaattatcattggttttggtgcatatgcatatatggtgatcaatttgggatggagggagtaaaatcttctctaaaaagattgaggcgaggtgcaagcaaaagcatgctatgtcccaagtaattgtacttaaaagaaaatgaggatatatatatcaaatatgataagtgaatttccagttctcgatgtgtctccagaaatggcacccaccaaacctccaccttcatcatcatccaaatctccagtagttactccactgacttgaactcctgcttggtctgtcacagcagaaacctggttacagcagtttagcatagtgtcaggcagaacccttatatttgagatgtatagcttgaaaacaacatgtattctagtaaatctgaagaaaacacttgccttaatcacacgtccagctatatcaagttgcccatttaaactctgagcagcctttgcatcttcaaggcgtgcaaactacatgatgaaacagaagtcagccacacagaactctccacaaaaacaaaagaattgcttaataagcaaacacttgcctgaacaaaaccaaaacctttacataacccagtaagtggatctagtggcaattggacaagctccacctgaccaaacggttcgaagacctggtaaagagaattcattaaactctatatatgcataacaaggatgccatagtaattcttctaccccataaaagtaatatgttttccattatgaactccaagggaaattttcttccaaaagcacagccaactcatctaaaaaacaatttgtcggcatcacctgtctcaattgatcttcagtaatatttgagtgaagatttccaacatacaactttcttgccccacctgaagctgctccacttgaagaagcatttgactgaactaaattcttttcagcctctgatggcttaaccatcacctgttgaccaagaagcagctggccagaaagagctattgccattggtacagacataacatcatagaattcgatgtacctggaaacgcaaaagcataataaatatcaggatatcatgtcgccgatagaattaggccgcattcgttcaatcttttgaaaagatattcagttattcacataaaatcttgcatatcaaacattttcaaacaggtttagaattaatttttcccagcacaaactaattgcacattcctccaaccaaaatcatatgaaaatgcgcagaaatggcatccaataatgtggaattgctatgtttgatgttccacgctgcttacttcccccaaaaagatcttgtattccatcttagtcataagtagctgattatcccagtagatacaccaaattataaacattcctgccgagtatgaaaaatcggtgaatatattcccccataataaatcgtagatgtagctacagtttaaaaatgcttgtgtaatcataacagcaaccagaaaaatattgacaaatatggtcggtattcattaacatttgaaataccctaccaatcaccccccacccaaaaaacaattctcacacatttgatctctttgcagcctcttgtgagacatctactccactctggttcataccttctgattcagttcatctccttcccttgttgcccaccaacaatggaccttacagcacacctacactcacgtgcaaacatgcctaacattgaatccaacaacctaaatcacaatatttgccacatgagcacaaaactggagcagctttacagaaagctaggaggcatttgctatttgcttgctacaaacaaatggcttagcaacacagactaaaaccccaaaacagtgggtccatctccctcattctcag

SEQ ID NO: 7270 - DNA, 620 bp, Oryza sativa
gcaagttggatgctttaatcataataacttcaccaggcataaacatggtagactgttctcatgtgctacctatttgcgtcaatcttagcagattgacataactggctaatacctcatgcccatgccttttagtactctcttcattttctgcaactttataaatcacggcattgagcaatgttctgagatctttagaagtcatatagaattaccttcggtgaaatcccctttttcagaaagaaaggaagcacacgtgtatctgttgattaattttagatgttatacatatgctgattaatcactcatgttctttgttggaaggatgcaggttgttttgcaagtgaatgttggtgttaacaaaatggaagctccagtgctagaagttcttcaatttgagaaatcttcatcaagcaattatataaccaagaatctggtcaatggactttctagtggtgatgaggatccatgtcaggagctgctaagctggctgctccctttggatcgcacacttcctccgcgatccttatcaacttctactctcaatcctagtgcatcacacaagcaatcttattctggttctgggtctcaaattttttcattaaggcacttcagaagctatt

SEQ ID NO: 7271 - DNA, 678 bp, Oryza sativa
  unsure (1)..(678): unsure at all n locations
tactttcagaagttcgattgttttaaacttatttcctcaaataatttcaggtaactgtcggtgcatcatttttatcacaaacattggctttggaggactcaacaatagtgaaatttgaaatatgggataccgctggacaagagaggtacacatacagcactatggttttagcttcttccaatcttgggataatggcatgctgttggtgcattagaagcattggttttgtgagaaagttctagtagtatgtgttactgatttttacaattgatccatcttacgtgccacacatgcatatggtttttctcaatcaagaactcattggtaccagccaattttaggtatgctgccttggcacctctttactacagaggagctgctgctgcagttgttgtctacgacataactagtccagaatcatttagcaaagcacaatactgggtgaaggtatgctatcgccaaattatctgcttttctgatgtctggttgattgattactctttctatcttttactatgagtttgtattttttgcccgaaactgttctagtaaaattttatatcatactgtaagattgctgctaaaatattataaatgtgttgnnnnnnnnnnnnnnnnnnnnnnnnnnnnnnnnnnnnnnnnnnnnnnnnnnnnnnnnnnnnnnnnnnnnnnnnnnnn

SEQ ID NO: 7272 - DNA, 953 bp, Oryza sativa
cacagtaatagtccgccattttcagaagctttctcaccagcgctctggccaaccaattgtcacgcagaaagctgatgaccgcattgctgctctcctgcatgaagccaaccacgtaggctgtcccgatgagctcggcgctcctccaccaccggatcctcgcgtactcacgcagacccgcctcgatcctctcgctctccgcacctccgccgccgccgccgaggatggcgtcgccgaggcatctcgccagcacgacgccgtcctcaagcgccgcgcagccgccctgcaccagttcgggcgtcatcgggtgcagcgcgtcgccggcgacgcacacgttccccttgcgtatgctcgccagcagcagcgagagcggcggccggaaacgcagcggcgcggtgagcacgtgcttcgcgtcgctcctctcgatgacctccatcacctcggctgggatctcggcgctcctcagcttggtcagcacgaactgcttcttcttggctagagcatcgtcatctagagcagcaacgcaccgatcaattgctgatcactaatcgattcactgttcgtgacactgtgtcaatgacagagactaaccgtgctcagaaggagaccaggtgaagaaccagtagacatcagtatcgttgcaggggatcacgccgatgttgattaatttcagctgtggcccaatgcaagccgattctctcggagctgaacgggaggatgaattagtctagcaggagtttgttagagatgcaaataagtcgcaaatcagttaatcgtgaccgagtctagcgctggcagtggcgcgggtgtgtgcatggagttcagagaaaagcggatcgtgggatggcgcgattttgcctcggattcctattttttttgcgttgagtataagtagttctctgagctctttattctttttgtaaggtttacattcagttgaatgagaaaaacccaga

SEQ ID NO: 7273 - DNA, 626 bp, Oryza sativa
gcattgtacatgccctaattatttggtattgttgcactattttgcaggaatacttctggctttgtgtaccttcgatttgacagtataacagctgccatgagtgcacagaaagcacttcatgggaggtggtttgcgggaaagatgattacggcaacatttatggtatggaatacaacatttaattgaggtcaatcttccctttctaaattttgggtttgctgattgctcttttgctgtgtcagtctccgcagcagtactcaacgaagttcccgagctagcggacagcaactttcggttgatcgctgaagattcttgctctattgctgtgtaacggtctcctgtaacattatgtcatgcagccttttgtactttatagcatgggttattcaacactaagttcgcatacatcactcgtttttgcttaagacattatctataagctctcgaagtgtacggcgggcaaatattttaactcttggtgtttcaattgatcgtgccgtgatggcaaatattaaagaaatgttgtcgaattttggggcaatcgtaattgcccaggaaaatgatctcattacttgatttatacccctatcatccgtttgaaaagcagaaattcttgttttagaaag

SEQ ID NO: 7274 - DNA, 1684 bp, Oryza sativa
  unsure (1)..(1684): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctgcccatcagcaaggagcccataacggttcatgcggcgaagcagtgcctcaccctcaaagatgcggcgtggattcttctcatcaagtgtgagcagatgccttgcattgttacggatacggctcaaagcatactgaacacgccacagctcacgcttgcacctcagtccatactcacccactagcttcagctctgcatcaagacgctccttctcgtaagggcgacgtggcttcttgaatgtcttaccatctgcaatgaagtaataaatttgttcacaacacatgacagagaaagaaaccactgcagatagcatagttgttcatgaggaaccaaacaataacatagaaagaagccctacagtcccaaattccttatatcctgaccccaaaaatatacaaagcaagaaagaaactgcacacacaacccggaaagacaatgcaacaatacaaataaagaaaactacagtagttgttgagattacgcccaataatagtatggatattcaagacaaatagtagtagggatcttgtgtacagtaaatactaagagcttcagatatacaaccatgtttgacaaggatttaaaaaacaattcataacattgtgtctgattaacccaagaatagcttacatgccagatttagttttgctgtgttatccctggttgcccatatcatacatacctaaattatttgtcctgctgtaaaatggaattcatgacctaaagcgacaatacttgaaagatcttatcagggactatcatataatatatttaagaaaatatacatatagaatgcaattagtatactacaacttacacagaaattttaaaaaaaattaacaaatatagttctcgatggatcactctatggacaaacatacagttagtgcattacaagtatatagtcctctatattaagcgccattattcattttcataaaaaaattcacaagcttatgcataactccattccaccaaaatgagtgatcaaacagagtatttgagaacaaaaaactctagttaatgaatatcatatttccagtccttaaaaccggtaaattatcaaattttgtaccataacagaaataaacattttcgagctacataataccaaatgccagagtaaaacatgtcctcattcctcagtactatacaacacatattagcattctagttagaacccccaaataatctactacatatctcgaaattaaatccggaccacacacaagtttcaactacagaatgcgcagtcagtcgaaatcagcacgaactaatcggcatagatacggatccaacgcagtggaaacgagaaaatgaacaaagctacgggaacagaacgcatcgaggcaaatcttgatccagatcatctcgccaaccgaaccagccatcgcctaatcacctaaccgacactcgctaatcaactaagacacataagcaagagaagagggaaaataaaaggagaacattctctcgctgcgtcaaatcgcactagcaccaaccaagacgacgacgaagaacacaacaggtaaggcccgccgttcttg

SEQ ID NO: 7275 - DNA, 7702 bp, Oryza sativa
  unsure (1)..(7702): unsure at all n locations
nnnnnnnnnnnnnnnnnnnnnnnnnnnnnnnnnnnnnnnnnnnnnnnnnnnnnnnatacgcatcactcggctgctagcttctagttccgggcacgctttgcttgtcaattgtcatcctctttgtcatagagggcagtgcgtggtgacaaagttggcagatgcagctgagtcatagatgcagatgatttggattttttttttctgttgatgtttgcatatcttagtggctacatgggtgttttctgttttaaaatgatttgatacttttgttcaatcgaggatgaatcaccattgaaatgatattttctttgtcctttcacacatgtgcacagagttgaaatggcattgccacctgctccaagcgaatccgatttcatgcatgtttcaaagaagacaaggtgctctccaaggttgaacaagggctcagcttcacccccactttgacaaatctaacactgctcattcttgtcatctatgcaggactacatgaaagaatatcgtagtaagctatgcaaaaggttactgtaccatcgcttcaacgacttacatccaaaacgtcgtttctaagcttcagaaccaatatgcttattcggttcaagcagtgtcggatgtgtgcttaggccatttttgtagccccctccctccctctcccccaaccaacatatgtaacaagtcaagtttcagaattgtgtatgtagctactatttttgtcttgaactggaaggttgcgaggggcacaacaatcaaagacatgaactctgtatgtggctactgttttcatgtacagatatgttggtaaagaagtggattatattgggtagaccttttctgtggactatatatagtttgagtacgttgtacacaatgaaatcgagttcagtatcatatgaaacctgaggaaatgatactgaggaggatcatgatacctcccagagttcacatgatcctactcaagtatcatatgtgaaaccagtagggaaccactttacaagacatcgatattggataggatcatgtgatacttcacatgtatcaatcataatgaaactcatgtatcacatgatcctacctacccatgtatcatgatagatgattttcctgggtaggatcatgtatgatacttcacaggtatcacaccatcctactaaagtatcatatctgaaacctcacagggatcatgttaccagagatgatacccaagtagaatcatgtgtggtacatgtaaagtatcacaccatcctactaagtatcatctgtgaaacccatagagatcatgttagaggacatgatacctaagtaggatcatgttagaagacatgatacctaagtaggatcatgtgtgatacctcacatgtatcacacttaatgatacttttttgagtaggatcatgtgtgataagtatcacgccattaagtagcatttgtgaaacctattgggatcatgttagaatacatgatacctaagtaggatacatgatacccaagtaggattatgttaaaagacaagatccctaagtaggatcatctgtgatacctcacatgtatcacacttaatgataatatttttagtaggatcatgtgtgatacttgtaaagtatcacaccattaagtaccatctgtgaaacccatagggatcatgttagaagacatgatacctaagtaagatcatgtgtaatatctcacatgtatcaaacttaatgatacttttttgaggagaaccatgtgatgctatagaggtatcacatgatcctacaagataacaagagtaccatgtgatcctacaagagtaccatgtgatcctcaagagtatcacatgatcctaatagagtatcatctttgaaaaccacaagaatcatgtgctacttgtgtgaaaaatttcagcaatcacataagacgccggattgcagaggaaattggctgacgacgtgtgcgccgatggaatcagccgagaaaacaagcatggaggcgcgcgattccgcggatgaatcttcgggatgcggaggagctcgcgccggcgaggaatcacgcacggaggcgcttgattcctaggaggattcatcgggttgtggaggagctcgcgccgacgaggaatcgcgcacggaggtgcgcgattctgaggaggattcgttgggttgcggaggagctcgcgccggcgaggacgcgcgattccgaggctgattcgtcgggatgcggaggagctcacgccggtgaggaatcgcgcttcgtcgggttgcggaggagctcgcgccggcgaggaattgcacacgggcgcgcgattccggaggaggattcgtcgggatgattcaggcggggcggtgagcactggtacgatacgtttctgttcctgtttttgttgacgcgctcgcgcgatactgtgttggtttcagaattatcctgtttttcatcgggataccggtatatagcagccctcttttataaacaacaaaatccgggcattcatcaacagaaggaaacgattccagataatcaaccagagagggttaggatgcaatgctgattgatatggtctcaattctaccaactagacaaggtttacagcttcagggaaaaaaaaagcatcatcatttcatcaccaaccaaacatggcagatttctacattactcatctactggtgtatattggagaaatatgttacatgatgacatgtcataacaattgacataggacaaacttgtgacaaggaggtgagttccattttccttgctttcttgatgaaatggctcctggagactgctacctaatcaaagaggctctctacaccgggctgaatttttcttctttggcccgtaaaagaaatgcaatgatcaagtaagttgacatgatcaagactgcaacgaaaaatatatttgttgagttcaggggttacatgtctagagacctctagttgcagtaactattcatcctcaaagatcatgaggcagcaaagaggctccatgagttgtgtttcggatatgtgctctgataagcagaggttggatagcagtcacacttcaattccttctccggctcaaatgccacactcttgttgctcttttgttcaagttcatctgaatcctttagtgaaccttgttcttctgagcctttcttgcgcttttcagtatcttcgagtctttcggtaccttattttgttcttctgaatccttcgccgccttcatatcttctttcgagttcgatggcttttgactctttcaaaatttttggtggcttcggttgttttgaatcttttgacggctttgattccctggattcctttgatgacttcgaataccgggattcctttcatgactttgaatctttcgatgatttgccagactgtttagattaggcatcacagataacagtgagcaccatgacttcaggatcatagctaattatatacaacatgaaagagcacatagactagtgcatgaagttcaaagtagagcctttttcaattttcacaattgtatagtgcatgaaatggggaaatatgtaactaaattttgactcaggtaccttctttgtcagtttattgagatcttcaggtccattttcttcaataaacttatcaagtgccgtgaggaagtcatcaaatttaccggaaagaccctttttctctgagggatataccaaatatttactatctggttctttataaacacagatatcacataattttggtacacataggctgcaccgctgaaatatggcaagacaggccagcaaataaagatcaatttcatggatggccaaaaaggaagcctgcaaaaatataagatggagagaccaaggaatttaatcagtcaatgtatcatgctaaccaatcataaatttgtgcaagccaaagggagggagagatattagagcaagcatgaactaacagatctttcttccttaccattatgttgtaatcaccatccaaaccaaaatatgcaatgctaaaaatcacaattgcattattaaaaatcctacaaaccttttatcacacagcaatggcatgaattgaaccatataattgcagaacacttgtaaacttgtattgatatctctttacatttttgaaaaagggaggagggtgcacctgacagaggaaaggtgtatgtttccgtactatatctaaacaatgcatgacaagaactaaataatgcttgcagttgcagggtgaccaagtgaactcgtaatttccctgcattagaataggcaacatgtattcccccaaaaatgccaaaatggtcgaagcctgtttgttctttttttgcactgtttttttcatgtaggcatgttagaacattgtatggtcatagctactactgtttctatgctaatgataagcatctagcgtacctggatttcacgtggtcgtgtagtcctttagtactgagagtgccaatgtggtgcctattttcagatctaaaaaatgtctattcacagctcacaaagaaaatctggcgggagattgaagaactgggtggtgagatcagggttgcagtatagtgcaacggtgagaagaaactcaccgctcacaaaaagctgggacttgggccgtgcagagctagcacggcacggcccagtgtgcttcgtgccaaattgggccgtgtcggcccagcacgccccactcgtcgtgccgtgccgtgccagcacgggctcttcaggacgcggcccaagcacagcccaatggcccgacgggcctattcgtgccgggccggcacaagcacggcccaaaagatgggagcaggccggctgcgctgagaagaaactctggcggcgacgcggcagcggtggcttgcggcttcgtcgtcccgtcgcggcgacgcggcagtgacagccacacccatcctgctcctcctcgtcggctcgtcgcggcgacgtagcccaccggcgcggcggcgtgagtcagccaacaatcttgccaaatgctagtgctggcctgctgggctgctggccttgctggttgctgctacgtgctaccgatgagccgatgaagaaaacgagctgctacttgctgctacctgctggctgcataggaaatttgaccgtggatgggtgatgactgatgacctcgtgctgcagcagccattcgcgtaccgtgccggcccaagcacggcccagtggtcgtgccgtgccgtgccgcccgtcgtgcccgttgtccaggcccaggcacggctcacgtacgggccgtgccggcccagcccatttacgggccgtgtcggaccgtgctttctatcgtaccgggccatcatgccttgggccggcttgataaagcatggcccaagtcccagctctaagcaaggggtaaactttgccccctcccccccaaaaaaaaaaaaaattggccaaaaacacatttcgcccaaaaagcctacttaaagataaaatactcagagagtttcccctaaaatataaaaactcgaatgaagttctcctctttatagaaaagttcttttaggacatgtttttacccaaaggaaacagcgttatgaggaaaagtacattcgagttaatgtcaagtagacagatgtattcgagccaacttcatccacctgacattatttttcctaatagttgtatccgagcaggttcctatggagtgacaaggcgccaagataatgggaaagtatattcgagttctctggtgcggccaagacagctgaaataacaagaaaagaaggaaaagtcttatcgagcagttgactcattcgaggaaaataatcgtggggaccacttcgactactctaaccagctggcaccagatgtcgcctagggcccactagcaaagtcctattatacccctagggcctatggatcactaggggtaatcaggtagctttatgtaagcccataatgacacagatgtaaatatttgtggtcatggtcaaacactataaaaggccgaccatagtcctgtagcaagaacacaatgaaatagagaaaaagtaccttatatacatcctgacatctacttttgggctcactctcagggtaaacgggaatctacactttcccgtttacccccaactctgttcgtgccataaggtcgtgacagtggcgccgtccgtggggacgtaaagtctccattggagtgggcccaagtggtaaatgcgacgttctcagagaccgaaaactgtgccaattcgttacactgacacttttgcaagtgggacaatagcacttgagaaggaacttgagaaggagtttgaaagagcatttgagcaaagtgatattgcgaacgtaacaaaaacgcttgaagagaagtgggcggaacaagtcaggaaaaggaaactgcgaatccctcaaaggaggaagcggggaaaacaaccacaagtgaagtggaacttgccgaaatggcacaagcacaaggggctgttatgataagcaaagaacaatacgaaggactatagagagagctacaaagactccaggctttgcacagtcaagcaattggagcaagtggatctggtgatcaactggagacataagaggctgatggaaaacaaccaaacttggcagaaaacactcatcaaggagatactttagctggagatcctcaagtcgtgaagttagcagaagagattcctcaagcccaaattatcaaaatacaagttcccacccaacaaatccttcaaatgcaaaaccccacccaacaaatccctcaaatgcaaaaccccacccaaatccaaaatactcaaacataactttccacccaagctcaaatttctcaaaaccgaattcctatccaacatcccaaccaaattcacttttcaactcaaattcatccttctcagattccataccagatataccaaaaccaaacacaaaatcctcaaaaccacacaactcacgctcagatttcccaagcatacacccatataccccagatacaaaacactcaaacacaaataccacaagtacaaatcccacaaatccatatacctcaaatccaaacatctcaagtgaactttccacatacacatgccatacaaaatcaagcaacacaaaactccagtcaacatattcaaaccttttctccttttcttacccaataagatgcgacaaatgaacaagtctacattccacaaatgcccaaccacatgcaatacacaggacaattaccaaaccaaacattcccattccaaacaactcaatcctattttcaaccaatcaaagcggtggacaccaaaagccctctgatccaaaatctgcaaatggcgccttggccattaagttttaagttgtcaaatatcaccaaatacaagggtgatacagatcccaatgaatatttgagggtatatgaaacagcagttgaagcagcagggggagatgataccacaaaagcaaaaatacttcaaaccatgttagaaggagtagcattgtcatggtatacaacaatactaccaatgtcaatatattcttgggaacatatgagagacactttttgagctggatttataggagcctatgaggaacctaaagaagcagatgatttgtatgctatgcggcaaacgcaaggagaaaccatcagaagtttcattttgaaattttcaagagtaagatgtcaaatccgacaagtggatgatgagatgctcatagcggcagccaaaagagctctgttgcctggacctcttaggtttgatttagcgagaaatagaccaaaaactgcaaaagatttgtttgagagaatggaaagttttgcgagaggagaag

SEQ ID NO: 7276 - DNA, 1180 bp, Oryza sativa
cagtgagcaccatgacttcaggatcatagcttatttatatacaacatgaaagagcacatagactagtgcatgaagttcaaagtagagcctttttcaattttcacaattgtatagtgcatgaaatggggaaatatgtaactaaattttgactcaggtaccttctttgtcagtttattgagatcttcaggtccattttcttcaataaacttatcaagtgccgtgaggaagtcatcaaatttaccggaaagaccctttttctctgagggatataccaaatatttactatctggttctttataaacacagatatcacataattttggtacacataggctgcaccgctgaaatatggcaagacaggccagcaaataaagatcaatttcatggatggccaaaaaggaagcctgcaaaaatataagatggagagaccaaggaatttaatcagtcaatgtatcatgctaaccaatcataaatttgtgcaagccaaagggagggagagatattagagcaagcatgaactaacagatctttcttccttaccattatgttgtaatcaccatccaaaccaaaatatgcaatgctaaaaatcacaattgcattattaaaaatcctacaaaccttttatcacacagcaatggcatgaattgaaccatataattgcagaacacttgtaaacttgtattgatatctctttacatttttgaaaaagggaggagggtgcacctgacagaggaaaggtgtatgtttccgtactatatctaaacaatgcatgacaagaactaaataatgcttgcagttgcagggtgaccaagtgaactcgtaatttccctgcattagaataggcaacatgtattcccccaaaaatgccaaaatggtcgaagcctgtttgttacttttttgcaactgtttttttcatgtaggcatgttagaacattgtatggtcatagctactactgtttctatgctaatgataagcatctagcgtacctggatttcacgtggtcgtgtagtcctttagtactgagagtgccaatgtggtgcctattttcagatctaaaaaatgtctattcacagctcacaaagaaaatctggcgggagattgaagaactgggtggtgagatcagggttgcagtatagtgcaacggtgagaagaaactcaccgctcacaaaaagctgggac

SEQ ID NO: 7277 - DNA, 1421 bp, Oryza sativa
  unsure (1)..(1421): unsure at all n locations
ccagagtctccagtagaaagttgcgcttcacgcaccgaatctcatgcggtccactgacgaagtaacgacacacgaacgatttcagttttcaggtgtttactcgtataagtatgattttgttacaaaattttaacattcaggtctcagctagcggtagttgcagacactgtaccttttcccttgcatctttagactcaacttcgcggcaggctctcccgtggatgcagagaaggccaacagcctgccaacaagcacgacaagtcacaacttcagtcgatcacaaactctttagtcttaagagttacagattactcctgcaacttcagtaggttaatcgaagggtaaactcaaaagatgggctggaaggagcaagagacagtgtaagcacacaagttcagagctcagacacggagtgggattgtggaaaaagcccaaaacttataaggtctagtacatcagaccaggcactggcagactgacccagcatatggacctaaaatcaggttcatcagtacggcccaggatggcctatcaaacgagctgggctgtaaatttgatttcgcttaaacgagaattattatactcgcgttaggatttgttgtgatttcgtgacggtcaacggactccactgttcgtctgttccactgtctctgtctggctattatctggatctacaactagaagggaagggattggtaaagcaagtggctgctcacctctcgtagagcagatgatgctccctgatcttgtcgccgacaccaagggcgtcgagcgcgcggaaggcgttcgtccatgtcgtgaacgcgaacccggacgcccgcagcgtcgccgacgactccagcaccaggctcctcacccctttcctgcacacgggacgcaccgccggcccagctcgatcatcagctccagatcgatccgcgcgcgcgcgcgcaaacgcggagcagatcaaggcgaaacggtcggcacagaggcttacctgtgtaacccgagcgccgtcgcgagccccgcgaggccggcgccggcgatgacgatgccctcgacgcccgagccctccattgttcgcgaacccccacccgcggttggtgtcgctcgcaagtggaaacagagtgaggatggtcgaaggctgtactgctgctgaaccagttcagggttttctatgatgcgccttcattttgtagcaaaacggtcgaggggtggttggattggacggagaagaccggattccaacgaggcggcgcgtccatccgtcatgccagcggtgaaacaaactggaacatggcggctttcacgaattcttgtatgactagtacacatcgaaatattggtcaattggtccatgttagtccgctcgatcgatttnnnnnnnnnnnnnnnnnnnnnnnnnnnnnnnnnnnnnnnnnnnnnnnnnnnnnnnnnnnnnn

SEQ ID NO: 7278 - DNA, 745 bp, Oryza sativa
  unsure (1)..(745): unsure at all n locations
nnnnnnnnnnnnnnnnnnnnnnnnnnnnnnnnnnnnnnnnnnnnnnnnnnnnnnnatgaaggacgagcgatacttaaggtcatcaagacacaacttagaacctcgactgctagtctccccatccgcgcaaaaatcaggcaaacccatcaaccaagtgccatttttcgaacatcgctcgctgaaaccaccaagtatatcttttatcaactcgggagaaggggtcattctgtggcttgatcttcaactatgttttttctggattggaaattcagattaacaacttcaggaacgttctctgtttgaacaggattgacagggttcatgtccacatcaatagcatcaatgcaaataggttcctcaacctctttggcagcagaagtaagaacgttcaagggagcagagaggtaatcagctgcagctgaaagagaattaacgttcgaaacattcccaatctcaactgaacttatctcactgatagcaggtagctcataagacagaatgttttcatcctcatcatcactatccagagcaattcgaacttttttcaagttcgagtcaacaggagaacttgaaggcatctttttacgcttcaaagcaggactcgagttttcttgcacaaaaggagcagtgtgagtatgttcgctcgactcagaggagccgctgtcatcagacgattcatcacttgaatcagactccccatccaagctattctcctcattatcagaagatgaagatgcagcatctt

SEQ ID NO: 7279 - DNA, 794 bp, Oryza sativa
  unsure (1)..(794): unsure at all n locations
nnnnnnnnnnnnnnnnnnnnnnnnnnnnnnnnnnnnnnnnnnnnnnnnnnnnnnntgttttgccttgattcagccattttcaaaacttgtccgcgaaggtttatgtagcattgtgaagaccacgtgaatgtatgatgtatcagaatggaacccccatactgtgcattataataatggaacataaatgccaatttcaagataacatactctggaaaggatatagtactaaagaaaaaaaaagctctgacttaggctgcgtttgttagttaggccttgtttagatctaaaaacattttagccaaaaacatcacatcaaatgtttggacaatgcatagagtattaaatgtagaaaaaaaaccaattgcatagttccgtgtaaattgcgacacgaatcttttgagcctaattacgccatgatttgacaatgaggtgctacaataaacatttgctaatgacggattaattaggtttaataaattcgtttcgtaatttacaggcataatcttgtttagttattagtctacgtttaatacttcaaatgtgtgtacgtatacttcaaaaattttacacccaagaagtaaacacggccttagggttcccaacccaatccctttcgcgcgcacgcttttccaactgctaaacggtgtgtttttttgtaaaaaaaaaatctatacgaaagttacttaattaatcacgcgctaatggattgctccgttttccgtacgtagggcactagttcctaattgggggaaacgaacacagccactatcctctagcattgagcctacaagtac

SEQ ID NO: 7280 - DNA, 525 bp, Oryza sativa
atttctaacaaatgtgcatcttgttaaatactcttaataaatgtgcaactggttaaataattttaattgccttgattatttgtggaacatgcggaatttgttgagcacgttcacgtggagtccgacaccctgctgcaaagactagaggcgagacctccagtcgtcaggcctgacgacgtggcgagcatccttcacaacttccttgcacgtgctgccgcactactacgtcgtgtctcctgtcggagcgcggcagatgtggtgcagacgtcgggccgacggccatcaccaccactaccccgacgttccagcgtggatcggagtggtccatcctcttcacgtcgcgggtacgaagcggccacacatctcacggtcgtccttcctttcagcacaccccagcaccggagtacaccagggggtcagccggatcaggggtacccacgtcgagcacggcaccaccacgtccgcagttattccaaactcgcttatgttcacccctcgcagggagcattgggtcggcacacttcc

SEQ ID NO: 7281 - DNA, 581 bp, Oryza sativa
  unsure (1)..(581): unsure at all n locations
nnnnnnnnnnnnnnnnnnnnnnnnnnnnnnnnnnnnnnnnattctacatgtcacatattttgtctgtttgagtttattttttatacagttggttcctatgttctcctaagtgtgaaaaaaatatcaaaaaaatgaaataaaaataaaaaattgcatctctacgtactgtttaacttatatatgtcatttcatatggttatattttgaattagattaagtaatttcatatagtggtagagtgcattatgtttaacatgctgatcaaagggttttactaaaggagttatggtctaattttagtgaaggtgcaaagtagactaagtggtatgctagatattttcaaacttagctaagtggtagttcgagtttaaattttttttgtggttggttgtatcgcgatcctgagtgtgaaaaaacatccgaaaaaataaaataaaaatgacaccgttgcaactccatacagagaaacaggaatggaggcggcggcgccagccatgctggcgccctacttcttggggcggagccagcctcctcctgccacgtaggttcgcgtgcgccacggtggcaggaggacggcgcca

SEQ ID NO: 7282 - DNA, 570 bp, Oryza sativa
gattgcctgcatctaaaagagactcagaaagttcattaattacgagaacaaataaataagaagataaaggacatctttgtcatatctttatcgtgttctctcctctactttatcatgcgttatctccgtctaaaatatattcatgtgttctctctgtcttaacatatactcctagatgctttgtggttcgaggcagccgtaatatctcaattccgttatactagtacttcaattccacacgttgagacggagagaacatgggaaattctaggaagcgtcatttgagaccttacagcaggggacagcgagtacagcgagaaaattgatattttaccatggtcaaaaactggatttcgctggaatgccactttcaaaagtggtttcgttaaaaaaccaccctcaaacaggagcaacatattacaatgtcatttcatccatttcttctcaaattaatgattttttaatgtttttttattgctgagtgaccaaaatagcattggatcctatctcatctctccctatatatctcttactcctctccattgccaatggtgggtggcgccggcgcgg

SEQ ID NO: 7283 - DNA, 1086 bp, Oryza sativa
gaaaagggacatccgaacactcccataatagttaaaccaacacattcatgatcgaacaaatggaagtggaatgaaaacgaagtcgaagtctgcatcatggagatacctagggtacagtggataggaacgaccgtctagatcaaaggtcatattcaatatgtatgcacgagattcaactttcgcacatagatttatactcctactttttaattttaaaatatactccatccgtttcacaatataagtcattttagcatttctcacgttcatattgatgtgattaacatctagattcattaatatcaatataaatatgaaaaatgttagaatgacttatattgtgaaacaaagaagtagcaattacgattggatacaacatatcctactactatcaatgtggtactgttctgatttctatcaatgtggtactgttctgatttgtagtaatatatatcatgtttgatgctgaggccgagtttagttccaaaatttctctttaaactttcaacttttccatcacatcaaaacttttctacacacaagctttcaacttttccgtcacatcattccaatttcaaccaaatttccagtttttacgtgaactaaacacactctttgttactctctcaatatcaaaatatagcaaatagtataagaataaacattgtactactaggttactatatttaaatataacggagataagatattttaggacagagggagtaatttcagttcggcgagaggcgacgaccatggctatatacggtccatacggagaatgcagcacgcgatggagatcccctcttgctcgtcacaaatctgaatatacggtccatacggagaatgcagcacgcgatggagatcccctcttgcttgtcacaaatctgaatgcacgagggagagagtgagtgtcaacctcaaccggattgatctaggtgaagtccaataaagctttgaacagttcgtcattataaatcccgatacgcaactactgtttggctaatttggtatttggacaactatcttacggtccagaaaaatggcaagtggcattgtggcgacctcatgttggaggatgaaagg

SEQ ID NO: 7284 - DNA, 668 bp, Oryza sativa
  unsure (1)..(668): unsure at all n locations
tatagggcgaattcgagctcggtaccctaaatgccataactggcggttcatctttaggagtcgaatcaaaaagacagagaaaagcttatgtgagacaaataaatcatgtgggcacaagttatcagtcaattccaccagcttactcaaacacagttatctcgtttggcccggaggatgctgaaggcatacttttcccccatcaagacccgttagtaatatcagtggaaataacacagtgcgaagtgcaaagggtgttggtcgatggaggaagttcggcagatgtacttttctacgatgcatttaagaaaatgcaaattccagaagacagactaactcatgcaggaattcctttacaaggatttggtggtcagcaggtacatgcaatcggaaagatatcattacaagtggtgtttggaggaggagaaaataagagaagagaagaagtcgtgtttgatgtggtagacatgccatatcaatacaacgccattttgggaagatcaacaatcaacatttttgaagcaatcatacaccacaattacatctgtatgaagcttccggggccgaaaggggtcatctccgttcgaggtggtcaattagcagcaagaaaatttgannnnnnnnnnnnnnnnnnnnnnnnnnnnnnnnnnnnnnnnnnnnnnnnnnnnnnn

SEQ ID NO: 7285 - DNA, 654 bp, Oryza sativa
ttccaattaaaaatactactatcttctaagattgaccttagttttggattcagaaccaccaaaatccaggattgaataaaataccacaaataaaatatatccctagcttgaccttacttttttattgtcccttcttctaccatgatgaaagggttgaaagccaaacaaaaaagaagtcctttaagctaaagttaaagaacaaagtggatcgcattgcatggccccccttgacacatcactttcgttcctctatttcttcagacatatcatcacttgtatcaggtttgctgcatacatgcaggagaggatttggtggagaaagtgaaagtggaagaaaaacattcttgcacgagcagagcacactactgcctgatgagtgttctttgcgatccaactttgtagaattgtaggtcaccacagacgctttacgcacatgtgttgttgcacgcgatgtcgcatgctttgatccagacatgaggagacgaaatgcgtccatccaaatttctggcaaaagtgtcgagggaagcatcgaagtttcaccatagtttacttgaagtttcgcaaattaactagctagaccttgcactttacagtgctgaaaaagttgtaaaactcgcagcggcttcacaattcagttaggaaaaatgaaaccgg

SEQ ID NO: 7286 - DNA, 379 bp, Oryza sativa
gaatcggcacctgacatcgcggtcacggtagtctcgctcgcggtagcgttcgcggtcacgttcttcgtcgtcgcggcggcgctcggaccggctccggctcctccgctctctatccttctccctctccctctccctctccttctccttctccttctccttctcgcggtcccggcttctcctctccttgtccttgtccctctccttctccctatccttctcgtcccggtctcggtcgcggtcgcggtcgcgacgctcccggctgctgcggtgccggtcccggtccttgtcgcggtcgcggtgccggtcccggtccttgtccttgtcgcggtcgcggttctcctccgagcgagagcgcttggatctgcgctcgccatcgtcg

SEQ ID NO: 7287 - DNA, 718 bp, Oryza sativa
  unsure (1)..(718): unsure at all n locations
nnnnnnnnnnnnnnnnnnnnnnnnnnnnnnnnnnnnnnnnnnnnnggtaagttgtagcatgtggcaaaagtatggccaagaaatagttagccacaagtgtggcaatgttagctctagttatctgagtatgacatgtgggaccatctaaatatgacatgtgggacctaagggtagaaaagtgtggcatgacacaactgtggcattgaaacaaacacacgcctaaaaactgtggcatgactgaaatgtggcgtggcaaaatgaagcaatcaaccaaacaccccctaaaacaatgtgttgacttcgggatttgggacaagattactctgtgttttatattgtcgctgggccttgatcatgatgagttgatgatactccaggtgtgatgcttcctgcactaacccgtgctagttgtcgcgccggtggtgtcatgcatttagacgaatcgaaaagacattttcaggggcgttagggttgcgagttgtgggtcgtttggactgtggagatcaggccaggaaccaggacgacgatttttaagactttgcaagcagtgcaaggctgcaaattatggcattttcgctttgcgttatacttataagctaaactttaaatttgattttttcgccctagtttatttttagtatttacttttgaatcgcttaagaatatatataaaagttttactcgcagataatttttatttgcttataaattgatttcg

SEQ ID NO: 7288 - DNA, 713 bp, Oryza sativa
  unsure (1)..(713): unsure at all n locations
nnnnnnnnnnnnnnnnnnnnnnnnnnnnnnnnnnnnnnnnnnnnnnnnnnnnnnntggaaatcctaataatcattttgttcttatatatccgaaggttatccattccgatggcctctgctcttaattaatttgtgcagttcttttaatccctgatgctgttgcatcgttgatccgttgccaaatggaggaaacaaaacacacagcaaaactattttttttcatgctctgtttttgtcttcatacgtgtgcctgactaagaatattctcccaaatggcaattaaatatggcgttgattaactcaggcaacatgtcagaaaaacacggacttctgaaagctgaaacttggaaaatgttggactgcaattcaatttctggaagtagtggataacctaatcctgtacgaacaactgctggatatgaatctcttgtcggtgtgctgattttccattagttaattgaataattgagtcggtgttttctttaattatgggttggggcatgccgcattgccgccctgattacgcaaaattgttttatattttttgtcttcggggtttacgaatcggaagaattgggttgtgtttagatctaaagtttgaatccaaacttcagtcctttttcatcacatcaacctgtcacacacacacaacttttcagtgacatcatctctaatttcaaccaaaatataaactttggatccaactaaacaca

SEQ ID NO: 7289 - DNA, 761 bp, Oryza sativa
  unsure (1)..(761): unsure at all n locations
agattagtggataccccgcccggggtatgtctacaataggaatttcgcatagaggtatgggtaggattgacatttcacatcgtcagatcagatcagatcttgagaaaggggccggcggggtgggtgtggaagactgcacacgttgtactacaaccctagcagtcagctctgctttccccaacgcgttctcaaccctactccatcccacttcgttgtcatctctgatgaatcttttctctcctgctgcaggctgcgtgtgcgcggaggaaaggaatctttatggagccaaaatttcgcagagataggaatggaatccttacgaagccaaaatttcgcagagaggaggatatctgtttgaggaaaaaaaggacggggtctcccttcctgcaacagagtacggatgaagtccaacatatgattagtgaagtactactagtagcctatttgctctgctttcatttcttctctggtgtttgattgattgggtgtgttgatgatttctcatcgtttcaagatccagatgtggtgcacctacagatgcagtctagttgcaaaccctagctgctaggctgtgtttagttcacgtcaaaattgaaagtttggttgaaattggaacgatgtgacgggaaagttgtaagtctatgtgtgtaggaaagttttgatgtgatcgaaaaagttgagattttaaagaaaaattttgaaactannnnnnnnnnnnnnnnnnnnnnnnnnnnnnnnnnnnnnnnnnnnnnnnnnnnnnn

SEQ ID NO: 7290 - DNA, 708 bp, Oryza sativa
  unsure (1)..(708): unsure at all n locations
agtattatccacggaccatgggccgtcggatgaagcttctactgtccagatcgtctgaacgggtggcggggtgctggtgttgggctgattaagggcatatttggtaaagctcaaactcttaaatctagctataggagttggagcaagcaaaacccagcttcaccttctttttttttcatttcatgacttggatctaaaataaagttatgaagcaggctaaacacgggcgtggctaattggcgcgcgcggctggcagcccctttttccctttttttttgcgattttttctctttttttcgctttcttatttttttccaaatattttcagtttcctttgggccttttttctaattttttttaatctttagcagacttgttttcaaatgtttgagttgaaagtatttaaattttaagttgaaaattttcaaattgaaatttttcaatctcgagtcgagagttttcaaaactcgagttgaaagttttttaaatcttaaacttaaaaattttcaaatctcgagttgaaagttttcaaatctgagttgtaagtttttaaaatttgtcttataaatttaaatctcgagttgaaattttaaaagtttaagttgaaagtttctaaaatttgacttcaaagtttaaatcttaagtcaagagtttttaaatccaactcgaannnnnnnnnnnnnnnnnnnnnnnnnnnnnnnnnnnnnn

SEQ ID NO: 7291 - DNA, 440 bp, Oryza sativa
  unsure (1)..(440): unsure at all n locations
nnnnnnnnnnnnnnnnnnnnnnnnnnnnnncccccaacggtaaaaccagatatccagtgtccctcaacttataaaatcgtttaatttaagtcattcggggattttaaccccggttttatccgacgtggcggctaagtcagcgtgagccccacatatcagtatgccatgtcatcccctcctctatctaacttcctcctctctctctctctctcacacacatttctcctctgtgctggctgccgacgggtcggaggaggtcgctgggcgaagacgggcggcggcagggggagaccggtggcacacggacggccgagggtcgcctgccgctgtcatcgccgaggccgttggacgccgacgccgacgtggaagcggtccctgagctcactgtcgtggaccccgacggtggtgaggtgagcaaggatgtgcggggtggtgggggc

SEQ ID NO: 7292 - DNA, 479 bp, Oryza sativa
ctcacggccggcagcatggccgcggcggcgccgaacggcctcacctacaaaggcttcattccgaatcagcccgtgtgcgctcggtcgtgcgtgccagggaggtccaacttgccgcagaggggttgcttgaagatctaccgatgccggtagtactatagtactaatgtagcaacgtttcgtgagcgtttatgcagatttttgcattctagtgtgtgttactgaatcgtctgaactctgaagccaaatctatgtataggtgcgtgctcagcgtgtgatgattcagggttcgtcttgtactcgaattgaatagctccatattttacttcgttcggattatattggcctacaggggcggatctacagtatagtcatcggtgtcaggcgacaccgatgactttcggtaaaacctatagcaaaactacttattcatatattatagcatcatattctaagcataattagcatactatgacaccgat

SEQ ID NO: 7293 - DNA, 1196 bp, Oryza sativa
tgaaaccatcctggagcaacaaattgtactgcttgttattccttgacaggtttgtgcagaacaatacacagcaagaggcgattccaaacagcctcaagaacagaacgggcttgcaactgtaaccatggtttgcgcatacacatgcttaaaaaacatttcatatttttagagaatggatcatatttaaatatgtttattaaaatctgtagaaatttcactgggagtaatatctcactgttgtacacaaaataaaccacccccatacagaaaatggagatgctgcataaatgtttggcaaacttgtgttagagcaacatagcagcataaaatccatgtgcttctacgctgttaccatcaaatttacaacacttaagatcactcatatttactttgatttttctttaataaagcaattcttagttgttaaagaccataagcttagcaaatggcaaagaaatgaattttgtttgcagagagccttttttaatacctttttcatgcaagcattactgaagctgtgagggagagtatgcagtacctgattatgcagtccctcctcttttctgaattttgtgggggagattccttgccaagcaagcctatcaaggagcaaaagaaggaaaaaaaattagcaagattaagagttggaaatgaccaacatctccgtaacgatcagcagactaattagatcagcataaaaggcaaaacatttgatatagtcactccatatagaagtcctctagggtgagaagatataatttgcagtgtatcccctgattcggtttgatcattccgtaaaaaagaaaaatacctgtagcctttaaatgcgatgaaacaatgtaattttctggtgtaatagaattaataactgatatacttgaccaaataagttccaattccgttatttcatctacatggttcagaaacgaacttaataaaactctctaaaaaatgtactgataccaccaagctagtagctgaactacttaataaaactctctacaatcgctaacatccagatgacaaccacctactggacaatatttgcaaaaactgaattatgctagtccagatcaaatcatccagtcatatatggaatatggatattatttatttaactaaaagttgctgtcacagggaacataattgagagctgcacgttgaggccaagaacacgataaaaaaaacacaccatt

SEQ ID NO: 7294 - DNA, 235 bp, Oryza sativa
gggggagggcaggtggtgaataggatgaggagagggcaggtgtgaagataaggtggacaactcactgaacttcagtcttttgcatgattccttgcgacggcagattccttcggtcttttacatgtttgatactttgatgcatcgttgagacagttttttttgtacctgaatcatgatgttcatgtcacaaccgtacgtgatgctcaagtaatcttatctgacaatgtagcttagc

SEQ ID NO: 7295 - DNA, 27871 bp, Oryza sativa
tgactaaaaagaatattcttttccacaaattcaataaatcatttctttaatccagaaaattcaataaatcctttttccgttgttccacaaatattttccttcctcccagaaaattcaaacaaccttcgtaaataatttctcttattcccatcggataagtacatatcctcccttgtccacaaaatttccacaaattgttttccccgctccaaagaatcaaataaatcatttccttgtccagacattcatttaaagcctccaaaaattcatatctcccgatccgtgactccgattgacctcgttccacttccagtaattccgtaaaattgtgatctatctaatggcactattattttagtctaaataggatccttttctatttggtccttgtttagatttttgattgtatgcgcctagttgcggttaccggatatttttcgtcaagcggatttctcgaagattcgtgaagaccctgagcaaggcaagccacctttgaacatcttgagcctatatttgaacttaattatattgattgtaaaatattattcattgataggattgcacttaatatgtttgccccgcctgcgaggcagattggtgggcctacctaacttgttgcatttgatccttccattgttaattgctatatcatgctcccttgtaaccacctggttgcgcctcggtattcatacactctgtgcgagtatcgacggtcgcctttaaaacttaaaatctgagaaacatcttgggtaaaacttggtttacgaaaggattggaaaacccgacgcctgggtcggtgccttgtgaaagaaaatgagttttaaaaataaaactcgcgacacaaggccattcctgggcggaatgcttgtgcggtcacatttaaggaccgattcctttggaattacatccgagcatataacaagtgcgaccacatgggtggaatgggacacccctggctgagtaacaagctaggccagggaagccttgatgccaagagacaagtggattcgccggggtggtgtcggggaggacccctgggcttcatggcacagtatggtctgggacctaacctgttgttggtccgggacccctctcgttggcatatggcaaccctgtgttggctttggaaatgccttgtcgtgaaagccccaagtcaccagacgtgtttgatccgcacgggctaggtgaccaaggctagtaacgtcatgtaggtaaagtgtaccccctctgcagaggttaacaaactgttcgaacagccatgcccacggtcatgggcggatgtgaggtgattccttagcgtagtttttgttttacccagctttgtgaaaagatgttgaggtttgggaaacctgatgtttggataaagcaagcggatgtcagggagacagcgggacagggagtccctgagaatgactggttgtttggagacaaccaaaactctgaaagattggaaaattggtttggtttgggaaaccaactttgaggccaactctgggagttgtgtaaatcttgcaaatcaaatttggttacgtctcgcccccaaccaagctgagacttgtctcgctctgtttgtggaaagcacacacttagattgttgaaaacttgaaaacaaatttgattgctaaaataacagcctttccttgaagcttgaattaaccacctaagtccccctggcttgctgagtacataagtactcacccttgctctatatatatatagttctgccagctctgaaggtgaagttgaagtgaagtgaagattaaggtttcgtcctagttccctagtattgcctgtggtgttgggtgttagaccgttggttccactgctgctgctgttgttggtgtttgcctcgtccgtgtcgtcggttgtattctcgggttgtcccgagctgcaacctaagtcaaggtaaataaatcctctatttattttaaggattgcaatgattcatatttgtcaccgtgggtaccagcgctatgtcctgggactggtactgtgatcgcggtttcgtaggaagcggttcgcgccgtttttcctacgacacgctcctgtcaggtgccgttgtacggcggtgccggatcagggtgtgacacgttcccgtccaacccagccccgaccctccccgttgccacccctagttgtaatgatggtttgtgggttggttaagctcagaaaccacacataaccgcaattaggactccagtatcttgctccacgtgttggcagatggcgaggggatgcaaaggcagttcgaccgaacttctggctcacctaccggccactcattcggttgggaggctgcctggtgggcccccaacatgttgtactttggctggactcaattttaggtggttttgattgacacgtggggcctccaaaccgtgtaatcgtgtccgattgtccggaggtgtatttggtcacatggcggatgatttttgtccatatatttacctatatataaatattcaccaagactactacctctaagtttggtattctattttatattctttcaattgttattatgcatgaattgataaatcgaatttggtacttaaggaccatcaacaccatccaagcaacaaatggagacaccgacaatagcatccatccaagcaaaaagaagttgtgataacaactaccttaattcaatctttgaatttttttttttgcttaacccgactactaccacccatccaagaacgaacaatcaagggagacatctccgacgaccaccaaaccagccaatcacccgtcactatcggttggtagcgcgccggagaagaagttctggagcatgatgaggttcacaagaatgggggcaatggtcctgttcttttctccaataaaagttggatgaagattaagattttcgtggcacgcttttcaaattgctaacggtacgtttcatgcgaaaaatttatatatgaaagttgctctaaaatatcatattaatctatttttcaagtttgtaataattaaaactcaatcaatcatacgttaataccaccttgttttatgtaaaaaacgtattcttcatcttcatctttattttcagaagaaaagaacatcaccaatgtaattacagacagtgctccagagtcctcagccatcggcgtattctggatctaagtgaaggatagcgtaatcaacatgacaacgagaagcgaggaaaatggtgacgccgtctcttcttgccacttgcgacggcgatggctgagggtgctctccgaccagatcggtgtctccattgcccgctgacccacatgtgcacggtggagagagatggggagacagaggaatgaggaagaagaaaaggagaaaggatgggaggtagattcaacgaaattctttcaattttcatggtacgatttaccattgtcacgtgggacaaaaccacctaactaaaccgctgggagactcgatttgcactagtatatctatatatctatctatcgattatattattaaaacagttttgaaaggaggcaccacgttcgctgtgggggctagaaattcccacattaatcggagaaaaagaaaaaaaaataaaaggagagtccaagtagaaatacaatctaaaaatagctggaattcggaattaaaaataagtaatattgaaataagttttcatataagaacccagtacgagattaatcaaaattcaaaataaaaataaaataaaatccaaaattagaaaaaaaaagcagagtccaagtagaaatacaatttaaaaatagatgaaattcggaattaaaaataagcaatatagaaagaagtttacatataagaacccaatacgagataaattaaaattaagaataaaaataaaaataaaatccgaaattagcaaaaaaaaaagagttcaagtaggaatacaatttaaaattagctaaaattcgaaattaaaaataagcaatattgaaagaagaatccacataagaactcaatacgagaataattaaaattcagaataaaaaataaaataatatccaaaaatagaaaaaataaaagagagttcaagtaggaatacaaatttgaaacaactgaaattgaaaataaaaaataaaaatattaaaagaacacaatacgatattaattaaaatttgaaaaaaaaaattccaaaattagaaaaagaaaaataagatttcaattaggaatacaattgtatcgctgtgggggcaagaaattcccacattaatcggagaaaaagaaaaaagagtccaagtagaaatacaatttaaaatagctgaaattcgaaattaaaaataagcaatattgaaagaagagtccatataagaacacaatacgagattaataaaattttaaataaaaataaaataaaattagaaactagaaaaaaaaagagcccaagtagaaatacaatttaaaaataactgaaattcagaattaaaaataaggaatattgaaagaagagtccatataagaacccaatacgagattaattaaaattcagaataaaaataaaataaaatcctaaattagaattaaaataaaagaatatttcgtatagaaatacaatttaaaaataactaaagtttgaaatttaaaataagcaatattgaaagaagagtccatacaagaaaccagtacgatattaattaaaattcaaaataaaaaacaaataaaatccagaattagaaaaaaaataaaaagagatttcaagtaggaatagaatattgaaacaatccaaatatctactattataaaaattgaagatgtttccacagtcggtcatctgtgtttgagtcggttataaaaaattgaagatgtttccacggttcgtcatccgtgtttgagtcggttttttttttgtattaatctatatctcttctctactattataaaaatttgttaacgaccatgtttttatcggtattttggtaagtcatccgtgtatgagtcggtttttaagtttgtttgcttttggaaatacatatccgtatttgagtcggtttttaagatcgttcgcttttggtaataccgaaagaatcatgcaagaaatatgtttaaaaaactcgcatgctaacttgagacgatcggactcctaactacagctcatgattttctaaaaaaatatatatatccaagcgaaatcccacagtgtattttatcttaactaaaccattgaaattagaaataaaaaagaaaaaaatattaagagaatagtctatatagaacacaatacgagattaattaaaattcaaaataaaaaataaaataaattcaaaagatagaaaaagaaaaaaataagagctcaacttgaataaaatttataaataacttaaatttgtaagaaaaaaataaagacaattgaattaagaggcaatctagaacacatgatgagattaactaaagttcgaaataacaaataaaataattttcaaaaataggaaaaaaattataagaattgaagtttgaatataatttatgaataaaaattatcggaatgaaaaatatgcaattttttttaaaaaaagtccatctagaaaacaacgatgacaaatagcattaaaaaggggagaagcaataggcatgtaaagcagtagagtgttggtggttgatgggatatcaacaaaaactataaacaaaaccccaaatagaatcacaatgatgattaagaggagtgacgataggtatgccgttaagcagcatggtcacgacggttggcgggacttatggataattaaaaaaaccacaatgataatcatattttatgtttaaaatgtcaatggcaataagaaggggaagcagcgggtttgctgtagaggagtatattggtgaagccactaacgattggcgagacttatagaaagtaaaaggaacacaaataataattatatttgatttttaaaatcccgatgacaataaattgaggtggcaacagatggccgtagagtagtaaattggcgatgtttgacgatacttctaaaaattatgtaaacgaaacccaataagataaggtactctaaaaactataaggcctaacttttaaagttctcaagaggatgaatagaagtagtgatagatcaagtaagcaaataaaaatgtgacaaaggagtaaagggtagcgactggcgttgcttttaaaaactataaaattattagaatagcatgaataataattttaaataaaattatgtgtaaaaatagataattttaaattgatgatagccgtgtagttgtgcgggtcatccaactagttttaataattaagggagttttatatcagattttatggttaagggactcaaataaaactacatagttcatagcctaaagtggactttttaaaaaaaaatgaaaaagaaaagaaagaagttcatttgggccttctcggcctggccaggcgcttaattacagcccgcaacatgtcaggcactcaggccgggcctcgagcccttgatcatatccttttcttccttgtccaccatccccagttccccatcacaaatatcttcccataaagaaaccctaggtgctcattccaccgccatcgcctccggcgaactctccaccgccccctttcctacatcccaccactattttataagccagcccttcatctcatctggagatctggttctactcatccaggaaagccccaatctttatcatagcaaggaggtcatgtcggaatcggccctcggtaatagttacatcaaccaatttttgttatttcagtacttctttcccattcttcttcttcttcttcaactcggagtcttctacggtgtatatctcttccatctccaaaattatttgcgaatcgccctcagatctggagctgttcctcatgtcgaaatgtcaaatctataattctgatctcttctgaaacattcagagcctaattaccgatttgatttcttttcggcgtatctagtacagcaggaggtattgttttgttgaacagaaacatcaatcttattttttgatttgttcgatttccataagttttacacatcactcgttcaactagtatgtgaaaaacttctttttaccgttcatttcacatatactagataaatatctgtgatttgcgatggattaaaataaattaaacgcgtgctaatattgcttggaacaaattaattgcgaggttttggggacagtttcgtgcttgtagattatgtagaaggactattttgtaatattaaaacacgaaggagtagttggtaaaagaaataatctatacaacagagttggtgtggtggcagattcactgccaccaccactgccttctttaagaatgaagtataggtttctatactattacacccaatattattatatccagctgtgggggtggaaattcaatgaattcatcaatttcagtgatgcatgtgccgtttgattcaaaatatatgttgttgcagggtatggttcctaccagtcaaactattttaactttgaccatcagtatataaagtactgcacatattgacagtatattcatcacggaaaatactcataatatttaatcatctttacttgaaatatcatgtttccatagatattgctagcctaagtgccactttgtagatcgtgtccatgtcctaaatatcatttattttgtcttcacagtcttaaggatcattgtttaccaattgtatattatattatattactagcagtacaaagttatgatattcttttgaatgtaactagagattaatcctccttgttacagacaaacatatagtggtgaaaattcccgatcattttctgccagatgctttcataggagaaagtgttggtaaaggtaaagaagatggagcaaccgtagataacatggacccgtcccgcccttttctagttatcaagaagtctgatttggataaggctggtgaggtatggtagcccatctgcactcttcctctaggtttctgtcttccattggtacctggctgctgacattctctcttccagtgggttaaaataaaatatgcttggatggccaagtccttaacaaatgatataatcatcccagaccctacccctcaggttgctctctagtcttcatgtacagaattcagttgctagatcatcctgttacgtttgtccttttttaatcctgcagcattttagtttacgtaagttgtctcttccattttctcaaaaaaaaagggtgccctttgctgaaatgaaatgttttgtcatgaaggtgcacgtcaatgagactttatgttttgctttattacattgaaagctgatttcttttcatctcttctgattgtgaacggaccaatttaggtggtgcgggatgccttctttgatatatctccccgcttggactccgtcttgagaaaggacagtgtccggtgcttcttccgtttgttcgcggaatgtactgcggccatggcatttaagtgtaacatcacctcagaaaccttatcctgcattgtcaggcataatgccttgcgatgtgcgaaaactgtattggagggcaaggcacctcagctcagttgtatgcatgccaatccaaactgcattaacccatatggaatttttccactccatggagctgctgaacggttctctgttgacatgatcaagttgctgttctgccatggtgcttcagccaatttacacacagtcaatgatgctggcattcccggactactcccgctccatgttgcagttggaaatacttgcttgcataaatatctggaggacaatctatctcctgtgcagtatcatgaggattatatctacaagctcattcatctgctgtgtctacctgagatggtttgtttcacttaacgctctttccaaagtatcatcttttcagcatgacaacaaaatgtgttcctgtttgtcatcttttaaaaattttcacatgtgctgaggcattttcttatttcaaatttagaggcaagaagtcagcagttcaaaattccattactccctccttttctagtcattgtagttttgtcctaagtgagctatctgtatctgaccgtctatttctggtcatatagtttaacacattaagatttatgtttttatattcaccatgagaaatactttcataatatataatttgcatgttgttaaaacacacgaatttatagaaattgatggtcaaggatataaatatttgactttggataaagctagtaatttgtaacagaggaaatagctaaatgctccctccgtcctataatatagcaatctaggaccggatgtgcatgtccagattcgttgtactatgaaatgtctcgtccggtcctaggttgttatattatgggacggagggagtagtaggttttattccgcttgatcctagttcatccttgctacaattagtggaaacgagatgtaataggaagtaatttttcactgcttgcttgcatacaaatgctcaaagtcatttagatttcattcctttgccttctttttattgtgcagaaggtttttttggatacagttagactgcttgctgaaaaaacagataatctagctgatgagctctggaattacatgaagaatgacaagcttgtagaatccgcagttttactcctggcagcccgaaaacatatccgtgagggcaaacctgatgggttcgacattatcgcgcaacgtatatatgaggactatgattccctagtgtgtgataaaggtgatactgcagaggggcagaagctgctggaggaaagaagagcacttttgaaatgtaaatgtctgattgtcactataatttcgcaagctggtgaggttttggataactacattcaagcacattcagaggtactattgtttttttaatggtgtaaaatcacagcaccatatgatctcttactcactgtatattttttcatattggtattaatattttaataggtaattccatggctccatgccctgatcctaacaagaatgctagtgatttgttgatttccgtggccactttccgttacttgtactatagggtagcatatccagcataaagtgaacggtcagtccagttttatctatcttcaacattgtgttaaaaccatcacaagagtaagctgtctaatgaagcttatgagttatgacgtaagagcctccgctgctttgagaagctggagccctctattgttagggatgtgaccttagcatgttgcaggagcttctgtaccttgggttattttgagtagtcatggctatccttgaaacatattaaattagattactatcctctggttgatttgagataggtttgaattagggcatgtatacaacagcaactaatagcaggctcttagcattggtaacaaggtaaagtttgctgacatggatgagaggggaaaggagggtgaaacatcgttgttaagcttaacaacggcttaacatcgactcttagcgtttataaaaggaaactttgttgcatgaggatagataaaagaaaagaaaagaaagataacaaaaaaactgttttggtgcattaatgtcagaaccttttgtcgtcttatctattgtaagagatagtatctgaatagagcctgtagcagactctagctggtgattggtactattatttggggcatgccatttgtcaagtaatccctgtgaaatttcctccctcgcccaactctagtaccatatcccctacaatttgtcctgttatagcattactcaccagttcataacaactactagcttcttaggggagccaggttctgaaggctcacccttccaaaagaacaactttagggtattcctgtcagatgctgatatgcattctaatatctgagttgtggagatgatttaggaaacaaatctcaaatagtaataaaattttcatgcatttgtatcaaccttttgtgttagtgatttatagcgtggaaatattattgcatttcaattcaactttgtattggatattatgtgagttgttttttgcttttgcttcaagtaaccaaaactgatttaacattatttacagaaatgtatacgaaatctttgtataaaaatgtcaatttatatcaattttattagagatgcaacaagcctctttaatcgtagttgtaaccacagcgcaggcatatacagagtaactgtgtacactttttgatatattttagtgatgttggccattgcaacttttgcatgtttcatgaatacttgtgtgctattatctccttgtgaattttcttgatgcacagcacataacggcaaaaaacgaaatactttgcgtattaattattggttcatggcggcaagtggcaaccaataggttttgttattgtcttaagctgactacatttccctgaggatattttgatattgttgacacaaacaagttggaaaagttaaaaaaatatattggtattagtggtgattttccctagtgcaggctcatattttgcatattttggtagtatatatgtcgcatgattaggtccacaacaatgaaactgacctgatgaagttcatgttagcgagaaccactatcatgttgtccaccatgaaatatgatttagtgtgttatttgtccagtttataaatttggggtaaaaaacaactagtttcttagttcagggcatatgcttcaagaaagcactatgagcctaggcccaaacacattacattaaaaaatattgaaaaaaattacactaaaacagcaacagaacaccacccaaggtagttcatctgcctaatgcaccatgtataatgcccagttcaaagttcagggtgaaaaatggactagaaggaaatttcaaatgccaaaaaatagacttttacctttttataatttatagtcaattacagttaccaagttgaaatttgaatgactaatgttcatgccttgtaccttttgaaccatctagtcgtattatttggttcctaatcctgaatatagttaaggcaaacgaagagaaatagttacgtaattttgaatatgtttgtatatgtactttattttaccaagtaaacttgtattcgatgtgattgcaaactgttctaccttctttcagttcatctgttataattaatttttctctaaaccattcttttttgtcatttctttgccaccaatgatatcattgtactacatgatcatattatcaatatatgcactttattttaccaagtaagcttgtattcgatgtgattgcaaactgttctaccttctttcagttcatctgttataattaaattttatctaaaccattcttttttgtcatttctttgccaccaatgatatcattgtactacatgaccatattatcaatatatgctatttttatgtttcattttctgacatttttcactatctgatataatggttctaatgtcattcaggtgcccaatgtggaggtccttgcgcgtgtttcatatattcttaaggaattcgggttttgccctaacgaagaatacattgacaccatgatcctgtactgctctttttgtattcaatataatattttttttctatgcaaatgtttgttgtttattaattatttcttaaacttgttattgaagctgtccatataacaagatttcttacagcgacatagttcacaaaggtgtgtgtttattatttaagtaactgtttctgaatttctcagaaagagcctttattaaattttttatggtcatatagatgtaaccaaggctgttgcacaaatgtctacttctctgcctgctgcagaaaaaaaggtaattgtattccgatgttaccaatgatgatttcttatattcaccttgttaattattgtgcaacaatgcgtggggagtatgatgtaccaaagcatgcagggagcagcagcagctaatgatcagttacttaggttccaagttaggtttgctattagttgccatcttactggctggtgcatataagccagagtgcctgccagatcattatcttgtagttgggattctagaaaagtagaaactctatgtctggtctcttctctatcctggtaaaaggttgctcggcagtttttacagcagtgcgtcattctagattatagtactgtcaacaatctgaaaataattgattttctccaatgagatagaatgttttgctttaagtattgtgtttagatttgatctgcctccctttctgtgtgtgtgtggtcttgcgatagatttttggtgtgcaatggtttgttttgatatttgatcatgacctagttaagatgttagaatgaacgaactcagtatgattagtccttttgtagttggatggtaataaatcaagctgatagatgtctgttatgcttctggttgttatgtttctgccgtgcagctgcttactggttcagctgcttttgcttaagcaattcagtttgttgacatcacttgaatataaccagaaaacaatttattctgttgctcaagtaaaacacctctcccaggatatatgaaaatattgtgaatcaagtgctctttggttgatcaagctggaatttaacaatttttttttgggtttcacaaagcttaatcttcatttaattatgggacaggctgcgagaaaaaaggcacttaaaggatgggatccaacattcataaagagaaattttttcccctactggagatcagtattaggggcccagctgtctgtatccaatggagcagcagatgagaagtcaatgcttcatcgtccacagttccgtaattcagtagtgagtaacgagtcttcgagtctgaaccataatattagtttcttgggaagaattcagcaactgagtggtactcatgaatcgagaaggtacagtactgctgcattcagaatgctcacgaaggtgctaaagacatgagcaaaaaggtatgtcgtgagttttgtttcagtctacagttactgaacatgtggaaatcattgctgtgacgcctatattattaattgagcaatatatcgtaatgtcaagttgttagggtacctcaatagaatttcacttgtttaaatttacagtaatattttcttgtttttcttcgtgcaggtgcctagtggcatgttgctgttgataaccataggtctgcaaagtattatgctgcgcacgtcttttgcggacaccttaagaaggttgcgaatatacatgtgaccaccaaaaccttgttcaaagtgatgctaagtactttaaattatgatgaaatgcaacatgccgtgtgttgtattcggcttgaaccctcgacccgcgagatgtggacatgcgtgccagcatgttgtacttgtaccaggttcaacgttagcttgaacactgaacaagttaaatgtgttgcaaaatgccatttttctttatcagcaatctcttctacctatatcagggtcatgattctagaatgttattgggccacgtggcagcctgaaaaattagctaaacatcaccaaaatttttgccacgtgtcaatcagatataagctcttgtgatgtcccttgcacatcagaatctctagaaaacccattactttacctatctctttgcactaatgcagttgataagtatcgaccaataaaataataaagagagttaataagtgcttcacttttgccaaccgatagccggaatcagcttttttgtgatgttttgatggatgcaaaagatatagttatatttaacatgtaaaatctataactaatataaatattcgtgtttttccggtcgtcacatctaattttcgtccatacacaatccgattcggttagcaatagccatggaataaaattgcaaaaaaaaaaaaggcggcctgcgccgacgcctgtctacacgtcgtccaggccgccgccttttccgctccgccggacatcccctccccccgatctagcggaggggagggcgttgccggacctccctccgccacacaaagagaaaggggaagaagtggagagagtggccgccgccgcccctcgcggggaggagggcgccgccgccgccgttcgccttgggggaaggcgggggtgccgacacacaccgccgcaccccaccattttcgcgccgtgccggcgagaagggagggacggcgccggtggcgggggagtcggccggctggggggagggggagagacgccggtggggaaagggagggggaaaggcggcgtcggggcgggggaggaagaggcggccggctcggctcggctggggggagggttagggttagggtttcatcaattttaatctgatctgagccgtccatcaaaactaacggctgagatcgattgagggtttgggccgcacgtgggcccgcggtccactaaatgaaaggagtatgggggtattaagtagactttggtctcttgcgggctgaagaagaaaatgggttgaaaaaggcccatagagaaaaaaggatttttatttagatttttatttcaataaatgctgaaatgatatttgtattatcaaaattagcaattaagctaggtaaattccaataaaatttcaatgagtgtaattaatatagaaaatttaataaaagttaaatccaaccacaacattttatttcttacacttactttacttataaattaatttaattgtatacctacctacttaaaaaatacctaaatatttcagaaaatttatatttcatttaattagaatttaatatgttttaattcaactttatctgttttttctattcgttgcaacgcaatatcacttttgctataatttaaaagagtgtaattaatattgcagaaaattttatatttcattaaattacaattcattttcttcatataaatagttcaaatcaaatttcagtcaccatatcattacccggtgcaacgcacgggtattttgctagtattatacaatatttatagaacttttgcaaaataaagagcgattaaaatttaataggctgtgtcaagtaaaaaaaacaatcaaatactaaaagatatgttacgtactcccttataagaacatctgttagccaatcaaatcaaggtatatatacatatttaattaaaatttaaaaattgataaggacgcaaaggatatttcttgccactacaaatttgcatgagaattgctagaaataaagttttcagggttggagtagaattttttttttgttagttctactttcgtgagaaatgccccgtcattgtaaggtctaaaacattatttgaaattgggtataggtattaataaactaggtgagtttttagataatggataaaatccagtgtttacttcaatagaagctatagccattattacatagttcttagttgaaaaccaaatataaactaggtgagtaagtggaaaaattaaataagaaatattaaccaaatataaactaggtgggtaagtggaaaaattaaataagaaatattatgattggttgagacaagggactggatactcaattgctatattctgatataaactttgaatgcttatattttgaacgaggaaaagatgttcttttatcataaattcgatttggtcttttttatatatataaaaaacgagtacggtcgttatttaaaaatgtccattttgtaaagcttatttttaaagaccatggcttatttagctgaatataaagctcgataattaatatttttaaaataagtacattttaaataatgtagacttacataaaaaaacagtccattttataaagcttatttttaaagaccatggcttatttagctgaagataaagcttgataattaatatttttaaaataagtacattttaaataatgtagacttactaaaaaaacactttttaatagctatgccataaatagattaaaatatgatgatctttaattgaataaatctacatgttaaatgaacaatttaatgaagttggcctaatcctaccaaatcttttgaaatttctacgttcatgcataagaacatgctaaatggggcgcgccatttggcgcgagattttctagtatagtactaatatttatctgttcgacgcctccaaataattcgttctcgtgtagtcgtcagctacgtaccgaaagctttgcgctttgcatgcagcaccatcaccatctagttctactaataaccagtaagtccatacttctcgatacaactatggattaaaatataaacatgtaaatttaaatgcaaactacaaaataaatataaacacggatgtttaaattcaaactataaggtataagaaagaatacattcttaatttgtagattgagagattgagttttaaattgaacgttatggaaggatggaatataggtttacttaaaagccgtgcgatcggtggaagactaccagcacatcagcaatttttgcaaaaaaaaccctacacttttggttaattacgcaccggtccccgctaatatccgccgtccgatctcgaggtagggtcgatctggccgtccacgttcctcactgtgctggcccttccgcacccgtgggatcgtcggatctctaacggacggtgtggatttcgcaagcctgaacaaaccctagccgcctcgccctcctcctccaatcgcgccgcagcctcgccctcctccttcactcccgtgcgtcgtcactgccgcaactccctcctcttccactccctcaaggcctcaacctactccagctatctcgccgtaccgccgtcgccgcttcctctcgcacgcgcgccgccatgccctcttctcttcattcctcgcgcgcgccgtcgctgtcgtagcttcgtcgtccttcgcctccctcgtgccctcatccagccattgttactgtgcccgcgctcccgcgccggcaagcgagtccgtcatgtccaccagtgaggaggcggggcttccagatccggcaacagcggcctcctcgctggtggattgtcggttgcccggacgagagggatgcgagccactgcactcctcttctcctctttcatctcatctccacgttagcctctctctccctcaccctatcctctatgcctgatgcgatcccaagtccgattccctcgactttccaggtggatccggtcgtggccctcttcggcagtacaacgctactctccactgtcttcctcacccgttctccatgccgctcacctcccctcggtgccaggatggggagagcaagagcagcagcttgggcaccaaagccacgacggcggaaggcatgggctatggcaaagtacggcgacgacggcagcaaggcacaaactatggcaaggtatggtgacgacggctgcaagtaaattgggacattgtgcttcggtttttctcctagatgttcttcattctttcaacatgactactgctaaaacattgattctccctattatatgcatatatacatatctgttctagcgcctgctctctattcttgatttgctgctcattgtgagtttcacatgattggtaggaaggaaagaaaaaagggagtgaaggctagattattcagtactaatgtttaaacatcaccacccaggtacagatcaaattaatcatctccttctgtcatgcatatgttgtatatgaattgagtgtattgatattatgattcggtttgtctcctagatgcccttcttcattctttgagcatgagttttaacagatcatttgtctatacaaattagttttacctgtttgcacattagtgttgcagtattaatacgaactgttgccatggtctagctctctatgtactttttggttgggaacacaagagtgacatatatgcctgtcattaatctataataataactgcaatgctgtattttatctttagaattacccattgtctaaggatacaaaatatccatatgtaatttgaattggttagttcttacattttgcatatcaggtttattagtaccatgaattccgtttccataggctttctcaatatttgatacaaccaaaatttgctatattgactacaatgtgctttgaaccaaacaaatatgttgtaggtctgttatctactgtgcaatttggttattggaagtaatttatattaccaacttctaagccttttacatttcaccgttttagtttgttggcacctactgaacaatatttttcccatccaaagtattcatgaggttattttctgtttggaggtctagacagtcttctctggggtgtacattattatagttccatgatacatgccggttatttttgttgttatagtgagtgtaaaggtgaagccaattttattttccaaatggaacatgcaagccatgttaaactaagttcttcagctttcatccttggtaataagttcccttttgtgcttcttatcaggtgtgcaaatgggaaatgagcagcgctgtcagaaagaaatagaagacactaaacatggacttgaatctggaagtattacatatgacccggcaaagcttaaattttctgatgacatcaaagattctcggtgaacctgacaatcttgacatattattgcatccagtgttccaatttggcaagtccaaaagtaccatttgtttatatctccatttttactagctcactttcctgatatatgtatgatagatcattaggtgggcagttcttcctgccttcttcacattgtagttctcagtgtattttctctatattcttgatctatacatggacttggaataaggtgttcaccctgaataaggagggaggtcagtacatttttcctaccttaaaaatctgaagtatggttgaatattgtattagatgatattcagataatattgttagtttataacaggccagttggtttatacctaagccacttggtcaatgcaaagctatatattctataattcctttatttcttaccaaggaatgagaatgtgccagtatgttccttcccatgcatttgcctctgtttgattttttattgatttgttgctcctctatttttgcccctatatttatttggatactggagttcattcaaagagacgaacctcatggtcttcaggcttcagtttagacagataattgtagtgtctttaaagtaacgatgttatattgcggtacaagtcttttagccatcatatctggagtaggatccattatcccgggaattatattgaaacaactgcgatggttaaaaaattatatttaggaaaatcagttgaagattttgatattggccagaatttaatagaccacgaatacacatttttgcgatctcttcattatctcagttcaagctctgtgtataacaagataattggcaatatgttgagacatgccctgaatatagatggcagtatcaataccagatataaatggctaaaattgtttatatgaatgcgcaagtgtgcacacgacctaacgtggcattagttaccgggttacttggcagatttcaaagtaatccaggcctagagcattggaatttgtaaagaaagtcttgcgctatttgcaaggaacaaaaggcctcatgctgtctcacagaaaatcagaatcgctccagatagtggggtattcagattctgactttgcaaaagataatacaaagtcaacatcgggatatgtgttcaccctggtagtaggagccatttcatggaaaagctcaaaacagactatcactgcagggtctactatgtatgccgagtttatagcatgctatgaagcaacggggcaggtgaactggctaaagaagttcatacccggtttaaaggtggttgacagtattgtgaaaccaataaagttatactgcaataacgaacccgcagtaatgtactctcacaacaatcagtcaagtggtactgccaaacacattgacataaagtactatgttgtgagagacaaagtccgggatcaaacaatcagtctcgagcatattataacagaaaggatgctcgcggatccgctcacgaaaggcctacctcccaacatgttcaaggaacatgtagcatgcatgtgtttaagggaagccttatgaatcctggactatagggcccaaaagttaaagtatctgtttctgaatagagatgtgtatagtggctgtcgaatccagcggtaattaaccgtgacgatgaaacatgctctatatgtaaacctgtgatggaatagaaaaagctaaaagaaatagtgagatcaagggggagaatgttagatggatctccctctccttgagcccaacggctcaagggggccttgacccgcgccctgatcgggggcgcccagcccaatggctggtgggcctccgtcaccctgcgccatataaagaggggtggaggacgggacgacacaagacacgaggttcgtcgccaccgccactccaccccacaaaccctaaccgatcaagggggcacagccagtgacgggaagactccatcgtcgcgccatgacctcgccggaatcgcctacgaccgccactgccgcgcagcatcgtcgccgccgcccacgtcaagcgcacaacgacaacgacgatggccggcctcacttcctcctcctcaacatcgaccggtcacatccctaaaccctctcacttcctctttgttagttcatctattgttgttcatccatccaaagtgttctaccgactagatctaaacctaggtaatccaatagacaaacctaacagttagtactcaagtgaggcatacatagctttgcagagttctttctgcaactagtcaagtgcgcctcccctgcccttcttcccgctcgccggcgtccgccgctcaatgccgctctcggagtcctccaccctcgcgacgtcggagctcatgccgccgaaccagaacgtgctccacttgaagaacccgccaccgccaccgtgccacctcctctccatgcttagcctgtccacctgagcctgcagcgcgctgcactggacctgcacgtcgcgacgaagacaatgacgaacacctcaaagctttgaattgatgaacggtggcggcggagatggccgtgatgaaaccgtacctggaggcgggcgaagtcctcgcggaggcggcggagctcgtggtgctgggcgagcacctcgcgcttggagggcagcgggcgccggggaggtcgaataccaggctgggcgcgccgaaggaggcaccgccgctgagctcggcgaggcggttgagcttgccgtgctcggaaaagagcatctgcagcacggagcgcacggggaggcggtcattctgaacggcgtgcgccaccgcctccgcctccgcctccgcctaccctcacaagagaagagaagaaaataaaagagaaaagagaagaaaagggaagaaagaagagataacgtggcatgctgacatgtgggtccacgtgggtcccacgctgactcagccgccatgtaggataaaactgggatcaaaaccaatacacggctatatgatattcttattattctatttctatatttactcatattctagtttcataaagctatactttagagaaggaaagagagattctaggaccacttgcccataagaataagaccgaacttaactacctgtaactgtcccaactgcccatgtgtactaaccccccgaaatcactttccctactgctacgttgaaatgaaaatgcccgcctccaatccacttaaagctcaatccaaaacatgaaagcggaatcacaactctcacgaaagaagggtctcaagcagtgttcatggtcactccaaacataggattttcggcatatactctttgcgaggcttctatctagatggttaggtcacaggagctttgtgggagaaatggatttctagtaaaagctactgcaagagatttccaattgggtagattaagcctaacctgttaaaatccgcgagccccttcttatattcggaactggtacagtaaaagctcttgtgggctcactccaggtgtagccgcaatagcaccagtttttatatctcttggctttacctttttttaaagaaatgtatgtgcgtagttcaagttttcgaccgattcaccaaggaatattttggttgcttttggcggattgcttactactaggttggatcagatgtcaacctgtggaggcaccatttgttactattggacaagttccttctttctttttcttcttgttctttgccataacgcccattccgggacgagttggaagaggaattccaaaatattacacggatgagactcatcgcaccggatcagtctcttagacggatgagactgatcacacctgatcagtgatcaattctggcacaatgaatttacgagttattttacacaatgaatttacaagcagatgagtttgcaacggtagacctatctcctgaaaagagatcagtaaacaagggaacgaagcgaccgataacgtcccctcggggaggagtgttttaagggattgacttcggctcctattatctttgtttacaaatcttaaaattggtgaattggttaataggaagtgcgcgctagcacgcttcatatttctagtaacaagggcagttgtttgtttggacgttagatcagagggcgctcatcccttgctcggtccctgaaaatgagataacataggcttttgatatctgctgtgtcaacaagccctggttcaatccctgcttcttccgggccttatcccgaaagaggtcaacaattctttttgtgtaaagccttttgttcactggtcttcacttcaagcaattccattagtccaagtctgctgcaattggtaataggagactagaggttgggacgcgccgcctgcacatagatggattaattagattattttgctgtttttaggctgaactactggtcttgtaagattaaagctgaataaagttgaaggcacatataatatatatgaatcaaacggcttatatgttagccattggtgagtaatttcgtacgagtggtgttacagaatctggagagaacaaaactattacatagccgttatactctaagaatgaagcactgatgcatatggaaaatgaaatcacatatttgcacgatgatatgagatcatgacgagatcttcactctaccctttgcaaggtcgatgtaacaacttggtcagaagagtcaggcccctgctttccttggctttcctttgatgagcacaaaaacatagttaaattgtctaagagacccagttttggaaatagatgacaaacagtttgatgcaagatggtttttcacactgaacaaatatagatgtaccaaatataaactctcggagtgttagagatgtgtttgactcactaatctcatgttacctttggctaatggtctttgctctacttttgtcctgtcttcgccactgcctacctgtaccgaacagagtgtgaccttcgactatctcctgcctattttttcttgtcgaagtcatcgttgtccatccatccatgaattggttgaacatggcaaagttaattcagactaagaattcaatcctattggccagtatgagccaaacacattttggcgttgttctcaccttcctatataagccgggagtagtagcgcttctgctcgtggccgttaggctctgcaagaagcaacaacaggtcagatgtcacaggttgagtcgagcttgagaatggcgtcttcagctgcttccatgctcgacatggcgttgctacttgcagtttttgcctccatcctagcaggtacagaactctctcactgattttgttcccctgcttttcttctagcatactctgcttctgtttagttcttgtgttttttgtattagcttgcaatgcgaaaagtttattgtcctatgtgaagagttgtgccgtgaaaaagttgaaattggtgtgcaagccattgccgaacgtacgagtgagtttgttgatttcaagtagtggagttactatcttgcacattagtactacatgacaagcgttacgcgagatactcatttagtgaaacggtaacacggtaagaaaacaaaacatgtaagcaatcgagcgtagattcaaggacgcatctctttcttcagcatgaacgctatgcatggaaatatacaatgcaaacgtttggtttgatgaaacacgggaaaattctcaccgttcctgtgaaattcgtgcacgattacgcatactactgtattaagaaactagtatggtaccacaaagctagattctgttagaaaattaattggttttaggggcgtcattaagatgcatgatgtgtgatagtttaccagcactactgcacgctagattacgattccttcaggagaggtgaaagtacgcacgtaccagcttgtcagtaactcatttgcccaaaatctatggactaggctgtgttcgttccacgcacgtaaaatggagcagtctagtacatgattaattaaatattagcatttttttgaaaaatcgattaatatgatttttttaaagcaactttcatatagaaaatttttataaaaaacataccgtttagcaatttaaaaaacgtgcgcgtgaaaaatgagggagatgagttaggaaaattggagaaagaactcagcccgatccctttgatggatgatagcacaaactgagttcgtaacagttatttgagagtaattaaatattagaaaatttaaaagttgatttaaaaattgtttctaacgagggcggccacccgtttttttttccgttcgtcattcgcatctgcgtcgtcgtcatgagatgatcgatctcgatcttcttggacggcatgtcttcgtcattacgtcgtcttcgtcaagtcgcgccgccgagtagatcgatctcctcggcggggctcgtttttcgtcgagtcaacagcagctacgtcgatctggtgatcttggaagccacggcgtccgtctctgctccagccccgtcgcccgagttccgccggcgcggccccgacggccggatcccgagccgctcggtccatgccgaccgccggatcccgagccgtcgccagcctccaccacctccagatccactcagccggttcgccggctcatcctccgtctcttcaccgcgccgaggtccacagccggcgtcgccgggctccctctgccgtgccgtcttcaccgtcgacacacggacgccatcggcgcgccagggccctgcagccggccggactcatcccggccgcatccctgcaccgccacgccctccgactccgccgcctttcgtctccaccacctgcgccctctcctgacgtcggctgtcagcaccgccgggcctgacacgtgacaccctgtcctgttttttttctcttctgtgaacttgcttgactgcaagggaggagagagagaagtgtagacatggagtttcatggatggctggctctggctgtggaggtctggagaggacagatgtgcatgcgtcattggtgctggtaccgttgaggcagagagattgctggacttggtctatggaccgacaccattgaggaagagatgtggtgttaccgtgttgctgctgctgtacatgtgtgtgtctgtttttttttcctgatcatagatcgggtttgcgtcgcccaccgcctcgtcgacttctacacatctccgacatcggcatcgactctgctttgacttcatcgttcagccccacgcatcttcggcttgatcacccgttcaggctcccggctacaacgacttctgcaaccgatcgtcatcgagcatgcgtctacgccattaagcttcgggttgccgctgcgtcgcccccttgggccgcagtgccaccgcccgtggtccacctccacttgttgttggaacgctgagaggcgccctcctcagcatggcctccctactagtggagttctcgccgctgcatcgacatcaagctgcacctgtgtcgcccctatgggtcacgatgttgcccctcgtcgtcttcatcgccgttcgcgcttcgacaccctcgtcatccgcactggtcatcgtcagccgctcagggtcttcttcgtctacttcgagcatcgtcgccgcatctccaagctgccaccgtcgccgctctaggccggtggtccagctacctctacatggttactgacgtcgccatccaggccgttggtcccactacttcgccttcgtcttcgtccagcatgattcatcgccagtgtcaccgtatcttcctcgactacacttcgctcttctccggcaactacgtgctactccggcaattctccctctacgtcgttctcgcgccgcgaccgtcccggaggccttctctgctagtctcctccgacattggcgtatgattcatggtggtcccctactaactttcattgttgtagacatcaataagtggcatctacatcagcaaaataggaagatcacttccatttcgaacaataaaataagagataatccaacaaatatcattgacaagcggctaaatctaagaaataccattaacaagttcgccagcgtcgcctccccatgattatatatatgttccaagaatatcgaattctcgcttcgaatcccctctttggcttccccatgttttgccgagttcaaatattcgatttgaattcaaatcccgcaccaattgcccccaaatcccttaaagcgatttcctggtaaaagtctactttacctccctcatattcgcttgggccgaatccggccatggcctggcctgcatctcctctcccacgtgcgtcgcgcgtgaccactctctctctctctctcgccgcttcctgccgacgccacccaaaatccggccgcgtcgttcgattttcacgcgcgcgcgcgatgaccgaccgtccgcccggtcgccgctgccgtcagcactgggctgcctgctgttgttgacggtcgttatcgatcagtttcgaccgtcaatattaccaaaatagaggagaactagtgatgcttgcaatttatatatactacctccattattttaatagatgatgccgttgactttttctcacatgtttgactattcgtcttattcaaaaaatttatgcaaatatataagatataaatcacacttaaagtactatgagtgataaaacacctcataacaaaataaattataattacgtaaattttttgaataagatgaatggtc

SEQ ID NO: 7296 - DNA, 2447 bp, Oryza sativa
aaaaaagaagagagtatgttagattaaatatattccactagtattaggttcactaaccttgtgcgaagaataatcataaagtggaggagaatcgacatcaacacagccgataaatcatccggatgatgtcgagaaccagacttatatatgaatggaccaagactcggaattgacacgacaaactgggccaaaattcacaagtctgtggagaagaacaacggaggaggccgccagccgaaattgggctagattgggcaggccccaggttcggctgaaccctcctcagtgccatccgatccagggcttcgcctggaaggtgtggattagcccccaatgacggttagagggtatttccgaccattccaacattcacaacgtcattggaaggctataaaaggagttgccattcccacttcactcacacacctcaagtaaagttctctcatattctctcaagtttagtttagtagtatcaagctagtggaataggaatagagtagaaattaggagtccggaagtcttcgaaagagttcgggtatggctttagtagctttcctatcttcttttgtaagctttgtagtattattaaatattcttctttatacatttatggtattggaatactttccgagagtatgaatgccaattttacattatgttcatgttatactgaatatgctgctagcttatctgggagatgctttggtgcgggtataatgtttacttatgcatttactctatgtcatgatgatgatattagagtagtatctggaagtttagacgtggtgtctagattacgtgatatcattatttggggttatatgctgcggatgagaggtgggccgctgatggtgacagctcagtacgggtattcctccgcgcgtgtatatgatcctaagttaattccctggggaggatattcctccgtatttagccccgattgtatggtcatgacgggctgtcataaggaactcgacagttaggggtggcttctcgaagtaccaggagggcatcggatagagagtattagctagtatatcagataactagaatgtatgtatactagaagtataggaatatattttctttctcatttctttccacttagcttagataatatattatgagaatgagtagctattgcttgtgtgtcactctacccttggattatcttaacccctgctcaggatatgattatcacaagtaatatataaattattagtcaagttctctctacatgatattctcatgggataaaataaatacgatacccttgggtgaaatactacaatggtatatgcgtgagcttacggataaactctgtaaccataatataccatgaatatttctgcgtcattgttagaaattatatttctagtaatatcgttaaaaaataccaacacctgcatcgcgtgctgccaccttgtcgccgctccacgccgcaccatccacgctatcaccgccggcgtcatccttccgcccctactcctgtgcgcatgcgtccaaaggatggaggcagagccctcagccacgtccccactttcaccacgccgtgcagctgctcctgccctagtgattcgacttccaccgctcgatccaccgcctccaccaccgagcgcatccccgtcgttcgtcgttttcatgtcgcccgtggttggcagccaagcgccagctcgcatgctccccctctaaaccgactatgccgctcgcaagctcccgccctccccgcctataaattccactccgggaccccctttttccctccccttgctccgtgcctcaaacggtgaagccatgccgcttcctccctcaactccggtcgccgtcgcacggccaaccccggagcaccgccgcctccttagtcgcggcggccaagaacgccaccgccgtgaccaaggacgccaccgcatgccccggtcgttcacctttcttatcctctctttgtcgtgcctactcgatgccatgccgccggtgagcacctcgctcctcccttccattttcgccatggccgcgctcctctcatcccttacccaatgccgcactcgctgccgccgttgaatccttccccggccgcgccatctcagcgccacgcctcctcggcgtgcgttcgcgcccatgcctccgttcgtcggtgagttcctcgcacctcttctgttttgccaccgcgggcgccaagaaccgccgtcggcttcttcttcctccccccggtcgccgcgtcaccctttccctcctgctctgctcccgccgccgcgcgtagtcgcgcgtcaccgccggttggtcgtccctgcctctttctcctccagcttgctccccttctttcctcctcttctcaccgcgggcgctcgccacgcctgcgccgcgctcgggcatgcgccgccatcggtctcctcataccgaacccctcgtatcgtcgcgcccccttgagccctagagaatctccccgggac

SEQ ID NO: 7297 - DNA, 964 bp, Oryza sativa
aataaatctgattgttgaatgtcctgaacaatcctactttctcttcgtatgcattcaactgatcgacgaatcactgaatctttttgtctgcacattcagatagaggagacgaagaacgcggattggagtgggccgatggggatcatcacgtccgtaggcctatcaaccatgttcgggtggatctacctgattgccctgacatcgatcatgaccgacataccttacctcctgaaccccagcaacgacgccggcgggtacgccatcgcgcaggccctgtacaccagcttccaccggaggtacggcaccggcgccggagcgctcgcctgcctgggtgtcatcgccgtcgccatcttcctctgcggatccgcgtgcatcaccagcaactcgaggatggggtacgcgttctcgagggacggcgcgatgccgctgtcgcgcgtgtggcaccgcgtggacagccgcgaggtgcccctcaacgtcgtctggctctccgtcgcggtggccttcgtcatggctctcacggtgaattctaagtccattgctgctgctgctgctgtaaatttctcgagctgctctgatttggttgttttctcatggcagtcgctggggagccaggtggcgttccaggcgatggtgtcggtcaccacgctggggctgtacatcgggtacgcgctgccggtgtttttccgcgtaacgacggctcggaagtcgtttgttccggggcagtttcacctcgggcgatatgggctcatggtcggctggatgcccgtggtctgggtggccaccgtcacggtgctcttctcgctgccggtggcgtacccggtggccaaggagacgttcaactacacgccggtggccgtcggtggcgtgctgctgctcagcctcgtcgcgtgggtgttccatgcccgcttctggttccaagggcctgtcaccaacgttgacgcgtaaaacgtaccctgaatttttg

SEQ ID NO: 7298 - DNA, 688 bp, Oryza sativa
ggtcactccactgggggagctgttgttttgaaggtatgccttgtaacaataagtagtttttctctgctctatttaggcgaggtttagaaactgaccctactcctttgggcctgtgaataatggataattggatatcctgacgggcagagcaatggtgcaaagcattaacaaaatagcctggttgaaaacttgaaatggtttggctgcagatatgttcattttacatgcttcatattcttctttcccttgtgcttgtcagtagctggtattttccaggcatcattgttccctcatatcagagcaaaactggaaggcatcatcctaacttcaccagcgctgcagcgggcgacctcggcggctggccgtttgccgccacagcctggttgcctccgttcgccgccgcagcctggtcgactccgttcgccgccggctcctggtcgccatgctcctcaacggcgcgaggatcatcgacggctgctacatggcgagacgcggccccgccgccatcggcatccccccgtcgagcggcgcgcgatggaggaagccgtcgccggcgactctgctcagcggaaagaggagaagaagaaggccgccacagcggcggcaacgaggatgcgggcggagggcgcgacgccggccgccggacctcctcctctcaccaccactcccggctgcgcgcggtggagaa

SEQ ID NO: 7299 - DNA, 1575 bp, Oryza sativa
ttcttcgtctcctctatctgaatgtgcagacaaaaagattcagtgattcgtcgatcagttgaatgcatacgaagagaaagtaggattgttcaggacattcaacaatcagatttattaccatgtgtgcagatgtatcgtagccgattacagagtactggctcatcagcaaccccacagctagaatgtaggccttctggtggatgcccatgccgttttctgtgttgaaatgggtaaagatgaactctgggctcgccctttccttggcaaccgatgggatcaagatcgtcagcgcaaacacacctggatcgtgtgttgatacagacaaacagaacaaagatcaaatcacgatcagatgatctgatgatgtaaatgttcagactgaatatctgaagaaacggtcgggacgttgagtcgactgtacctgcaacattccagaaagctccaagttgaccaaaccaggagagccagtgtatgggaaggctgttgatgagaccgtgcaggatgaggatgacagagtagatggccaacacgacgtacttggacgccatgtagccgccgccgttggcgcctcctgtggcaagcaagatgatcacctggagaagctgcgccagcgagaaatccacgctcgtcgtgcaagcccactgggatgagtggaggagcagttaacgagcgattggagcgtcagagatttctgcgctttctggaaacaattcgagagtgcaaaatgtactttttttatttatttttaagaaatcgtgaagtttgaacaacaattagtccaaaggtatattgagaaaaaaaaaggaataaaattatattcatatttgaaagcactttcaaaaatcatggctcattaattacttcctccatttcatattattaatcgttttgtctattttctaagttaaacttttaaatttataagaattttagcaacgtctacaaatcaaattaatctcactaaatgtaccatttaatatattttataatagatttgttttgtactgaaaatactactatatttttttataaacttctacataactcatggagtttgaatgcacgtacctgtccgacaatattgaacctgtaaaacagaagacaaaaggattaagcggattccatatttaaaacatgttaacgattaaattaaagcatgagagataaattaagctaggacgcgaagaacacaccagccagtgacccaagaagccaagggagcccattccttgccggccagcttggcgctccagtagtagaggccaccggaggtcgggtaggcggagcagatctcggccatggacagggcgacgcagccgttgaaggcggacaccaccagccaacccagcgtcatggacactggcccgccgtagcgcagccccgtgccgtacgtcgtcgtgacgcccgtcagcacggagatgatggagaaggagaaggcgaagttggaaacaaggctaacaaaggattgcaatatatgccaaattaacactcacaagcttaatttggtgaaaaatgatcgcaatgaagtgtggtaaaagaagggaagaagaagcacatacgagaggccacgcttga

SEQ ID NO: 7300 - DNA, 588 bp, Oryza sativa
cttgctacaagatgaaatagaaatatccttattcttgatctgtataaattcaagaactatagaaaaaggatttctgtccacattctggtcagtaaatacttatggctaatggctagtcctaatcacaggtttgtcatcagaaatgaacatgcctactatattccctaggtggaaatatggatctttttccccatttcagaagataggtttgaaatacaaagtatactatatggacaaaacattactggagaaacaattgttacagcgaagaattcaattaccttggccccaagagccgccatgatactatcagcagcccatggcatgttgttgatccaaaccaacacaaatggaccatcaagggatcataactctgaaccttaaaactcaacagaaagaccttgataagaacacaaatactttccatttagtttttgacattttacagtgcaattcttgagttggttaatggcatattcatatgccttgctgcctggggcagcaattaaaaaaagacttccataatattttctcagtttggactgaagacatcattttcctacaaatatgccgatattcttgaacttc

SEQ ID NO: 7301 - DNA, 11928 bp, Oryza sativa
ggcacatattatatatatgaatcaaacggcttatatgttagccattggtgagtaatttcgtacgagtggtgttacagaatctggagagaacaaaactattacatagccgttatactctaagaatgaagcactgatgcatatggaaaatgaaatcacatatttgcacgatgatatgagatcatgacgagatcttcactctaccctttgcaaggtcgatgtaacaacttggtcagaagagtcaggcccctgctttccttggctttcctttgatgagcacaaaaacatagttaaattgtctaagagacccagttttggaaatagatgacaaacagtttgatgcaagatggtttttcacactgaacaaatatagatgtacctcaactgtaaaaatatgactctagtcccacctttccaatattagagaccagctagcaactgttctaaaggacacactcatcactgaaactgaagctaagttatttgagatggactgaggagatcaatgtgtaacttgatttcttcagacatgaccttaaaaacctgcaggttaacgagaaagacgtgataagctacttagagtacacatgtgaactaaagcaaaataagctgatagaaatgacacactcgaagcttatctaaaggacttgacgagcttacaaaaagaaacacagagaaattggctccagttggtaccagcaagtctcaattttgaagatatagtagtatcagttgatagcaacaagaaaattgaagatgacattttgcagcttaaagttttactgacaaatcttgaagagcaggctatctacaaaacatgggtctaagataaaaaaaaaaaaggaggaacataataaaatgtcattattgctccaggatcccagacaagagtgcttgaatttaaaagagaagaacaaggatcttactcaaagaattggtgaacaaatggtgaaggcggaagagttgaagaatttgtctatccatttgaaggaatcaaaagagaaggctgaaaagctgaaagaaaggagaaaacaaagatcatatagtgagcatatttttatttgcacctcttaagtgattgtgccagatgtaggtcaaaaaactcctcgtatgacatctgcttcatggtagaggtgtggcttagaatacaccgaattcttgaaaggtgcatgttcatgtatttggtatgacaagattaaaaattaaatttgagggtagcaaagagcattaatcgaacaaatttctaaagaaaatctatgtagaaatatcagaatagaaaatgaaatgatagccttgggtaaaatttatcaccaacaactcaattctgattgaaatagcagaaaaacataatattgcaatacgtattaaataactctgaaaatattcaacactctccaacaaaagtattattttgatgataggatttaggaccctttttttgaaatctgaaacatctcaatccgttttagaagaaactgattcaaattataacatggatacagaggataataatgccttttgtaaagcaattgtaagatatacatgatcaaatatcagctagaaaggcagttgggctagcaaaccatggtgtcattcaaaatgtatacttgatggaaagaccttcaataaaaacttgggtaaagtccctgtttggaggaaacataagctcattttcctaaatagaaatttaccatgaatggaagttttgtttttcaaataaaccaattagatagattatccagcaaatgctttcgcaaaaaatgtttgttttgttttttcagcagaaaaaatagatgcttatgtgatcactgatcagtgatccccaaattaactactcttcgttacatgggcaaaatagcatatatttcacgctgtaaaaaagaaaaccagttaaataggatagggtgacatgctgagtttgaatttagcttcggagaagtagtttaatagatataactgaaatatcgaacaatggagatgttatattgactggtattagaataacaaaaaaaaaatttgagcaagaaccttagttattattttggttgtaaaaagtgatgaacgaaccagaaaacaaaacataaacctagttcaatctagttccctataacaaagtacaagcacaactaagtgttcttttagcattatcaatataccaatttatttcttcaaatcacaacagggtttacccccttcatcggtcaacgaaatcatgcttacctcatagagtggttacaacgaacaaatcataaagtttgccttgctacaagatgaaatagaaatatccttattcttgatctgtataaattcaagaactatagaaaaaggatttctgtccacattctggtcagtaaatacttatggctaatggctagtcctaatcacaggtttgtcatcagaaatgaacatgcctactatattccctaggtggaaatatggatctttttccccatttcagaagataggtttgaaatacaaagtatactatatggacaaaacattactggagaaacaattgttacagcgaagaattcaattaccttggccccaagagccgccatgatactatcagcagcccatggcatgttgttgatccaaaccaacacaaatggaccatcaagggatcataactctgaaccttaaaactcaacagaaagaccttgataagaacacaaatactttccatttagtttttgacattttacagtgcaattcttgagttggttaatggcatatccatatgccttgctgcctggggcagcaattaagagaagactcccataatattttctcagtttggactgaagacatcattttcctacaaatatgccgatattcttgaacttcctgctcagtaatcacattatttgttgtaactaacgcgtctagaatatgagtgatgttgagaaaattgaggacaactccaggaaaataatagtaagcaatttttaggtgaaggctaaaggagtaagttcgtagctgaaaattttgcctaagcttgcatatacaccatattgttaaatgcatttttatccctgaggcctacaccctacatatttgcatgtatggcataaaggtgcatgaagacaagtagtccattgatgacagaggtgatcgagtaaacaactaaagaaacgaaacgctgaatacaaaatcaaagcatgcacttctcactcaaactcaatatccatatcagccaccaaacctgaaatttattattatcattattcctacatagtgatagctaacaaagtatcattaggattcgattaaatggattccaattttgtggcataccccaatacatatggtaggaactaaaaattttcttattcgcctgcagaatggtgcacacaaccaaggactgcctgtgacctgtgcaacaaaaagtttgatgtttccataagattgtccattagaaatgagcaaatcaacatggagcaaatttcatgtgtcattgaaatagatgaagacctatgataatggcaaatactgcatttcatagactacgtctcacaataagaatgcaacagtgacctagtcatgccatttcctgtgtctgcataaactacaaatctaggccttgtttaaaaacttccatttttttttgtttggaagatttccatgctgaggtgcaaactatgtagctgcaagaaattgatgaagttctccagttatatgcatatgattctggcattagagtaatttaaagtccaagagcaacgtcggtcatttcttgtttaacatccagagtgatggcattgcatatctaagatggcaccactgtactctagtataataaacgttgaaaatgatgtagaataattattttgtcaggggcatattaaaaattcatatccatctcaccacggaggcactgccattgaggggaaattgttactgtcacaatttttttctttttgtgagtagttccaacatcataaccacatttttccctactaattgacaacgaactgaaatatcaatacaatcattatgtattgtcattgtatatgtctgaaggatagcaccgtatatacttgattgcattagagagcatgcaaatcagcagtacaatgccaaaatctagctcgcaactataacctagaacagaagatagcttgtacaaattaggaaatttatctactaattgacgatgaactgaaatatcaggttagctgctatacaaatacaatttctaagtaatgttgatacaaatgactaaaagttaaagctctagaaaatacctaagagcagtaaatcttctaaaggaagaccttgccctacagcatctgctgaaaattccacatgtaaaactcataacactaagctgagatgagcaaaaatcattgacacatacttgttttacttgccgttgtacatggtactgaaagtgtctacatgatgtcctctacagtgtttgtgtcaggtgaggcaatgaaagatatctacacttctgaatggttcatggagcaggggttctcatctggtgaagattctcatgtacagattctacgtatgtggtttgaagctttgaaacacagatccacttagttgtcggtactccagtcatcggtgcctagacaaatctatctccaacctacaaaaaagatattgtttttctgggaagaaaatagaagcgaaaggatactggatagtatgagatgattatatatagagaggggggggtacttggagacattgttggctgcattaggtggtctgaaaatctgaggattctacaggggcggcctaatctcctagaagaaatggaaaagaaatgccaagcactcgatctttaaggttaggtcaggtatgattctatgtctgagtggattgaatcatccacaaccacaaaaataatcagctaaagaaatctattattttcagtttcgttacgatagctctaagaggtcttcttactctttgagttattggctctagcatcctagaacatgcaaaaccagtattgaaggacgagtctgtgtatctcttcaagcaagctccctcacccctaatgtcatacctgaaaaaatgcatgatcacatccatgaaggccagcattctctttagttttcagtagatgcaagcttaactcacacatgaatagaagaggttaagctatcatacttgtcacgtatgaacaattttggaggcccatgacactgcttgatggagtccataatgaaacaaagtgtgtgagtgtgtcaccttttgtcacaaccccactgtctaacctcgaattcaaatgccaacaaattcctgcaaacaaaccaatcaactctccatgtgaatgagagaaatacaaaatgcttttgttagcagaaacaggtagacgtgaaagatgtttcttttagaggagtttgtgttatgtggtgctgcacatacccctgttagaagcaacatacaggtagtctgtatgcaaagatcacaagagttattctccacgagtggcaactctgcctccagctgctgaactgaacatatcatggagaacgtctgtgcaacatatctgaacacatgaatgggaaaatccaatggcatcatgatttgtattaaataatgatatgtcagtctcataggtttggagaaaaccacacattgcattagatgccccccccccccccctctaatgaaagggcaaattcttaccagtatacccaggatcgcttcctcaaaatgtggggcaaacacagatacatgaaaatagatgcaggaatagaaaaaatagagttgaggacccttttgttaggcctcactaacttggctttgagttgcagaggtgtttatatagaactaccttacttgaatactgggcctcaacataaggccatatcgtttccatggtaaggcttatgcaactccagatgaaatagaatggtcactgtcaagccattgaaacatagggggtgaaccactgcatgtttgatcttccaaagcaaagtaacaggaaataataatgtgaggtaaaataattaggaacagatcctggacttactcttgtttctccagtacattttccatgatcttgaagcaatccataaataatgaggaaaacccgcatgctgctatccctttgtcagcaacatatacatctgggaactgcacatccatgaaagattgaaacaaatagccaagttaggaacatgcgatgtggcattagctcaccgtcgttgtcgccgtgccgtggccgaaatccatcgcgccgacctccgcaatgcccctgccgtccctctcgaccctggctccaacatctcctctgcttgcgatgtgcgccactgttgcttggatccaaggccaccgccaccggtccgtgaccgcgtctccctcctcagctcctccaagctggaccttcctctcactgccgccccaacaccttgtacgccaccggtgcacaggagctcatccccgccggccatggccgcactacggattgggacgagacaggccgctaccccagcgccttctcggcacctggcacaagggggctcgaccccgccgccatgacagcgctagggtttggggcgagaccacagggctgatacaacactgatggggaggaagaaatggaagcggtgagagctaaaggagagggggaaaagagcagtggtttgctggcggaggagacgatgcgcggtccacctcaggcgagcgaggcgacgccgcagccggcggctgtcatcctgtcgagggagaaagcaaagggggtgaggcgaagggggatagagttgggggagaaagcgaggggaaggcggaggcggcggggacgacgatggcgacggcgcgaggcggaggcagcggcggcgtgaaggggagagggagagggagagggagagacgagagggaggagagtgcgtgagggcggcggcggctagggctggatgcggccaccgtggcggaggtcaacgcggcggcggcggcggcgcgaggggaggcggacgcggcggcgtcatgatggcgcaggacgagagggaggaggagtcgaggagaggcggcaagggggtcagtgcgcggcacttttgcgaaaaagcccctagactttatatttttacatagagctcctatttcgcgtttctcccctcctgcgcatgtaatatcaggattttagaagggtccttacgcacaatatcgcctcaggggcactgttcggaagggacctactcggaattacgaacaaaccggagggctttctcgcaaaacaaccaccccgggcactgtaggactgtagctttttgctgacttggcatgccccctcgctcgcccctcatgcgccgcataatatttgccgataagcaattggtggtcgtaggctcactcacctctagatacggtgctttacccgtagacgcttctccagctctcgcaggaattgtatgggagtcgtcctcgggggaacttcccgaatgaccgtaccgaggaattctaccgtactccgtgtagctatggttgttgattctgcggagctcacccaaaggttcgggccggattgtaggaagtgggtgatacgtttttgtatttctatgagaagaaatacggcacccacgatttccagtagtaagtcgtcggcatatcgcgcgtaacaaatccttattaataaggaatggcttttaaaggggggccagcttacgggccaggcctttctctaacctgataactagtatcgcttcccgcccagctctatcagcaggcctcttcttttgcaatacttaaaaaggtcactcatggctaaattcttattaaagccttctctaccattgaattcggccctctgggtcaacccagcggctctcggggtcaacccagcggcttctatgagaaagggggcgcaaaggaggctcgaggccgctgaaggggagaaaacaaaaggcgatgattttgtaactcggtgacaagttgagggaccttcggtgtattttttcctttctgtgggcgctgccgccggcgccatgggcgcgcgtggcgcgcgtacgcttgccgccgccgctgccttgccaaccacggcaagccgtcgctgtgccgtgcactccactgccgccagccaaccctcccgcgaccgccgcgtgtatgcgccgccgtcgccgaccaatcacaggccacagccggcgccgtcgccttccttctcacgtcgccgccaccaaggccaactccctcttcccctctgcaaaccgccattgaccaccgcccttcgtcgcctataaatagccggcaataccccatcatttcctcacatcgagcttgaagctcttttctctctctctccctccatccatgtccggccgtcgccgccgtcggccgatctcctccttcgtagttccccttcctcttcccttgcgccactatgctggctccactccggcgaatccattttgcccatctccccttccttttccccttgaatcaagccaccaccacccctctctttaccaccggagataagctcttctactcgccgttccggccacatccctcttcctctcttccatccaccaccctccccgggtgcgcgtcgctcgggaacacaaacctccgcggacgtcgcagcctcccagccactggagcaccgccgccccactcggcctctcctctctcttctctcggctcactgtgagacagaaagaagagaacgaaaagaagaagaagaaaaggaaaaagaaaggctgacaggtgggcctatacacagtgcattttcacatttctagatttaattcaaatcatattctttagaagcccatatctcctaaacagtagatccgattccagtaaaacttggacataaattcatctaaattcaaatgcttcattttgaaacccaatttgctattttatttgaatttattcaaataccgtttgaatttatatttgtctttcaaatattttcttttatcccaaactaccccttaagccactaaaaagccgccggttgaaactttacgccttccatggggacgttcgcggtttactatccccgacgttgaaccgttggttgtaaagcccggcaaaacccaaacccaaggtcgaagtgctgctctcgacactccacgcctcgatgcgtacaacggtcggagctcactattccctcgacctttacagcacgccgcacagttagttcttgagctctgtgtgatcctaaccactccgccgccactcacggttgtcggagtaacacttccacaccgctaaacttcctattcctctaaccgtcatgctgtctgttgacaccggctaaagaagataccaaatcaagtcgttatgctacccaactctagcaacgactagcaaacaactaaaccttatactacctaaacctaccgccagcaaatactagcccaataatccctataccctataaaggaaatagaatataccctaaaccatagcccttttaaccatttatcgttctctttctattttatggcttttattgaatttggctcttccttcaagtagagtctattatcttttggatggcaacctatggtatttcaagaatcgataatcaggctgctatattggatttatttacgttggagcaaggcaagttattatccctctcctttgagcataattgtcccatattccatgcctctattattctatgcattagtcatacatgatttcaaatgcataacctgaacatagtaaaccaaatatgctagcttttgcttagccttgcctagttagattgcataaaaatataataaacttagattgggacagtacgtaggaattggttgatttccgggtggctagtgctgtctcagtcgatataattgttcaccaaatacttatgtcaaacgaacaggtatgaccgcagcttctagaatggggatatacctagttattatgtcaattaataatgtggtatctctgtgtagtggttcttatttaagttctcgcgcaggaggcaaacttacgccgagcagggcgattgtaatatttaccgaggcgcaggtaaatatcttgattatctcgcgagctgtatgtgtgaattgtgaaaacctgattgagatgacggggggtctctcaactagttctctcgaaaaacctcgagaacgccagaactactctcgctgctgataacgttacgttcagagcgcatgaggactagagttcacggaacaggtaccactattgttagtaacctaatactgggccatgactaagctaatgattattggcaagttatggactgcgggtaaagcgtacatctactgcagtatgaatattcttaaaactattcgaatagccgtgctcatggacttgagtatcgggactcatatggtatttggttagaaacctaattgaagattttattaaatattgatgcatttcaaacatcataggctttgtccctctttattctcagctttctgcaagtaaatctagctctactaagatattatcatttcatgcattcaatattgaatataatagcttgctgagtacattgtactcacccttgcttcaaccccacctttttagagtcattttggagattttgccaaagccgggagtttaatcatataagttagtttcattccaacttaacttccaagtctagcgtagttagatggtttaagtctatagcaaaacattagagttgagtcattctatagcttctgttgtaataatagttagccacaaacttgtaaataccctattatgttataataaaatctcctttagagacattcaaatgtatgtaatgaaaattcagattgttgaacctgtatcaatctactgattcagggcttgatacagttaaatatatcggttttcgaatcattagtttcgggacccgacagttatgtacttgctagttcaacaatatatcaatggcggtgtatgactgacatcctgtggttgaaacttgtaggagatgcgagactgtgtccaacgtggcaaaactaaaggatatataccttgacagtgctcaaacttgatggtcatgcatgaagtctcatgctatgatcgtctggtcattggtgaacgttgaaacagttatattctttggaaatgagttctgtatgcactatactttctgcaatcaaatgtatgcattgtgtagcgtaactcataaactataaacgaacctatgtgatacgttattatagccctttcatcttctaccctatagttaaacaaaggaaaaagtccaaatacccccctaaactttggatggaagtccatctagcaccctaaacattaaaaccggacattcaaccccctaaactttgcaaaaccgtttatattaccccctaaggtggttttggatggtggttttgcatattttaaaagcttaaacgaataactttaaataacatatataacatatttacatatcatcagttgtaagtcatcaatttatacttatacagcgataccgtgctattattatgttggtacttgtttgtaagagagctaaaaagtggtaaaaagaaagatttaagtggagattttaatatatatgtctgatgtgtatgtcacgtgatcaaactcatccaatttatatacgaattagataaaaaccactatacaaaaccaccatagtgggtaatatgaacggttttacaaagtttaggggttggatatctggttttaaagttcagggtgctagacggacttttatctaaagtttaggggggtatttagacttttttcttaaacaaatggttttactcattcatcatgtcacacgtccaacggtcgaaacccatctgaagaatttggatccaacgtcctatatcagcgcgcgtgtcccccacctccctccgcatcctctcccgcatctacctctctgccgcaacgcatcctctcccgcacctccttctcttccgcaatcgccgcgcctcctcctcatccgcgcgaccgcctgtcgcgttggtgtgacccaggagaccctcggccccgtggtagatcatgcgcgcgcag

SEQ ID NO: 7302 - DNA, 2236 bp, Oryza sativa
gatggtaacagcgtagaagcacatggattttatgctgctatgttgctctaacacaagtttgccaaacatttatgcagcatctccattttctgtatgggggtggtttattttgtgtacaacagtgagatattactcccagtgaaatttctacagattttaataaacatatttaaatatgatccattctctaaaaatatgaaatgttttttaagcatgtgtatgcgcaaaccatggttacagttgcaagcccgttctgttcttgaggctgtttggaatcgcctcttgctgtgtattgttctgcacaaacctgtcaaggaataacaagcagtacaatttgttgctccaggatggtttcaactttcatataaattatatctgttgtgatctcttctccgtacaattaattccttttcagaagttcccccttgctgcagggagaccgaagcttttttcattattgatgttataagatattattgatatattttaatcacatcttaactaacttgtacttgtatgagatttgcagtgttccaaaattttgatatgtgatttgaacctctgaagtaggactacccaactaaaattcctgattactcttgctctgtcactacacgcctccacatccctacatccgaggctcctactcggcgactccgattggcaattgaaggtcagtggttgatagctcatgcctcattgctcataggcttgtagctcaagcttaggttgccaatttgtgatttgtgaatgaatgcgaataagtttctgctgtcatggaatgttttggtattggcctattgggtaagacgtgaataggaatggggaagtagtaatctttttaagggttgtttggagaaattggaacacagctaatgcacttgacaaacatgggggatgtaccttgtgcacaccataaagctcaagaaaaatataactcaatttgtactggtgtggggctataactgatgctcttgatagacatgattttagtccattattgttgttaagggatattatttctatatttgcatcaattttttaactaatttgtagttgtaaatgggatttcgatttcaggttcagataattgcattatctatctatttgtgcgattcaatggaaatgttcataaatcaagactgtttgattcatgctctgcatgttgatttatatattactaccctttagttgagcttaattaccgaaaaaccatgatgccaattatatatccatatgcataacaactgatgtcaagggtttatgattttttctccatgtcctccagatcgacgacgccaccactggaaccctctccagtctcaacctctccgcgaacacggtaatcattgcacgatcactttccttcaaccattacagttcaaattcaaattacgatatgtaatgcacaagccattaaaataaagttctatgggcttatatgtacactgctgccttattttcatttactcatcaaaatttgtcattactgttggaaactggaaagcgcctttggctatattttgaatttcatgcattatacacatcaattgaccggaaatttgtgtaaaatataacctgactaataatctttagagtggtgtactgctatattaattttcatttttttaattctcaggtttgacctctggattacatcttcaactggtaataatcttcaactgtttgcttccctttttcaccaactatgagcatgtttggaatgtctaaaaataacaaaaaataaatataagcttcacagaaaaaaaatcacattcagcggtataattttaaaataaatccaattatatccacgttgcaaaaaaaatactttggaagtaaggctaacctgttggacgtcgcctccattgtcccctctgccggtgaccgacgtccttgactcgccgtgaatcccagtcaatgccgcccaggtactttagtttttttaaagatcaactgtatcagactcaagcagtgagccaaagctgatcgattttattcccttattttctgaggatcttaaagaatagtacatagagattagttgctgaaattaatttgctcatgctcgaaagcaattggtaaccatgtgctttcctgctctatttacgtacagatggcgaacaattgagtcaatattggtacaaggattattttcgagataatttcaataattatgcatacgattggaaatgtagtgtttaatccttctattctgagcataattttgacccat

SEQ ID NO: 7303 - DNA, 16289 bp, Oryza sativa
ttcggtcatcggtcggtagttcggtcatgcactcgagaagaccgaagtttttttgggtagttcggtcattcttctcgggtactcgatgtaaccgatctgtataaaaacagagttaaacataggcaaacataggcatgtgttggtgttgggctcatgggttgggtggctggcaagcccattagtgattagtgtatttctccacgagacaaacaagtcaacaaacctaagtcccgaaccagaatctcgtcgcttcgcctcaagcgccgccgctcggcctacccactaccccaatctcgtcggctcgtcggcgttgccgcgccgccgcggcactgcccgcgcgctgctgccggcgtgctgcccctccgtgcgcccgtcgcggcgcgcaccgcctgctgccgtgcagccgtgctgctgtctacccgactgctgagatagcgagggggccaatcgccgagccggaggaggagggggccattgaagtgaaggtgacgaacagagcagcacaatggagtccatacaatcttgtaatgtactgtacgtatgagcctgaatccttcaacgcttgatttgttttgcaatcatgttctgattgttgtgttggctgccaattgccacatgctgtatgcctgttcggtctgtacggtctaaccgaagaccgagaccgaagtttcggctaaccgaactgtcggtcttgattcttgtgagagcaacttcgggtgtcaattctagataaccgaaatttttaaagaccgaactaaccggaccgaagtctcggttatgaccgaacgcctacccctagccttaagtgtgctcatccgatttcgaattcttttaggtttattacaatttcatttgagaaaatttgtttcttgtatccagatcggcggcgaaccccttcacgtcgcgctttgagccgtttctggagccgcccatcatcgagccgtgcttggagtgacagttctaactaaaagactactgagcttaattttttatgtaaaacacaaatggttgagaaaacaaaaatatacatgatgcactttgattgtcagtctttaggaagttatgattctttaggagatagataaaaatattttatgattcattgtataaaaatgactttatggaagcaactatagatgacacaggggaatgtccaatagctatagagctcaattacttcttgctggaaacaagcataatttcttattttgaaggaatcacatcaaccgagacgaaacgtttgataggtatttgatcatttagaaacgatgggaagtggctaccggctttttggagtgggactgtaaattatgaagtttttacattaacattacttattgttcatccgtcaaattactctgtaaataacgtattgattttggcacattgtcacattgtcgaggggtctgtcaaggcaacttgacaaacaacaaggattttggcaaagccaaagaaagaagtcgaacctacagggaagaacagaatatcatgtatcaaaacgttcatgattggtgagcaaatgtaggttcgcgtgatcaaaattaattcagaaacttattttagaaaatagtaaattgctaactggaatgttactcaccaatgtcctcttgttttgtacaacacgccatcaccattcaggtggaatattgtgtgattaataagatgattaaatatgcacttgtgtctctctaaatatgcatttccgtcatcgactaattttagtagtcgtttcatataaatattgaaagaagacgttaacgagataaccaacaattcttatattgtgaaacattgtcaaactattactttgacatttgtgtcatatcaaactggtatttgggtttataaattcatgccctcatgctatccttaatgggctgcgaccagcgtgtgccatgtgtgatgaatagaaaaatcaatatttttaagtacataagccaatttagaaaaatgaatggaattggcctatgggaacatccgaattcgtgacatgtggaaaatatattttcttgtactctatatattttttctatttgcgacatccaaattcattttagagttttattaaagattaatataattgcaccgtagcgtttagcacgggcatattactagttacaataattgtccttttgcgtgagggtgaccaaccattgttttagaattatttttatttgacgatcttactttgtactgacatttagccatgaggcaaagtggcagaaatataaagtttaccatttatttaggtttcaaatgcgagacgatggaagcaaattggaagagaacactaacgttatttgaccatgcaacttagccatgccaagtaccagttcgacgcttgttgaacggtgcagaaccttggacgtgagctcaattggcatcgatctgtaaagcatacacctatgcccgcagcagccggcaatcgcttggcggccgacatcactgcacgagcctatccctaatgggccggaagaaatttctatggggaaaaagtacacagtatctttctttgagcaagtatagtattgtcaattactagctttaattcattatagccaatctaatagctcatttatacaatagttacatactacactattaatatctggtcccacatgtcatacacacattgtgtattggagtccgtgctatagctggctacaaatctgtagcctgttgaccttctctctcctcatttatctgcttaaaatatgtttgcagctggcttatagcctgctattgtacctgctcttaagtatgataccccacaaaattaacactaccaaaatttgctgagatttttcttttagaaatgaattggaccaagtccctcgtttgcatgtatgtatggatcgatgacaaagcacaataccacccatccgttttatattacataagtttcaccaaatttataaaaaaatgtagcaacattttcaaataaaaaacatactatataaataaatttgatattatatttgatgaaattaatttagtgttatagttgttgctaatttttctaatgaacttaataaagcttaaaaaggtttaactataaattagttaaagttaaaagtttcgagtaatacagaaaacggtgggagtacaagctaccaaaccaacaaccgaacctttgtggtggggaatatatactgggcgggtcacctggccggaatcgattaaattataaattatcgtgcgtgcatgggtttcagcccctccatcgatcgatgtgatgtgatgctgtgatgggtttcagattttgatcgcactactagtagtactcctatttaaataatccacgtttcattctcgatcaatcaacatcaaatcaaatggaatttcaagaaaaaaattaatcaatcccgcatgcagcgcggccaaccgatcgtatgcgcggggctgcgttaatttgcaccgtttccatgatgcatgcactaaagggttatttggtttgctatcaaaatttgtcaaagattaccacactttatattagacaagtttgactaaattagcatattatttggttcatagccacgcttgtagcaagattctttctcatctattagggtcccacatgtcatcaactcattaaagtatggcacaatccaatcttgctagctaaggcgtggctcattttttttaagccacaacttagacaagtgtggcgtaaaaagtatgatgaatagtggcaaacttagtatagcatccaaatatgccctccttatattccaatttttttcttcaaacttctaacttttccatcacattgaactttcctgcacccataaactttcaacttttccatcacatcgttccaatttcttcaaacttctaattttgggcttagttttcaaaacaaaagcttttcacctattctatcgaatgtttagacacatacataaagtattaaatatgcatggagtattaaatgtggataaaaaaatcaattacatagtttacgtgtaaattgtgagacaaatcttttaagcctaagtgcaccatgatttgacaatatggtgctacagtaaatatttgttaatgacaaattaattaggcataataaatttgtctcacagtttcctgacggaatctgtaatttattttattattagacaacgtttaatccttcaaatatatgtccatatatccaatgtgacatccaaaacaaaaatttttgccatctaaaccaggccaaggtcccgtcgggcttgcctccttccctttgacctatctatgccatgatgctcatggcagcttaactcttattggattttcttttctaactggattttattctaaagattaacctttgctgtaaccaactgagctaccagaaccacttgcctaaagtctcttttcttcatctatgagcatcccagtggaggagtttgctcaagaaccaagagccggccagggagttggatgaaaattaagatttttatggcacacgctttttaaactgctaaacggtacgtttcatgcgagaactttctatatgaaagttgctctaaaatatcatattaatctattttttaagtttataataattaaaactcaatcactcatatatcaataccacctcattttacgtaaaaaaacttaatcttcatctccatcttcatcttcagaagaaaagaacaccacctaagtagagtgttgtattagtttttttactactggctcaatcttgggataatttactatatattatgataaatttatttccattagttcgcgtgaatattgacggaatggatatgcatcatcaatatccatgcatccatatataaatacttgtagtcaggccgaagataaagattcacacctcctacttctttcacgcagcagcgtactccctattttaaatacaaccataacttttttatccaatatctaaccgtccatcttatttaaaaaatttataaaaaagttttaaaaattaagtcacacataaattactatttatatcttatcatctaataacaataaaaatacaaattataaaaaaaattaaataagaaagacggtcaaacgttggacactaaaacccacaagtacgcttaatatgggacatagggagtagtactcttgaaggaacacatttgtacatacaacaaatagtgagacaaatcatcatccactatttgatactccctccgtttcaggttataagacgttttgactttagtcaaattcaaactgtttaaagtttaactgagtttatagataaatataataatatttataatactaaattattttcatcaaatcaatagttgaatatatattgataataaatttgtcttaaattgaaaatattactacttttttctatagacttaaatcaaatttaatgtagtttgactttgaccaaagttaaaacgtcttgtaacctgaaacatagggagtagtacgagtagatgggcgaggcgtgggatggagacgaagaagacagcaacatagggcctttttagttcgcgaaaagaaaatttttggctattacatcggatgtttgaccggatgtcggaaggtgttttcagacacgaatgaaaaactaatttcataacttgcctggaaactgcgagatgaatcttttgagtctaattaatctgtcattagcgcatgtgggttactgtagcactcatggctaatcgtggacaaattaggctaaaaagatttgtctcgcgattttctcctaaccgtgcaattagttttttctaaatctatatttaatactccatgcatatgtccaaagattcgatatgaaggtgtgtttggatcccagccattgaatgccatagctacagtattttcgccgcgctacagtattttctgaggcgaacaaaatgtccgccacaggacctgtggcgagccacgacgtggcgtggcattctaatgccctgtttagatgggactaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattataaattaattaggcttaaaaaatttgtctcgtgaattagcttttatttatgtaattagttttgtaagtagtctatatttaatactctaaattagtgtctaaagatagggactaaagttaagtccctggatctaaacaccacctaagccgccaaccaagcagccccggtatttttgggaaaaatatttgggaactaaacgaggccatacttaatcagcagctgctgcccaatccgtcaatggttggtggggttttttagtgggctgtcgccgagcgagattcccagttctcacaactggtttaactctacatttgatatcgaggtacgtacacgtctctggtttgatatcaattaatctgtgtctatgtgtcgcaacaatcggttcccagcatgtacgcgcgcgaaaacggaacaatctattagcgcgtgattaattaagtattagctaattttttaaaaaatatagatcaatatgttttttaaataactttcatatagaaactttttagggcatttgtaaattttccactggtttttttaatattgcaaggatatcactggaatgatagtactaatggcatttttgcaattttctagtggcagttttttaataacaattcggagtagtggtaaatttgtaaaaaaacaaaccgtttaacagtttgaaaagcgtgcgcgtgaaaaacgaggtggagagatgggaaccagccgttccaaacacagcctgtgccttcttcttttcttaacatctgttaaagttttttcgacccccatcaccaacaccaaggatcttatattggatgcaaatgagtatagtagttgcgctgctgtagtacctaaacaatgcatgcgtcttaatttggtaatccctaaacaacaacgattgttttaattattagagattagtggataacccgcccggggtatgtctacaataggaatttcgcatagaggtatgggtaggattgacatttcacatcgtcagatcagatcagatcttgagaaaggggccggcggggtgggtgtggaagactgcacacgttgtactacaaccctagcagtcagctctgctttccccaacgcgttctcaaccctactccatcccacttcgttgtcatctctgatgaatcttttctctcctgctgcaggctgcgtgtgcgcggaggaaaggaatctttatggagccaaaatttcgcagagataggaatggaatccttacgaagccaaaatttcgcagagaggaggatatctgtttgaggaaaaaaaggacggggtctcccttcctgcaacagagtacggatgaagtccaacatatgattagtgaagtactactagtagcctatttgctctgctttcatttcttctctggtgtttgattgattgggtgtgttgatgatttctcatcgtttcaagatccagatgtggtgcacctacagatgcagtctagttgcaaaccctagctgctaggctgtgtttagttcacgtcaaaattgaaagtttggttgaaattggaacgatgtgacgggaaagttgtaagtctatgtgtgtaggaaagttttgatgtgatcgaaaaagttgagattttaaagaaaaattttgaaactaaacacagccctagtatcagatcgttagtgtttaatactactactatttcttctcgcccggcggttttatttttttgctttcatttggttgctcagttggaccgatggatttgccgattcatattcaacattattataagtactactccaagcatggcaacaatcagtctgattggttggtcggctggattgattgagctgtggtctgtggattattattatcattatcctatttttacttgtaacctatatttcccctggtttacatacacagccagtgcgcttttagcagtatgttttacatgctttactttacattaatcgtaatttttttttttttgcagaccgcgtgatgatgttaccgtttgatgtgacgtaccttagtttgtacgcgagattcaacaagatgaaggtaattaaacgaattacttctcttgtgctatgtctactactcctgtagtacatgtgttgcactgtattgcactgtattgacccagtaattggattgtgaatacgctccatatggggcgtccaatctgggggacaaaaacaggcgccccacatagctattcattcactcatttctctctcccgtatctcactcatctctctaacttatcttcctgctcgttttctctcctctactttactctttctctctctcaccaaggctttgatgtgaggacgagggcgcagcgtccccgtcactacttaaaaaaacgatttttcatgacgacacccttttatttttgccggcggattaatgaaacaaacgctagtaaaaacatatgggaggattctcgctcatgagccgccagcgaaaaccgattttcgctagcggaaacttaggaggtacgtcataaaaaataacactattttttaggcggacctcttaagtgtggcggtagagcaccgctcgtaaaaaaaaataaatcccattgccccaccacccacagcccaccgctcctaactacccaccgcgcattggtttcaattttcgcaaacagtattctgaccgcttgtggaaagtaaggattttcactggcctttacctgctggcgcgcctgtgcaaatgtttttaggccgtcagtaaaaatgttttttctagtagtgcgtagcaccgccaccgaagatggcgatggagaggacgcccgcagcagcggcaaagaggaggcgtggggcagcccatcgtggctaaggaagttgaagtacgtatcaccgggtcatcgcgttgcagcacttgaggttgtcgaaggaagcctgatccaactaacggagaggaggaagaagccagacctagccagcattgattttgtgaaatttccagtgtttcagtcaatgcatttttgatgtttcttttgttggattgaaatgttgtaccaagtattttaatgttgtttcattattttgtcttcgattcattgcagatgtgtagatatttttgattcactgcagatgtgttgatatttcaccaaattgaatttgaatgttttgtgtgagaccaaaatgtttcaggcctaaggccctaattgtagtgtatttttatcactatttctttcatttagctcgcaatctaaggctttaaaattcattaggtggaacgtcttgtttttgctgtttaagggcattagcattgcgatgcattgtgtgcacgtactactatgcatctatgccacacgggttgggtgcttttttatacaactagtaacatgtaaaagtgataagggcttagtatcacattccttgctgtgataattgcaaatcaaaccttgtatttttcgtgggctgtcctacagcagacaattccatactatggtacggtgcgctcgctcatagacgggtatcaatttgatttgttgtttttacgatgctgaacaattttatctatctgagttccaccgcataaatatgtaaatagagatgttatatctgtggatgggtaaccaacgaccacttccattcacgtgaagagttaaactaagtttaaattgtactgtcatgcatcaaaattaattgatcccccattacgtgacaccactttgaatcttctatcatgccgcaggggccggtgggcaaggcgtcacttatttgcggaggaaaggaaacccatgatgccaaaattttgcagataggagatggaggagattcagttcattgtgtgcaaaaaagacgactgatctccccctgcaaatgtgtacggaggaagcctatgattggtattacaactcgtattgatgagcactacaccatggtacagaggcagtaatatatccctacttctcttaaataaatttgctctgtttttgctgtgttcttttctccactgtttgattgtttctgctgatgatttttacatcttgcgtcccatggggaacccgtacgcctgcaaacgtccagtttctaggtagattaatactccgtccgtcccaaaaagaatcaacctaggttgagtttttttgggacgaagggagtactcccgatgaggtgcacctatatatagagcctgcttagtagagctctaactcctaaatttaactttaggagttgggtctagaggggagttgtggagctacctaaacccagctccacctctctagatcattttgtgagagctccacccagctccactccaattttaggtctccaattttaggtggagttgaaactgttttgttgagctctagctctagtgccacaatatacaatttctactaaaatatgacatgttttatatgatctgacatgtgggacgaaactctgatatgctcacataagtatggtcatatggtggatgaaagaactcatgaatcccccacgtgtcagatctgggttaaattggtcaattatttggtgttatgaaacagtagtgctaaaacttatgtggttttgtgtaacttggaccataataaataatactaacatcttcaatttgtcctaaaataagttcccaatgctccttcaaattgtctgaaaataagttcatctttaaagtaatcattgcattggaatatgcgaaagtagtgaataattgtattgaaagtagataaagcgagtaatagttgcattgggattttataaagtaggagtattgtagtctaaaataaacttattttgagatggaggcagtagtaatagcactccctatgaggtgcacctatagatgcagtctacatgccgtctagctggccatatatgagtgatttatattttttatagtttactattactccctttgttttattaaaatataaaaactcttgaagttataatattttgttaaaaaaagaacctactacttgtaaaaggtgatttttaccaccaacttacttaaaatgccttacccacactactacgaaagggtttttctgcaaaagggcgaaaagcatttttgcatgcggttgggccagccgcatgcacagaaaggtctgcgaaaatcgcgatctttgcatgcggctagggcaacagcatgcggttgcttacatgggccgcatgcaaaaataaaaatctaaaaatcgcaaaaaaaatcatgccggccacgcgtcggcgtcgtgggatcccgctgctcccaccgtttgctcccaccgctgcccgttcccgccgtcggatccaggcgggaggaggcccgccgccgttgctcccatcgaccaccagcgtcgtcgtggaagtcgcccacgcgtcgccgccaaccgctcctgccaacagatctaggctggaggaggctgagctgtcgccgttgccgccaccgccttgtcggcggcggggagggggggggacggagccggccgccgccaacggcgacagtgaggaggggatggtggtggtgccgccgcctactcgcctgatccgccgcccccgctgcgcgcccgccgtcgcagcagccgctccctagggcggtggatccaaccttcctgagggtggcgccgccaaatccgccgcccgccgacgccattgccacccgtcctgctcccggtcgtcgctgcccgctcttggagagagagcggggaggacataagaaaacgagagatagaagaggataggaagagagagagagaggggagactaaaatagagagagagagaggagatagaaataatttgaagtggtgggagggaaaagagagtggagggagatgaaaaaaaggggtgattttttttgtttgcgggtatcttaagtggtccgcatgtaaaaatgctaactcatttttccatgcgggctcttaagtgattcgcatgcaaaaacgagcttatttttacatacagacctcttaagagcccacatggaaaaaaaacgatttttccatatgggcgccttaaagagccgtatgcgaaaatgccgctcgatttttccagacgcgacaacttacggtccgtttgcaaaaatcatgggtcccgtacagaaaaatcgtttttgtagtagtgccactccttaacaagtcatttttgcccctccttgctggctgtgatgtcgagggcgattttgttttgtttgcttttctttgatggctccattaaattggatcgatggaaccaaaatacttactccatgatcgatggagtacatgttagtaatataaatccatgatcccaatctagagttcggattgcgtactgtcacttttgtaaagtaaattgcacgtaaccataggtattatggtctaagtaatacaaaaccatatgggttttggcatgtgacacataaccacgagtattacgagtattacggtagtgtttcataaaatcgcacaattgacaaattctacttaaatatgacgtgagatgatagttttatatgatctgacatgtgggatgaaacttttacatgctcagtgaagtatggtggatgaaataactcgtaaaccaccccctcccctccccccctacatgttagatttggattaaattggttaattatgtggttttatgaaacagtagtataactttgatataatacctacggttttgttcaaacatttttacgactgtgcgattatttgttgatgcactttacccgagtttctagatttatcataaaaattggattatccataataagaattagttaattccttcatttgtacagtcaaatactagcaatcagtgaaaaaaatagattatacagtatgtcgagccaaaaaaaaatcagctatctcaaaccgggccaaaagtttcagctatgtcaaaccaagccttcaacttcctgcctgccttgcggatccccaaactcccaaagtcgaacatgaaggcccagtagtctctattcgcactttctcaacaaggggcaaaaaaaaatctctattggtcgtcgtacactcgcttcactttccccttcccttctactctctggaaaccccttttccccgtctcccttctggtggacgaggcggccaggaaggggcgacgaggaattgggagggagatctgcggagatgtcgagtctttttcggttcggccgccggagatggacgctgtgccgtgcgctgaccgccggcggcagcaagcaagccgaggataactcaggtcaatccactcgtctctagggatggtctaagttttgtttccctagctgatcttgtagattaaaaccttattgatctatgtgatggtctattaagttgggttggctcggatttgtttcctagttgatcttgcagattaaaccctattaatttgtgtgatggtccattaatttggcgaatttgtttctctcgtttatatatattaaaaaaatcctctgatttgtactgggcgtggaaactggggatttgtttctctagtctgtttgagatctggtagatttgcttggcgtggagactgggggaggtgggggcaatgtcaaagcagtcctttttttttactctattgttcgatcttggagattaccccccggtagatttgttcttgtggattattcccctgctgctgagctgttgtttgatcttgtagagattatcccctgctactgatctattattgtttgatcttgtgaattatcctctgctgctgatctattgttagaacttgtagattatcccctggtagatttgttcttgtggattatctaccctgctgctgatctgttgtttgatcttgtagattatccctgctactgatcttttattgtttgatctcgtgaattatcctctgctgctgatctattgttagaactcgtagattatcccctgctgctgatttgtgctgttattttcatgctcgttttggctgtttggtgatggtgtttttatgtgttcttttgtatgcatgcaggtgtttttcgagatcccggcgagcgtggattcagcacaaggcccaatctttctttggaacagttgagtgttggccctggggacactgcggacttactgcggaaagtacttccaggcattcgtgatgcaagtaagacctttgctatccctgcgttgaagcaagtgtttgaggacagcattcgtccactacttgtttcaaagtgtttactcattcaccagcctcttgataaatccatgaaaactttcaaccaaagaacaaataacctgttgaagaagtctccacgctacctcagtgccctagatgtgaccacagaaaaggaaatcctgctggaagatgaatggactttgttccttgagcacatctttaaacatagggtcattgttgtagatgattggacaaagtgctacgggaccgttcagaccttcctccactcgagtgatgctgaatcatgcagtgattctttcaagggggagtgtgatgcttcattctgtgagcaaactggaaaggcaaaacttgcctttgtcatctttaaagagggtaaacttgtctgggctgaggttttccatgaggtaccttgcaagagtgttgtggaggcagaggctttggcagtcatagctctcctcttcaagcttattgaccttaacttgttaagagggactgtttggaccgacaacaaggtctgttataatgtgctgaatggtgaatatgagataaaggttgatgatcccaacaggtcgctgtttctgtttctgaggagtttgagaggtcgctttgagtccttgaccccggtctggaaacccagagaactactgctgatcccagatcgtctggttagtatggttgatgaccccctgatatcaaggaatagattggtactcagtatactggaaaaaacagttccaattcttagtcagccgcagttcaggatatcatggagcagctatctgcgaacaatttttggtatgctctgtttccttttttttgccctgttataacatgttgtttcagattatgcgtgtttcagatataatttgtactcttgcatttttcaatttttggtatgctctgtttcctttttgccttgtctgatgataaaataaaaattgctctgctcgacactaatgcgggcgactaactagcaaaaaggccttgtttttgtgggtgcgccagttccaaaaactcgtgttttttactcttttggcagttatatttttctattttgtacacgccgctctgtagactcttagtccgtccagcactccagcccctacagatatgaatgctccatatataggcatcttaactggggagtcataagaatactcggtttcagatgagatgagtattgtagtagtcaacacttacagctcacatgcacatattcaccagaagtgtcttggccctttgacacgttccagattgatttttagtctggcaagtaaagcgcgatttgtataaatgcattgcctcaatgttcggtagttagaacattcataagataattatcagatcagtggttcagtacttcagttttttacatcctacattgtttgggttatagtcacatttgctgcttactctgtctctccttatgtatttaatttgtcatgttttctttttttcctctgttataacattgttgtttcagattgtgcttgtttcagatttaatttgtactcttgcttcttttttttccagacaaacgtgatggtggaaaacaaatttctaacacaacaaatgaaattaaggaatcagatgaatccgaggattcaatctgttgggttaaggctgatgatgaagaagctgaaattgcttcctttcttgaaattatgaaaactttttcagcccatcgcttgcttattgtggttgacaactttgaagacaaatctcctcattatcaaaagttaattaaggatctctctcaaaagttttacacgtgttggatgagtaaagaaggcagtgtcacaattgtggagtatgactctcctaacactgaagagaaagagaccaaaagattggtggttatgtttggtgggacaatggcactggatgaatatatccaccaaaaaaatctctgtacagttgttttggtgaagacatctgagattaagctgctaagagatgctggaatcgaagaaataagtgctaagacacttctgagttttcgcaacagtaagtttgtttatctttttttcagcttttctcgtagtttttttgtgacttgctatgtaaatttaatgaaaattatttctttgcagtcaaagcaaaaccagttgtgccaaagaaacctcgggaggatgaggatctatagaagggggggggggggggggg

SEQ ID NO: 7304 - DNA, 4489 bp, Oryza sativa
  unsure (1)..(4489): unsure at all n locations
nnnnnnnnnnnnnnnnnnnnnnnnnnnnnnnnnnnnnnnnnnnnnnnnnnnnnnnnnnnnnnnnnnnatactgcattgagatcagacgagcaccgaatgaggatcgccgttttccccgccaaaaaaatggggtcggagttttggcggtatattttctttttgtccttttcatttttccatctctcttcgttaattttttttcccaatctctcgttccatcaggatgtacgttttcctccgcgcgaagcaatctggaccgctgaaatttgatcgaacggcctgaacatgcccaaattatattagacagggctcacatcatacaccgaattaaagcccaggctcacgaagttggggatcgctagttggcgcatacgcagcgctttgttgggataaggcggttagactagtattagtcttagataacaacagtttgagataatgacggtagtagataagatttttcttttttccgcgagatttttttactaacaaattgaaaagaaaaaatatatatctaaagtcaaattttgaaaattttaaacccagatttgaaaacttttaactcaaaatttaaattttttaagtcaaaatttgaaaactttcaagttttcatctcaaacttgaaaactttcaactcagatttgaaaactttcaacacaggtttgaaatttttcaaccaagatttgaaaactttctattcggatttaaaaacttttaactcgagatttgaaattttcgaattcagatttgaaaatttataagttaagatttgaaaacgaattagcaatcacccatgaagttaggacctgtttagtgcagcctaagagttttacgtaaaatgatagcagaactgagtggagcgctctcacaaaattttaaaaaaggtggagctaggtgtagcccggaaaagctagctcgcgcacgcgccgccagcgtgcgttccgggggagttaagacgtactaagtaagttagctaaggataattacgaaattaagagtagattttttctggagatttttttactaactgattgaaaactttcgagttggatttaaaaactcttgacttaagatttaaactttgaagtcaaattttagaaactttcaacttaaacttttaaaatttcaactcgagatttaaatttataagacaaattttaaaaacttacaactcagatttgaaaactttcaactcgagatttgaaaatttttaagtttaagatttaaaaaactttcaactcgagttttgaaaactctcgactcgagattgaaaaatttcaatttgaaaattttcaacttaaaatttaaatactttcaactcaaacatttgaaaacaagtctgctaaagattaaaaaaaattagaaaaaaggcacaaaggaaactgaaaatatttggaaaaaaataagaaagcgaaaaaaagagaaaaaatcgcaaaaaaaaagggaaaaaggggctgccagccgcgcgcgccaattagccacgcccgtgtttagcctgcttcataactttattttagatccaagtcatgaaatgaaaaaaaaagaaggtgaagctgggttttgcttgctccaactcctatagctagatttaagagtttgagctttaccaaatatgcccttaatcagcccaacaccagcacaccgccacccgttcagacgatctggacagtagaagcttcatccaacggcccatggtccgtggataatactaaattgcgagttcgtgacaaacgtgactagctagggagaggtgctgagaatcgaagctggtgagtgtcgcgactaacaagaataataatatccttcccagataccggtgaattcgttcaagtggcgtacgcaaacctcaaggttaacattatgaaaacccatatgatactagccacgaggtaattgtctgagctaattagcacaaacagcacgtgcagatgtacttcgtagacttcgtatacacgccaggctgtatttgcaatcccatgttcccaatcactctcttttttcgcgcgcacgcttttcaaactactaaacggtgtgatttttttaaaaaaattgtatacgaaagttgcttaaaaaaatcaaattaatccatttttgaaaaaaataactaatacttaattaatcacgcgttaatggaccgttccgttttccgtacgtgagggatttgttcccatcccttgattacgaacacagcctgttgaagttccaatatcctcgaaaaacaaaagaaaaaaaaaatccagcggttaacagggtttaccaaaccattttatattgtgttcttaagtccaagttcccaaggcttttcaaactgttaaacggtgtgtgttttgtaaaaaatttctatagaaaagttgcttttaaaaatcatattattccatttttaaaagtattttaagctaataattaattaatcacgtattaatccattgctccgtttttcgtgtcggaggacctaagaacacaaccagatttgacgattatcgcgacgtatactatagttttaaaaactaaaaaggtactgcacgtgataatcacgtgataacggttcacgtcaatcgctcgtttggaactaaggaacagaggaaggcagaatataggagaagtttcctgtaatctgtacctttgcagtttgcacccaaaacggggaaaaccaatgttttctcttcctatgctgaaaagtgagaggagcgggagagagaaaaatcatgtattccaaacacccaactatctattcttcttcatgtgcttttctactcatttgttgtacgtacatccgcattcctttttttttttgtatttttgtgttttgtttttcagcgttccaaacatatctttgtttctgtgttttgtagttctgttttcatatacatccctacggagattccatttttttatattcctatattttactattcctgcgtttgaaagggagcatagccatttttatcccttattcctttataacttcaccaattaccagacatactatagggcctctttaaaatgaaggaaaagcaaagggaaaaaaaaggaattttaatcttataggaaataacactgttgagtgttgatgtctttgactcgtatgaatgagcaaacgagaaacataggaacttttccttgcaattcaagaggaaaaacataagaaatttatcccctctttgatttgtacgacaaacattgaaatattggaggatcttgatcctacatgaaaatttccaagaaaggcctttgaacaaagcattaactcccaccattttatttgaaattcctatgaaataaaaatactataaagatattgaagaaaagttagcaaaaaaacttcaacctcatagaaatttcatttgaatatctatcatccgactcgtgggtttttgtgtggtctactcaaacaatcattcctattttttaatctattttgcaatctatattttacacttaacaaaatactaagttatttctatttctctttttttttcaatcttgcgtttcaaagagccctttaagactcctttgaaatactctccctatttcgtattataagtcatttgacttttttttttgttagtcaaacttctttaggtttgaccaactttatagaaaaaaatagcaacatctacaacaccaaattagtttcattaaatttaacaataaatatatttggtaatatatttgttttgtattgaaaatgctagtatatttttctataaacttaatcaaacttaaagaaatttgataaggaaaaagtcaaacgacttataatatgaaacagatagagtataaaattatcagttccaaaccagaatggaactataagtttatcaataaacaaacttggtgtgaaatagatacaaaataaaaagaaagtttcgtgacagcctggtaatgtggaccggagcaatcacctatataccattacctcgcaaactgcatgctacaaacttcatctgttttctaatagataatactattgactttgatctgatgtttaatcattcgttctgttcaaaataaattatagaaatattgtttattttgtttgtgacatattttatcattaaagaatatttaagcatgacttatactttagcatattcacactaattatttaaataatgcgaacagtccaacgttatttcaaaagtcaacgtcatttattaaaatatatattttttgaaaaaaaatacatgctaaatatagacgtgctaggaacttgtataaataggggtgaatgcttttgttacattgcatcggcatgcaaagtggtcagcaggctccttaacaactagctatagctacctgtaggggtgaaaatggtttggaatttttccagattccggacctattttcggaaacggaatcagccggtcggaattttttcggaatttctcagaaacggaatcggaaacggaaataatttttcggaaacggaattgaatatgataatagcagtttccgtcggaactcagaatcggtcggaaaaattccg

SEQ ID NO: 7305 - DNA, 6871 bp, Oryza sativa
  unsure (1)..(6871): unsure at all n locations
nnnnnnnnnnnnnnnnnnnnnnnnnnnnnnnnnnnnnnnnnnnnnnnnnnnnnnnttgcacttatggtccgtttgaaaacaatctggtctagtgtctaggaaaatctttcatacatataaccggctcaaacatcgccctcaccatgggcgtcgccaacgagaacctctccgcgttcgcctccgacccctccgccgtggccaattgggtcaagcagaacgtccaggtctacccgggcgtcaacttccgctacatcgccgtcggcaacgaggttgagagcggcaacacgcagaacgtcctcccggccatgcagaacatgaacagcgcgctctccgctgccggcctcagcaacatcaaggtgtccgtgtcggtgtcccagaagggcgtgctcgccgggtacccgccgtccaatggcatgttctcccccgaagcgacctcgtacatgacgcccatcgcgaagtacctggcgagcaccggcgcgccgctgatggccaacgtctacccctacttcgcctacgtgggcaacctgcgggcccagatcgacgacatcaactacgcgctcttcacgtcgccgggcacggtggtgccggacggcagcaaggcttaccagaaccagttcgacgccatcgtcgacacgttctactccgcgctggagagcgccggcgccgggagcgtcccgatcgtggtgtcggagagcgggtggccgtcggccggcggcacggcggcgagcgccagcaacgcgcagacgtacaaccagaacctgatcaaacacgtcgggcaggggacgcccaagagggccgggagaatcgagatctacattttcggagatggattctaatagcttgagtggacgtccacccgtttactgcatgtcaactaaatggttacgaaatatttttaaaaaaattgacaagatagatcagtatgtaatatatcacttcacaaacatgcaaattcaaattcaacttctacaagttgtaccaaaaataaaaaaatttaactgtaaatatacatatattaatttgagtcttgtttgttatatttgttagaatttgtagaagttgatttttaacttgcatgtttgtggagtgatatattacatatttatctatcttgttcatatttttttaattttttcataaccatttacatgacatacaataaacgggtggacgtccactcgattgagctgttaaaacagttcccgccaatgttcaacgagtacgacaagaaaggcgccgacaccgataagcacttcggcctcttcaacccggatcagttcgcggcctacaccattaatttctaaagagaacagcacttacaggctccatacaattaaggacatcgatgaggaaagcaacgactatatagtactccctctgtcctataatataagggattttgagtttttgtttgtaacgtttgatcactcgtcttattcaaaattttttgaaattattatttattttatttgtgacttactttattatctatagtactttaagcagaacttttcgttttttatatttgccaaaaaaatttaaataagacgagtggtcaaatgttgtaaggaaaaacttaaaatcccttatattgtgggacggagggagtacgtaagttccagttgcatgtttggatttgatcgaataaactgttacgtatatatacgtaacacttgcatgttttggataggctatctgtcatttaatttaagcatgatgtggtaagcttgtttagtcaaggtgcccgcgctgctggacattctcaacatgaacatccctataacgacaataaaatactcggaattacatgctaagaagacaaggaaagatgactgtatggatagaagcagttcaagcccattgagagtttttacagcatgttaattaaggagtacaaggaaaataaaatcctactattcaaaagggggaggacagactcccccaaatctccgacttcctccatcacgcccttgcacgcgtcatcggcggcctcctggtccagagccctcctcaggtccaagtcgggatgcgccggccttacgcacgcgaggacgtggcacgccctggtgtagatcccgttggacgtctcctcaccgatcctagccgcatgcttggaggggatctcctccattgccgtagctagctccgcgagcgaggacatcagcgagaactcgtcagggttcgccgggatggtggtcgtgacgccgcactacccggcgagctggtgtaggccggtgtaagatacccgtagcgagccgcggatctctgacaagttgttctcgagctccgacatccggtgctcgagcccttgtcgctacctttcgttgccggccaccagccccctcatcttcaggaggtcctcgcgggcctccgccagttcacgcgctagcttgtcggcgcgttggttcgccgacgacgccgctgccttggcctcctcgatctcgcagcctacgctgcgagcaccggcctggaggatgcactccatctctgcttggagctccccccaggtgagggcatcggcaggcgggccccgagcaggcacaaggccgacggcgaggctactcggcgtcacctcccggtccttagtagcgaccacgacatctgtcgaagtcgctgcaggggacgtgctggaagtcgaaccagtcccgccttgcgccggcttcgcccgtgccgccctgcgaagagtttcctctctttcatgaagctagttaatcaggactttgtgaatgaaaaaacttcaaaaaatatccacttacttcttgccgatcgtcacaagcctctgccttcgctgaggtggaggagacgcgtccgaggcctaagtgagataggatgatgtgaggctaaatcattccgactacatgctaaagaacaagagaggcttaccaccgggcttggcgccttccgataggtcccgagtacagaggagaatttcctccccttcttcggaacattgctgccactcatggtagcagcagcaatgtcggacgcctccttggtgacgccctccttcaaggacgctgccgcttagtggtccataagtggcccgatgacgtccgtcagagggagagcctgcataacatgaagtcacgacgcgatcctggggaggaagatgtaaaggatacatcgagtacactcacgttgatcgcagcctcgtgttcagccggacccttctcgcaaagggggatcgggatgtcgctcgccgtcgaggcagcgctgatcatcacctggccgacgcggcggttcatggtgtcactgtccagacctgtagatcgagaacagaaactcgataagtcgggagaaacagacatatccaggacaaaatccgaaatacaagaaaaaaaataccccgaggagagacccgggtcgtgtcctctggccccgagtaatcaaaggccggatgggcgggggcctggagcggttggatccgtctacttatgaagtcggcagcgacttcataccccgacaaccctcgagttcggaggttatcgatgatgttgatgaaagactgaagggagggagtcagggcaggtttggcggtccactctgggattttgtctggttgttcttccgggacaacaaggacgggatccgagttttctatctgaagatagaaccatctcgcccgccatttgctacgagaagaggggcactggaaggggatgtaacgcgacttcaggcgatcccaaagtcggaatccaacacatccggataccctattggattccatccagcgcaactcatagtaaaaacggaaaagatcaaggaagggctctaccccaatataggcctcgcaaagataggagaaaatactaaggaatgcgatggagttggggttcaggtgaagcaaagaaaggccataaaagttcaagacaagaagaagaaatttggaaggcggaggaagaaaaccgcaagaaatgtaatcttcgaccgcaaccatacggcccaagatgggttcgggttcaatacctcctaactccctctgcatggtcccgcgaccaggaaggcgccgtcatcttgcaacttcttcagggacgcggtggtggaggtggacttgtcgagatccatcgctgccggaggatcgccggagagtaaagcgaaagaagcaggctagggttttctctgcaggagcggagatgacgaagggcgcttgaagacttgagagttctttggcaaacggacttcaaaatggatccccaaaatccctttaaataaccgcactaccgacggtgcgtattccaaggaaaggagagagattgccgccggaaaattctgggtccgttacgtgtggtagtttttagacttcaatttaaattcattcatgaccattgaacttcatacggcattgtcgataactcttcgtctctacggttctcacaccgagatcgatcagatgagaacgacaacgattccgacatcagaagtcacgattggttacatgagttcatttaagcagaagttgggggctactgtcagggttacggataaggtataccctctatccttagatatgcgttgtatattgatatggcatacccgcgcgtatacggatagtccttgtatgcgttaaagaaatctatcacgagatagaagcggaatccacagatggaaggagtcctactcagacaagattgggtatttgccatatcgtgaggggtctgatatctccgagtcctacttggagatcaactgacccgcgatataaaagggacccctcggcaggacgtaaggcatcgaatcacaccgccaacacatccaccacagcctacgaagccggagcctacaggagccaagtcgccgtgtgatctagtcgaaccaactcgactacgatctcgtcggtattatcgagttccgctattccttctgtaatctgtggtttccattatataatcccataccaattggattagggctattacctgctaaggggtctaaaccagtataattcttgttttctgtttgcttgatgtcgtactacgtagatcctcgtaccagcgtaccccaataccctctatatccggtctacgggtacccactgtcgacaatttgaaaataattcaataataagataaaaaaatccgttggaatatatccatgtgtggttttgttttgaagatttaattgcaacgaatttaattgtgcaatcagatcatgattttgattaaatcatgataaataatttaagagaaaaaatagtttaaattgtttttacacgtatgctgacgtcagcacccgattttacctcctctccacgaggcacccgacggtagtcgcttccggttctttcgtcagctcgacatgcgagatcgatcgagaaggaaataataccagctccgtctgatggcggaagcccggccgtctccctctcgtcgccgtagttaagttgatagtttggaggtggttttcggtaggatgggggttttcgtgtccaaagcaagccatcgtgtgcgaatccggcactggattaacaagctaaactgagacaagagaaccagttttttattgatttctctaagatttctctccgttttctctgttattcacttattccttttccttttttttctatcttttcttaccttttcgttacacttctatttttcagtatttgtctaccttttcaccgtttggcagcctacttaggaatgtttgtatcattttgacccatcattaatgcataggtagaatctctctaccttctcagagtaaaaataaccttcacacgtggtgtagctagctccggccgccgccggcggcccgaaaagcgcaaggagcgagaggaggtgagctgcgcgccaacttgcggacattgtaacgaccctatcccgtcgggtttctgtgaaccgttggatttgaagtttacggtccagataaaccgattcccggacaaacgcaacgatccgattaggcccacaaatcgtaaactaacattgggccatcataattgggcccattagaatttggatagtagccatcgctatgccgtggtaaaagtctaattgaactcactcaattgcctcagtccaattcctatatcccgcaaccttagccttcggcagcagagattgtgagtgagtttgtttcgatttccccacgcacacttcctgaactattaaacggtgtgttctttgtaaaaattttctatacgaaaattgctttaaaaattatattaatccattgagtaaatttcacaaaactacaggtattttgaccaaattatcacaaaactacagatttaaggagttgtatcacaaaactacacatttagcaccaaatttatcacaaaactacaaattttaggttaagtatcacaaaaatgcatatttaatattgaacttatcacaaaactacaacttttagagtttaaatccctagcactattgttatggtggagctataaacattattactttgtaattaaattggttctaaacctgtagttttattataatttagttactaaacgtgtagttttgtgacacttcatcttaaatgtgtagttttgtgataaatttggtgctaaatgtgtagttttataatacaactccttaaatctgtagttctgtgatagtttggtcatagtatctatagttttgtgaaatttactctaaatacaatagttatccactacaggcctacagcatttatatcatcatcgcttaattattttgtctctcacctattccccttttctctttcatccaagccaatcagggaagcccgttcatgctaatttctttatcagtcgacgatatcgtcgataggaaggggccaagccagcgataggagcattggtgcccgggcatgaccgtcgacaaattaatcgacgacgtttctctctcatacttctctttctaccacctaggtataaaaa

SEQ ID NO: 7306 - DNA, 2827 bp, Oryza sativa
gtgtagttttataatacaactccttaaatctgtagttctgtgatagtttggtcatagtatctatagttttgtgaaatttactctaaagacaatagttatccactacaggcctacagcatttatatcatcatcgcttaattattttgtctctcacctattccccttttctctttcatccaagccaatcagggaagcccgttcatgctaatttctttatcagtcgacgatatcgtcgataggaaggcgccaagccagcgataggagcattggtgcccgtgcatgaccgtcgacaaattaatcgacgacgtttctctctcatacttctctttctaccacctaggtataaaaatccaacgcaagcttactacttgtagttgccctaactcgtcgtcttcctcccattttttctacacaaacaacgccttgctggagctaaaatattccacgaaacatggaaactcacctatgttttcctggtgtggtgttcttttctcttgaagatgaagattaagtttttttacgcaaaacgatatggtattaacgtatgattgattgaattttaattattacaaacttgaaacatagattaatatgatattttagagaaactttcatatagaaagttttcgcacgaaaattgcaacgagaatcttaatcttcatccaactcttgttggagaaaagaacgggacatccatttgtgttctgccgctgcatggaaattcttatccattagtagtatttaacagtacacccaacttgagaaaattgcatatctacaatcgcataaacttgcttcgctagaataccagtggtactgtaaattgcattggtggctcatattttgttcttcatgattacaccttgaaatttttgtaccctcgaatttaattgcattccttctcttcactgtttgtgaacgtatgcgtttgtaccatgtttaaaaataaacctcaaagataccatggtccttgcagttatcacaccgcgccgtaaatgaaccttcaagcaaaatagaggacttctttttttcgttgcgagatatagaagttgaatttgaacttgcatgtttgtgtagtgatatatcacatgttaatacatcttcttattttttttataatcatttgagtagaatgcaaataaggatgtgacatcctctcgaggatcaaaatagtctcctcatgaacatataagtcgcgctcaattgttcatgcactgattcattgtcgattagggaaaaaaacattttcttcactttactcatggcataatacactattaattctggaatttgagaatcgcaggcacaccatacgtgctgcacactttattactgattgattatttctactgctctgcttgaagctagcttatttttagtttacagttaattttaaggatgcatacgagcaagagctttcagtagctgctatgtcgatccgatgcagcatctgacttagaaccggatgggatacacgggcgacttgttagggtagaagagcccaaagtttctctcggtgggatccccgttcttctggttctcattgaacatggcgaatatgtacgcctccagtgcccccggcctcttgggcgtgccacgcccgacatggtcgatcagcccctggttgtacgccctcgcattgtccacgctcgccccgaacccttccgccgacggccacccgctcttcgacaccaccaccctcacgttcccggcgccggccttctccagcgcggcgtacacggcgtccatcatggcgtcgaacaggttggtgtaggtgagcccgttgtttgggtccctcaccgtggtgcccggccggaacgtggcgtccctgaggctgatgtcgcgcgggttccccctgtaggcgaagtacgggtacacgttggcgagcagcggcgcgccggtgctcgccaggtagcgcgcgatgtccttcatgtaggcgtccctgaagacgccggcggagggtgggtaggagttggagatgacgtcgaacttcaccgcggtggacgccttgatggcgccgaggcccgacgaggccagggcggagttgacgttgcggatggccgggaggatgctactcgtggcgccgccttccacctcgttgccgacggcgatgtacttgatgttgacggccgggtagtagggcctgacgttgtcgcggacccacgcggccgcgttggaggagctggcggcgaggttggacaactggtcgccgacgtcgaggatgagggcgatgccggagttgcgcagggcgttgagcgcctccttgtcggggtagtagatgcgcatgccgttgatgcccttggacttgtacagctgcaccacctcgctccgcgacgggaggttgttgccgagaacgccatagcacacgccgatggattgcacagctgcatatgcacgacaggataatggacaccgacagcataaagttaggttttccaataaaccatagcagagtacacaatgaacgtgcaccttcgaattatcagagcatgcctagttgaatttcaagtgaaactttgtttgcccaaaaagaattaacccaaagctatagtgtctatctggtccggacattttatttagtttcatctatctatttatctatcttccatatatctatctatatattatctattatattatctagaccagacatgatctattatatatatattggatagtaacataatgataacttgaaacgaagtcaccatattcgctatgtatacctatacattatcatattaataaaataataagatctaagctaattacatcatctaggaccaaattaacggtgtagattaatactccttccgtttcaaaatgt

SEQ ID NO: 7307 - DNA, 1307 bp, Oryza sativa
tgttcattgttctttgtcaggtaagcagcacaacactacctttccatcggttgagaactcagccgaatacctgatccacatcagttactatacacacgcatctcatagaatttcttcagcatggacgtaccacgaattaaacctatggaattatctggaatctgtatgacctggcactaattaagtttttgagatcagatatgggaaatacctgaaaagaaaaaaatattattatatataggaaatcattaaatcatttgtatcctgaatatagaaacccgggttctaatccctccacagaatattatctcgtatacctttttcttccgaatttaatataaatagtcataaaaaaatcttaaaaaaactaacaattgtaggtacagtacatctatcactgcaccaaaaagcaagttcaaattcgacctacacgatgagaaaaaaagagataaattcagctatgaatagtacagagtatttaactatttgccactcttagatttgttgtttaactatttgtcacacatgtgccaatgacatatgagacctcatgtgtatatgacatataggtccaggtggtaaattgttagttgccacaactgagaatgacaaatagttaatatcccgaataataacacaccaccacactactatttatatgttgaagttgtattttttatatcttaatgtataaattgagtttgggtctaaaattttgtgtactgatacatgtatgttatatgaatatatcccatttttttagaatttctttataactatttatatattttttaaacaaaggagagagcatcctctcgagatataaatacagtttcccatccgaatacaatacgctattacagcgcaagcaatcgcgtgaatttgacaactggcgctgatgatgaacgatttcactggaaattgatagggtagactgctgtcttgttagggtagaaggctccaaagttttgctccgtggcttccccgggcttctggttctcgttgaacatggcgaacacgtacgtctcgatcaccccgggccgcttcggcgtccccttcttcgcatgcttaatcaggttctgcacgtaggtccgcgcgatgtcgatcgtggccgagtccccgccggccgacggccacccgctctccgacacgacgatgctgacgcccgccgcgccggccttgtccagcgcggcgtagacggagtcgaccatggcgtcgaacaggttggtgtagaccaggccggtgttggggtcgggcaccgtcgtgccggcttggaacgtggcgtagttgaggctgatgtccttctt

SEQ ID NO: 7308 - DNA, 17178 bp, Oryza sativa
  unsure (1)..(17178): unsure at all n locations
aacggcttgacgttcgcgtcgacccaggacgcgccggacgccgggttggcggcgaggtcgatgaggatgtcgttggcgacgccgacgatgaggccgatgcctgtgccgcgcagggcgttcatggcctcgacgtcgggcaagtagatgcgcatgtctgtgatgccattggatttgtagagctgcacgacgtcgctcttcgacgggagatcgttgccgatcatgccgtagcacacaccaacggattgcacgcctgcaccacatgtatttcattcagacagaaagcatcagtacaagctctgatctttaatttgtttctacctacccaaatggacctaagatctctttggacaagtacaaagtttttgcagaaatttcgtcggaaatagttcagtccttataatttttttttcaaaattcttatgtttcaaacaatgggaaactattttaaacttttgacgagacataccctcattgtctacatgtcatctaaatagttataaaaaatttaaaaaattcaatcagatagattaatatcaacaatacatatatcaatattcaatagtacaggcgaatcacgtacctacagggattgagataaaaactccaagaagcagcaatgcagctgcaaaaaccagggagaaacctcgtatattcaccatctcttgtggtctcaaacctagagagatgtaacaaatgtggcgtattctgtacctagaccacctatagttcacttggtttctggatgtaatttacagagttcaaagcagagcagcttgatttatactggtactcagcaagcagatgaatgtgtgaattgttccggataaactataaacactcagcatgcagatgagactgaataggttcccgataagctgcaaaccatagtgccagaaaatcaaaattccaaatgtcaagacataaatacgggatgatgaatctgacctctcaaggaatccaaccaatgttcatgatgaatttgattagcaaatcctctattgctttatttgactggtgtaattattttattttcattttttcctttatctccttgcttatgtggtggctggcgaactaatcttgttatatgtggctccaggaaagttgccactttgaaatagagtttgtgggtcatcctcattttggtcggaaaattggatcgacgttcgaacaacagattgtggtgatgttctttgggggtgaacaacagattgtggtgatgttctttgggggtgaaaaccctaatctagtattccgacaacgttgaaatttcttcatcggctccctgttaaagatgttgcttcttgagctaagtctttgggacgaatatcttgtatagccctttctagtcacaatcgtcattcgacatactttttttcatctcaaaatagagctatttttagctatgaacatagacaaaaacttgtctaaattcatattaaatgtacgacaaagaacatatttttttataaaaagtgttgtacgagagagcaccttcaatcggacctcatgtcatggttcaaattgtttaatgaaagcccccaacttcaaagaagaagaagaagcaggttgtcacaaaggcagcgtgacacaatcaaattgttttaagttttttcattccctttttgcctttgtcagataatattacttccatttatcattttatccaaaaatactatagtacaacaatggtttaatgatgtggaggaaaaggaaatacctcctccggtcattaatatataccgtttataccatcgtactccctccatcccaaaatataagtgatttttagacggatgggacacatagtcctatgaatctggacatgctccctattcagattcatagtactaggaagtgtcacattcattcaaaatcccttatatttagggacggagagagtacatgtagtatatagaatcaaattattcattacacgaatttatttgagacagctaaatacgacaacttgtttatgtgttatctagatgtaacgtacaaatattatatagatcgaccatgtgcaaattagtctgttccaaaagttaccgtgcattcctacctttccaaatccaaccaaaatattcgttaaccaaatgttacaattgaaacatgagcttgtttaaaagtacatatgtgcacatgtggtgggtgagtgttcaacgactgttcatgttcaacatctggcacatacaaattctaacagattttgattcgtaagcaccagattaagcacatgatatatactgtacgacgtagtacatattccgtattggagtaatttttcagaaagtgattgggtaaaccggtgtcttgtcttggattgaacagcccaaacttcttctccgtggcgtcgccttccttccggttctcgttgaacaaggcgaacacgtacacctccatctgcccgggcttcttcggcgtgccttgggcgacgtggtcgatcagattctggttgtacgcccgcgcgttctccacggtggcccccttcccgccgtccgacggccacccgctctccgacaccacgacgtcgacgacgctgcttccgccgccgctcaccttctccaccgcggcgcggacggcgtcgaccatggcgtcgaagaggttcgtgtagctcagcccgccgccgttggggtcgctcaccgtggtcgagctcggctggaagagcgcgtagctgaggtcgatgtcctggctgtccctgtacgcgaagtaggggtacacgttggccaggagcggcgcgccgttgccggtgaggaacctcacgatgggctccatgacggatgggttggtgaacacgccggcggacggcggcgatgaggcggcgagcgtgtccatcttgatggcggtggtcaccttgatgctgtccgcgaggcctgcggacgcgagggcggcctggacgttctgcatggccgggaggatgctcgccgcgtcgccggtgccggtgagctcgttgccgacgacgatgtacttgatcttgacgtccgggtagtaagccttcacgttgtcctggacccaggagtccgcgttggccgcgagctggccgacgtcgttccgttcgccgacgtcgagggcgaggtcgatgcccgagccgcgcagggcgtcgagggcctcgcggtcggcggagtagatgcgcatggcgccgatgccgttggacttgtagagctgcacgacgttgctccgcgacgggaggccgtcgccgttcatgccgtagcacacgccgatggatcgcatgctgcaccaaatctcagcatacgcacgcacaagcgtacgggttcagtgacaacgagcacagtatcgcacggtaggcttgacatatgtggccagatgactagttttcgggtaagcactcaattcatccagatccaaattaaatcgtaaatttgacattatcatactgatgtccactaattttaggacaagtacttacgatttacaaaggtgtgacgagaaaaacgagctaatgcatactgcacgccaaaatctagagtcaacggctatgaataattttgttaactacagttggagatttacaaatagacttgaataaaagtttcttctttagtgttgctattattagtttttcatcttcatgtcttaggttttatgagctctcttttaagccagttatataataagtggctataacttcttttttaagggaagctataactttataaaacacaagcaggaatacatttacattatctttaaaaaaaaacttagtacttacgacctacatataacgaagcttagcaatatgtgtacctgaaggaaaggaggcgaaggctgcaatggccaaagccgctgcaagcacaggaacaacgccttgcatagacatcttctgctgctactagtttgatctgttgcacttgaactcgatctggatgtaagaaaatgcaacgctgcaagcttgcttttatagtcacgctgctcggaatttccaggcgaagactggacaagatcaatacaaatgggattgacatacgttcatttactgttcattcgtcaccacataaacaagctccgtgtttttttttcctttcctcctgggttagccaaccccgtcgcacacgggtgagtgcagagtagatacacctctgcagacttaagagctcaagtcaaaataagccgctacttgttggacggttctggctaaaatcttccaatgctttgttcaaaaaaaaaatctaccaatgccaacctctgaatccttcttgaccacacacgtacacacgctaatttggaactccaagactacccggcacatcacggcatagagtactcagtacagtgaggctcatgaaagtttaaagttgagggaatgaccctcgatgttgtactgaagtatcgttgtttgagggaatggccctcgatgtgcttaaaatttgtcaaattacaacaggctgaggaaaacaaattgcattgcagaaaaatatcctgtaaatatatgatacaacagctgtgatcttactgaacaaacaaagctcataggggcagtcatccatacctcatgtcataacagtagtgagctatttgcctgatggtgggatgagattacaaggctaacaaaagattagcctctctaattggttgtcgatcccttaactgcacttcaagtaataaatgatatttttagactcttcaatgatgccccaactgtacactgtaatttccttctgagtttcgcacctgcttgctagtatacaagataaccagaataagtccttcagtttgtcacctttcaaagaattgtctcctcatggtaccgcagatttcatccgccacagcagcattttcacgtaggaatttctcagcttctgccttgtttggaaggaactcaccattgatccaatacccagaatcatccttcataataaccccaagggaagaagccagctccaggatctctgattcgtagcagatccccttcccaaatctgatgtcaatgccagcttccttcagagttgctggagctaatttgttcttgattatctgcactgatataccgatgccagtagcctgaaatggcagaattttcttaattgcatatttacaaatgctgtacactttacctagaataatgcgcgctcttgtctagtgctagtattctaaggagggaaccggagaagggaaatgagaagcatgaaaagttatgtacaatacctgggcctcattgtagcgtaattcccttcttgaagtcctcattctgactgcagcatagaatcctaatgcattgccgccacaagctacctccttgaagattccaggagtctgatttgagctcaactttgttctaacctgcaaacattagcaatcagaagctctaaataagttaggcagcatcaacactaaacgatattgaagtatgccatcctggttagtgcaaaaaaagcaatcatcccaaacctgattaacaaaaataatcagcgtttcagagcgacttagtgtgtgctgaatttttcgaagtgcccgagtcatcaagcgggactgcacatcttcagaattcatatatatttcaccttcaagttcacatctgggaataagtgctgcaacctgtcagaagtccagtaaaagcaaggtaaacaaatatgtagcaaagcacaagatatcaaatacatattagaaaaatggatgtcctgacagtatgacagtgctaaagagcatcagaagtgaatagcagtccaattttcaaatttagtaactacttatccaagtattaggcctgtcatagtagggaatgcataaaattttaataagccaataaggaatcaaatagaagagaaaaaactaatccaaactgacattgcggaagaaacatacactatcgacaacaacaacatcaattgatccaccaacaagagtgttcactatgctcaaagaattttcagcagagtcaggttgggctatcaggagcttttcaacgtttacaccaatggcttcggcaacagaagggttaaaagcattttctgcatcaatataagcacagcagcctgcaaatagtcccagtcacaactccaatcatataatgtaaaatttagaagaagggtatactccaaaaagaacagcaaggaccataaacaaatacagacctcctttcttttgcgcttccttgacaacatgaagggcgagtgttgtcttcccagaggcctcttttccaaataattcaaccattctaccctgttaaatatctacaataattttcaaacagcacaactaaaagcagtgttcaaaacagtatgccactacactcactgatcatatcaatcaaggtaagcctgcagttttaactctaaacatatatgctatcaagaaaaaaaaaaggatggatgatatggacacatttgacagaagtaaagctaagcaagatatgggcatcagttctacctataaatatatttcctaatcagaaataccatagacaaaatgcaattttttgttgtccagcaagaaggaaaatactgccatcaacaaatagtattttcacaactaaagaagagggcttttggcactaatttaactagttcaacacatcatggagatttcattggattaacacaaaagggaaattagacatcaaaagatgaaaagccccacatgacacatttgacttttagagttcccattgcaacaaaatagtgaactaaggccgtgtttagtttcccccctattcccaactttccatcacatcataccacatcaaaaactttcctacacacataaacttccaactttttttccaaactcccaactttcttcaaacttccaacttttttcaggaactaaacacaccctaactgaacaataacaccatgcagaagacttatttgaactttgatccttatgtgttatatcagaaatatatgatttaggaccaaggtaatatcatatggaatgatatagtgataaagagtaatgatatcattggaatactaaatatctagaattctagatctggacaatatgaaagcacatcatgacctttggtaatccaccaatgccaagagcaatatcaagcttaagagaaccagtggagatcacaggtgtgcgccttgtgcgggagaaccgctccaaacataaattagattctctatcaaaatcacttgcgagttgagagacagcgacacttagtgtcgactctttctcgagaacttttacaccatcgagtgggggatcagtctcatagtctaattgcacatcaactgaaaagaatcatatcattagaaggaaaaaagaaatgaaatgtttgtacggcagaaactgtgagtattgataataagtggacaaacattgagcatacctgaggttgacatcgaacaactttttgataagaaccaacaaaatctgtcgtttatccaattctagcaaatcacagggaagtaaagatggactgcattacttcgtagttcaaatatttgacacatatatcataaattcaagaaaaataaagcgttccagatcttaatgttttaagagcggcaagctgtgaaccaaacatcacatacattataagtgttttttcattaacaacttgagctgaacatatctgtgttccgtattattgtcagaatggaagaaaaaaaatgaaatccaacgtttgttggaacacttgacagaacacaaaaggcagaaccatactacactgcgcagagctcattttctcctcacacactcacaacccactcactgactcacatcggtacttacgggcaaaaacctggagccgcctaagtgaaacgctaataccctcgctctttttaatcccctgagtttcaaattcccacaaattcagtctaaaacgcaaaatcaatcaacaccacacttggataccccctcttctaaatctatctcaagctggaaagagggccttagagatggggaagtattcgagggcgtacctggaggggaaagcggcggagaggagaggacacgggaggcgcgccattacagaagcccgcgccggagaggttggcacgggcggcagatctccggaggagagcggaggaggctacgagagctcgcatggaggctgggcagggaagcgcacacggctgggcggcggggcagtcgcaagcgaagggggcgggggcgccgccgcgccgggagcaggcgccgccggtggtggaggattcgaacgcgccgccacacgcgaagccgttgcaagcgggaggggaagaacccgccgtcgcgtactcgcgtatagccgccgcccgccgcgccctccggacgaggggaaagaagagggcggcaataaaaactgggccgaacagcgctacactattgggtcgcctcgcaacggtggcccattactctatgacggctcggcccaacaggaaaacaccgtgctcgcccagtccacggccctgttttgcagagcttaacagtctcatcttggcttatatttatgcttatcataagtaaggggactatccggtaaaaatgagctaagtattaaaaactcgtgaaaatcatgcctaaaagttttgtaaattcataaaaaaaatactagggataggtgtagatatgaaatacattctcaccaaatctcaagttcaaacttaacttcgtttaggagtaacaaaaaagacaaatttcaggtgaatagtaacaggacactgttcacctgaaatttgtctttttttttctcataaacgaacttgggtttggagttgaaatttggtgagaatgtattttatatctacacttatctctattatttttttcataaatttacgaaacttttaggtatgattttcacgagttttcaacatttaactcattttcaccggatatgtcctcagtaagtaaaactttaaattttcgaacttagatttagagctaactagctaggtggcccgcgcaattgcgcggctagtacccacaaaattatctatttttacacacgattctacttaaaatttattaaaatattcatctcgctgtcttagaactttcaaggatcgaacattatcatccatgtgtttctaatttcatagtttttaaaattcacatccgttgctatccttactcctttgtcacccctttatttgttgcacggctaacacccatccaaaattatctatttttaaacatggttttatttaattttgttaaatagccatctagccgatcttaaaagattgaatcttattatcatcgggttagttttcgaaagtcaataagtcgccaccccttacttttttgccgctcatttatttgattgtccgacatgtcacaacttttattcatcctatttggaactttcatatttagatcttatagtttttgtagttcattttcttgtcagttgcatatttatatttttagaagttacatgaaatgtcaccattgtactgctctacaatccacccgatgtctcgtcttaattgtcattggaatttaaaaagtcaaatatgatgttatgattatcgttggtgtttttttttttactttttagaagttccgtcaaacgtcacgattgcgctccttgacggcttgcccgctgttgtttcttttaatcgtcgttgagatttttaaaatagaacctaatcgtcatttgattttgttttattgttttttaaatatcccatcaaccgctacaccttattcatttatggctcacccgttatcccttcctctttgttgtcatttaccattgttgtggtacggttgttcttttaatatttctttatttttattttgaacttttgttattcataaattgtattctttcttaaacttttgtttttatttttataatttcgtaatttattttttttaattttaattaatcacatgttgtgttatagatgcttttttcttttcatagtctttattattttctttcgaatttagttatttataaatcatctgaattgttgggtgtatatttggtgattaaaaaggatcaaatagataaagagacagtcgcttcattttttattggcaacaaatatttcaaagtatgttctaagtagttttgaagtgattatagactgaaaaaataatacttacatgagcacacgtatatatatggctttctgcctacctagttcctgttgcttttttttcccacctagaatcaaacctataacagttttgaaattggatctcaatttatccgtcgagcagagcagggccgctttgtactcctgtattagcactacaactctaattcctatattcctatatacgtgttatatctcaatcgttaaattatgaacgttaaattgtgaatccactataatctaaccgtttaatctgactgtcattaatccatctcctgtgaaaaatatacactaattacaatatgtcgatatcatttgtactttcataaacatcaaagaaacttttggtgtttgatgcattgccggctacaagtattgatctatttattctaatgtctatctaaatatcatgtctttttactatgattggctcccgctaccattgggttcaagcccaatctttgctgcttgaaatctacagaatatatatgtgcagcagtgcaagcttttgtatatttggcagcacaaatcttgcccgtgtaggtttgtaattgaattagattatacgtgtactgtgtacaccgctaaagaaacagaaaggacaaagactcctagtatgtaacgtacacaatacagatctatggacttatcttttctcctacaaatctagaccgttaaaatttagaattgtaatcaatggttttattaatctcgtattgggttcttatatggacacctcttttaatattgcttatttttaattccgaatttcagttattttttagattgtatttttacttggactctccttttctttttcttcgattaatatgggaatttctagcctccacagcgaacgtagtgccttcttttcgagctatcttaataatataatagatagattttggggtttttcatcaaagtttatttttcagactttgtttatattgctaagaacacttatataaaagttttatttacaaattattttctgtttgcaaatatgtcatttcgcttattccgtcaataagagaaacgatagagtcctaagcttcttataagcagttagtgataatctagagaagctggcaaacccagtttctgatttcgagtttattttctagattctacaactacaacttttcaaaatatatgtgaaaatctaaattgtttgatggagtttctggcagctgaagattatagcagaagctacagctactgaaatttccctagacaggcccctcgcatcgcacgttgctgcgctcttcaaccgttcaaaaaagttttttttaaaaaaaacatttttttcaaaataaaaaggataaaaaaagaaaaccggaatggtggataactgctgaacgactacaattgcacgtatagattacacaatataaaagtgtggttccatatttccactgactcgctgactaacaacacgataccatacttgtcaacaatgcgtgtcaacattcgtgatgggcccttggaaccagaagcgggcacgtagcacccacgcaccaacactgagcaataacacgccgccgacggccaccggagtgtagttgaatgtctccttgttggccaccgggtacgccaccggcagcgagaagagcaccgtgacggtggccacccacaccacacccgcccagccgacgacgaccccgtatcgcccgaggtggaacggccctggcacgaacgatctccgagccgtcgtcacgcggaagaacacgggcagcgcgtacgcgatgtacatccccagcgtcgcgatcgaacccatcgcctggaacgccacctggctccccagcgactgcaccggcaaaaggcagagaaggcgtcgtcatcacgcgcactcaccgtgaatcaccggagcagcaatgcgaatgcaaatgcaactcaccgtgagagccatgacgaacgccacggcgacgccgagccagacgacgttgaggggcacctcgtgcttgttcacccggtaccacacgcgcgacaacggcatcgccccgtctctggagaaggcgtacgccatcctgcacaaacaacgagtatgtatatagcactttgagcaattcaatcgatcatcagggattcagggcgacgtgatgctagctctgtcacgcacctcgaattgctggtgacgcacgcgatgccgcagaggaagacggcgacggcgacggctcccaagcagacgatccctccaactccgctgccgtatctccggtggaaggcggtgtacagagcctgcgcgatggcgtagccgccggcgtcgttgctggggctgagcaggtacgggatgtccgtcacgacagatgtcagagccaacaggtaaatccaaccaaacaccgtcgcgaaaagaaccgaggtgatgatcccaattgggccgctccggtctgcattctttgtctcctcaacctgcatgcatcgtcagttaatcactgccacactaccgtctgtcaatgctcattcagatatctgcaacctgagggacagcaggattaacttaccatgtgagcagatgtatcgtagccgataacagagtactggctcatcagcaagcccacggctaggatgtaagccttgtcatggatccccatgccgttttccgtgttgagatgggtaaacacgaactcaatatttggcctgtcctttgctactgctggaatcaagatcgtcagcacaaagatacctgttgattgtttcagacagataaattcagggttcagaattcagatgcctagaaccgatagaactcacttcattgtgtacctgcagcattccagatggctccgacatggccaaacagagatagccactcgatagggaggctgttgatgatgccatgcaagattaggatgaaggcataaatcgccagcacggtgtacttggaagccatgtaaccgccgccattgcctcctcctgtgctaagcaagatgatcacttgtagcagctgcgccaacgagaaatctacgcttgcaatagctgcccactgccacaacaattgaagacaagtacaaggccaacgacgatgcaattatagtctgcaactgaaaaaaaacaatccccaagattatccaagttgacaatggcaagtgtacctgtcccacaacgttgaacctgtcgaacacaaaaaaaagacagaattcaagtaggcaccatctcaaggcaagaattgcatctgacaattttgcattagcacgtaccagccagtgacccaggaagccaaggaagcccattgtttgccggccagcttggcgctccagtagtatagcccgccggaagtcgggtacgccgagcagatctcggccatggacagggcgacgcagcagttgaacaccgccaccaccaaccatcccaacgtcatggacaccggcccgccgtaccgcagcccggtgttgtacgtcgtcgtcacccccatcatcacggagatgttggcgaaggagaaggcaaagttggacagtgccctgtacgcagattagttgtgaaaagagtcttgtgactggaagatccaaaatgcatgcttaattgctaatcaagaactagtctgaacaaattaaacacaagcaagcatatgcgtctatacgagaggccacgcttgagctcctgcttgtagccgagctggtgaagccggagactgtccggatcgacttgatcgccggcggccaccgccaattggacggagcgagacatggcctggatctctagatcctctaccttgggaagaagctttcacctctgttgctcactagtcgcgctatgctgcagtttacatgctcagacagctcagtgtaactagtcaagtttccgaaagagaatagtccaagtatctgtcatgtatgattcgcgagtcaacaaaatggttggaaattttgtaccactgattcactgatctgcccatgtcacgatttcctttcgtattacacgccaatgttgactcagaaaatataggatatatatacgtcacgttagtactacttctaatcacggttcatgttaaactatgcttgaatgggtgcatgcatgcttttttttcagtacagtttttgtccccacgcctgtccttttctaataaaatcagccggatcttagaccgttgaagttttcaaatttgcatccaataaaaatgtgaatccaatgaaggttatgtttggcaagagctagagtcagccaaaacgttttaatttcatctaaaatgtgagtgaagctggtggaacattctcacaaaatgaattagagatatactttagacccagaatggtaaatttaagagttgagactctaacaaatactaagccctaaagaacgacctcttattgggcccacttatgggcctccaagcaaggctacacatcagcgggcccatacttttctaggccgtcaaatcgggccgtcactagtgttggtaatgggcccttggaaccagaaccgagcatggagcacccacgcgccgacgctgagcagcaacacgccgccgacggccaccggagtgtagttgaacgtctccttattggcgaccgggtacgccaccggcagcgagaagagcaccgtgacggtggccacccacaccacacccacccagccgacgagaaccccgtactttccgaggttgaacggccctggcacgaacgatctccgcgccgtcgtcacgcggaaaaacacaggcagcgcgtacgcgatgtacatccccagcgtcgcgatcgagcccaacgcctggaacgccacctggctccccagcgactgccaaaaaaacaacaaaattagcgcaccgtgtcagagcagcgcacgcaggaggaacagaagcagcaacgcgtgcaactcggaatataataattcaccgtgagagccatgaagaaggccacggcgacggcgagccagacgacgttgagaggcacctcgtgcttgttcaccctgtaccacacgcgcgacaacggcatcgcgccatccctggagaaagcatacgccatcctacagaaacccgacatgtaaatcaccaactcgacacgatgattcgatgaacagctagctgtggaatcatcagatcgatcgacgcgatgtgagcccgtcaccttgagttgctggtgacgcacgcgatgccgcagaggaagatggcgacggcgacagctcccaggcaggcgatcccgccagcgccgctgccgaacctccggtggaaggcggtgtacagagcttgcgcgatggcgtagccgccggcgtcgttgccggggctgagcaggtacgggatgtccgtcacggcagtcgtcagagccaacaggtagatccacccgaacaccgtcgcgcaaacaaccgacgtgatgatcccaattggcccgctccgatctgcattctttgtctcctcaacctgcatacacgcatcatcagctcgtcactgtgacactgtgttctatccatattcagttatgctcattcagatatctgcagcctgacaggagtagaggactcgtttaccatgtgagcggatgtatcgtagccgagcacggagtactggctcatcagcaatcccacggctaggatgtaagccttgctatggatccccatgccgttgtccgtgttgagatgggtaaacacgaactcaacacttggcctgtcctttgctactgccgggatcaggatcaccagaacaaagacacctatcattgttgattgttcagacagataaatttcgttcagggttcaatattcagacttcagatgccaagaaccacaattcataaggactggtgattattgcctccatgtgtaccatgcacctgcagcattccagatggccccgatttggccaaacagagatagccactggatagggaggctgttgatgacgccatgaaggattaggatgacggcgcaaatcaccaacacgacatactttgaagccatgtagccgccgccattggctcctcccgtgctaagcaagatgatcacctgtagcagctgcgccagcgagaagtctacgctcgcaatagctgcccactgccacaacagttgaagacaaggacagggcaacaatgcaaatttttttctcgaaaaatgaagttataagctggagctaaaaacagtatctagatccaccagacaatggtagtatacctgtccaacgatattgaacctgtcgaacacacaacacaataacaaattcaggctcgcaaattaagttgaacaacagcatacatgcataatccacagcaacaaatattcaaaatagtaatgatcaaacataatcttcaagaaggcaccatctcaagacaacaattttttttcaaggatatcaagaaaacaattgcacctaaccattttggattagttccagtgcataaagacaggggaaattgatgcagactagctcatacatgtctcacgtaccagccagtgacccaagaagccagggacgcccattccttgccggccagcttggcgctccagtagtagaggccaccggaggtcgggtacgccgagcaaatctcggccatggacagggcgacgcagccgttgaacagcgccaccaccagccaccccagcgtcatcgacaccggcccgccgtagcgcagccccgtgttgtaggtcgccgtgacgcccgtcagcaccgagatgttggcgaacgagaaggcgaaattcgacagggtcctgtgtgtatatatatccagatgaatcgatcaagatggtcttagttttgaaaagaatgaactaattagcacggtgaatgcatgctaagtctgaataaactgaaacttgttgtgtgcatacgagaggccacgcttgagctcctgcttgtagccgagctggagaagcccgaggctgtccgggtcgtcggcggcctgatcgccggcggccatcgctaattggacggagcgagacatggccgtggatcagttctctatctcctgtaggctgtttcctgggaggctagctatttttgacgctatcacctccatagctcactaatcctgcagagtatagtttacatgctcgctgtactagtcaacttcccaaaaaagaaatgtccaagtacgtacctctctcttatatataattcataatcaacgaaatggttggaaattttgtataccactgatgattgattgatacgcttatgtcacgattttcctgtannnnnnnnnnnnnnnnnnnnnnnnnnnnnnnnnnnnnnnnnnnnnnnnnnnnnnnnnnn

SEQ ID NO: 7309 - DNA, 5724 bp, Oryza sativa
cacgcatgctgcttttttagtatagttctgtacctcatgcctgtctttttctaacataatcagccgaatcgtagaccgttgaatttccatccaaggacatgggaatacgaatcaaaataaagaacggcctcttactgggccgcccaacaaggctacatgtacgtgggcttccttgtcagccgtagaactccatgggccgtagcacacatgcatcggcccatacagttatgggccgtcacagcgggccgtcattagtgttagtaatgggcccttggaaccagaagcgggcacggagagcccacgcgccgacggtgagcagcagcacgccgccgacggccaccggcgtgtagttgaacgtctcctccgccaccgggtacgccaccggcagcgagaagagcacggtgacggcggccacccagagcacggcggcccagccgacgacgatcccgtacttgccaaggtgaaacggccccggaacgaaggatcccctcgccgtcgtcacccggaagaagatcggcagcgcgtaggagatgcagagccctatcgtcgcgatggacaccattgcttggaatgccacctggcttcccagcgactgtcataaaaataaagcataattctggttattctgaactgagaatcaagcatgaaaattaatcagcagtggtacgaattaactcactgtcagagccatgatgaacgccaccaccacagagagccatacggcgtttataggcacctcttgcttgttcactcggtgccagactttcgagaacggcattgctccgtccctggagaacgcatacgccatcctgcatgcagtggctaattaacctaggaaattatcaacatgtacgtagctaattaagctaagctaaattcctgaacacgtcagctgatcgatcgatctgacctcgagttgctagtgatgcaggcgaggccgcagaggaagacggcgacagcgacgactcccaagcagaggatccctcccaggccgctgccgtatctccggtggaaagtggtgtagaaagcttgagcaaccgcgttgccgccggcgtcgttgtcggggctcaacaggtagggaatgtccgtcaccgccgacgtgagtgacactatgtagatccacccgaacacggtcgagagagcaaccgaggttacgatcccgatcgggccactccaatctgcattcttcgtttcctctgtctgatgcatagaatgatatactgtcagagtgtcagtagtatttgcagtttagatatggactactgtgtctaggggcgaaatcgcaacgtaccatatgagcagatgtgtcgtagccggccatcgcgtactggctcatcaacaacccgatgagtaaaatgtaagccttgtcgcgtatccccatgccgttttctgtgttgaagtgagtgaaaatgaactcaacgctcgccctttccgtggcgacagccgggatcaaggccaccagcacaaagacacctagcaaacgaagaacaatagagtgatgatggaatcgatggtgacttaataaggagatcgattgcaagaggaggaaaaaaaaataatttcattacctgccgcattccaaaaagctccaagctggccgaaccaagagaggcactggatcgggaggctgttgatagcgccgtggatgacgagcatggcgccgtagatggcgagcacgacgtagttggaggccatgtagccaccgccgttggctccaccggtgctgagcaagacgatcacctggaccaactgcgccaacgcgaagtccacgctcgtggtagcggcccactatgtcatcaagagatccatatagcgtcagcccactgttaggcttttctgtacggaataagttcacattgagtccctctatttgtcactcagtccgattttcgttcttgaccgcaaaaccgggtatgacccatcccccaacttacaaaaaccgtgtagacgaggtccctcagcggttttgaaggtgattttggctgatgtggcgactacgtggcttgtttgactagatattcgtcccacgtggcattgacgtggcgcttacgtggcaattatatctcgaaaaaataataaaaaacatgggacccgcatgtcagctaaaaataataattttaaaatggtggcccacatgtcagctactcctcccttcttccccctcccttctctctcatattcatcgtcctctcttcttcatgtgcgcagggggaaggaggcgaggcggggcgacgcatcccccacaccgacaccacccccagcgcgccgccaccgccggcatcttcgtcttcctcctcgccgccgctgctgccgccagcatcttcgtcttcctcctcgccgccgccgcggcaatcgcggcaagcaggccggcgacgacgacgtggagatggccgaggggaggaacaacaaggtcgccgacggcggcagcgccgatgactcgacgaccagcggcaaggcggacaccaaggggtagctctggcgtctcagtcaatccatgagcgatcgagtagctcagtagcatgcaatcggctaagatttcctgcatgtgttctagtactacaagtaataatattagctagcctaaaaggctaaaacacataacgtgcataaaaggaaagtactatcctaactgaataaaacagcttttgcaggcacaagtttaacataatatgtctgctttgatctttatttggaagttgtaattaaccatgtttgtaataacgagataattaaacgagagtatccatgtgtcaagaggtcaagcgtgacctctcccacaccgtccatggcttccccgccgatgagcaccacgtccgggaggtgattgcgctcacgctccactcccgcgcctgcgtcgcgtcgctgtcacgctgcctgggcgtcacgctcaagatgctggtgctcgtccaccgcctcctcgccgacggcgacccggcgttcgagcaggaggtgttctacgccatgcgccggggcacccgctccgtccacccccgcccccccagcgccgccacgccgtcgcccgctccagccagcctcctcgtcgctcggccgccgtgcgccgttccagccggcctcctcgtcgctccgccgcccatgagcgggagagagacaagagggagagagaggggacagagagaagaggttgtgaggatgacgtgtgggtccacatgggcccaccttttttattaatttgtgtgtgcaactgacatgtgggccccataagttttattatttttttgggatctaattgccccatcagcgccacgtcaataacacgttggacaaaaatctagtcaaaagaagccacgtcggtgccacctcagccaaaaccagagtcaaatactgccgagggaatttaaacggtttcgtaagttaggggatccgtcgtacccggttttgtgattaagggacgaaaatcggactgggcaacaaataaagggacccaaagtgaacttattcctttctgtactcatggcccaataaaaaggcccatcaattagcgagaagcccgggcccagaaatccgaatgtacctacctgtcccgtgatgttaaacctgcaaagcagaacacaaggaatgaaaaacagaacaagagataaaggtctttctctctttttttctttttgagaaaataaaggtctcttttggaatgtgcgagttttacaagatttttatatacgatcgatcaatttccgcgaaaatcctataaaaatatcctattttaaacgaagcctaaaagatgctggagtatgaaatttttgcaaggctttcctcatttcttggaacgagaagttcatgagagacggacaattcacaatacatacacgtactcaccagccagtgatccaagaagcaaagggagcccagtcgttgccggcgagcttggcactccagtagtagaggccaccggaggtcgggtaggcggagcagatctcggccatggacagggccatgcagccgttgaaggcggacacgacgagccacccgagcgtcatggacaccggcccgccgtagcggagccccgtgctgtacgtcgtcgtcacaccggccatcacggagatgatggagaaggagaaggcgaagttggagagaacactagctcacgaaggccaaaaacaattaaccaaagatgccaatgaacagtagtagtttgcgaggcttcgcatggtaaattcataagataagctgctccttacgagaggccgcgcttcagctcttgcttgtagccgagctgccgcagccgaattttatctcgatcgccatcgccggccggatcggcgggcacggccacctcgacggagcgagagagcgccatctgtatcgtgcttcctttgcagtagatttgcaaaaactttacaggctcagtgcatggtactagtgtctggtttaggcagtagcttctctacgatggaagaatcaagatgtggatggggatattatttgattgggtaggatagtagcaaaatttaaccgtcgcctttcatttccggacaataatgcaaattgctttgatatttttggattgtttcagcttgtgcattaattggtcttcagctcttcgatgtataccggatccctcgctgtctctgatcgatctgtttgttcacacctgtgtggcgggcgcggaggaaaaactccgaggaaaagcccatgaaattgatgagtcctcggcctattaggcccaataaacaccacaagaatatcttggggaaaaagtacacccaaggtccctcaacttgtcatcgggttacaaaaacatccccaaaccacaaaaccagatatacaacgtctctcaacttacaaaaccgttcgttttgggttcttcagtggtttttaaccctggttttatccaacgtgacggctgagtcagcgtaggacccacatatcagggtgccacgtcatcatctctttcctctcctttcccttcctcccctcccccccgggtatttaactatttgccacttttagatttgtcaattaactatttgtcacgtctatctcaatgacatatgggtccacatatgtctataacatatggatccagttagtttccacatctaaaagtggtatataattcagtatctcccccccccccccctccccctcacttttctgctctcgcagggtcgggaggaggtcgccggtgacgtgggagaaggggagggcggcggcagcggcggactctggtgtctacgccaccgagcgccaccgtcgctcttctcctctgccggccaccggctctgtagcatgatgaaggggaagggcatcctcaagccgaggcgcctaggatgcggcagcaaggacggcgacaagggttgtgcagcggcctcctaggattcggtggagatagcgtggcggcggtggaccaacggaggccgcgccacaggcagagcggggtggaggcggtccaggtggccagctgcgtgttcccgccttccctccgcagcgctggcttcacgcactgcaggaggagcgccacgtccaagttgccctcgcctgcaattcccccggcccccgcagagactaggaggcagcaaatcatgagacgcatcatcgatctcatctgcttgcttgaattgcgttggggcagagcatgtgaacacactggactggagcagtggagtgaaagagtgtgcaagtgaatcgagtgagaaccactcttaatactcaagggagggaagtgatgactgattgactgctccctctactgctgctcgttcgttc

SEQ ID NO: 7310 - DNA, 1253 bp, Oryza sativa
gccggcggagcagacggggcgcgggcgtgcagcagatgaccgggcgtgcggcagacggcgaaggttggcgtcggcgtgggcgaagcgaatgaccgggtgggactcgcgggcggcgatgtcgaccccgcggaggtggacgcgacgcggtcggggtaggcccagtggtcgagacggtagaagaagagcggcatggggtggcgggagcaatggcgctggtgcttggtggtcgcggtgaaaggcgtccgtggcgatgaggtcgtgcagacgccgctgcagcaggccacctcggcggcctgcttgcaatcaaaataacaaagtattaccgtttgttatggacaaaagcatgaaattttattcagaatagctcatgattgtaatgttaccacattctgttcactcatagcacaaattgactctgcagtgcacacttactaacaaaatacagtaggcaatttcattgattttatccatgcagtttgcattgtttttttatcaacaacatctgtttggttctgcttttattttgaacattaacaggctaactctaactcatatacaatgtcaggccatggtggcagcgatggtctacatggtgatgtgccttcactagattatgttgtagaagatacagtaagtctgaatataagcaagcagtcttgcaattattccttcattcagttacttatgaaatatattattatcttcaaacaagatgtacttcttggtaaaattgtgcttgagaatccaggggtcctctgttttcttcttggtcactccactgggggagctgttgttttgaaggtatgccttgtaacaataagtagtttttctctgctctatttaggcgaggtttagaaactgaccctactcctttgggcctgtgaataatggataattggatatcctgacgggcagagcaatggtgcaaagcattaacaaaatagcctggttgaaaacttgaaatggtttggctgcagatatgttcattttacatgcttcatattcttctttcccttgtgcttgtcagtagctggtattttccaggcatcattgttccctcatatcagagcaaaactggaaggcatcatcctaacttcaccagcgctgcagcgggcgacctcggcggctggccgtttgccgccacagcctggttgcctccgttcgccgccgcagcctggtcgactccgttcgccgccggcttctggtcggcatgctcctcaaccgcgcgaggatcatcgaccgctgctacatgg

SEQ ID NO: 7311 - DNA, 740 bp, Oryza sativa
tatcacacactagggaatcatagtcctcatatatacgttgcgcgataatgtcgaacccatcaggtttgccctcacggatatgttttcgggctgccaggagtaaaactgcggattctacaagcttgtcattcttcatgtaattccagagctcatcagctagattatctgttttttcagcaagcagtctaactgtatccaaaaaaaccttctgcacaataaaaagaaggcaaaggaatgaaatctaaatgactttgagcatttgtatgcaagcaagcagtgaaaaattacttcctattacatctcgtttccactaattgtagcaaggatgaactaggatcaagcggaataaaacctactactccctccgtcccataatataacaacctaggaccggacgagacatttcatagtacaacgaatctggacatgcacatccggtcctagattgctatattataggacggagggagcatttagctatttcctctgttacaaattactagctttatccaaagtcaaatatttatatccttgaccatcaatttctataaattcgtgtgttttaacaacatgcaaattatatattatgaaagtatttctcatggtgaatataaaaacataaatcttaatgtgttaaactatatgaccagaaatagacggtcagatacagatagctcacttaggacaaaactacaatgactagaaaaggagggagtaatggaattttgaactgctgactt

SEQ ID NO: 7312 - DNA, 658 bp, Oryza sativa
cccctgacttcgttttatccattaaaaatttgaatttcaaaacttcaaataatattgtgaagcagtaaataatttcagttgaaaaagtcatcaccaacaaaagttgtataacttatcaagatctataacttttattttggtcatttcttcatccgacaaagtgatagtaacattttcacaaaatttacatatctctcttatagtttagaaaaccatataagagatatgtaaattgtgtgaactatgttattatcactttgtcggatgaagaaatgactaaaataaaagttaaagatcttgatgagttatataactttgttgttgatgactttttcagctgaaatcatttattatttcaaaatcttgtttgaagtagtcctaatttgaaattcaaattcaaattgttgaaacacagtcatatagaaaaatgttcaaaacgaaagttgtagatcttgataagttatacaactttgctattgataattttttcatttgaaatcatttactacccaaaaaattgtttaaatttcttatattttaaaatttaaattttacatagttcaatcaatctcggatggagaaataaccaaaagaaaattggtagatctcaatgaattctataactttgtttttgacaattttttcacatgaattgtga

SEQ ID NO: 7313 - DNA, 1138 bp, Oryza sativa
tgttttctaatagataatactattgactttgatctgatgtttaatcattcgttctgttcaaaataaattatagaaatattgtttattttgtttgtgacatattttatcattaaagaatatttaagcatgacttatactttagcatattcacactaattatttaaataatgcgaacagtccaacgttatttcaaaagtcaacgtcatttattaaaatatatattttttgaaaaaaaatacatgctaaatatagacgtgctaggaacttgtataaataggggtgaatgcttttgttacattgcatcggcatgcaaagtggtcagcaggctccttaacaactagctatagctacctgtaggggtgaaaatggtttggaatttttccagattccggacctattttcggaaacggaatcagccggtcggaattttttcggaatttctcagaaacggaatcggaaacggaaataatttttcggaaacggaattgaatatgataatagcagtttccgtcggaactcagaatcggtcggaaaaattccggaaagtttgtcggaatttctgaagttaaaaaggcccatccaaatagtccataattcctccccaagttcccagcccaacccaagtccctaaatcactaactggctaactctaaaaaggagagaggctaaccctagagaggagagaggcgtcgtatctagatcgagagaggcggcgcatccaaagcctacctgtgcctgcaaacaaagatggcaaagcatggtgttgcttccattttaacactggcactggtccttggagtacttgcggtcactcctaaaggtaagtatatactacctccgttttttaataaatgacgccgttgaccttttctcacatgtttgaccattcgtcttgttcaaaaattttatgtaaatgtataagatataaatcacacataaaatactatgagtgataaaacaattcataacaaaataaattataattacgtaaattttttgaataagacgaatggtcaaacatgtgagaaaaagtcaacgacgtcatctattaaaaaacggaggtagtatatatactactacatgaatgatttttgcgtgcaggtggaattgatttttacgtgcggagcttctacccgtc

SEQ ID NO: 7314 - DNA, 832 bp, Oryza sativa
agttggttgtcaattagaaggaaaaaatgtggttataatgttgaaccactcacaaaaagaaaaaaattgtgacagtaacaatttcccttcaatggcagtgcctccgtggtgagatggatatgaatttttaatatgcccctgacaaaataattattctacatcattttcaacgtttattatactagagtacagtggtgccatcttagatatgcaatgccatcactctggatgttaaacaagaaatgaccgacgttgctcttggactttaaattactctaatgccagaatcatatgcatataactggagaacttcatcaatttcttgcagctacatagtttgcacctcagcatggaaatcttccaaacaaaaaaaaatggaagtttttaaacaaggcctagatttgtagtttatgcagacacaggaaatggcatgactaggtcactgttgcattcttattgtgagacgtagtctatgaaatgcagtatttgccattatcataggtcttcatctatttcaatgacacatgaaatttgctccatgttgatttgctcatttctaatggacaatcttatggaaacatcaaactttttgttgcacaggtcacaggcagtccttggttgtgtgcaccattctgcaggcgaataagaaaatttttagttcctaccatatgtattggggtatgccacaaaattggaatccatttaatcgaatcctaatgatactttgttagctatcactatgtaggaataatgataataataaatttcaggtttggtggctgatatggatattgagtttgagtgagaagtgcatgctttgattttgtattca

SEQ ID NO: 7315 - DNA, 1293 bp, Oryza sativa
tactctgtactattcatagctgaatttatctctttttttctcatcgtgtaggtcgaatttgaacttgctttttggtgcagtgatagatgtactgtacctacaattgttagtttttttaagatttttttatgactatttatattaaattcggaagaaaaaggtatacgagataatattctgtggagggattagaacccgtttctatattaggatacaaatgatttaatgatttcctatatataataatatttttttcttttcaggtatttcccatatctgatctcaaaaacttaattagtgccaggtcatacagattccagataattccataggtttaattcgtggtacgtccatgctgaagaaattctatgagatgcgtgtgtatagtaactgatgtggatcaggtattcaggtgagttctcaaccgatggaaaggtagtgttgtgctgctaacctgacaaaagaacaatgaacacacgtcaggaagtcactccggtacaagccaccattccattcagttagcaccccaaacctgaaattccacgtactggtcaagaatatacgtaagaattcaatgcaaaatcggatatacggttggaaaaacaaactagtgtggtattagtagtgatcttccgcgactctgtgtactgctgatgagggaagaattccatgaagcggaagaatacatgctgtgtctaagtacgccaagaaaacagaggcgagtttccacgtttcgtggaattttttagctccaacaagccgctgtttctgtggaaaaaatgggaggaagatggctagttaggctgcaaatgcaacgtagcagctagctgtaagcacgcacttgggccgtggatgtgaggaaattaatgtgcctaactggctagacactgaaacttgtatataaaggggtgtgcattggcacatagcatgcataacattcaggttcaggagcagcagttgggagtagctagctgggacaacaatggccaggagacagggagttgcttctatgcttacaattgctctgatcattggagcatttgcttctgctccaacaagtactgatcagattctctctatgtttctagcaaatagcaattctctgttttgcttgcaatgccctgagcacgtactgtaagtgtttagtggctagtcagagatttgaggggaacaaaattctgaagagcaccacaatgttctttatagaataaaccacattttatctatatgcatcctggtgtcttttcataactatggaatttccccacgtaattttacacgggtcagttgaat

SEQ ID NO: 7316 - DNA, 186 bp, Oryza sativa
gcccgccgatgtcgtcgccgcactcgctgatgccgccgccgatgcagccacgacgcccgccaatgctgccgccgccatcgatgccgccgcctcccccgccctaaccgagggcgccggcgtcgccgagaaggggatggggaggaggagagggagcgggagagggaggattggaggatgtggggagga

SEQ ID NO: 7317 - DNA, 699 bp, Oryza sativa
tatcatacttaagagcaggtacaatagcaggctataagccagctgcaaacatattttaagcagataaatgaggagagagaaggtcaacaggctacagatttgtagccagctatagcacggactccaatacacaatgtgtgtatgacatgtgggaccagatattaatagtgtagtatgtaactattgtataaatgagctattagattggctataatgaattaaagctagtaattgacaatactatacttgctcaaagaaagatactgtgtactttttccccatagaaatttcttccggcccattagggataggctcgtgcagtgatgtcggccgccaagcgattgccggctgctgcgggcataggtgtatgctttacagatcgatgccaattgagctcacgtccaaggttctgcaccgttcaacaagcgtcgaactggtacttggcatggctaagttgcatggtcaaataacgttagtgttctcttccaatttgcttccatcgtctcgcatttgaaacctaaataaatggtaaactttatatttctgccactttgcctcatggctaaatgtcagtacaaagtaagatcgtcaaataaaaataattctaaaacaatggttggtcaccctcacgcaaaaggacaattattgtaactagtaatatgcccgtgctaaacgctacggtgcaattatattaatctt

SEQ ID NO: 7318 - DNA, 13587 bp, Oryza sativa
ggatgacatagcggtataagtttagggaccggtgatatactttactctttttgttttttagtcggtaagaaatctctcacaagcgtacttgtactctgcttatgtggaaattactaaattacacggaagttcatattagtgttgaaggaccaaattaattggttaattagtcacgtgtaacggctgtgctcaatttaaattttttgaaaaagaattgtaaattttggaacaacataacaaatattcagcaagagttttttttaaaaaaaaacttcagttagctccagcctttaaaactgaagtttcggtcttgaagataaaatcatttttttgggggaaatttgattatgtcccttcattttgatctaaaactataaggattatcattatatgccaataacatgtggcaggtggggtcataaaggtcactaacattttcaaggatggtaaatctcaatcaatcaatcaatatatctaatatctaatgctggcttttctgccagtttctgattggtccgaattcggacctacgattttgcgacacgtcgcactaggaaagaggagtatgagctttggaacaagtaggaatactttatcagggcaaaggccctctgcccaagccggtgggccgagcctgccctactggtctggcctggtatcagcagcaatgctcaagttaatcggtttatttaggaaatttcaatcgcatcaattaatggattacataaatttcatggggaataaatcatttttatcaattaatgcaagaaatcatccaaatatagatcagattattactgcatcaatgtcaagtggcatagtgatatcaattttaagatttaaaactccaagtcaaccaccttcaaacaagcacagaaaaaactttgtcctgcatgccttaattttatctacaattttataatgaattttacaataattaacttaaaaaaatgtaagacttatattttttttgaacgagtttatgttatatacggctatacaccgtctcgcgtgcctattgggcacacctattttctagtttcaatataaaaagagggaatatgatcacattttactatttaaatggaatagatttagattatgaaaggactttataagactacaaatccgcacataccatttcacatgatcaaaccaagtattaaaattttattccagttttaaaggtttgagaaaagagtaaaatgtcataaaattatggctggagggattattttgttggacttaagtaatggacccgcatgtgagtgcctaatttgatctaaaaaaaaccaaatgttaaacatcaattctaacaaatgtgagcctgctctttcttctccattccacttggtctgaattagttatctatggcatctctggttttgcatatagaatctgaattgacagagcaacacaagtgaatacatttctcaaaatgcttgggtgaatcgcattgcacagataagtttgttaaaatggaagtgtctctcgcgtttttcaaaccaacatgacccggtttgtgctatgcacgaaaagacaatgagatatgcgagataatcagcatgcaacattattttcttttttggctataccatcatcagtcgccttgttcaccaaacacaccaaccatgaatgtgtgctgttcaaagcacccaccgctgctaagtgtgagacagacagtatggtgttaattaatggctatcaagcttctcccgtttgttcggcaccggtgagatactcttgcacattcaagaatcgttgatcaatgaggcatcttatgtttctcacttaattcctgcattcctctcattctcatagcactctgaatctgttatatacataattctgcccttgcacacaacaatataacttgtggacactctaatgcttacacaactcctcagttaatctttttgcatccttatcatctgatctttcttgctcacgtgtagcatatccttatgtagcattaataatttcatattaaaagcgtactcacgtgtgcctaatatttatatgcacttggattaaaacctatttggtgagttatttttaaataggaatgaatgtttaactttaacaaatcatcaaacataaattaggtgatatataattgaatagaaaaccaaaaaaaatgtaaaaaaagaattaatcactgacaaacttatcaagtatataatgtctaataagaatcctaattaaaaagcatgtcatgtgtagagaattagtgcaaatttagaagaggaatgaatcaaccaggatggttgtacgctatagatataccaaggcattaattatgttgaacatcatgtaagaagttataatataccaacctgttcactcaaactcctaactcaaacagttagctgtgactgagatcttacgaactaatggaaatcatcaaagttcgttcttttttttaagattaattagtggtaatctaaaacgagattagttaatgcaacacaaatcaagcatatagcccaaactatatagatgcacttaactagacaaccggaggcccttagacacctggggcccagggcggcctcactgctcgccctgccccagggttggccctggcagcaaaggctgaagcatttgcacctaagttagggccggcgctgggctaatgtggatggtgcgaccgtactaggacttaaaaaattaggagcctccaaaatatgtattctatggtaccacgctgctggatgagattgatattgacactatcatcattgattttgcatctagaattgttagaagaaattattttaaatgatctagagacatttatttttttattttaaacttattagtgtgaaattcgttaatgacaatgagtttttaaatattatcttgtatttttatagtgaatgggggccttcattttttattccacaccgggccaccaaaaagtcagggccggccctatcctgagtcctcggcgatggcgagcaccatggcttgaggcgctgaggggttcaaatacggtgacaatgacagtaagagcatgatggcccagatactctttagttctttaaaaactttttggcaatgtgcaactacttccgaacatccactacaccatgtaccaaaattggtgacaaacatcgtcaaaaaaattcatttttcgttcattagaaacttggaacaacaaggggaggtaaacaaaggaaaggcaaaggttgaggtcaaaggatcaggcaaaccttattgttatagatgttatactaaagggcatacaatgcaggaatgttcttctaggttttactatgagatttgtgaaagtgaggatcatgttgcttctcgttgcccaatttttaggtcatctgttaaacctgttgctcagttatgtggttatgctggagatggtttgggtttcttccatatacctctttcagctggaatgagggttaagcatgagcctaaagcggctatggttaaggtcactaaaggacagatgtctgtaagttctattatttctgagttggagaggttcatacctggtagatggaagtgggtggtgcatgataatggtgatgggacttttcgttcttctgcagctgaattaagtcgtatggtcgaatggggcaaggtacacactaaagttggtgaggctgaaatggagattgtggaaaggggagttgggaatgaggtgaaatatgtgatgccaaaagtgtgggtatagtgcaaaggtcttccttctgaattgagagagtatttaatcatttgggctgttggttccatccttagaattactaaagctgttgatatgatatttactagaaggtatgatatagctcgcttacaagttttggttcttgatccgtctctgattcctgatgtggtggatatggttattggtgatcacttgtatgagctgtttagagtagaacctgaaaatgggcctaaggagcctgtgcctatggagatggagaatttggatgatggggatttggaaaagaaaaaagaggggaacgtgaatcaggatctggggaagggggctggtttatttgattcaggtaatagctctaagatgggttctggtggtcaatttagtgagaggggttgtccttctgctccctcttctcagctaaatctgatacctgaatctgatggcttgactgtttctgatgaagaatttgatggtttagatgaggagactataatggttgacaaggcccagattcaggaaagtcttgtggcaaagctctctgttatccctgaggcagtaatctctccatcaaggaagagtaagagaagggaaagtgatagcgattagcttgttcttgaaagggccgaaaagttgaaggctgataagaacttggagaacctgcaggcttaaggtaattcagttaataatgtttcttttacacaattttcaaatgatcaaatatctgcacatcttcagaatcttggtgttataccttctagtaaaaatgttgttttagatgatgcaattaatgatttgaaatgtgtagaaaataataggataagcgaatatgcttgttcttctattaatcaagtttgtacccctaatgttgatactgagtcattagatgaccagttggaggataattttttactacaacatttatgtagtgaaattatggaagagatcatggattttagtgaggactgtgagaatagtcttaaaaacactttaaatcctatggcatcttctcctaactctaagaaaaagagtaaaagggggaaaaataagaaaaataataaaaatagtttcaaatgaagggaatcttttagaattgtgatgggtttaaggacccaaaataacataagtttatttctgacttgaccaaggaacatcaacttgactttatagcattgtctgagacggttaagaaagaatttactccagctgcacttaaaaatctttgtgctggtaaggagtttttgtggcattgtaaacctcccagaggtaggtctgggggtcttctgttaggcatcaatttactaaacgttgatattggtttaattgatgaaggtgatttttatattaagttccatttatgtaacaaagttgataagttcaagtgggctttagttttagtttacggaccggcacaaaatgaacttaaggatcagtttcttgctgaattagttaatttgtgcagtcatgaatccctaccaattctcattgatggtgattttaatattttacgtagccctgatgaaaaaaataatgacagttacgatgatagatggccctttctttttaatgctattattgatggactgtgtcttagggagttgcaaatgtcaggtacgatttatacttgggcaaataacttagcaaatccaacttatgagaaacatgataggattttgatgtccactgagtgggaacataaatttcctttatcctcggtggttgctcttaatagagatatttcagatcatactccactttttttaaatacaaactccacctcttcaggtaatgcacaacatagttttaaattcgaacttggttggttattacgtgatggctttgtagatatggtaaaggaggtctggtctagtgtacatgagggtaatactcctatggagcgatggcaggcgaagattcgccgattaagacagcatttgagaggatgggctaaacatacaagtggtatgtataaaaaagaaaaaaaaggagattttggataggttggatttgttggataaaaaggctgaatctgttcttctaattcacgaggaaattgattttagatggttttgtaggaatagattatctactcttatgagagaagaagaaattaagtggtatcaaagggctaaaactaaggatattttggagggtgattcaaatacaaagtattttcatttggttgctaacggcaaacatagaaaaactagaatttttcaacttcaagacggggatcaattgataaatggtgatgcaaatctaaaatcgcatattaccacttattataaagacctctttggtcctcctgatgattctgatctccagtttgatgaaaataattttgtggacatcccacaagtatctcaattagagaatgaagctttaatacaagaattcattgaaaaggaaattaaagaggctattttccaaatggaacataataaagctctgggtcctgatggatttcctgctgagttttatcaggtcttttgggatgtcattaaggatgatatgttggatcttttcagagattttcataatggtactttgcctttattctcccttaactttggtactattattcttttgcctaagtgtgctgaggccatgaaaattcaacaatataggcctatctgcttacttaatgttagttttaagatctttaccaaagttgctacgaatagaataatgagtgttgctcaaaaggtgattagccctactcaaactgcttttatacctgggagaatattatggaaggtgttgttattttgcatgaaactatgcatgaattacatcgcaaaaataaaagtgctgtgatttttaagatcgattttgaaaaagcctatgacaggtttaaatggtcttttgtacatcaaacgctcagaatgaaaggtttctctcctaaatggtgtgagtggataacttcttttattcaagggggacatgttggtattagagtaaatgatcagaccggtaataattttcatacttacaaaggtctaaggcaaggagatcctttatctccaattctttttaatatagtagcagatatgcttaccttattaattaagagggctaaagatgctggttcattgaatggggtagtccctcacctagtggatgatggtttatctattttatagtatgcggatgataccatcatttttttggaacatgacttacaacaagcgaagaatcttaaattgattttatctttgtttgaaaagttgtctggcttgaaaataaatttttataagagtgaattattttgttttggtcaggcaaaggaatattatgatgagtaattctaacatctttggttgtaagtttggctctctccctgttaaatatcttggtataccaatgcatgttagaaaactaaataatagagattggaaaatgattgagaaaagaattgagaaaaaacttagtagttggaaaggaaaacatttatctgttgggggtagactggttttgattaactctgtactttcaagtttagctatgtttatgatatctttttttgacataccgaaaggggttcttcaaaaaattgattattatagatcatggttcttttggcaaggggatgaccataaaaaaagtagacttactagatgggatatcatttgtcaacctaaggatcagggaggtttaggggttcataacttggaaatacaaaacaagtgtctcctgagtaagtggttgtttaagttgattaacaaggaaggtgtatgtcaaaatctattgaagagaaagtatctctacagtcagtctataacccaagttaataagaaacagggcgattctcatttttggtcaggtctcatgaaggtcaaagataccttcttagatatgggtttttggattgtaaataatgggaaacaaataaggttctgggaagataaatggctaggaaacctggcttttaaagacaaatatacatctttatactctattgtccgaaggaaaagttctactattgctaatgttatgagatctgttccactcaatgtttcctttaggagatcattagttggtcagaatcttgcatattggcacgaattgtgtgcttctattgtacatattcaattgaatcaatcctctgatagctttagatggaattatcatcagaatggaatattttctgttaggtcgatgtatctagctttaattaataatggttatattgagagaaaaaaagattatttggaagcttaagatgccacttaagattaagatttttatgtggtacttgcttaaaggggttgtgctaaccaaggataatttggcaagatgaaattggaatggcagtttaagatgttgtttttgtatgaaaaatgagactattcaacatctttttatagagtgtcattatgcaaaatttgtttggagagcaatacagttctctcttggtttataccttcctactaccatatctaatatgtttgatggttggctcttggaggtagacaagaagaagagtaaactcatatttgtaggagcttctgccatatgttgggctctgtggttgactagcaatgatatggtttttgacaaatcaccatctatctcatatatgcaggtaattttcagggcaacatattggctccgattttgggcacaactgcaaatgtgtgaagatgatcgagatcttatgaaggttgcatgtcgtaggcttgagataacggtcatgcaactccttgcaaactattgatggagattcacaaatagacttgaataaatgtgctctccttatcttagtttgatcttttattttgttgggtgtgtttaattaatttgaactacactcagtgtttgggtgttacttttgtaataattggctatagctctgatgaacaaaggccgggatgttttattccattatctaaaaaaattagaaacttggaaatgtgcatgcacttattcatctatgactatgttcacaagatcaaatcaatccgtatgaaggaaatggttacaattacatgttaactgttcatgtgtggatgcatccaacatgttctcgaaaaaatcaaatcaaataatggatacaaacgtaatcactatatatgatgcaatcaattatattactgtttatagcttgtaaccgtaggttaagccttatccaaacagtattttttttctctgcgctccacctgaattttctgtggtatttctatagtgaacatgaatagaccgaattaactgggtgagcatcacaattagtggatccatcttctttgtacgttaggatatatagcaacaaattgcgtgtcaaagggagaaaagacgaagctgtacgaactcatcttgtgttttctatcatcatcagtcccattttccagcaaatgcatgacctacaatgcatgcaggtcacaaccgtgggtaagtgtaagacaagccgtctccttcatataattttatacctctcaccaaatgttgttcatcgtgagttgcaaggggaggggggacacatgcatgccctaggcaacctgcgcgacgacccggggcctgtggcagaagccccatttagtacttctattgtgtaggacccaaacttccatggacggggctaaggccttggccaatttctagttccgcccttcagaagttcatctacaatctagaaattcggttaatccgtgttgcttagagttcatctcacttgttttctcgatgcctctcattctcagatcttagctgagtacctcaatcttactcttatgacactatgatggttgcacagttactctactaatccttccatcccatcgttatccaatctttcttgtttcacttttataggacaaggatgaatcgtctaggggtgaagagtttgatgggtgtatgtgtttatagtggcatatttattgttcagttggcgtgttaggtcccgtgttcaatgaactgaatgtgaacctttgcacttacgaacatcgggaaagcggtgctcaaatgagaaatatggaaattttgttgtttcgagataagctatgacttaatattcacaaaatcaacatgggagatatagctaactcgttgttgaggaatcgcttactagttttggtgaacactgtttaattttagtaggtatgaaatctcctacaagcgaacttgtactctgattttgcttggatggttagtctcaatttcaataacaaagaagagggcatatgatcaaaatttactttttaatataatagatttatataatccaataattttataagaatataaaaatacttttaagatgacgaatccacacatactattttatatgtttaaactaagtatttaaaaattattgcacttttaaaattttgacaaaataataaaatgtagtaaaattttgacttagccgatagatctatgtgtcagtgtatagtttgttccaaaaaatcatatgttaaaccttaattctaacaattgtgagtctgctctttctgctcaattccactggtcagaattagtttcccgtggcatgtctgcatttgtatacagaatctgaattgacagagttagcatcacaagtgaatacacaacacatttctcaaaatgcccgagacgtactcttgtgaaagctccgatgcaagcggttaatccaattccacggataaagtttgttaaaggggaagtgcctcttgcgtagttcagactattgatccaatttgtgcaatgctagaaaaagacaatgacatctggccaacttgcaagcttgtcttgcttttcctatacatcatctacaatgtctgcaggtcaaagcaccagctgttctaacggctattgatctacactgagttgtttggcactgttcagttcaaatgctcttgcgccttcaaacttgttcgatcggtgaggcgtctagtgcttctcccttgtttcctgcatacctctcattctcacccacttacctctcattataatagcactatgatttcttctacaaatataataactctgccccttgcatcaactatagacacacacaacattaatttgtggtcactttgatgcttgcacaacaccttgactagtctttgtttcatactcattgtctcgtctttttaacttctcttttatacagcatgcatctcattgacatcgttgtcaagctctaaacagatactcgtaatgagccaaaatgccaaatattcacatggttgtcaagatcagcgaatgatcaaatgcctcgcacttctttcctgaatgccatcattcttacctgaatgcctctagcttttatggcactctcctgcttgcactacttatcgattaatcccttctatagagtagaatgaatcgtctggaattggagagtttgatgcgtctgtgtttgcagtactatgaatgaagttattgttcagttatatcgtgagaagtcccatgttgaatggactaaatgtgaatttgtgatcctttccatttatgtgcatcacgaaaacaatgtttaaatgagaaatgcaaaattttggtacttttcaaaaaaaaattggggcaaaaccttagtaaacagtaaaatggaaaatattaatctctactgccgaatcgaccgactagttggtacacatggcttatattatatttttagactgtaaaagatctcttacaagcatacttgtactctgcttttttggaattactactaagttctaggggaaaagcagttcatattagagttgatgatgaaatttggattctaaatagagtccaaggaccaaaatgcttctttccaccggtcagcacttgtttcttgtggcatctatacactggcatgtataatctgaattgaccgtgtgagcactgagcatcgtaggtaaacccatcttcgaaaaattctttgataacaatttacttgtacttctgtgaaaacatctaatggttaatctgattccacagataaaaaatttgtttatttaaaaggattgtgtttcttgcaagcttgtgatgctgttcagagtaatgatccaatctgtgccttctgcgagaaaatgacagtaaaaatccaatcaccacgcgcaaggtcatcttgtgtctcctgaaatcatcagtcgccttcatcaaatgcgtcgtctacaatttgtgcaggtaaagcaccactgctgctgagtttgagcaaatagtagattatgtgcttcacaatactatcgaattcacctcagaagtttgtcgccggtgaaatactattgcagcttcaagctaaccgatttagtgacgcatataatgcttctcactcatttcccgatggcctctcattcttgcccaaatacctctaattctaatggcgctctaacttactcaaggtaattctagcatatgccccaattttaatttgtggacagtctaatgcatgtacaacttcagaatttcacgaataatcttcattccatccttgttgtttgatctttcttgcttcccttttatacaaggatggattgtcaggcagtggaaagtttggtgggtttctattttcagtgagaagttattgttcagtaatcatgttatgcacttaggtcccatgttgaatgggattaaatgtgaatttttgcaatttatgcatatcagggaagctggaaaggggtgctcaaatgagaaaccatttttgcttcttcagaagatgacgccggtacaacttttgttattttgatgaaaatttgtggcatgaccttcagaaatatcagaatgggaaatttaggtcactgccaccaaatggttctctgctccacctggattctgtgtctggtacttgacaaatgatcattctgagtcgggtcgtcttgaatccggaagatcggttcatcggtgacctatcaagtgcctcccacttctctccggggactcctaactagcgcgtgctcgctgctagcgagcactctttccctattaactacctctattaccactattacttaatatacttaactacctctattagttaatatacttaacactaaagatagtaattaggaaagattcaggagatgtttttactaatagattgaaaattttttaagttacatttgaaaattttcgatttaaattttaaagtcaaattttaaaaactttcaactcagatttgaaaactttcaactcaaattcgaaaactttcaactcgagattcgaaaactttcaagtccagatttgaaaaatttgaaaactttcaatttgagatttgaaaactttcaacttgagattcgaaaactttcaagtccagatttgaaaattttgaaaactttcaactcgagatttgtaaactttcaagtccagatttgaaaattttgaaaactttcaactcgagattcgaaaactttcaagtccagatttgaaaattttgaaaactttcaaatcgagatttgaaaactttcaagtcaagatttaaaaactttcaagttcaaatttaaaaattttcaactcaaaatttaaaactttcaaactcaaaatatgctaaagattaaaaaaataatcacaaaaaaaggaaaaagcgaaaaaaaatgggtaaaaaatgaaaaaaaaaaaaagagtggaaggcgcgcgcgccggcgctgggccttatgggccagaaatgcgcgcgcggcgcgcgccgattagcaatcgcgcttttctcctgactcctgactgcatctcattccaacatggcactctgatgcttgcaaccactcctcgattaatcctgttccatctccattattatctaatctttaatctctctgatttcccttttatagaccacgttgaatcgtccggcattggagagtttgatgtgcgtgtgtttagaatattatgaaattattgttcagttacattatgaagtcccgtgttgattggactgaatgtgaacctttccttttatgcacatcaggcaagcggtgttcaaatgagcaatataaaataaaatataacacactaac

SEQ ID NO: 7319 - DNA, 7823 bp, Oryza sativa
ctgtggcatgcaccaacttaaggcacgtttgagataacaattaggcccgtcacagatgactcatcagtgacgggctatatactaatgtccgattgagatgacttaatctctatcgggcatgaactaaagcccgtcaccgatgagtacttttccatttttcatatgaaatgtttatatttataagctgaactgtcgcgaccgggaaaatttccttttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaagactccacctaagacatcttctccaaagcttctcttactgaagaggggaaagattgagcaagaatgagtacaaccacagtactcagcaagtcacaccggcagatgcatggttaatgcaagggggtacaaggagtaataatataggggttaagttttgcagaaaagcggcatttataagtcacttagttgcccaaagctattttataaagacgatcctagagctacacagtattattaaacaaggccgtgaaccctcacgaacctgccttaacccaaggcctacgatgattcggaccgaactggcaacccgacctgggtcccagctcgtcccaagccaacccaggccaaccatcccatattttagttgttgagcaaattttaagaattaaaacactgacttgggtacattgctaggcttgcccatatccgagggctcggctattcgaatagatttactctgatcagaggtgtacatctttacccacaagacacatcttcctcacgtgttgccacgtgccacataccaccacggtatacggacggaagacgtgacatagtttccaacccatcctagccttagacaagagtaccgacccaatcctacctacggccgggatacccgggacaggcaggcagaactgagcccctagcattgggcaccaaccctctgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagctttagtccttatagtggccggggtgctacttcccacaactggcatgcacccaaaccccaccgaaaacaggttttaggggttttgaaagaggaagagaggtgtgtgtccaattccaacataagccaaccattccatagtgtccaaatgatatgagaattcccaaagtctaaaattataaaaccacctaatgttgcctaatgaatcagcgaagcatctacctaaattcatactagtggaaccataaatagagtgtccactagatggggttttgtttaatctagggtgaacaaggtattaatatcaatagcaataataatgtcttaacaaaggtaaataggcatggctaaataaaacagtgataacgcgggaatttaaataaagcggtaatgcattaatttaaatcaaaataattttataaactgggattcaatatgctcaaggatgatgtgacttgccttgctcgctttcccaaacgccggcttcgacttccacgaagaacggatcttccgaagctgcagcgtctacacgaccaacggaaaagaaaagggcttttactctaataaactccaaataacagcataaacaaagcacaaaaatgggttctttacatcttaaggaaaaattagagacttgaacggtccaattccgagttcaaatggccaagatatggccctttgaagtttatatgctctttaaatggatatttacgaatttcttcatttaaattttaattaaaaaatcggattattgcgtcagccgagggggcgggcgcgcggaccgggtccacgggagtggggcccacgcgtcagcctcacggtccacggtggaccgggcgcacgcggctggcggcggtcggcgccgtgggtcccgcgcgtcagccgcacccgcgggcgcgggcggctgacggacggtcccacttggcagacgcgagggcgcgcccgagggcggacttctccggcccgatcgacgggagcggtgcgcccgcgccccgatggtaaccgccggaaaccaccggtgcggtggagcggcgcccgagagagaggagggaagggggaaggtgaacggttgacctcggtttaccccgggacaacgacgacgacgagaacggcggccggagcggaagaagacggcggcgcggctcgggatgacgatggcgacggcgctccgacggtcggcgggcgaagcggagcggcggacggggtcggcggcaacacggcgaagcggacggaggggtcgccgagtcggaaggaggaccggagcgacggcggcggcggaacggagctcggcggcgacggcggggagagaggagcacggcgcgagcacgattccgacagcgagagcgagcggcgagcgccggaaacggaagagcggagctcggggagcaattatatagcaacgggagggagagagggcggccggagagagaggaaacgggcgcggagatctcggctccattgaatacgccggcgaggtttgcgggattgattccgagcgaatccgagggagagagagaggggaaagagggggaatcgggagaggggattgcggggaataattcccccctcattaaggcgcgcggggaaggcgggatgcggcggattccgcggcggcggcggcgctagggcacgggcgggcggcgggcgcggcgcgaggagggagatgacaggtgggacccacccgtcagcgagggcggcgggcgggcccgcctgtcagcggcgcgcgcgcgcgggggagaccgatgggccgcgggggaagagagagagggagggactgggccgagccggcccaagaaggaatgggggggaaaagaggacttcttttagggtttttctttttataaacctttttaactttgtttatttcttttcaattattatttgtgctctgaaaattccactaaaatttgagggctccttttagaccaaggagaatttaacaaaaattctccgggtcacatttgaatttttcttgtacgtattttaaggtttgccaatttcttttcgaattttaattaattctattattccttttagaagatgatttttattttgggatgaatttatcaggacgtgacaaatccaccccccttacaagaatctcgtccccgagattcgaggaggctagcaagaagataggttgggcggtcttctcttcttgtctgacttcttccgttgcgtcttgacaaacttccagcaaaacttcaccactcggaactgcttggcttgacctcctgttgaggatggaatcttctcttcacctgacttggaccagggtgcaccttttggctgactcagactaggttgcggtagtgcagtgatgcttccgttccagaacttctcatgattcctatcttcggagtcaacctcagacaagttaccacttcacgtcatgcgtcaacactagcttgtcattactaggatactatgtttgtcatcataagaatatcatgcttgttattcacttctaacttgccatcaactgtctcatattagctttcctggtctccggtgctaggtacttcggctattcgatgcaagggtcaaccactctaactataagttatgcttcccaagagaaccaatttatcccacttgacatactttgacgtcttctccaatggctgtattgctggatttgttattgtctaatcattaccctgtcaaatctgaggcttcgttgtaagaggtgattttaatctgacctctatagactatcttcgaacatatcactggtttctataactgggaatggctctcacgaacaagcagctcggattcactttctttacattcagtttacttcccattattatcttcatgttgtcctcagttagtattcaacgtattcctttacaccttcaaccttgatgtgttctttcccattggatcatctcccaagacttggcattacctggcaaccggtgcttgcacttttcactccgtgtagcatctgataccgagtggaagatttcactctttgccttcatagaaacacttttacctaggtcatcttgctgacttaatgacaaggtgactgttgcggggcaattacaatcaggggtcttccgtgagcgatgcagagcatgtttctgtttatcaatcacctttcggcctacttcttttatgctggagaacatctttgccaatctcttttatcaatcatctttcggcttatctctaacaggtggtattctttaatgtgggttgcggacgcttctggggacgatgaggtcctttggcttgctgcctttcagtgaaaccttgatgtggtttgtcaaaaagctgcactgactaccttcagggaaatacattgcttgctatctgtatctatgccactagggtttagtgcttcctcgagatggggagcatccatattgttcttctgccatatcacctttgacccttttctgatacctgatcgactaactaccaaccattgactattatgttctcgaatattgatgtctcctggatcttcttaactgtttgcaggtatatccgaacttatcaatgtagaggcatggcgggtacccttatgggtttcatccaacaatccttatcttgatctgtaaaaggcgtatccaaactcctatcctcaactactgtctcgttggctttttaacccaacacagtttaattgtttttcttttccatccacaggttggttattaactcgaggttagaatatagttcctctgacacgagaccctaggtctcctttgtcagtaaacaattatacacatgatcacatatccgcatctttcaaaagaatcctcttagaacttgtctgcattacacatttctcccttattacacgaatacaaggcactgccttaaacaaaaagagacggtgcttaacatcggtacattgtatcctcaacatgaatcatccataagcatagcaagctcactgtttatagacatgaatatatttatgtattacatgattgctgcaaactttcgattacgcaatgataggtagcgaactgaaaaccacaaacacggctgctcattttgattccggagagatatagctggcattgttctagtgactgcatccttgattggttctgtgatgatgtgataggactgcataatgctatcattcacaggagaagattccttctgattgctggttgaagcggatgacggtcttctgcttggtatcgccttccggaggttgattgcccttggctcggcctggagtaggtcggggagagacacaacttcttccatctacgacaattctttgctgaggctgtcgatgcagagagtggttgctatgatttattgccgagtcaggtgcagcaggaggagcattggtgcattgtttctgctataggttctgattatcacgaggccttacgggtacggcgtttgctccagtgaccacaatacgattggaatgtctgcttcgtgtaaattggcggtaatgtggaggtcgattttgccttggttggggacagttttcggagtaatgcccttcttcactgcagttgtaacaaacaataactttcttacactcgggttcttcatcttgtacttgatttctcagctgctgtattggaacctccaaaggtacaacgcagatactggcctctgtcttgtcagctggtggctggggctgaaattgagcattgacaccttgtggtagtgcattcattggaattggagctgttgcaacgcgggctataggactgcttcgggatgcatggatgacaattcgttgaggtgcaagcttctgattgcagggagttgcgtggactgacgtgccggcagctatgtttctcggttttgggcacttgtcggcgaaatgacccattccttgacaattgaagcaacagatgtcttcccggactcggcattttcttttctcatttcgattcctctgtcctggcactggagttaggctgaaactgtaatcttggcgaggattggtgttgccttgatgcttctctccgttggaactggcgggttggttagccatcttcttcgtcagcagaaaactgaattgacaatcttttggtacatgatcagttccttcacaaaagaaacaagtgatcctgctcgttggacacctgtcgggtggatggtcttcctcgcaatgaacgcatatagtggcacatgagctggcgacatgaccgatttctccacaacgagagcatgccttacgttccatttcatcttcatcatctgaggagacttgatctgaatcttcactatcagacactctacctccattagctaaaagatgctctgtcaactgtggtgcacctcggaaggtatttcttctctgacgtctggtcattcctggtggaggccattctgtgctagtaatgatcatcttacggacttcatcttcggttcgcattggtgtttttcttttctgctgaggacgctcccttgcatagtgcccttgctcctcacacataaagcaaatgttacttgcttcttttgggtcaacatgtggcacgtcaccatgggtccttcgggatgctggcggcatgctgacttgtggtgtgagtgcttggactgcctccaactgcacttgaggtcgtatttgactcgggttcagaattggcgtctgatgctgctgtagtatctctataagcaatcggttctggttaatcaggtgttggaccagtgtcacacaactggtgtctggtgcttcattcactcgggagcttaaggtactaatgtcctgacttctgaccttattgcctttctcattgtcagccatctgttgcaaaggtttggagagggagagagggaaaacaaaggggagagacagattagaaactaaggataggaccttaacagatctaagtcttttgctgttatgatgtatgttaggcttattctgcaagttgattaagcaaacaacctagcatggttacatcacaacccactgatgcaaaccacgcgctacacacacaagcaaggaaacacacgacaaacgaaacactagagggtggcttaggttctgcgacgggttctccaagatcttcgctcttgcttcacagctggcttcactgcttcctttgcttcgctagcggatcctgcagtcttctggggcgtcggcaaacaactgacgacatcttcttcttcgcaaagctgaccatctagtacttagttgaaatccgaagaaagaaaagagtaaaccttttgcaaatagcattaggggaaggagaaaaagaggaactttcgcaaatacttttatttataaaatatgtccttaggttttatccacttggcttatcctacagtcgagatggctctgataccagcttgtcgcgaccgggaaaatttccttttcccgaacgctagtgtattaatccccgtcccaggaaaagccggggtacaccacacaaacatgatataaaagacacatctttattatatcgataatatttacattattacaaaggcgcttaaggcctgacaatcaaaaataaacagcagcggactagcgggcctacggctccatcttcacaggcgctcaactggggtataagccaagactccacctaagacttcttctcca

SEQ ID NO: 7320 - DNA, 713 bp, Oryza sativa
ttgacaaaaattctccgggccacatttgaatttttcttgtacgtattttagtgtttgccaatttcttttcgaattttaattaattctattattccttttagagaatgatttttaattcgggatgaatttatcaggacgtgacaaatccaccccccttacaagaatctcgtccccgagattcgaggaggctagcaagaagataggttgggcggtcttctcttcttgtctgacttcttccgctccgtcttctataacaaacttgcctagcacaacttctccactctggactgcttggctcgatctcctgttgcagatggaatcttctcttcacctgacttgtccctggttgaacctttagctgacttcgactgggttgcggcacttgaagatggggcttcagttccagaactttgcatagttcatatctttggagtcaacctcatacaagttacccacttcatgtcatgcgtcgagatcagctcgtcattactaagataccatgcttgtcatttgcttctaactcgccaccaactgcctcatattagctttcctggtctccgggtgatagctacttctgctattcgattcgagggtcgataactttgcctttgaattatgcttcccaagagaaccaacttatcccacttgatatactttgacgtcttcccaaatagttttactgttagacttcttattgtctgatcgttatccgg

SEQ ID NO: 7321 - DNA, 2009 bp, Oryza sativa
ttcctctgaaatgagaccctaggtctcctttgacagtaaccaattatacacataatcccatatcagcatcttccaaaagaacccccatagaacttgtctgtattacacatttctctccttattacatgaatacaaggcactgctttaaacaaaaagggaaggtgcttaacatcggtacattgtttctgctatggattctgattaacacaaggcctcacgggtacggcgtttgctccagtgaccacaaggcgagtgacctgtcttcttcttgcataatggccggagtgatggcgcaggttacgcttcgactgtggacaatctctagagaaatgacctggttctttgcagttgtaacaaatcaacgtcttttttgctgagctgtccatctggggatgatcattgtgacttggagttgaaattggtggttgaaaatccttgctaccattggcatcagtggtaccatagttgctatcaccattggagtctttctcagcgtcaaaattgctaaggttgtcattctgggttccaacattgatactatcgttgacatcttggtgaatgctactgacattgcacgctttgttagagtggtcactaatggggcaagaaccatggttgttggtggtatcatcatcattagtattgctagtgttgttgtctgcattgcgttcatcttcttggggcaggaactcttgatgcacaacagaagatccggtgatctgaagtggctcagtgcgctgtctttggttaccacctggaattactgggatgttgacaatccttctcttgcagttcgtcatccgattatgctcactttcaagttgcatggctttgtccacaagtttctcaaaatcttcataatcctctaggagtagttgcactgcgagctcatcttttaacccctggagaaacttctcttgttggtcttcatcattttccacatcttctggtgcatagtgagccaaacgatagaactcatgcaggtactctgtgacggtcaaatctccttgcttcaggtagcgaaactctcgttttcttagtgtgatcattcctgcgggaacatgtgatctcttgaatacagatgaaaactcgttccaggtgatggtatgtccttctggccgtgatgcttcgtagctatcccaccactctgaagccggtccaaccagctgatgagttgcgaagccaacccgctcctggtcggtgcactgaatcaaccctagcttcttctcgattgtgcgcaaccaatcactggcttccataggatcgacggcaatggcaaaggttggaggctcagttttgagaaattctgataacttgcactgttgctggactgtaggcacttgaacgttggttgcccctgctgggttgttccaattctgtaatagttgaaaggctgttgccaacatgttggtttggttaaccacaacttggattagctctggtgaggtttcgttgatgcttctctcattcccattggcttgggttcttgagtcatcggatccatcattcccatagcctttgttaccagtattatccatctgtcacaaggtagaggttgagaggggaagcatacaaggaaagaatagaccagaactagggacaagaccttaaaggaactaactcttcttattgatgtgttgtttgtttcacttattctgcaagttgattaagcaaacaacctagcatggttacatcacaacccactgatgcaaaccacgcgctacacacacaagcaaggaaacacacgacgaacgaaacactagagggtggcttaggttctgcgacgggttctccaagatcttcactcttgcttcacatctggcttcactgcttcctttgcttcgcaagcggatcctgcagtcttccggggcttcggcaaacaactgacgatgtctttttcttcactgacctgaccatctagtactagttgaaatccgaagaaggaagaagacagtaaaccttttgcaaatagcattaggggaaggagaaaaaggaactttcgcaaatag

SEQ ID NO: 7322 - DNA, 440 bp, Oryza sativa
acgatgacgcgggcgagcccggccgcctgccgctccgtgtagtgccccttgcgcacgatccggtcgaacagctcgccgccggcgcagagctccatgacgacgtgcaccgccacggcgtcctcgtaggcgccgcggatggagatgatgttggggtggccggcgaggtggtgcatgatctggatctcgcggcggacgtcctccacgtcctcgtcggtgagtagcttccgcttggcgatcgacttgcacgcgtactcgccgtcgttcgccttgtcgacgcacaggtacgtcgtcccgaactggccctgaccgagtttgcgccccaggctgtatttgtccttgagattctccgtctttcgccggagcaccgactccacctgcaggccggcgctggagatgcgcttgatgtgcgccggcttcttggcgcgcgactgctgccgctg

SEQ ID NO: 7323 - DNA, 678 bp, Oryza sativa
ttttaggggttttgaaaaagaaagagaggtgtatgtccaattccaccataaaccaccaattccatagtgtccaaatgatatgagaattcccaaagtctaaagttataaaaccacctaatgttgtcctattaatcagcgaagcatctacctaaattcatactagtggaaccataaatagagtgtccactagttggggttttgtttattctagggtgaacaaggtaataataccaataccaataattgtatggtcataacaaaggtaaataggcatggctaaataaaacagtgataacgcgggaatttaaataaagcgataatgcattaatttaaattaaaaataattttgtaaactgggattcaacatgctcaaggatgatgtgacttgccttgctcgctttcccaaacgacggcttcaacttccacgaagagcggatcttccgaaactgcagcgtctacacgaccaacggaaaagaaaaggcttaaacactaaataactccacataacagcagaaacaaagcacaaaaatgggttcttgacttcttaaggaaaaattagagacttgaacggtccaattccgagttcaaatggccaagatatggccctttgaagtttatatgctctttaaatggatatttgcgaatttcttcatttaaattttaattaaaaatcccatt

SEQ ID NO: 7324 - DNA, 6472 bp, Oryza sativa
gtcacttgttcagactgagacactacaaattcttttagctcttccaggctcttcaattgtccaatagtcgtttcatctgaaaatctcgtgtcctgattgataaatagacgagctagtcgttgaaggtttgtgatagttgatggcaatatctccacattggtttgtcttatgtccagcgtttctaaatatttcagttctccaattttttctgggagataatccactccatatgaggagatacacatgtacttcagatgaaacaatttttcaatatttgcaaaaaggtcacccattctgtccctatatactaggtccaacacacgaagaaacttgaaatcaaatacagaagtttgcatgcgatttccaaatatagtaagtgatcgtacttgagacagatctaggcttgtcggtatgttgacatcttcttcattgctgttgatgactgacagcctccgaaccttatactctgtagtgcatccaggcactgtagatcctaatgaggtgacaaagttctcttcagtagccttgcatttgatgtagtcaagaatgatgtcatgaactcgacatgcctttgcctgaccatactttacatcaacaggttcaatcaggcttctattgatgagctcattaaaatacaactcaccagttctatatgcacttcgcccttgttcatcctgaatgaatccttcagcaatccatttactaaccaaacgtcgtttgtcaatattataatcttctggaaatacacttaggtacatgaagcaagtttttagatggtgagggagattgaagaaactcagcgataatatatttgacattgtctctgcataaggatcccttgcaagtccataaccaatatcattaagtaccctatgccattcatcaatagcatgctgatatgataacaagctagatatagtaatgattgccaatggtaggccaccacattttcctagtatcttatccagaacatcttccagatgaggataatgtgatttttcataaccaaatgctcttttcaaaaataaccatttggagtcatcgaaactaagaggcttcatctcataaatataaccatcttgagaagagcagcatgatgcgactgcaacgcttcgtgttgtcgtgattactctgctgccacagttactgtttaataatgcaagctcgatagttttccatgcttttgcatcccataaatcatcaatcacaacaaggtatctgtcacaatatatttacatatatttagtaattcgttcttgaaatccacgcagttgataataattgaaaatgttggcagaattaattacagttagctaagacgaaaatactaacaaatcaaatcattatgataagaacaggaaaattaaaaatgatgatttgagtgcgatggattggacagagagatggctcaagcataagataattactaatatttggacacaacgagtgtaagattaataattttatatactcaaatataatagtttggagacctagatagtagccaggattaatatatttatttaatacttcttggatggtaacaatcaccaaatagtaactaaggaaacagacaaagcagcttcccaccttcattggttgtaacgatacacacatgccatattattgctacaatgaaacaatgtacttccttccagcttgtggattgttgcaatctgcaagcttactttttacaatctactagaaaagaaaaggtgcccgtgctttgcaacgggtagagccaatttaatttgtacatatatgtcagtgcataaataatcacataccatcgttttgtttattcatgtgcttatccaaatcacttattaccaaacaaaagactatttgtatgcaaatcttttatatacatattcttagcgattcagaagtaaatgatgtaaaataaagtacgataaaaaaccaaaaagtcgagtttaaaattaagttctaaaatttaaagtttcgcttacaggaaagcataagccaaataatgaggccttcaaacatgagctcgatttgttgtctagctttatcttaagtcaggcaagaattgatgacggacggattcagcaatttcgatcattctttatttcatttggcatgttctttttgaaagtaaaactgattcttatgaattattgtaacgttatccctggtagtacgtacgagcatgtgtggagactgacttgaaatcgtgctaacatgtcccaagaatcgtatcgtgtaatacgaatagaatcggatgatctgagcaacgatgtacgtgatatccacatagactctgcgagtttcattcgcttggtattcatatcacatatactgtctttcgcaattcgctcgagagtcaacaattgttacgcgtgacaggaatcggatacggataatgtaccatagttttgaaaaaaaacatcttcaatttttaaatcacgggcgaggacgacgcaatctcaatcggacacgcggcaagggaaaattgtgcgcatgatggcttcacgggcccaattgggcatgcgaaaaattgcacgtgcgagggcattgcgggcccaatcgaggcggcgcgcaaaggcgcgtgtggaatacagactcaagcgtgggcccgatcgctgcttgtggcaagagacgcgtgaaaaggtgcaagcccaattaattcgcgcacgtctctgataagagggacactctggcataagaaaaaaaggaaaggatttaactgaaacataaaattaaaaccgattcaaacacggatgatgcaccaaaattatggcagaaacatcttcagtttttataatagtagagataagctgaaacaaacaagacttaatataatttcattatggtttgcaaataatatatagtaacatatataatagttaaagctagattttacatcatttcaaattgcaaaacatcgtttattttcaactggagggaatatcctatatataggaaaattgttaatgtttacacaattatggctgtgttcttcccctacctttcccaactcacctccctcgtccgcgcacacgctttttaaactgctaaacggtgcatttttttgcaaaaggtttctatacaaaagttgctttaaaaaaatcatattaatctatttttcaaaaaaaaatgtgtcgctccgttttgcgtgcgcgggaggtgagttcccaacctcacctcccacatagcctaagatatatacatctcatttgtataaagaagtttttgtaatttcattccaaggttaccggacttttctatagggcattcccacgcatgcatatatattaacagtcccatcactactgtaccggctcatatgtgccaatttatttaaaaccagcacctattgaccatttttcaccttaggggggattacccgcgcaagaagcaggtgctgccgtgctgagctgctagatcaggctgtggacgacgacgttaactcgagaagtagcagaacgctggctaatctcaattctcacgacgattaatcgtgcggagagagggaaggaggagataaaaaaagagaggattcttgcctgagtaaagaggccagtcctgcagctcctcctccacctggccgaggccgaccaactgctgctactgctgctgctgctgctgaggcgccgatcgatcgaggccggatcgaggcagcatacgatcgagcgcctatggcctatggggtcggggctgacttccgtcgtttttgttgtgcggtctcaggaggagttgttgttgttgctgctgttgttttctcaagttggaatgggtctcagagaaaagttgcatcttagtagttggttttacgcgtaaaacccggcttccaaaagtgggaaatttaactatttgccactcttgtgacatggcaattaacgatttgccacaccgtgtctatgatatgtgggccctcatgtgtctatgacatgtgggccttgtggcaaatcgttaagcaccatttgtaagagtggcaaatagttaaaagcccctccaaaagttgcacctttatgtgtctatgaatgaatccttcagcaatccatttgctaaccaaatgccgtttcttaatcttacgatcttctggaaatacactcaggtacatgaagcaagtttttagatagtgagggagattgaagaaactcagtgataatatatttgacattgtctctgcattaggatcatttgcaagtccacaaccaatagtattaagtaccctatgccattcatcaatttcatgctgatctaataacaagctagatatagtaatgattgccaatggtaggccaccatattttcgtaatatcttatccaaaatattttctggatgaggataatgtgaattttcataatcaaatgttcttttcaaaaataaccatttggattcattgaaactaagaggcttcatctcataaatataaccaacttgagaagaacaacatgatgcaactgtaacgcttcgtgttgtagtgattattctgctgccacaattattgtttaataatgcaagctcgataattttccatgctttcgcatcccataaatcatcaatcacaacaaagtatctgtcacaagatttttacatagatttagtaatttgttcttgaaggccatgaagttgataataattgaaaatgttggcaatattaactgtggttagcgaagaaaatgctaacaaatcagatcattatgacaagaactggagaattgaaatggaagagtttgagtgtgatggattatatagagagatggctcaagcaaaagatgatcaccaatatttggacaatgtctgcaagattaataaatttgtagactcaaatataatagttcagagacctagatggtaaccaggattaatatatttatttaatacttcttggatcgccacaatcactaaatagtaaccgagcaaacaaacaaattaaagaagcttcccaccttcattgtaacaagagtaaatttcagagaatcgcatatttagtcactgaattatcagattgttacaacattagtgacatatttcagtttgttgcaatgataatggagaaaattgtcacaaaaccgcaagttcacgcagaccccaatgttacttacacattgggcccacatgtcatagaggtggtagacggcgaggaacaagttagcacatgcattgtagcggcattctgtgttggcagctgctaagcccaccactgtgccctagctgtactgtagagatatggtccgattgaaacacccctcatactttgtcattgcacttgagtcaacactcatcaagcttcaaaagagctaagggcaacacgagagggtcgttttccctaacctagaattggttttgattcgtgcattggctgagcggtattccagccaaatcagatcaccacagtgtatggctggaccaaagtagtgggctgagggctgacgtggagtacgtgctaatgtttcatgcaagagtaaatttcagataactgcaagctattttatacaatctataagatgaaacaaacatgacctaatgtaatttcactatgatttaagaacgatagtaacagatatagtagtcaaagctagatcttaaaccatttcgaaacctaaaaaacaccattaatttgtttgcgaatatcctatagataagaaaattgttaatgtttacctaattaagatatacacatctcatttgcatcaagaaatagtatttgtaatttcattccacagttaccaaatctttttattgggtattaagtcgcatgcattcatatatattatcattgataatataactaggcttaccttttattcttgagatgctctcggagtatattaatgagtttcttttcatcattaccaaccggagtacgagaagagatccctactccttcagcaatatcgtttagaatcttctttatatcaggcctttgtgaaactgacacaaaagctgcacaagaaaattggcttcgaattgtgtcataaacttggtttgtaagagtagtcttaccaagacctccacaaccaacaatagagaccacttttagagaccctttcatctccatagctagcagctcaatgatacgcttcttaggaccatcaatgcccacaagtttatcaacctcctcatagaacgccgacagcctaggatcaatgccaaaagtgctagagttgtgtgctaattggtcaaaattatacctcttgtgcctttcgcttgcctcgatcgcacggatcttgagctcttcgatctcattggcaatctcatggcgcgccttcagtttcttcaacttacggaagaatttcctgaagcccatcttttccccatcatggtcaacacgagacataaaatcatcgatgcaatcttccaggtcataggccagctcgcgtagcttgtccctccaatccctcatttctgggttgagctgctggtccgaatccgcgagcatctggagtgcaggactcatggtgctcaactcatttatcaagaacttgatctgcttgcgcacgc

SEQ ID NO: 7325 - DNA, 9981 bp, Oryza sativa
aaccatttttgctcatctgctgatgatctccctggagtgaggtggtgctgtgggagtggtacaggtttcagattgtgtatatggcacagccaatggcgcctgtttttcaaggaagaagagtgtcttgccgccagcagtgggttaattgttttctgacctctagatccgcgcaaaataaagaattgttaaattaagctaattagctttggtaaagaatattgcacacgcattggacgctgccatgaaaacctatgttactactcctacaagaggctcgtgacgacccagtaattaataatgtgactctgcacatcctgattaaaattattaattaattctatcaagctttgtcggcaggctctagttaccacgcgaagaaacatgagcatgtgatgcgcacagtttgtattatagggcctgctttggagattacctatttcttttcactggtaaaaatctttccacctgtaatttgacggtcactaaaacctacaatcatgtgttttatacttttattaccccttaaaatagtactgtatttgggtatagtaatcaatactaccgtatgatccactgcatcaatgaaaataggtgcaggtgccgtcacaagtaccggccaggttgtagacgacgacatagctagagacgtactgtagcagaaacgctggctggagcgaaggaaatcaggctagatttatagccaactgtaacacggattctaatacgttgtgtgtatgagatgtgggactatatattaatgcttaaaaataactattatatgaatgagctattagattgaccaaagataatttagagctagcagttggttataatattaagcttgctctaaccgtgcagagaagggggagataaaaagagattaatcttggctgaggaggaggtgagagagaggttacgcaggccgcagctcctccacctggccgaccaaccgctgatgcggaggcgccgaccgatcgaggtggttggacgcgaggtggaagtcggggatcaaggcagcagctaggaaccaccatactcccctccatacacatgcattatcagcatatacagtactccctccttataaaatctgacacccatttcattctttggtttttttaaaattctaaatcctatttatagttattgtgtgctaaattaaattgttgatcggaaataaaaagttattctaatacttattggttgtatattcattgattttgccacatggtattggtaattaagttaattgctttttggtattgattgaaaaataaataggtcttagattttgataaggagggagtatatgatttgtgtatcgataccaatacaccctcacaagcgatttgaattaatatcgattaacatgcaacaccgtttcttgtgtcatgcacatgcatcaaggataatttgagcctatgatattgcttgcatgcatgcatggatgacaatctatctatctatctatctatctatctatctatctatcatctatttatctatctatctatctttatatactaaaagtccattaaacttcctacaaacgctctcaagttgccacgtggcgctctaataaattagagaaaatcctagaaattctaagaaaaaagcaaaacatctacccttgattttcacttaaattagtgggtccaatattatacaccgttagataaaattgatcttaaaacaaaccaaataatatgggtcccacctctcctttttctcccgcgtgcataggtataggtcacgtacgtacatgcatgtggacctgttgttcgtacgcctccctccatttttttcctttttttcttcttttttccatttatacaatctgatatatatttgtttaaataataataatttagaaaaaaagaaaataccatcatataactctttataaacacaggtaactaaattagctatgcagactttgaaaataaaatttacaccatattatatgttaattagctctaaaatcaataatgtaagataatttactaaatactattattttcatataatgcactattttaaaataaagcttacacaatattatattgtgtacctatcaaataaacaatttaagatctatattaactaatatatacatgtacttaaacagatagacccattatttaaatcatcggatctattttttattactttggattattattctcaaataattcagtgttttaaaataaaatctacaccatcaccataatgttgtgtacccattaaattaacaatttaatatatatatatatatatatacatatatattaactaagttacatttacactaaaaccggtggacccattatttaaatcatcggatctattgttaataatgtctaaagttctctttttggcccactccacaatgcacatctgcacctttgcctttcgcacatgtgacagagtgtcgtgtttgaggcatcttgggtgatcacgaccgctgcagcgctaccgttgttgttaatagcatgaaaataaaattaaagatgtgatgtagcgagagaagaattaagtaccgtggaacacttaactctgtttaagctgaaatcgagagttgattaaataataattataatgtattgtgttatgttgtatttgcattttgtattatttgttcgtacagttgaaagaaatcattatgttataattgtgagcacaatattaacgaatatcaacagaactcttactaggataagagtgttacaagggagtttaaggccctattttttccctgattccatcttttgaattttcgtttgcacgctccacgctttccaagttactaaatggtgcttttcttaaacaactttttaacttttcagaagtcaattcattcgtttataatctcaaatagctatcacataaatcagataattcatcaatttcagttgtcctatcccctaaagtacatatttttttcatgcgagtcatggtgataagtaaattggtgatcaacgcataatcaaagtcgtaagataaatctgttagaacaactatgaccaattgtaaataggtgtcaaaattaattgctattaattaaacaactaatggcttgctagcaacatatttaatttttctctacatgtatataaacatggacgaagctaaaacgaatatgaacatacatcccatacatatatatattacatcttaatattctaattacatgtggtaagtccactaaaatttcttaaaatgccctcaagatgtcacgtggtgctctaataaattagagaaaatattagaaattctaagaaaaaaagcaaagtatctactacttgattttcacttgaatcgatgggtccaatattataaaccattagattaaattgatcttagaacaaactaaatactacgaggtcccacctctccacctttggtacgcacctatgtacgtgggtacctacgcttccccaccctttttttttatttttccctttcttctttttctccatgaatatgcttccctccctttcttactatatcatgcaccttcacgagacgatttaatctatttacttaagaaaaaaatatgattcaaaagtcgtaagtacttaatccatctcccactcaaaagcttgcgaatggacttttaagataccttaacaaaaaaaatagaacccttaaattattacaaaataacagtatccgaactttagtttgcccttaatctatgtgataatttttttaacaaacaataaaaatctaacctttcaataatatatgtgcccgcgcatacgcgcgggccaccttcctagttagagagtaaaactgataaagaatgtgtattacatatagttgagtaaatttcacaaaactacatgtattttgatttaaggtgttgtatcataaaactacaaatttagcaccatatttatcacaaaactatagatttaaagttaagtatcataaaactgcatatttaatattgaagttatcatagaactacaactttaatatcaaagttatcacaaaactatagcttttagagttcaaatccctagtaccattattatgatggagctctaaacattcatgttttgtgactaaattgcagagaacttgtgctcggatatggttttgtgtttgattcatgtgtaggtgagtcttgatgccttggaagagcattgctggagatggatcgggagtcaacttgggatatgatgacgtccggacgatcgggatatcttgtgggatacttaggctagagatcaatgcacgtgattgatgaatatttcatatggcaaacgacagagatattgtgtgcatatgggatgaggagtttaaatttggagggagtccaaatttggtacaattggaatttgttaagtttgtttcttatttgggaatgtttttctaggggattagaacttcttgtataaggttggtttgtgccttttgtgcttaccttgggtataaatagagagggagggtgacgccttctgatatcgatttttagatagttgagttgtgagaaaagttagggtttcgagtttagtcgagatttttgtcaggaatgttgttgttgtactttataaacacgaatagaagtaatgaagtttcaatctactttgagagatcttgcatgggagtggtggtccaaccgatgggacactggcggtcagaacgacgacatcggcgcagtcagacctacaacactacggcggtcagaccggcggcgacgactagcgacttcgacgcatcgggtggttaggccggagcaattataccggtcagatcgaaggtcttcgagcggtcaaaccgacgcatatactccggtcagatcgatctatatcaaattcgagagtaacttttaattccgataaaagttatggtttttgggttctacaaccattcaccccttctggttggcttaattcttgttgttagatcctacacgggagagatcgagagaaggctatgtgtggctatgggacagggaagaaagagatatgggagttgagaaagaaataagactgagtctgcgagtgctatgaatgtgtcactctgtagctaactaaaccagcattatcaccaccaaaataaaataatattgaattaatcaagcctgggactacacagatatattgctaggaacacttgcatgtacacgtagacatgtatatatgtgtgtccatccccttcacgaaattaagctaatcaaactagctttcagaattaaatcgacacttatgatattactattagttttttattaaactggtattatggtggtcatcaatgccaattcttatttaagtgtgcgggtgagagaagagcagaaagttgtcatatggattacatcatggcgtaccttgcaccgaaaggtagcctttgggtaaagcagctggtaggaggcgaagccagtaaagcaagcatcgcttaatattgtaatgtttattttcccattgcaacacacggccaggtcttttttctagttttatgattaaagttacagaaaactatagttattatggcttatggtatttaaccataggttttatggtctaactattttataaaaccacacgtattcaaatattgattaattgcaacatgtttgaaacatttttttttcaaagtagtgaagagttaaactatcaaccttatcaagaacttaataattaaaaatttcatatacactctaagatttagaatcttaagtaaattcctgctcaacatacatagatgtggggttttatgaaactttaaaaccataatatccgaggttatgtatcaccggttataataccttcttcctttgtcgcacaaaaaacacacctaaagcaaaatgtgacatattttagtactacttattctagtagtatctggacagagagttgtccagattcgtagtagtagaatgagttacatcatatcatatatttatttttttggtacatggagtagggttttatgtaactttaagataaaacatagatgctctgttaaaaaagggaataaacctttaataggaagttagatttttgcatgggaatttttctaaaaatattctatgaaaactttcagtagaaactaaaagattttaaatgttagattttgttagaaaaaaattcaaaaaattatgtaaagattgaaataggaaataaccaactaaaactccgcggtatctcaagctccgtaatggagcagctgcacgctgaaggacagcacagtgtccatcggagttgaacaagatggcagctacacgcctacacatctatgtttcacgattttgcagttggaattagcacctccatcggaggaggcagttggaggggcagatgatcaaggccttgttcgaggcagtcctgatggtcctcttcgccggcggtattgattggaattttgtagcctaaggcacgcaatgctacacgtgcgggcgacaacaaggagctggtactggaggaggtgacatcgttgagctggtaacgagggtatcgggtctggtaccgatgtccgataggtacaagatcggatactgatgggtatcagccgatatcgatgggtatcagatctgatgcatagtaagataccagctatatcgactaatctgcgttcagcagcaggtgaaagagagaagatttctcttgttctccgcgtgcacgcttcccgaactaataaacggtgtgttttttttaaaaaaaaaaattctataggtaagttgctttaaaaaaaagcatattaatccatttttaaaatttaaaataaataatactcaaataatcatgcgctaatgattcacctccttctttttacgcatattctcaatcttctcttttcctattctctcaaacactcggatattagaaaaatctggcaattaattgatagaccctcaacttcacaatggacccaccaaactttccactgtctaactattcgtcagggtctaaaaaaggaagcaaaaaacatggctgaggaggtagcaaagattaattaatcgagaagttgtgcaagcatccacatatacaaatatcaaattgttatctgcatctatatatagttggtggagacgccagaattatctaaagaaaatcagaatgccttgaaaaaaaaagagaggtacacgagggtgggaatgagatgtattcaggaaacaggtgacaagaacaagattcattgtggatcaagtaggatcggaaggtcaacatgacctgattgattgccaacatatggtgagaagtacacagcctcatgcttaccagcagtaggtgctttcaaccgcctacatggtggatccattctgttctgtaaaaaatgctaccgatggggataggaaacttctgagtgtagtttctacgactcccctctgcagttttcaattgttttgtcgtgcaatttgggttcataagtctgaacaacatcaatcacaagtccgcaagaaactcattgcttttgcaacaaatttgcgtggattttgattagctgtatgatgttttctgaacagtacaactcagtttttttgcaactctgttgttattcaagaatttcgaggatatggatccacttgtgatgcgagttcaagcgaccaatgtagaatattctcaaaaatgttgagaatatgacaatgtagaattccaagcgaccaattaaccaatctcctgactatcgtaacagagacaattgagctcccaaactagtcaaatggtaaaaccatttggtggcaatgacctaaatttcccatttttgatttttctgaaggtcattccacaatttttttttcaaaataacagaaatttcacaagagtcatcatccaaagaagcaaaaagagcgagggtttctaatttcagaacagatgtgcataattgcagaaaattgacattcaatcaattcaacataggatttaagtacttaataagatatattacagaacaataacatcgcattaacaatacacacgcaccaaacttttcactacgcggaagcaagaaagatcaaacgacgcggatggaacgaagattactcgagaggttttacatgcataagactgctcttagattaaatttctgagtgtagcacatgtagttgcagcagatgccagaattatcttgagtaagttagagtgccactaaaatgagaggtattcgggtgagattgagaggcctttaggaaatactccctcattccctaaatgtttgacaccgttgacttttttaaacatgtttgaccgttcattttattaaaaaccttttgtaatatgtgcaaaactatatgtatacataaaagtatatttaacaataaatcaaatgatagaaaaagaattaacaattacttaaattttttgaataagacgaacggtcaaacatttttaaaaaagccaacggcgtcaaacattttaggatggaggtagtaagtgagaagcactaggtgcatcccaaatacagaggttctcggatgagaatcagaagcactagtagtcactcgatatggcaacaaagtgtcactagaacggataccatcatctcaatcggaccgtaagccccatctcaatcgggcatggcgtccgtcacaggttagaagtcacagctgtgaagagttatctcaatcgggcaaacggccgtcacggatgaatctatcttaatcgtgccctaattaaagcccgtcaccgatagctttgacccagacgactaatcaaactatagcccgtcacagatgacctatctcaatcgggccacaactagcgttcgtcacagatgacccttatctgtgacgggtattaactatagctcgtcacagatgactctcatctcaatcaggcataagttaatgcccgtcacagatgagtataataaaaaaaaaataaatttcattttttggctagccatgccatgccatcccgcctctcccatgccaatcttttttatcctcactcatgtgcacccgagaagaactttccggtgggtgacttttttatccccactcatgtgcacccgggatgaacttttcggttggtcacccatcccgaaattgctccagggctaacacgcttaacatcaaagttctttggagatcggcttccgaaaaaatagttgtaaattcttggtatgagtattctattaatcctattaagccctaggctaggatgtcacaccccaacatcccccattcatatacattcattcatatacacaaccatcaatatatttaacacaaccacattcacataacatccattttgatcatatatttcatatccattcacatatttcacatattatattagcaaaaccgagttaattggatcaaatattatatttagcaagtattattatgaagaggaagcaaatcagacttctagaaaaaatgaattttgaattgaattttataatactaaaaaaactcaaatgaaaaagctgtcaaaaataaagttgtagaactcattgagatctgtcaaaaataaagcccgtcacagatgagaacattaaatttaattttaggccgattgttgtgtgtcaaatgcaaaaatcataaacaacaaaattgtataactcatcgagatctaaaactattgtatcggttctgtacaaataaattcatttgaaagattcaaattttgaattttcaaaatttgacaacttcgaacaaaaattggggttattaaatgatttcaaatcgaaaagtcaccaaaaccaaagttgtagaactcattgaggtgcaaaatttttattttggtcatttctccatctgactctatttaaataatttgaaatttaaaattcaaagtttgaaaaattcaaatagaattttagatcaatgaacgacttcaactgaaaaagtcatcagcaacaaagtcatcagcaacaaagttgtataactcatcaagatctataacttttattttggtcatttttctatataatattttttgaaccatttgaatttgaatttgaaaatatgacaacttcaaacaacatttaaaaatactaaatgatatgaactgaaaaagtcatcaa

SEQ ID NO: 7326 - DNA, 719 bp, Oryza sativa
cttgtacttccttgcattaattatgcatctccggtgtggcttgctgagtactgtggttgtactcattcttgctcaatcttttcccccttcagtaagagaagctttggagaagaagtcttacgtggagtcttggcttataccccagttgagcgcctgtgaagatggagccgtaggcccgctagtccgctgctgtttatttttgattgtcaggcctgaagcgcctttgtaataatgtaaatattatcggtataataaagatgtgtcttttatatcatgtttgtgtggtgtaccccggcttttcctgggacggggattaatacactagcgttcgggaaaaggcaattttcccggtcgcgacacgacccaatcccgcctacggccggaacctccgggacaggcaggcaggactgagccccaagcagcagggcaccaaccctctgccacgacatctcgactaccgggccgcagctcgtgtagccttcatttgccctggagaatgttcatcgacccccgacttcatccatccccaatccgtgtacttttgtttataaccagactgagccacaaactaagccttacccactagacatgtggaagtacggtagtgctttgcaacagaggccctaagaccggtccttatatggccgaggtgctactatcaaaaccatgcaccccgagcccagcctgaaaccattttggggattttgaatagaaggagc

SEQ ID NO: 7327 - DNA, 8172 bp, Oryza sativa
ccggcgaactttgcgggactaaatccggacgaatccgagggagagagagaggggaaagtggggggaaagagggagggaatcacggggagtgatttccccctctttatggcgcgcggggacggcgggatgcggcggattcggcggcggcggcggcgctagggcacgggcgggcggcgggcgcggcgcgaggtatgcgatgacaggtgggccccacccgtcagcgagggtggcgggcgggcccgcctgtcagcggcgcgcgcgcggggaggaggccgatgggccgcggggagaggagagagagggagggaattgggccgagccggcccaagagggaaaaggggggggggaaagaagacttttagggactttctttttataaaacctttttaactttgtttatttcttctcaattattatttgtgctctgaaaattccactaaaatttatttacgcattttaggcttttaggaaatatacaaaaatcctccaagccttatttgacttttaaatttgcacattttaattgttggaggctttcacatgaattttaattattctcggcacaatttcgaggatgtattttagagtcgatttgggacgcgacaaacctacccccccttaaacggaatctcgaccccgagattcggaagaactggcgaggagatcgggatgggctgccttcagctcgtcttcacgctcccaggtagcttcttcttcggcatggttgctccactggagcttgcaaaaacggattacccggttcctggtcctgcgctccatggtgtccaggattttcactggcctctccacgtaggtcaaatcttcgcgaacttcaatctgctctgagtcggcctgctcggatggcactcgaaggcatttattgagttgcgacacatggaacacatcatgcacgttgcccaaggaggcgggcagctccaactggtaagcgacttctccgcgtcgagcaacgatacggaaaggacccacataccgaggtgcgagcttcccttttgtctgaaacctgtgtacacctcgcaatggcgtgacccgaaggtacacaaaatcacccactgcgaattccaggtcacggcgacgattatctgcataacttttctgccgggactgtgccacctttagattatcccgaatgattctgactttagcttcagcttctctcaggatatcagtcccgaacacttggctttctccaacttggtcccacaatagcggtgtccggcatttgcgcccgtacaacgcttcataaggtgccaattgtatgctggcttgatagctgttattgtaggagaactcggcataggggagactcttatcccaggtcttcccgaaatctagtacacatgcgcggagcatatcttctaggatctgatttagacgctcggtctgtccatctttctgcgggtgataggcggtgctgaaattcaatcgagtacccagctcttcttggagcttcttccaaaagtgagaggtgaattggcttcccctatcagatacgattttcttgggaacgccatggagactcacgatcctagcgaagtagagctcggctagtttgttccctccataggtggtctttacgggaatgaaccgtgctaccttggttaatcgatccacaactacccatatagaatcatatccaccttgggtttttggaagtccggtgatgaaatccatcccaatttcatcccatttccattctggtacttggagaggttggagaagtccggccggtcgttggtgctctgccttgacacgctggcacacatcacatagggccacaaactctgcaatttcccgcttcatgctaacccaccagtatttctccttcaagtctaggtacatctttgtactgcccgggtgaatggaataagggctctcgtgagcttcctgaagtatcagctgtttaagttctctgttatctggaacgcatacccgctttccgttccatagggttctgtgttcatcctctgtaaaaccagcggctttaccctgtttcatattcttgaggagtccatgcatgtccggatcattcttctgagcctcgcggatttgatcgagcaaggtaggcttggcttctaacgcagccaagaatccgcgactaactatgcttaggttcagggcttccatctgttgactaagttcgggtggaatgccacggacgttaagagtgttgcaatggctctttcgacttagagcgtcggcaaccacgttggccttaccaggatgatagtgaattcccacatcatagtctttgatgagttctaaccatctcctttgccgaagattcagatccgactgggtgaagatgtatttcaaactcctatggtcggtatatatttcacagcgattcccaatgagatagtgccgccagatttttagagcatgaaccaccgcggctaactccaagtcatgtgtagggtagttgccttcatgaggtcgtagctgacgtgaggcataggctactacatgaccgtcctgcatgagcacgcaccccaatccttggcgcgaagcgtcacaatacaccatgaagtccttgcgagtatccggcaagattaacaccggcgaggaaaccagcttttccttgagagtttgaaacgccttctcgcattgcgggctccacacaatttctcttctttcttcaacaactgtgtcatgggtcgagcgattttggagaagttctcgatgaaccttcggtagtatcctgccaaacctaagaaactgcggacttgagtgactgtcttgggttgcttccaatcagtgacggcggtcactgtttcggggtccacagcaatttgacttcggacaaccagaactcacacttgctaagcttggcatacaattgatgttcccgcaactttcccaacaccagacggagatggtgctgatggtcttcctcggattgtgagtatatcagaatgtcatcaatgaacaccacaacaaacttatccaagtattccatgaacactttgttcattaagttcatgaagaatgcaagagcattggttaaaccgaatgacatcaccgtgaattcatacagtccgtatcgcgtggtgaatgcggtcttcggaatatcttcttcacgaatacgtaattggtgatatccggaacgaagatcaatcttggagaatacagtggcacctttaagctgatcgaatagatcatcgatccggggaagagggtacttgtttttgatggtgacttcattgagagctctgtaatcgacgcacatcctcttcgtcttgtctttcttctctacaaaaatcacaggagcaccccatggggaagtactcggacgtatgtaccccttttctttcaactcttccaactgtttctttacttcggccagttcatttgctgccatacggtagggtcgcttgtgcagaggagtggttcctggagcaagatctatccggaactcaatctctcgcttgggcggcataccgggtagttcttccggaaacacatctccgaactccctgacgatggggatttctgacagtcctatctgatgcaattctgaactcttgatagaggttgggggtgcaaagaaaacaaccggttgttccggccctcggtacagagtaacagtgcgtctcgcgcaatccactactccttggaattgagccaaccaattcatcccaaggatcacatccaagttcttggtgtctagcagaatcagatccgagggaaaaggaatcccctgaatttctatagggacggcagggctataatactttgctgtcataacccctccaggggtggtgatgagcagagggttcttaagcctttctacccccaattgatttctccccacgaatggcacagatataaacgagtgggaagctccagagtcgaacaaaatggtagcagggatggaatgaacgaggaacgtaccaacgatgacgtctggagttgtcagcacgtcctcggccgtcacgtgattcacacgaccccgaatgacatccttcccgccgttgttggagcggggaggcgcttggccttgctgacgccttggctttgggcatttatccgcaaagtgcccgggctcgaagcagttgaagcacagacgctgctgaccttgagcgtccctgcggccttgaccaggctgcaccgttggcgtaggaggacggggcgcacgagtcccttgttgattctgctgttgctgcggctgtgggaagcgcaccacgaattgaggtcggggcgcggggcgaggttgctgctgctgttgttgctgctgcgaggaggatccccctggatagggattggtgtagcggcccctttgattagcaccctgttgattgcggaaattcgccaagcggcgcttgtgcgactccagctccttgtgcttggcttccaagcggatgctcttgtccaccaatcgttgaaaatccggatagtccccagagactagacggacggacagttcagggtccattcctgccaagaacttttcttgcttctcctcatcttcccgcacatcctccggggcgtaacgggctaggttgttgaactcatgcaaatactccatcacggagcggttgccttgcttcaactctcggaattcccttttcttaagggccacgactccggcgggcacatgggttctccggaaagcggcggtgaagcgggcccaagtaataggctgcccctctggctgcgtagcctggaaatggtcccaccatagagatgcgggcccctgcagttggtgggcggcgaagataactttctcctcatcgctgcactgcaccgtgtctagctttttccccacggcatgaaaccaatccaacgcatccacggggttgttggagctagagaaggtaggtgggcggatacggaggaactcggcgagtttagagtgttgtgggggtggtggtggagcattatgttgtggtggattttggaggtggtggaggaaagcagtcatcatgttggcttgctgggcgaggatttgggtgagaatggcgttggtgtctggtggtggtggtggaggcggaggaggaggtgaaggtgggttgccctgatggttgtggttgctgccttcgggttggttgccatcaccggtggcagcatttctcctggtcgtcaccatctgaaaaccccacacagaaccagcaaacagagaaagagctaacaattaaaactaaccacccacgactaccataattcttgaatttattactgctattaaattggttcattaatgttcaagttgcttaggcaaataaaataagacaggctccgacacagttatgccacacaccggcataaccatgccccacacgactcaaaaagacaaacgagaaaaaaaaacacacgcgcaagcctactaactgctcgtctactgctgcgacgggccaggacggaaggtgagcaacagcgcaccctccgtgctaccaatgccggaggcttccccctcctggggaaccacgggcgcgggctcggcacgaggggtctcgacgaagcaagtccacgccagggactgacgaacaagctcgggcctggaggtgctcttgcgggcggtgatcttctggctgcggcagacgcggcgacgcttggggcggcagacctctccctgggcgatcttgagctgatgcagctgcggcctccaccgcgtctaggtccttcttgagctgcaggttctcctgacgcagctccaggatcttcagattgttctcgaccatcccgcgacgcaccatctgatggaagtcgatacgagccgcgtcgtacacctccaccatgcgcgccaggtgcacgatggtagcgtcatcctccgagctagcatcccggaaggtggcgtagtcgtgggctcctccgcgacgagggtggtagcggtagggcgagtgctgcaactcgtccgggtagcgctggtgaagagtgccgatggcgaggagagcggcgttctggcaagcggcggggaaggaatctccacccgcggtaactgccagcgaagtccgctcgggagagccagagaggatcactgcggtgacctcccaaccagcgtggggctccgcgtcgtcaccctcctgatccggaagcggcctggcctggtagtccactccatgtggataccccagggccacgcacatgccccgcagctccaagacgaagccagtcatgtccaaaccacgacgggtgacgctgccggccatctacaaacaaaaacaaaaagaaaacaacattttaaaggtcagattttggcgataaatgaagcagcaagacagagagagactagacagtttttacaaataacaaaggatttttatttttgaaaatattgctaaggcttgggatctacggctcgtcctagggtcaagggtagctctgatgccaacttgtcacgaccggaaataacccaacgggcgtccctgacgtgcgtgcattaatccttgtcccaggaggcaaggtacaccaaaacttgatacaattcagagtttaacaagcggaagcgtaaatagttaacttattacatgggcagcgaaggcccagcacacacaaagacaaacgggaaacagcggaagactagggcgacgaccacaggcgcttgacggcaggcacgagctagacaccaaagccttcatcttcaaggagctcctcttctgggcttgggaaaaaattgagcaagactgagtacaaccaccgtactcaacaagacacacccacaaatgcagaataaatgcaagggagtacaagggaattataatataaagggttagagttgcagtaaacagcatttaaagacatttagttgctcaaagctattttgtaaacacgatcctagaactatacaatgttattaatcaaggccgtgaacccacacgaacctgccttaacccaaggcctatgatgattcagaccaaactggcaacccgaccctgggttccagcttcgtccaagccaacccaggccaaccattccacgttttagttgttaaacaggttttaagaattaaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacggacggaagacgtgacatagtttccaacccatcctagccatagacaagagtaccgacccaatcccgcctacggccggaacctccgggacaggcaggcaggactgagccccaagcagcagggcaccaaccctctgccacgacatctcgactaccgggccgcagctcgtgtagccttcatttgccctggagaatgtccatcgacccccgacttcatccatccccaatccgtgtacttttgtttataaccagactgagccacaaactaagccttacccactagacatgtggaagtacggtagtgctttgcaacagagacccgaagaccggtccttatatggccgaggtgctactatcaaaaccatgcaccccgagcccagcctaaaaccattttggggattttgaatagaaggagcggtgtgaagccaattccacaagaaccaaaccattctaaagtatccaggtgatatgaatatttcccaaagtctatagttgaaaaaccacctaatgttacctaattaaattgcgaagcatctacctaaaattaaactagtggtaccatgagtagaatgtccactagttgaggttttgtttaatctagggtgaacaaggtaataataataacaataacaataataatatggtcataacaaaggtaaataggcatggctaaataaaacagtgataacgcgggaatttaaataaagcgataatgcaataatttaaatcaacataattttataaactgggattcaatatgctcaaagatgatgtgacttgctttgctcgctttcccaaacgtcggcttcaacttccacgaagagcggatcttccgaagctgcagcgtctacacgaccaacggaaaagaaaaggcttttactctaataaactccacataacagccgaaacaaagcacaaaaatgggttcttgacttcttaaggaaaaattaaagacttgaacggtccaattccgagttcaaatggccaagttatggccatttgaagtttatatgctctttaaatggagatttgcgaatttcttcatttaaattttaatta

SEQ ID NO: 7328 - DNA, 4684 bp, Oryza sativa
actttgtttatttcttctcaattattatttgtgctctgaaaattccactaaaatttatttacgcattttaggcttttaggaaatatacaaaaatcctccaagccttatttgacttttaaatttgcacattttaattgttggaggctttcacatgaattttaattattctcggcacaatttcgaggatgtattttagagtcgatttgggacgcgacagccaccagcgaccgcgcttcactcccggacagcagggtggacctaccaccatgatcgtccgccagcaccgccctttcaactcgagcagcttccaccagggcgccagtggcagccagaaccaccagggaggtcagcccaactgcagcgcagctccgcgcccaccaacggcaccagcacagtcagctccatcagccgaagccaagaaggagactggaacaaagccagggtcctgcttcaattgtggcgagcatggccactttgctgacaaatgcccgaagcctaggcgtgctgggccaaggtttgtccaggctcatgtcaaccacgcgtccgccgaagaggcgcaaccagcaccagaggttgtactgggtacgtttcctattaactcagtccctgctacagtactttttgaatttggcgcaacgcattctttcatttcaaagaagtttgtagggatacatgggttaagaaaagaagagcttagtacaccaatgagggttcataccccgggaaatagttcaaccttggtcagttatagcccttcagtgctcatagaaatacaccgatcacgatttctagccaacctcatccttcttgaatccaaagatctagatgtcatccttgggatggattggatgaccaagttcaagggagttattgattgtgcgaatcgcacagtcaccttgactaatgagaagggagaaaccgtggtgtacaagtcaccagtctcacggaagcaaggaatctccttaaatcagattgaggtggaaaaccctgtagccatcgaggagaagagttcgcggaaattggaagatatctccatagtctgcgagtatccggaagtgttccccgaagacctcactaccatgccacccaagagagagattgaattccggattgatttggcaccggggaccgctccaatttacaagagaccgtacaggatggtagccaacgagctagcagaggtcaagaagcaggttgatgagcaactgcagaaagggtacattcgaccaagtacttcaccttggggtgctccggtcatttttgtgcagaagaaggacaagacgaagagaatgtgtgtcgattatcgcgcactcaatgaggtcacaatcaagaacaaatatcctttaccgcggattgatgatctgttcgaacagctgaaaggagccaaggtgttttccaaaatagacctgcgatcaggctaccaccagttgaggattcgggaagaggatatctccaagacagccttcactactcggtttgggttgtatgagtgcacggttatgtcttttggacttaccaacgcacctgcgttcttcatgaacctgatgaacaaagtgttcatggaatttctggataagtttgttgtggtattcatcgatgacatacttatttattcaaagtctgaagaagaacatgagcaacatctccgtctggtactcgaagagttgaaggagcaacagttatatgccaagttcagcaagtgtgacttttggttgtcggaagacaaatttctgggtcacgtcattacagctcagggcatagcagttgatccagcaaatgtggagtcagttaccaaatggaccccacctaagaccgtgtcacagattcggagttttcttggacttgcgggttattaccgtcggttcattgaaattttctccaggatcgcccgacccatgactcagttgcttaagaaagatgagaaatttaaatggacggccgagtgtgacaagagttttgaggagctcaagaagaaattggtgtctgctccagttctgattctgcccgatcagacgaaagacttccaagtctactgcgatgcgtcccgccacgggcttggatgtgttctaatgcaagagggcagagtggttgcttttgcctcgcggtagttgcgtccacacgaagggaactatccaacacatgatttggaattggcagcggtggttcatgctttgaaaatctcgaggcactatctgatcagcaaccgctgcgaagtatatacagatcacaagagtctgaaatatatcttcacccaaccagatttgaatctccgacaacgaagatggttggagctaatcaaagattatgacatgagcattcactaccatccgggtaaagccaatgtggtggcagatgcattaagcaggaagagctactgcaatgccctatgcaccgagggcatgtgtaaagaattgcagcaggagcttgaacgtctcaacatgggaatcgtagaacacgggttcgtagccgccctagaagcacggcctacgctcgtggatcaagtcagagcagctcaagtgaatgatcctgagatagctgaactaaaaaagaatatgagggtcagaaaagcccgggacatccttgaggatgaacatggcatgatctggatgggagaaagattgtgcgtgcccgatgataaagagctgaacgatctgatacttactgaggctcatcagactcaatattccattcatccgggtagtaccaagatgtatcaagatctcaaagaaaaattttggtgggccagcatgaaaagggagatagctgaattcgtcgcgctctgcgatgtttgtcagcgagttaaagcagaacatcagaggcccgcaggattgctacaaccctcttcaaatcccggaatggaaatgggaagaaattggaatggatttcataacaggtctgcccaggacatcatctggtcacgattcaatctgggtagtcgtggaccgacttaccaaagttgctcatttcattccagtgcatactacttatacgggcaaaaggttggcatagctccatctctcgaggatcatgtgtctacatggagtacccaaaaagatagtatctgatcgagggagccaattcacttcaaagttctggcagaaattgcaagaggaattgggaacccggctgaatttcagcacagcctaccgtccgcagaccgatggtcagaccgagcgggtcaatcaaatattggaggacatgttaagggcttgtgcacttgattttggtggagcctgggacaaaatcttgccatatgtggagttctcttacaacaacagctatcaggccagtctacatatggcgccgttcaaagcgttgtacggttggaagtgttaacagaagcattgtacggcctctcttctgggatcaaacgggcgaacgtcaactgttcggaacagaagtgttaacggaagcagaagagaaagtcagaaccgtcagagagaggctaagaattgcccagtctcgacagaagagctacgcagacaaccttcgaagggagctcacttttgaagcaggggattacgtgtaccttcgtgttactccgctccggggagtacaccgttttcaaacgaaaggcaagttggcaccacgcttcgtgggaccatacaaaatcttggaacgaagaggagaagttgcttattaactagacttccattcaatatgatcggtatccatgacgtgttccacgtgtcccagttaaagaagtgtctgagggtacccgaagaacaagccgattcagagcacattaatatccaagaagatctgacgtatgtagagaagccagttcgtattcttgagaccagtgaaaggagaaccagaaacaaggtcactaggttctgcagggttcagtggagccaccattcagatgaagaagcaaccttggaaagggaagatgagttgaaggccgcccatccgcacctcttcaccagctcctccgaatctcggggccgagattccgtttaaggggggtaggtttgtcacaccctgaattctctccccaagcctaaattgaatttataaatcaccatgagaaaatatcggtgtcaaagcaagagaaaccctaataaattaatgcaaataataatcggaattgtcatgtgggatttttcttgagttctacacgttgaaatatgctaacaagatttttagtggaattttcagagctctagaaataattttaaccaattaaaattgagcacaagcaatatttaattccctggaaattcttttcctcctttttctttcttttttcctcctttttcttttcagcatgggccgccggcccattctctcttccccccttccttcccgctgggccggcccacaggccgaggcccagctaagccggccgccttcctcctctctcccggggtcgccgacaggtggggcccacctaacgggtccttccctaaccaccagccgccgccaccgcgcccgcaaccgccgccgcgtccacgccccgcctgctccgggccacgtcggccacgcctacgcatgcgcccgcgccttccgcacccactccccctctccctcacccgcgcccgtgctcgagacagccgggattcgattttagaatctcgcctttctctcctccccacctctcctaactccgctggcgaaatcgcggccaccccggccacgatcggcccttctgtgcctatataaagtacccccgttccctcct

SEQ ID NO: 7329 - DNA, 6680 bp, Oryza sativa
ggtagatcggggccgtccgttcggccgcccacgtggctgccgtgtgaccgcagcgtcggcgccacgtcgtgcgccgtcccttccccggtccgtagactcggtccaccgcggattgccacccgtgtcatcgccatgtggggcccgcatgtaggcgccacctctctctctccccgggatttatttattgtgcaataattcaattaaggatttttctgtttatagtaaaatcactgtgaatcttctaaaattcatatctaatccatccgagctccgtttaagcccattcaagtctcagtaaatcaagaaaaatgtgtagaatccattaataatggttttgttctctgtttcagtagtcttatagcctgtttgtattgtttgccttgtatgtcgcttagattccggctctcccgatgctccggtgtactttgaaatagtcgccgaggttcctccaggagcagagcaaggcaagtcatgcttgtcacttgaacatattgatcctatattgcaaatggtctattgttttccttcaaatactgcattgttttgcaataatagtacgggatgtttacctaatgttacagccatgctatttttggtaccatgctcctttgataacttgggatataaacatgattagagattggactagggattgcttagccatgcttaattcaactagcacacaatggggaaaacatactaatgtatagactgtaggttctaatgttaatgctggactagtgccaccgcttcggtgttggttaactaaaatcaatcacatggtgggttgtgggtgcatggttttgaaggtcgcgcccatggcaattaaggatcggttcgcgggatgccctggaagaacttatcgtacttaccacaagccagcgtgggcaacggctgggcttgtagtgtagctttcctctagctgacgcatccaggcaagggtgggcgtgatggagtttggatgggtcctgcgacggcctatgcggcttccggattcacctaggcacgagaggggactacccgctgccttgcgaggaatgggggtgaaacctgaggtgtggtgtgcttggttagagggggttatgcgaagggtcctgtcacggcctctatccggtatatcgtggtggcatgtcggcgcatggaaacgtgtcgtggggctgtgtcttgtgggtacagttgtacatctctgatcagagtaaaactattctaatagcagtgcccgcggttatggcgggccaaacagattcaccgtgattagtctccccctagtgttgtctgatggaactgattagttcaggtggttggttgggcctgttgcaacgtggtgtagcgttgaccagtggatggttaatattgattaattagtacaattgttttaccgctttaaacacctgtttataaatgctcgctttatgcaaaagaacctctctagctatcctttggcaatatcctgcatcataccccgattccggtatgacttgctgagtacagtgggtagtactcagtcttgctctattttcccccaacccaagagtttgagtatgcgtcagatggtggttctccgagaagtaggcttcgtccgtgctgtcgaggatgcctgtggagtggtgttcctgctgccgttcaagtcaaggcttagctccagttatcttttgtttttccgctgcacttatataagactcttataatgtatgtaagacgtggatctgtatgtcaactttgtcgtttgtgtaccccggccagtcctggacagggattttaatgcacactatgcttggaattctattcgggaatttctgggcgtgacaaacaccgaccaagcaacacagcccaagcggcttgttctcatttggttccacttcctttttcaaaaagtatgaattaacccccataaactatcgaggtcgatcgaattgccccctgagctgcaataccggccattcagcaccttaaactcttaaatccggataaataaccccctgcctcaaaccggggtggttttggtcctacatggaaatctagtcagcaattattttttaaaaaaattcggtggaccctacatgtcatactctccccatctatctcttcccttcatcccatccgggtacgcctaatcggcaatcgatcgccggggggatggggtagcgatcagattcgctccccacccctccccctcccttcctccacctgatttccttttttggcaccgcattactttcctattttagtcaatttatgcacctaaagtttgtgcacctcaagtttacacatctccacatttttttaaaaaaaacagaagttagaaaaatttatgtatagaaatactatatataaaaaaatttgaattcaaattcaaatttgaatcgggtatgtaaacttttaacttctaaactttgggtctataaactttagatgtatagaaatactatatatagaaaatatttgaattcaaattcaaatttgaatcagatataattcaaattcaaatttgaatcgggtatataaactttaggtctataaactttaggtatataaactttaggtgtataaactttagatgtatagaaatactatatatgaaaaatatttgaattcaaattcaaatttgaatcggatatttgaattcaaattcaaatttgaatcggatataattcaaattcaaatttgaatcagatatataaacttttaacttataaactttagatctataaactttaggtctataaactttaggtgtataaactttagatgtatagaaatactatatataaaaaatatttgaattcaaattcaaatttgaatcggatatataaacttttggtttctaaactttagatgtgtaaacttgaggtgtataaatttactaaaataggaaagtaatgtggtggcaaaaaaggaaaccaggtggaggggtggagggagggaggggggaggggatcgatcgctgatccatccccagggcgatcgatcgccaaacaggatttccgatcccatcctctctcttttgtcccttcccttccctcacctccatctctctctctctgaactgagctagcgacggtggtgtctatcagcgttgcacagcggtcaatggcaggaggggcttgagcccgtgcaagcagagccacgggcgccgatagaggcagcaggtggcgcacgtctcgcatctcgcggccgacaatggtatacgcgagggacgggtgaggacggctggaaaaagctactgcggcggcagttttttcggcgaggcaggcggcgcttggcagtgagataggtggcaatggcgcccgggacagaggtggtggtcttcgtggtcaacagcgagcgcttcaagctctaccaccacggagccgctgtcgccgaccccaggggcaccctcctcgggttcctctgctcccgcactcgcttcaccagcgccaagcctcaccattgtgctgctatcggcgtcggtcacccggcagcctctccaccacctcccacctcctcctcgcctctctgccaatccggaggagatggtggatgccctccatgagcttgcagagacgtctcccaagcaagctcgacctcctattcgtgggattgatgagccgctgcctcgagcccacctcaccgctgccccgctatctctgacgaccccctcgctagtgcactgccatctccaacccccactgcgccctccccgttacgcccaccatatcctcccagccattggcagccggccgcccactcaccatgtgtgggacagctgagctcgtgcagcccccttccttccctccttgtttggactggccctcgctggcagcactctgtcctctcacggatagagaagcagagaaggtggagagaaaaaccaacgctaacaagcgggtcctattaatttttatttgtttttgctgagatgtatctgctacaggacgcatgtttgcagagttacaatataagaaaaactatctatttaagaagagtatactccctccggtctccttttaatgtatctgctacagtatgcatgtttgcagagttgcaatataagaaaaactatctatttaccttcaagattgttcacgttaatgacttggttagtgcatgaactttgcaacctgcaggtgctgtgttcgagcacagatgaaagcgttaatatcaaatatattaagatgtgcgtgcctatattaatgcttctataaaagcatctcgatattttgtagagatgcaatttacacgtctctagcaacgtcttaaataatataggtacgcgacatctctagcaacgtcttaaataatataggtacgcgacagtgcaaacggagacgttcctacgacgctttataaaagcgtccctacgacgctttataaaagcgtcccagttatctgtgggagacgaaataaaacgtctctatcctacaaataagatgtctctattgggttgttttgttataaagcgtcccagttatctatgggagacgtttcgtctctaacctacaaataagatgtctccattgattgggttgttttgttgtagtggtatctcacggtgaaattagtagagagtaaaaatgatcaaaatatctcatcattattaaaatactaacagtgatagatagataaagtatattaaagagataaaacttgtcattttatgtgctgagaatagttaggatactagaaattgttcttgtggaacaaaatgttgagccttttgcgagcttcacttgttgggcctgaactccatgccctctataacaagaccactcttcttgacatggtcgttctcctcgcggaagtccactatcaccttcttctcaccgagcagcttctcgtcggcagcaaactcggccagcttgagctccatccagccgtctcccctggccacaggataggccacgccggcggccattccgcgcgccgctgcagggacgacgtcgacgctgaccttgccggtggagacggtgatctcgccgtagagcctgagcgatgacctctgcgtctggccacctctcaggccgacggaggtgcccgtcagcttgtacaccaggtacaccgcgtagcgagtacccggcgtcaggtcctccgttgcgatctccccaatcaccgccagccagtacacgtttaggagctccgcgcattcggcaaacctttgtaccaacagaggaaaaataaaacacaaaaaattaatatgtgcatgttttcaggatttggaaattaacaagcctttgtattttaccagcagagaaaacaaaacaaattaatatacatgtgcctgtttcatggatttggaaaatagacctttgttccaacggagaaaataaaccttccgtttcaattcatattgtaagtcatttaactttttttaactcaaagtttctttaattttgaccaaagttatagaaaaaattagcaacatttatgataccaaattagttccgttaaatttagcatcaaatatattttgatacaatgtttgctttatattaaaggtattattatattttactataaacatagggcaaatttaaagtactttcagtaagaaaatagtcaaagacttatagtatgaaatgtagagatttgaaaagtttgctcagtatggaaaccttacctagaatcggggagggtgatccatttccagtgctcggggctttctccccatgtaacctttaataatctcgatgatagcatgtagcacttggcgttgcttgtagcatcaaccaaaaactctacatgcgttcgtcaaccaatataaaaatttggattgttcggtaccaagtataatccacagtagattctgtaaatgtctgtcagtactactccctccgttttacaatataataatttctagtattgtctatatttatataaatgttaataaatcaatttattaatatttatttgggcttttgtttcttcatttaccttatcagctggtctcctgtcccctggctgagaaggcccaggttgcaattgcaacgctttggactcctcacctcgaattgttcgcggttcgggtgaagttacagccattcgctttatgctctccatcaacctggatagcgagcttatctgccacggaagcaaaataaaatctaatcacagaaccattcgaagtaaatgatcggcaatgaaagagcctgttgttagtttttttgtctttctctgttttcagttaagacatccctttcccttatttgcctgtgtctatgcttggtactcccagtgaattacattaattagactcaacaaattcctctcgcgaattattccagagttatgaaatgagttttgtcattagtctatgtttaatcagtgtccaaacatctgatgtgacaggtactaaagattagtcccccatccaaacagccctaagcgtagccatgagtttccgtgtccaacttttatcatccgtcttatttaaaaaaatttatgattagtatttttattgttattagattataaaacatgaatagtattttatacttgacttatgctttttatttttttaaaaaaaataaataagacgaacgattaaagttatatgtggaaactaatggttacgtttattttggtacagagggagtacttatattcagccaaacattcgggctcacggtaattacttttcagtatactcgtcatcatctaaagctttttggatgtacttggtgaatctttgaatgggggatcct

SEQ ID NO: 7330 - DNA, 6112 bp, Oryza sativa
tgagtaaaaaaaaaagtgtgagatagtttaaacaacataatcttaaataaacataagtttacgtaagttaatgtgaattaaatttaaatagtatatagaatgatgatccaaatataaaagtaagatgatgttactttatgaggaaacaaaagaagataatttagaccatacatctaagtgctaaaaaaattgagataatataactcaatgagagaagaaaagaaaagagataatttgaaccataaattaatcatctaaggactaaaaataattgatgtgctatgacttaatgagaaaagaaaaatatcataaactaaataaggatgaactatataggtatataggatattatagaaaaataatggagagaaatactgaaacattatgcgaattatgtaagatgatttgacaagtttacattttaaatctctaaaactattagattaataaattataataatatagcatgcatgttgcatgatgtttaaatgttgttatccttagtatgtagtaataatatcttgggggtttgcaatgaaaactcggtatatcgactataattattataattattagttgatgatgatatgatatgtttgcatgttaaattttaggaattagtgatctataaaataattttatagtaagagatgatttatttatacccaatctacaactggagtaactgggacgatagaccaattccctgcttcctctttctcaagccgacgaaggatatcccctgtggttggcctcttatctggtttacccgctatgcatgtctctgatatctcaatgcacgcttctattatttgccggtaacgcatttcgattggcgtctgcctcatctttgatgaatcctgttccaacctatgcctccagatttctagtacctgacaagcaattcaatttcattagcaaaaagttacacacgtagtagtattaactcaaacaatctaaaatgtagtactgattattaattatttcttcttgaatatacattttctgtcgttgttccttcattattaggacccatcaccatctctctgattatcaaacccaagctgtatatatctgacttgactgtgatatctccattaactaagtattcgggtgccatgtatctcctgcatcaatggacacctgtaatctcaggtccaaggaaagcggatccacgggaaaactcatttgcaaagatatatgaaactctctctctctctctctctctctctctctctctctatatatatatatatatatatatatatatatatatatatatatatgggactacatagtgcccggactccaaggtatatgaaacacacaaattctcttaaattttttaaaattttcaaattgtgagtatatacctagatataagaatttgattcatacctatacctatcaacgaaaacaactcaaactcaactttatattcacaattcattattacatacctaactaataatatgtttggatgttatatacctagaactaaaatctaacaaaaattgttcaaactcagttcaaacttgtttgaacttgttagtaaggaagttaatattcatacctaaacatataaaaaaaattcaaactcatttaaattaggtatatattcaatttgaattttagagcccgtgcaccgtgcaccatggagcctgagttaattttactctctctatatatatatgtgtatatatatacatatgtatacatgtatacgtatatacgtatgtatatatatacgtgtatacatatacatgtatacatatgtatataaacacacatatatatatatacacacacacatacttgactaaccttgttccaaaaattctctcagtgaccatgcggcttttttcttcactcaagagccttgacaaaccaaaatccgcaattttaggcaccatactgtcatcgagcagtacgttatctggtttgagatctagatgaattatcttcctctcatgcagatagtgcaaacccaggcaaatacctttgattatttggtaacaaatctgccattgaagcacacaagatccggctgtacgacaaataaatagtacatcatagccttgtagtataaattgcaaaattattcataatgccttttattttggcacaccattgccatgcacttcgaatatatgaccattacaatatatagtggtggctggccatgtagataccataattttgcccgcaactcaaatttggagttaattatatttgcacaattttaggtcaacaaacctcttattactatgttgtatttaccgatacactagtggttttctattactttttccacaatgtaaatatttttactcagaatgaacatcataaatggagcaaatggatcacatatagttataccagtatcaagatgactgcgaaggcttccattacgtagatactcgaagcaaagcaacttttctttcgaatccacaaacatattttcccttccttttcgtaccacatttgtagatgtttcagcacagtacccaacaaaccatactatattgcagtgcctaatcctcatgagacaatcaacctcgcgttgaaatggttcgtctttaattgcatgaaatgagtaaagcttcttcaccgcaacaagctcatctccaagcactccctgtgaattttcaactctatatgttaattgctacaccataccaggtcaaacatgacggtctcatcaactcgtcatctctaacgggttcggtgttcgtcagagttaaagtgaccagtgatgacaaaataccatctttgatgggtgaacacccatcacaggtgagtcatctctgacgagtagtaactttcaacccatcagtgttgagtcatctctgacgtgtcacaacttctcacccgtcactgatgactcatctctgatgggtagtaacttacgaaccatcattgatgttaaatcacgagtcatgattttgaactttaaatgcgcattcaaaaaaaattaaaaaaatttgaatttcactagctatccattctatacatgatgacatgtcactacccacaattccacatttttttagaaacgtagatatgcttgcatttgttgtgtttagtactcaagacctccctctctaaaaagagcacccttacaaactcatcaactatagagcacatgttgatttgatttctctttcaatattattgttttagttattcctctccaaagcatgtaacatatatttaacactctaaatgatttcaaatgaaaacatcatcaactaaaatgttttagatctcatcgtgtttaatattatatatggaatatcttcgtctgagatcatttgaagaatttaaaattttgtttttcaaaatagatctcaccttagggcatgtaaactatcccaaataaaactattgtcaattataatgttgtagatctggttgagctctacgacgactttgatccataccatgttttcatccgaggtcatttgaaaaagtcaatttttcatttttaaaaatagatctcatcactttaatgcatatttggggatgtatacgatctctaatgaaaatattgtcagttataaagttatattgagatctacaacttttatatagggcatttctccaaccgaggttttttagaaaattcgaaatttggaacttttactcattagtgaattttttatccgtgaattttttaaaaaatgagtgatctcatctatgatggttcataacattatctatgatgtcatagatgacatagatcattttgtgacgggttacaattatggcccgtcacagatgacctgacatgtgtgacgggtcctccccggtagccatatcttaaacgagatactttttggcccaccaaagatgactcatctatgacgagccatgttaatccatcatagacaatcgtaataatttctaagtcaatttctgtttttcctgaaatttttcagcccgtgttctcatgaattatcatgtgactttggaggaccctccaatcagtataaaaatatggtatactggttcagttgtacggttccagttggacatttatatattcagttggtaaggtaacatggacttcctgttcgaaattagcaagatggtaggttttgaaatgctcctataactgataaaatcaagaattagtcagacataccttataaactattccgaagccaccacttccaataatctgctcttccgagaagtcatttgtgatgctttgcagtactgatagcttaataggcaatgggtctcctatgtcatcgaatagcaaatcttctagagtgttgcactgtttaccttgcgttgccatttattacctgcctctaccatttgagagcaaaatcaaaatgcttcttttataagactataaatataaaaaatgattataatttgtagtgacaaaattgtggcctaccaggaagatgtatcaaaatcaacccaatctctaaggtcacaaatgacaaaaagatcactgccttgagcacttatttccgaacagctctgttaacaatttttaaatttatgatgttacataagtattactgatgcaacaaaaatatttgaacaacctggaaatatttgtcattgcatcatttagaaatagtaaaatactactcccttcctgtccaattctgtatggagataattatactattcatggagcataatgcagaaatcagtgcaagaatgaattcgccatggttatccatggtgggacattcatcttggattatagaacagctagaatccttgtagcatcaatttttgttttttttttcttttctgcttttcagttccttgactcctccgaactctgtttttatttcaacttattaataatataaaactagtaggatttcactgaactctgttcttatttgtttaaacgtattaatatatactcagtaggaattgatctattgtttcataaagagtaaaatacatagccgatacttaaagttgagcgcgggtgtcacttaggtttataatattgtaaattgcacatatatgtccaccatcttgtttaagtgacttattgaggtccaaaccccactttaccggctctgactgccgacgtggcacgccacacaagcaccaattttacaaacaagcccctccgcaacagtagtgccatggacagcacaaaaatccccaaatccttcgttgtagtcatgccgcgccaccgccgctaccgacggtgccgcgagcgccagtagcaagcaacacactagcacgacacacacgcgcgagtggctgcggctggtagagcagcggtgggcgagagcacgggggcaggcatcacggcaacgccgggatccataacatcgcggcagcgtcgggatcctgctgccacgccgcccctcactagctcaccagcacgacggcattgagaatggcgacggaggagtggaggacgacgacgaggacgacgctcgggcgctagtagcggcagcggaggcggaggttgctcgggcggccgtcggcggagcagagaaggaggtagcgcgagcggccagtgggagaggcggggctcgctcgggcgccggtggcgcgcttgtgtagtcggcagcggaggcggaggcaaaggcatgtagccgcgcgcgggggcgggccagcagtcggcccacacggtgcggcaatggcggagaagcggaagcatcggcgaggcgggcgtggcggagaggcgcagcacccagcgcacgtcactggggccgacgtcggccaccggatctccctgccaccgacgcctcctctctcactgctcaccaccgacgcctcctctcccgcccccaccgacgcctcctctctcgccgctcgccaccgacgcctcctctcccacccgacaccgacgcctcctctcttgccgcccgccatcaacgccatcctccgcacccccaggttgaagacgacagcgacgagctaggcgcggtggcagcgatggagtctcgtagcctcggagcggaagggcagagtcagcgacgccacgtgggagggcagcggggccgtccccgtgcgccgccgtccgatgcccgcccctccacgtcgccgttcgccgctcgccaccgacgcgtgagagagagatttaggaagaggggaagcaaaatggggggcaaaa

SEQ ID NO: 7331 - DNA, 12381 bp, Oryza sativa
ggacttcaatgagtcacttaaacaagatggttgatctagatgtgcaatttacaagattgtggacctaagtgacacccgcgctcaactttaaggaccggccgtgtattttactctttcataaaaataaagaatccaattctgccatctttaagtatatcgcgaaacccactgcatattcatcttatggaaatatggaagttctctaatatgattcaaaaggatggtacatgtaatactgcataacacacacatcttagcagtaaagctatgagctgattcaataacttcatcagattagacaaccacactttcctgatacctaacccaactactttgactgagaaacatgtgaatatataagttccccttcttggatcacgtacaataacaaatcaggaacacttctatggctgtgtttatggctgtgtttagattcaaaattttttctttaaactttcaacatttccgtcatatcaaatgtttggacatatatatggagcactaaatgtggacgaaaaaaaccaattgcacagtttgcatgtaaatcgcgagatgaatcttttgagcctaattacgccatgatttgacaatatgatgcaacagtaaacatttgctaataacggattaattaggcttaaaaaatttatctcgcagtttatgggcggaatctgtaatttattttgttattaatgtacgtttaatacttcaaatatgtgtccgtatacttaaaaaaaatttggcacacgaattaaacacagcctatgttcattacaaaaggaacaagcctggaggctagagggttgctcgatcattaactgaacgacatgcaagaacacacgaacaaacgcagaaaaactcaaattaatgatagacgacatgggagccaaattatcacatggtataacagccgagatgaatacaaaacaaaaataggtggcattcacaaagtgaagaaaattaaagaaaatattaaatattgcttggcattttctaatttgcagaagagaagttgtgtgtcgtataaaatctgagaaaagctttctcagatgtagggaatgtttgccgcataaaattagtaagcgtcactagcgagagagagagagagagagagaaaaggtaagcaggagctgaactaggatcaactaaccttctatggtgaagcaagtgtagaaaggaagtggcgatcttggatttttgggcgcaatttatgctgggatcaagcatgggagagccatataaattaatatcacttggggagtactaccgagtctacgaccgggtcatgtccagctataccatgaacaattataaggcgcgaaatcagtcgtcttttcaattgattcttttttttctaattgattcatatgactaaaatgacatgactttagatttgcgtgtccattgtaccaatgcacacccatcacccatgtggtatcagacaaacattgtcagatatacggagtcaaacttggcgacataggtcgcctcttggcctaccacacatgcatgcatgagaccaaaagttaagctcgtggattgcagcgatttgtagttatgaaaatgacaactaggaaactaaagaatcatccatccccacccggaaagggagaggagtgaggttgtgtactattgaaaatttaatcttgcgtgtgtggactgacttgctgaagattaaacaaaatactcctttcgtcaaataaaaaaactcaacttagacgaggatgtgatccctcctaacataacaaatctagataaccatttatctaaattcgttgtattaagagagggttaacccttgtagattaagttttttagatggagaaagtatatttgaaagggatgtcttttgaggttgttaagagtcacaatatcgattcctgctagcggcttcgttcgtgaactgagattttaattggcacagaaaccagagcaagcaattaacacatgattaattaataattaattattataaatttgaaaaataggttcatttgatttttaaagaaacttttatatattctttttatcaaaaatacaatatctagaagtttggaaagtgtgctaatggaaaaagagaaagttgaagtttaaagttggagtttaaaacaaacggaaagaaataactactagtagaactttagcaaatctgaaatgaccaaataaaattttgtggctctttcaccttacacaatcgacacatcacctcctgtagcactggcggacccagaaaaaaatcatagccatggcgaagacaaaaagagtcaactaacaacatctcaatccaacccaatgaaacaacaaagacagccaacatggcaattacaaaaataggtagatatatacttcaagtactagttccacatatctgtattagtgaaaagtaaattccaagattggtatatatgtcctcttttatagcagagttagcacttgcgtctagtatcaactcctccttggcacccgccggtggcaccgtttccatgatctcggtcgcggtttgcaccgttgtagcctccattgttcccgtggtcatggttgccattgtgcctgctctgttagccgccacgtcctcgattggccatattgactgtcgcttcggtggtttgtcgacgggccaggcactgctcaaagccaagccactaggagtatgcctctcccagaaattaatcatcggttcggttttactgacaatggatgagatgaccggctcaaagttgtcgtcgagctagcaatgaaataggagatgagatcttcatcgtcgacaaccttcttgacagcggcggtcatctcatcactaagcaccctcatctttgcgatagtcagcgacggatagatctagatcgcccttcttggtgttgaagagagcgattctagtgttgatgaagcacgctattatcaccgaggagtacatctcctcaagcatcctgcacgcctctgcagcagggttggaaatttcggaccaaaatttccgaaatttcgatcatttcagtccactccaatacgatattagttcgtccgaaatttttcaatttttcaattttttcatgaatttggataatatttgttcaaattcaactaaattttgctcaaaatttgggaccaaaatttccgaaatttcgggatttcggtgaccccctatcaaaagtcccaaaccgagaaagtgaaccttgctctgcagaggtgctgcatgtggctacctgtgccaggatttgcttaccagttgccacccattcttcatagactggatttgggtccccggacctctgtccttaattagctcgttgtcaccttgcttcgtgattatagcagtcggagctgccgtcgtgccggtgaggtgcccttcaagatgggctcctcgcaccaatcccagaatctacgctttccttaccgcgtgattggtcttggagagtttctccaagatcgtgcttccaccgagcggattgctggccgtcgccttggatgaactccccatgagttcgagcagatgcgattttagtggggctctgataccatatgaagcaccagaggtgcagaagtgttgaaccctcttgggccgcacctttgttcatatattggtgataataaccatcactgtggtttacaagatagtgcaggttgttggatagataatatctattctgttacaacagattatatctgaacctatctatccattcaacgatgcaccgcatacatcatatatcatctatctatctatcttctatctatctattatattatattatattatattatattatatactaaaagtccattaaacttcctagaaacgctctcaaaccgccacgtgacgttcctataaatactcctagaccgccacatggcactgttaaatctcaccgtcgattttcatttaaattggtggacccaatactttagactattagattagatgtgttatttttttttaaaaaaaaagaatactttcgcatctatactgtgggccggacaaagaaacaaaacgtaagttatctttgtacgtacgtacgtacatacggagaagaaacaatgaatcttatctcctcttcaatggaagaaaagaaaacatgtaccgacttacgataaaagcgattaataagtaaaaaaaacatacgtaaagcaggtacgtagtgccactgaaaaactcgatgctccataaaatatgatattacactattttaaaataaaatatattactctataaagttatgcaaatatacatagctaaactagatcgtttacaatataaaaataaaatatcctatgaatactctttaaacatcctatctataaattattttaaaatcatatatctaatttgtgatccagtcggatcctctaattaaataaaatattgatgtctatgttcataaatacatcattatatatgaggtcaacatataataaataatgttataataataatcagaaaaataatgaattacctcttaaactattacggtcgaccgaattacccctataaacccgaaaaccggacatctttcaccctcaactattaataccggatgaattacgtccccccccaatgcggagtggtttttcgtcctacgtgtcaatttagttagcattttcttaaaaaatggtaggacccatatatcatatctcttcctaaccccttcatcatctctctctttcttctccctccacatatcaatcggcaaggctaggggcggcaagcggcggaggccgctcctcctcagctgactcggcagccacatgcgcattccaatcgaggccgtcgtctccatcatttccgttgcatatcgttgtcgcatgatgagagttgcaggtaccggaggcgagaacctgcgctggtcctcaatggccaggttctgctacacccctgccatctagaacttggccaacaaatatggccgcagctatgtctaccatagcatgtcgtcccaccacggtttttaatcgatccccatcaccaatgcctctctcccgatgagacaacgaggcggatcaatcaagcaagcaagcgtaggggaatagacgaaggaggaggagaagagcggcggggtgacagtgtgcctacccggccggtccagtagcaatgggagggagaagagagaggctggggaatgggattcaggaagagaagcagagagagagaggtgagagaggagaggggtagagagggtacagagtgtcacatatggccccacctattttattttttttaaatgcagactggactaccatgtaggactaaaactactccaggttgagtttttttttttggggggggtaattcatcttttattaataattgagggtgaaagatgtctggtttcgggtttatggggtaattcggtcgaccgtaatagttagggggtaacttgtacttttcctatttcaaataattttacatcatattctaggtgtcaaataacacttgatgactatataatgctaacttaaagctctatatgtaaaataattgaaaacaacacaatttagttgtgtatttttaagcagatatgatttagttttaatatgtctgagattaagattctcatcttttttttaatttttagaactatttcaatagtatatgataagtgggcaacataaatgttacataaatgtaaaaaataattatgaaaaatatttcaagccagtgatcttgctataatataaccatttagtccatcataggatttatggtcatatatgtatgtttttctctttgtcaaatagttttgataacaaatgaacaatcaattaacatgcgcaataaactactcatgatatttttttttatagttgaggaattccaacttatcagacataatttgatgaatgtatgtcatgcactctattgatgtgactatgaattatacttcaatcaattagttattataaataagtttgggaaaatagattcattctctaaattaattagtaaaggtatcttatgtgattatgaaaggcgttgaaaaataagatatgcaaaattatatatatttgtcaaaatataaccaacaatatggtcctttggagattttatcgtggtagtattttaaaaaacactttattcaggtaagaaaatcacatatagtacaaatagaaataaaaaaactccattattccattattgttttattatcgtgacacatgttgttctcataaagtcatgtcattgtcataaatttagggttgtatggtttcatgtaatatgtcataaccagatattaactaaaacatgtttaaaatagagtgaagatctattttgaaaatataatctaaatgtaaacatttataataaaaaaagttaagcaacattaaataagtgtctacgcatatgcgcgggctatttatatactaaaagtccattaaacttcctacaaacgctctcaagccgccacgtggcgctctaataaattaaagaaaatcctagaaattataagaaaaaaaagcaaaacatccaccccttgattttcacttaaattggtgggtccaatattatacaccattagatgaaattgatcataaaacaaaccaaatagtgtggggtcccacctctcctcctcctaccgcgcatgtgtgggtatacgtacgtaacatgtacgtacgcttccttcccttcctctttttttttcctttttttcttctttttcccatttatataatggatattttttaaatcaccataattttacaaacaaacaaatttaccatcatacaactcacatgtaactaaattagctctacaatttttgaaataaaatttacaccattatatgttaccattaaattaataatgtaatataatttccacttaaacatatgtactcattattttatactattattttcaaataatgcactattttaaaataaagtttacacatctatattgcgtacctatcaaataaacaatttaagatctatattaactgatttatacgtacacttaaactgatggacccactatataaatcattgaaactatttttattacattggactattattctcaaataatgcattctttcaaaataaagtctacaacattatatactatatactgtgtacccattaaattaacaatttaaaatctatactcactaatatgcacttacactagaaccactagacccattatttaaatcatttgatatattatttgctaataaataaagtatccgaaatcatctttttggcccgctgcacaatgcacgtctgcacctttgccttttgcacgtgtgtaaagcgtcgtgtctgaggcatctaaggtgatcacgactgccgcagcactaccgctatgccacatatcaaatcatatatggagatgattaattttgttaataacatggaaagaaaattaaaggtatgatgtagcgagagaagaattaaacactgtgggttgtgttttttctaacatttagctctgtttaagctgaaatcgagagttgattacagaataattataatgtatcgtgttatgtcgtatttggattttgtactatttattcatataggtgaaagaaatcattatattataaatctgagcactatattaacgaatatcaagagaactcttacaaaaacaagggtgttataagggagtttaagaccctctttttttctagattacatagttggatttttgtttgcacgctttccaagtttctaaatggtgccttttttaaaccacattttaactttttagaagtcaatttatttgtttataccctcaaatagctacaacataaatcagataattcatcaatttcagctgtcctaaaccttaaatagtacgtatttttttttcatgcgagtgatggtaatctgtaaattgggaatcaacggataatcaaagtcgtaagatgaatatgtaagagctactataaacaactgtaaataggtatcaaaattaattgctattaattagacatctaatggcttgctagccacacaattaatttctctctacatgcatataaacatgcaggaagctggaacaaatattaccatgtgccccatacatatatattaagctacatgcatataaacatgcaggaagctggaacaaatattaccatgtgccccatacatatatattaagcggttaatattttaattacatgtgttaagtcctttaaaatttattaaaatgctctcaagctgccacgtggtgctctaataaattagagcaaatattagaaattctaaaaaaaacagcaaagtatccactgcttaattttcacttaaatcgggacatccaatattataaactgttagattaaattgatcttagaacaaactaaatactacaagatcccacctctcgtcccatggcataggtatgcacctacgtacgtgggtacgtacgcttcctctcccttttttcatttttccctttcttctttttttccatgcatacccttctctctttttcttactatatcatgcgcctttatgagactatttaatcacaagaattttgagtatcttgctctcgcaatttttatttgtggctatactacgcggtatgcatatagatggactatatgataattaactagcaatagtttcttatttactcgagaaaaaaaatgattcaaaagtcgtaagtacttaatccttctcttactcaaaagtttatgaatggtttttaagataccttaagaaaaatagaacccttaaattattataaaataacattatccgaactttagtttgcacttaatctatgagacaaaatttttgaacaaacaataatcttatcttttaataatataagtgcccacgcatgcgcgtgggccaccttcctagttatatactaaaagttcattaaactttctacaaacgctcatatatcaccacatggcactctacaaacgcttctaagctgccatgtggtaaagaaacatctaactcttgattatcatttaaattagtgggcccatctttttttttaccattacaatagatgtagcaaaaaaaagtaatccacccatcctaatctaactctaaattggaccctcactctattcgtgcggatgcatatacatacgtactctgtacgctcctattcccaattctcttttcattctattatctatttatctctcctattttccttcttctaatagaaagcaaaatttacgtcaaaaacatttaggcaactatagcatttaaatcataaaagtattctaatatgcttatgttgttagattatttacatagtaactaaatcatacatatatgatttgatcacactataaaaagacacatagagatcggtgttgtaggtgctggaagtgataaaaccggcacctatatatcatttccgacctctgcgggatgaaaataaaaaaaagactatacctttaatagactgtaggtgtcggttttctataatataggtgtcttttttttaacaaaaactaacacctttaatttactatgagtgtcggttaattaaaaaccgacactcggtttttaaaaaaccgacactaaagagtcgagccgagctgaccggtggtctctatcgcgcggataagaccgagagtctctcgctctcccccctctctctctctctctctatctctcgctctctctgtcgcgcgcattcttctttctctctcacacacacgaacacagtctacgattcatgcccgcgcgaatgcgtgggctatcttccttgttttcttaatagcgggtacatatttacagtaagtatatgtatatatattttttctccaagtgtggactcttgttgtgagccagttctcttaagatctgcattcagccacccacccagctgccttcctcactatatatagcctatactgcttctcccgggaagaattgcacacaaatacacaatgcacacacacagacacactctcgttagcttaccattgatgaattaatacttctgtctcatactcagacagatgatacagagttatactgagtatggaaggcattgggagtatggaagtcgccaacacgtgaagtcagagtactatagatatctagaaacttatccctatatgatatgtaatctcaaaaggtaaggtaatgcgtacggagatgatacgaataagattagaggtgagagtcacctctacctcaacaatatttaccagccttgtgcctaggcttccatgtggttaggggtcgatagtagagcttctgctcaccatccatgcctgaagaagggaacagtggacctagtccaacaaccaatgtggttaatttcccccacaaaatctgtaaaaagtgaaactttgttgcaactttcatggaagataggctctctttggcttgtggtttgcttgatgatttgattgctactttcttgtgcatattaactcatacacctcaactctgctatgcaattgtttttgttatgttatctgtatatctctgtgttgcctcaaaaggacaaagggaattgttagcatttcaaatgttcaggcagaaaacaacatttttatctgcttgaacgtggggtgatggatgtttttgcaagacaccaaccggcaagaaaataagcttgaaatcttcagttaacaaaactcctattcctttacatttacaacacgtatgcacaacaacatttcccatagaaaggggtataccaatatacaatataacactacaacattgtcagctatgtgacttcaaggcatccctaaaaccgctaaaattatgaccgcctttcttcccgaaccctgttgttgttttctgcatcatcgcgacaaactcgttgtaatctatacgcccatcctgcaggaaaaagaatagcacaaaacacatcagatttactgatggaagataatctttcatggttagagttgccaaccctaatagcagcgcaaaattgtaggattggttcttggatgatcttacattgtcctgatctacttcgcctatcatgtcttcgagtcgaacatcctcgataccaaactcatcgcaggcttgctggagctcatcagatgtgatgtatccactgccatctttgtcgaagtattggaaggcggcatatagatgatcttccctttcaactttgttgaggtgtagagtggcagctatgaattctccataatctatggtgccactattgtcgatatcagcctacataaagaacatgataaacgttttgttatgcacttgccacaattagttgcacattgatgaattcagttcagtctttaccagttaacactttgtcaataagtaaacaggcaaagaagaacaaaagaacatgtgactaaactatttggttaaagaattcgatttcccttgttcttaatcgttgttatgccgagctacatggactgggacaatgttctatgcaactcctttgactatcaacagaaaacaatcaagtcagtgtgcttccttcatgtcacattatatctgaagatctgaaaaataataagaagatctgaagaactagagtctaaaatgtaacttctgtgccattccaatctagaagttaaatgtaactaattactactccctccgtttctaaatattttacaccgttgactttttagcacatgtttgaccgttcgtcttattcaaaaacttttgtgaaatatgtaaaactatatgtatacataaaaatatatttaacaatgaatcaaatgatagaaaaaaaattaataattacttaaagttttcaaataagacaaacgatcaaacatatttaaaaaagttaacaacgtcaaatatttaaaaacggagggagtaatttgcaaataatagttttagaaaacatctttaccaaccaagatctccaagtgaatatgattagcagaggggtttagagcacaaacttacagcctgcatgagctgataaatttcagactccttcatgttggcacccactctctccaacccggccttgagctcctcgtagttgatctgcccgctgttgtccgtgtccatcatcttgaacatctccttcaacccggcgatctcctcctccgacaagttctccgcgatcacctgcgcaatcgatcgcccaatcaatgtcacacaccatcaccatgaacaaatctcaatttccacaatgcaagacaggtgctcactctcaatgccatcttcttgagcttgttcatggccgagaactgcctcagccgcgacagcaccgccgagtccagcggcttgtccggcgccgacccgctcatctgcagccatggatggcctgcgagaaaagaacagcagtgtcagtgttgcaggaagcagccatggcggattgccaagagagtggtgagctcacataggacttcgtgcgcggtgagccgcttcttggggtcccggacgagcaccttgcggaggaggtccttggcgccatccgacacgttcggccatgggtccgactcgaag

SEQ ID NO: 7332 - DNA, 9297 bp, Oryza sativa
agacgatcgggggaagctaaaaatggagaggaaatggaagagaaacggagagggagaggcaacagcggcggcgtgccaaatttggcgggaaacagcgggagggccgcggttgggtggcgggactcggcgcgggagctcaactgtgtgagcgtgacagcgcgcgggaaattggttgattggttgcgtgggacgtttttgtgcccgtgtcctcaatttaaattttaaaaaacggaaattttcgataacatgaacagctttgctattttcgaaacattttaagctatcagacgaggggggcctactgggcgtcgcccagcgatcggatctgcccccccccccctctcccattcctcctccccttctcttcctattacagtacacaaaaagaattaaaaaaaaagttagaaaaatttatgtataaaaaattcaaattcaaatttaaatttgaatcgggtatataaacttttgacttataaactttggatctataaactttaggtgtataaaatttagatgtatagaaatactatatgtagaaaatatttgaattcaaattcaaatttgaatcgagtatataaactttaggtgtataaactttagatgtacagaaatactatatataaaaaatatttgaattcaaattcaaatttgaatcggatatataaacttttgacttatagacttttggtctctaaactttagatgtgtaaacttgaggtgtaaaaactttaggtgcataaatttactaaaataggaaagtaatacggtgccaaaaaaggaaaccaggtggagggagggagggggaggagggggggatcgatcgccctcgcccagtagcatttccgatcagtcgattcttttttcccagtagatcttgtgcaagttacgtgcgtattatcaggctatgaccctgtttagatgagactaaaacttttaagtccctatcacatcggagttttggacaccaattataaatattaaaagtagactattaataaaacccatccataatcttgaactaattcgcgagatgaatctattgagcctaattaatctatgattagcctatgtgatgctagagtaaacattttctaattatggattaattaggttttaaaaatttgtctcatgaattagctttcatttatgtaattagttttgtaagtagtctatatttaatactttaaattagtatataaatataaagactaaagttaagtccctgatccaaacaccacctatgtgacgtgcacatttgggcaacaggctaatggcgctcagttaacccgctgcttcctctccccaatttccttttttttcactgtgggtagcgtgcagggaggccgctactaagtgcaattttaaatttagttaaaattggatatatgcaacttcaacttaaatatgtgcaaccttcaagactactactgttttttattatcagtactataaattgagtacagatctctttgtcatttgaactatactatcactatcaagaagttacacgtgtgctagcattgtgattttattggatctccctagggatgatcacaggccgggttgggcatgggcagagcaaaaccatgctcgacccaaggcccggtaatatgcaattgggttagtaggcaaaacttcgtgcctatgcacatacctagcgggcacacgcatgcccagtggataccgggtaaggacctagcaccgtcactcaaagagtagtctgcgtcgccgcctattgtccttggccgccgtcactattgcctgtcgttgcctgtctgaactgtcatcaccgtcgtcaccttgagccgctgtcgtctacgtcgtgctaagccacaactgctgatggccaacgatgccatcctgcatcgtcgcttcctacgtcacctacacgagccaccgccgttcttgcgtacccacgccgacatcatgtgtagccactccctacctgtctccattgcccgcccataccaccgccgtcggtgtggggattggggtaggagaggggtgttgggaattaggttagggtttctattagttgatattttcaaattttctctgttgagtatatatatgtcattggttaatgggccaaataggccaagaggatgggatatgagatttaagagatggaccaaatttagctaatgcataggtaccaggtcaagcatgggttactggtggataaaaaatacacggttgttgcctgctacattctcaggtgagcaaaatattactcccataccagtgcccatcgggtcgggcacccgcggatacctacactcatggtcaaaattgccgtccccagatctcgtccatggctatcccttatgttttgtctcattacaatgcagattacatgagtgcagatggcccatacaagatgtccataaatttcaatccattttagtacaaaagagaaaaaacggcccacaataatgatcaaaatccgacccaacttacacgccttagcaaaacaaatgcctttgagacgtcatcacaagtggtccacaagataagaccaaaatacaaatgccaggtggcccaaaaggccgaaacgcgcacaacaagccggacccaagttaacaagcaaaccaaacatacaacaaacccattagcagtcttttacggccatcgttgtttgcaaaaaaaaagacagccattgccaaatttttaatttagaattttattttgaagttgatttcaaggtactttcaatgtacttcttttttacacggacttttaagttattaacacatatataaaagttctattcataaaatttattttgtctgtcgttgatacgccgttacggtttataatcaaccgaggcctacgaggcttgtttttgctggctttttccttcgcccttgccgttggatgaagatatgatggcacacgtaataaaaataattcagttagcatcaatactacaagataactaaatttggtatcggtcttactggttacacccaaatttagtacctatgaacgaaatagggaaaaattgccaaagttttgaaagtgtcaggtttccttcacaggaccggtcagaccgcaggtacgtgggcggtctgaccggctagtagggccggtctgacctcaggtatgtgggcggtctgaccgtcagggtcgagtccgagtctgttttcatcgggtcgcgggtttccttgctcgggaaggctatgtttcgtgtttactttggtttatatcctgagttagacatggataagggtctgtagagggcaagaccaacccttatttaagggacaaggccggttcattgtaatcccccgaatacaatttacttgaatcgttcttttactatattttctattttaccctagttttagtccatctttgtcagtttgcgccgtaaactgtctgccaccgctgcgagagtgcgacacctctttgtaggtttgtcctgaaaaccttccgttttgcccacgagacaggtagttatcttcatatttgatctctaaatcggctccactaggcggtttagctaattttctacaaaacccatcttgatttggccttttggctagatcgaggtggttggcaactctatatcaccgtaaagcgtttaggtgctgcgatcgtgcttgtcaacttgtcacacaaagttgtgaacacttacaactggcttggacaagtgtttgccgaatcagtacgagaatagtcagataaccctgaacttgcaagcatacttgaacagtaatacatttttggattctcatgtgtttactgaatacctctcattctcatgacactccagttttcttaagataattctggcatgtgctccaactatatatgcacacaaaaatattgtgatgcttgcacagttcctcgatttatcttgttccatcctcatcgtctgatgtttctttcatatccttttatagacgaggatgaattgttattagtatgaagtttgatgggtgtgtgttttcagtgtgaagttattcttcattaaatttgtcaggtttattggttggactgaatgtgaatgagcatttttacaggcacgtcagcatctgaataagatgtatctggttggttaaatttgtcttctcatatctttggattttcctaaaaaaaccgatataagaaatgactatagtatctttttatgcaaatgttggattttatccattatcaaatcaaatgagcagccttatttcttcttccggtcatgacactaatgaaaattttgttcatcttggaaaaaagaatttggcataatccaaagaaatcaaaatgggaaaattgggtcactcaccaaatgttttgactagttttgaaagctcaactgtctgcgcgtaacgcaatggaaattggttaatgctttgactagttttgatagtaaatgttttaaaagttaataaagaaagtcaaacgtcatatttttttaactgtaggatggaaacacaagaactaagccaatcagaggggggtgaatggttggtatacccaaaaaccaaaaacttttagcggaaataaaagttaccctcaaattcgacggaagtcggtctgaccgagattgatctgccggtctgaccaagtggatgctgtcggtctgaccgatatagatcgatcggtcgaaccgccgagatgcctgccacgcctatcgccgccgccggtcggaccgcccgtatgccaccggtctgaccgctggtatattgccggttagaccgctgaaacccggtgaactcaaatcgaagaactcttaaagtggatgacgactttattgattaactctgtgtttacaaagtgcaccaacagcactccttacaaaaatttcgactaaactcgaaaccctaactcaaaactcaactcaattgctctcaaaagcgataccaggaagcctcacgctccccctctatttatatccgaggtaggcagcctaaagccacgaatcaaactcatactaagagtcctaaacaccttaggaaaccctctagtataagaaagaaactttacataaccaatcgtatcaaatttggactccttccaaattcgactccgcatcccatacgcatataatacctccatcgtatgccatatggaatctccatcaaccatgtgcatcaactctagcctaagtatcccgcatgatctctgaccaccacggacgtcgtcttatccccaagccgactcccggtccatcaccgcaaatactctcccgaggcatcgagtcacctacacatgaaataaacaaagaaaccatattctgagaccaagctatctccaacttgactcattagtagcaaacaacagtattacatacgtataatatacatctagaagccataattatgaaataatcacggatatccaaacaaacaaccaacacagcgtcggccggtcagaccgtgcaatacatgccggtctgaccggctaccagagcccagtctgaccggtcacataaaatgacgaatcctgcaatcacctgtgaaatccaatcatctccaaaatcacttcgtgaataaattccaaatatcaaaactaataatctccaatgcccaattgttcatcacagaataataatcaaaaacacctttgattttacaatctgccccttgatgaacacattggcaaacccataaaaaatgttttggtgtttggaaaaaataaaaaacaaaaatggtaaaaagcacacttcgtacaaatgtacacatcgtgctcaaaaatccaaaagaaaacttctccccctttttgaaagaaagaaattcccaattgaaccaaaaacaacatgctcttctcaacaactccaaaactcatctcttctcaaaaattttcaccttgcttcacaaaaattcatctcttctcccccttttgacaatgatttcatcaagcataggaattatgttcaagagcttagcatacatatagcatatcaagtcatgatttgcaataaaaaggagatgaacccatctagaacataacaaacatgcattaaagtataaccatgaaccaaatattttacaattaagcttggatcaacaatcaaaattcatgatttcatacgatttataatgcaacatcttaacaagcacataggttgaaaaataaacactaaacacatatacctattgcatttatcactctttctcaaataacctttagcacaaaataaccaagagtattttttgaactttttttttcttgagcttttttgctcatatttttctcttgtattccgggtacatccctgttgtcaagactgtttccagagattcggcacccattattttgctcacatagaatacatccttgtcgtcaagactgttttcaaggattcggtattcatttttttatattttttattctcttttcacaatgagcaattaaagctatttgaggaataacaagtcaataaagcatatatatagagcatttacaaatcaaaccatatgctagcatcaacattgcatatttgcttaattcaagtataaaatttaagtgtcatgcatcatctcccttaaaagcaaaaatctaaatctcatgaaaagactataatacatacaagctatgctagagacaaataaaccttcgaagtattgctagcatgcacaagaaaataccatatgtatagaacaaagctctcgtttatcaatttttctcattgtcatattattgcttgataaaactatgaggtacaaactccccctcaaaccatgccaaaagaatgaattattcccaattcaccacgaagaaaagcaaatcgattagaatccaaaggtttagtgaaaatatcagcaatttgcaactttgtgtccaaaaactgcaattcaacatctcccttctcaacatgatccctcaaaaagtgaaaacgaatatcaatgtgctttgtgcgtgagtgttgaacatgattcttagcaatattaatagcactagtattatcacaaaagagaggtactttatcaaaagtaagaccataatctttcaaagtagataaaagccaaagaatctgtgaataataactagcagcaacaacatattcagattcagcagttaattgagcaacacaagattgtttcctagaagaccatgcaatcaatgatgtaccataaaaatgacatgttccactagtacttttcctatcgattctacaaccaccaaaatcagcatcggaatatccacttaagcatatagaagatgaagtagaataccaaattccaaactcaatgtatgattcaaatacctcattattcgcttggccgcttgacgatgtgaagcacgaggagaagcttgaaagcgtgcacacaaacacacagcaaattgtatgtttggcctagaagcagttagatacaacaaagatccaatcatacttctatattccttttggtcaacagcttcaccatcttcatcaggatccaaaacagctgtagaaccaattggtgttgaaattggcttgcaattctccatcttgaaccgtctcaaaagatccttcgtatacttcgtttgatgcacaaaagtaccttgaggtgtttgcttaatttgcaatcccaaaaagtacgataactcacccatcatgctcatctcaaattccctgcgtatagtctcagcaaaatctacaaccaaagcgtgggtcgaacaaccaaagatgatatcatccacataaatctgaacaaaaagttgattatcaccaggcataggctaaacctttaaccctaataaacatatgaacccactattttatcaatagttttgtgtggaaattatgaattaaccatggaggcagaacatgtgtgcttaatacaattatatatatagcaaaggagttctcccaaaattaaagcacgttgacacagaaactcttctacatgcaagctttatcgattagtaacacatccagtggtcagtgcctctcacttctcattctcatctgaatacctctcattctcatggtactccaaccttctcaagataagtatcgcatctacaccagctacacatgcacacactaaaaaagtaaaaaaaaaattgccagtgctctaatgcttgcacaacacctcaattaatctttgttccatcctcattgtcagacctttcttgcttcccttttatacaactggatgaatactcgagcagtggaaagattggcaggggtatgtgttttcagtgcgaatttttgtttagttatgtcgttataggtcccatgttccatggacagaatgttatacattatgcacttgggggtaaggattgatcaaatgtttttgttaacacatcgaccttttcagaaaaaaaattgccagagtattcgtaaacatgcaaatggaaaaaatagctcattggcattaaaatgtgggccgctatgtggcgtgcttataatagtttacttcgtaagaaccctctgtacaagaataatagtacaagaataatctttacttctttaaaaaaggaattacataaatgatgtcacaaggataaatgtattagaataaatttcataaaacactggagtgtaacccaagttacacaaaagcacattcatcttaattggcatgtgacaaattaccctgtacgtcgatcatgactaaaagttcacaaaatcacaatgtccactattcttattagttctgaaatagatttcaaatttacaagttgtttgatctacagtatgtgagtagcaacaatctaagttatatttttcttattttactacaattgcaaattggattatctaaaatctgctatttgcatgattttctgcaactgcataactattttatgttggttatatgccacatgttaacacccaggtagatctatatatgtatcttgaaccacaataactcatatatatggtttacaattattataacttagctcagcagtctgtacatgactatgcatggaaattgggctaattagtcgcatcaaacactggtggagaagtgctttttagtcccggttcgtaacccccctgtagtcccggttttccaaccgggactacgaatccgggactaaagatcgctatctttagtcccggttcaaaataaccgggactaaaaatcgatatttagtcccggttggtggattaaagatgggcatctttagtcccggtagatattttttcttttttgttctatttttaatattgaatattgatttcacaccatcccctcccatatccaaatcatcacatatcacagaacatctccaaatcctcaaatcctcaaacaaatcatctctaaatacatcacaaactcttaaaaaaattacatcacagggttataaaaattcatcacagattcacatctcacacaaaaatgcttcacagat

SEQ ID NO: 7333 - DNA, 37338 bp, Oryza sativa
  unsure (1)..(37338): unsure at all n locations
cggttagtatcaccaaccgggactaaaaataggtttttagtcccggttggtgttattaaccgggactaaagatcctagagccctgacacggcctgacatggaatcaaccgggactaaaaatgaactttagtcccggttggagttatcaaccgggactaaagaacaacaaccgggattaaagatcttcctcttattaaccgggactaaaaatcatttttagtcccggtttttaatggaaccgggactactgtggatttgggtcgaccgaccaaaaatggtttctctaccagtaaaatggctgtgcacgatttattttattacaataaactagtttttgaaaagcataacaaaaatcttcagttaccttaatttcaaaaactaaatttcattgaaattgggtctcggttacgactcggtccatctaacaaagcaggctcatcacgtgtaagttaaattccacatcgttcaatacagatttatttttttaaagtactctgatagattaaaaaatgagtatatatagatttttactgtttaggtaaatataattttttgaaatgaaagtttcaaataaaagtctacatatgaaaatacgattttatttaaatatgtatgttctctcttcagaaaaaaaatcaaatcaaagtatatgaatacaaatggaatcaccatatatgctgcaatcatttatattactgtttataacatgtaaccgtggattaagctttatccaaacagtattttttcactgttccacctgaaaatttgtgtggcatttatatggtgagcatatatatgtaggccaaattaaccgggtgagcatcacaaatggatccatcttctacaaatggatccatcttctcaaaacgttaggataaacaagttgtgcgtcaaaaggagagaaaagacgctgtaccaaatcgtcttacttttcctatcaccatcaaactcatattactgtcccatttcccagcacatgcaaaagctaccgtacaaatggacatatccttcatgttgctgtctagctctcaccaaatgtctgtcgtgagacggatcgtcttcaatctggatatttggttgatcactgttgcttcgagttcctcttgcttattttctcaatgcttctcattcccagatcttaactgaatatcgatctcaacctcactcttatgacactatgatgctcgcacaattactcgattaatcctgtttcatccgcaccgttgtacaatctttcttgacacccttttataggaccaggatgaatagtgtggtagtggagagtttgatggttgtgtgttggctgtacagtatggactatggagctattcttctgttatcttgttcgcccccatgttgaatcaactgaatgtaccttggcatttatgcacgttaggaaagcggtgttcaaactttgttgttttgagataaattatggcttaatcttcacaaacatcaaaatgggaaatacagttaactagctgttgacgaatcgatggactagctttggtaaaacattgtttacattatttttatagtcagtaagaaatctcccgcatgcgtatgtgtactcttctgttgaaattactaaactatatggaaaatcatactagagttgaaggagcagattggttaattagtcacgtggaatgtctgtgctcaatttcaatttttgaggaaaaaaaagagggtaaattttggaacaatataacaaattaatatcctgcaacttttcggttttgaaggggtaaaatcactgtttaatggctgtgctcatattgcatctcaatctctgtatttccggtgcaaaacagagcagggatgctcaattttccctccacaactctattaacgtgctctgattcacgccatgcagctactctggcttgctggttttatcgtctgttaagcgcacgagcgacccgagccgacggattgcttggacggtggataaacgctgactgcatgctcctgctttcaaggagtgaaggcagacgatcttgatcagtcacctccacacatggttgtccatctcaccaaatcttggtgatcagtcatgtggtcatcctgcacttgcaagagtaactggcagctacgcattgtttgtgtttcgcttgtttcctgaatacctctcattctcgtggcactctgattttcttttctataataactagagcatgtgcttcaactggaaatgcacaaaaaatactatgatgcttgcacaattcctccatttatgttgttccatccccattgtctgatctttttccttgtgcctttttatagacgaggatgaattatatatcatgctgtacaaagtttggtgggtgtatgttttcagtgtgaagtttgtgttcagtaattttctctggtcccatattgattggactgaatgtgaatgagcatttatatatgcacaccagcatctgaataagttgtatctggctggttatagttgtcttcccatatactttcatgtttggcttttttagaaaaacgatataattggctatagcttcttcgttgaagtaaaagctggattttatccattatcttcaaaaatatgcacataagcagaaaggtgctcaaatgagcaaccttatttcttcttccaatcatgacgctagtgaaaatttcgtttttttgaaaagaaaaagaatttggcataatcttaaaaaatcaaaattggaaatttagatcagtgccaccaaatgttgtgactagttttgggagctcaactgtccgggtgtgaccacgcacatgaaactggttaattagttgcttgcatgtatgggactgttgtgcctgtgctgaattcatttttttttagaaaaacagagcttttgaaacacataacaagattattttttatccaactttaagaacaagttttcctgaaattatgtctcgattagtagttcactaccaaggtaatctaaccaaagtgaggctcatagtgtaattaactacagatacaactgaactgcgacggctttttgatactaaagttagcaaccaaattttcagttagctccaatcgtcaaaaatcgaatcttccaaaatttgggactgtgttagtactagccaggctgtcatctaattaacgtataaagtgggtttatcatgtgtaagtagggcccacatgcctgtgctatactgtactgagaacgactagtgtacggcattccgtccaaatgggataattgaatgacacctccgcctccctgagcaagatatggataaggataaaaacggactcagctagcgtgatgtatcaatgtacatggctctcaaaaaaatctatatgtctccccacgtgcatcgagcgctcccttgagtttgaacagatcaatatattgttccaattgtgacttcagcatgatacctaggtaccaaatctgatgcctacggagtatcatgtttggtgccggagacaccatattcggtatcatgctgatgtcaacatgatacataggtatcagatctgatacctatgaggtatcatgctgatgtcatcatgatacctaggtatcagatataggtccccatcgtttggcatattcatatgcttatcaaccaaaatttgaattttcaacgttaaatttggagctgattttggggttttttcatcgaagtttatttttcagcctttacttttggatcgctaaaaacacatatataaaagttttattcacaacttgattttcgtttataagtatgccatttggcatattcatataatatgccatccaatgaggctgataatacctatgggttatcatgtttggtaccggaggtaccagatccgttatctctctggtatcatgctgatatcatgtacattagctattccattggaacggtatacttttctatagtctccctctattctagtagtactaactaggataaggtgattcgtaataagtatcaggtgatacttgtgagatatcatttgatgccgatctaatcggtatcagatgatacctatcttgtattaggcgattcctaccaggtatcaggtgacatcataccttgcaagtatcaactgatacctgagagatatcacctgataccggttaggtatcaggacataataccttagatatatctggacttgatacttaaccagtatcattccgaacggaataccatcttatagcatttccggaatgagaaaagaaaatttctaaagagatgaacgataaagataaaaaaatgtaatattagaaagccccatgtcttctcaccgtgagtatgcacaaatgaatgtattgatttgtgcagctttatcataccgtgatgttaccaacttaggtactggtgtggcccacctcctcgtatcacgtgcccatgagcacttgagggagggctgcagcacacctcagtaagctgctcgtgtccgtatgccggttagctgctaatgtccgtgtttcacgtgcccatgagcacttgattgcgcacaaaaatcaaattgacttatgtatgtattggagggagtgatcatagtagtctccattaaactgccatgtccgaacggtatcccgcattgtagttttcctatactagtagctattgctataatttccacgaattggattcaaatcgaggagtcaaaatcaataattagccatcggttgccctgagcgatttttttattttcttcaccactttcccttttttcactgcatagtttttcttttcgtataagattgtgtatcaaaagtttacgcaccttatacccaatgtttataaagctaaaaatttatatagccgatttaaattcagatttaaatattcttttatacaaaatgtttctattatgtgcataaagtttacaatatatttgttactatgtgtaaaatctatacatatggatattatcttttttctactttctttttaaacttaatttttattttattttctattatccttttaaaacttattattttttaattgtttttgaaattctatctggtttcatgtgaagggggagccatgggaaaggggcacacgattggcctattggccatatcgagcggcacgaccacctgatgagaaaattaagcaccctcggagagtagttcttcctaaatgtacgaggtcggtcaagtaaccgtgaacttacaagcgtaatcgaacggaaaagcattttgggcttctggcttgttcaacattttaatgataattctggtatgggctccaactgtagatgcacacaacaacaccataatgcttgcgcatttcctcgatttatcttgttccatcctcatcgtctaatatatctttcttcgtgtcattttatagaccaggatgaattatcatgtagtgcaaagttttgtggttgtgtgtttgaatttattgttcagtaattttgtcaggtcacaaattgattggactgaattgtgaatgagcatttatgtacgcacatcaggaaatggaccggatgctcaaatgagcaatcttatttcgtctttcgatcgtgacactagtggaaatttcgttcttttgagaaaaaaaaaagaatttggcccaacttttgatagacatagcaagattatttgttggcccaactttaaatctatgttttcctaacattgtgtctcgattattacttgggtcatctaacaaagcgaattagagtctaatcgtgtaaactatgtacagatggtactgaactgctaccgtctaaatggttgatagcaaccaaattttcagtctctatctctttgtcacccccatctcccccccccccaccccccaaaaaaaaaaaacttctcaaaacgttaggatggatagcaacaagtagggcctccaaaggagagaaaagaagctgtgctaactcatcttgcattttctatcacccatccatcccactttctagccgcccggttgtctgattctcgccgaatgttcgtcatgagttttggatcgtgtaccgtccggaagcttgggttatcgatgtcgcttcaagctcccctcgcttgttttctcgatgcttatcattctcaaatctcaactctgaatgatacctctcactcttacggttatctgattcttacacaactactcgattaatcttattccatatccccatcgttttccaatctttcttatttcccttttatagatcaagcatgaaccatctggtagtaaagggtttgatgggtgtgtacgtttatagtagtacggagttattgttcagttatcttgttaggtcccatgttcaatgaaaaccttggcatttatgcatgtcagggaagtgttgttcaaatgagtaatatgaaaaaaaaaagctattttcagaaagaaaaaaaatggcttaatcttcacaaacatcgaaatgcaaaatatagctaactcactgcttttgaattgactgactagtttttggtaaacattgtttatattattttttagtccgtaagagatctcctttaggcgtacttgtaatatgcttctgtgaaaattattacattaggaaattcttattgctattgaaggaccaagttagttaattactcatgtggaacggttgtggctcatcatgtgtcactaaaatccacatgtgagtgccatagttttggaaataagtacttctacatatgaatatttgactattctttttactgttttgacgataaaatcatatttgttttagtgggaaatttgatcatatatcctttgtttcgatcgaaaattgcgcgattaccatctcatgccaatgacatgtgtggtcatgtaaggtcactagcatgcatctcccacgatggtaaatctaaatttcaatatataaagagagaagattatcacattttacttttttaatagaatagatttataaagtctaataagtttataattaagactataagagtacttttcagtatggcaaaaatacacacatgtaccatttcatatgattaaaccaagtatataaaatttatcgcagttgcaatcgtttcagaaaacagtaaaatgtcataaaatttgaccggagggagacttttttgttcgacttaagcaattgactcacatgtcagtatctaattttaatttgttctaacaaatgtaaacctactctttcttctccattccgctggtcagaatttgttttccacagcatgtttgcatttgcttatagaatctgaattggcagggttagcatcacaagtaatacatttcttgaaatgcttgggtagcagccgattttgtactcttgtgaaaactccaagagtggttaatatttgttaaaagggtagtatatatgtctcttgcgtttttcaaactaatgacccgatttctgctatgcaagaaaagacagtgagttcctagatcaacgcaacataattctttgattcccgtacggtttattattctacttatccataagaattgaaaacatctttctaatcgaagaaagtacgtacgcacatattatactttgtacaaacagataacctacacattagtgaaaacacattcatatctagaacagtattattcttaactaatctcattggcagctacaacagatatagatctaaggcacggcaaatcaaagcgacgagcatttgatatatcttcacagaaactaacttcaccgcgttgcatgtgcttctcaaagctagaatgcatatacgcttttattctaaataagtcagcatgcttgctctaattcgctttggttcaaacattacatagccatatagtgcagttacgataacatgacagcaaattttccatgtttttacacttaagttctacttctatgaattactgtctgccggattaagtagttttttattattatgtcaaggtcacgatagtaatcacccttaaattattgtgcttggagcttgcatgttaaatttgtgcactatgattattgcacttatttgtgtcaaataaaatataccattcaaattactgatgctgttaactacggccatctcacttttgataacaaagtactttcaaacgattagattgtaatggattaaaattatatgggtgtattttttataaaaaaattaaataataaaacatattgtcaaagtattataaatatttcacttaaaaattaggtggtcatattttgaaaatgaaattgccaatgttgatcatgccaggacatattattaccatcgacatttccatctgcaatctatctatctatctatctattatatactaaataaaagtccattaaacttcctataaacgctctcaagccgccacgtggcacttctacaaacgctcctagactgccacgtggcaatgtctaatctcaccgtcgattttcacttaaatcggtggacctgataatttggaccattagattagatcagatgtattttatttaaaaagaaactaataccttactatacaccggaaaaagaaaacaaattaaactgattttagtcctcccctgtaccctgcgcggacatatgcatccatccccgtatatacgtatgtacaggtaacgtactaatgaacatacgtaagaatagaaaacaatgaatcttaccttagattatatgtattttatttaaaaagaaactcataccttacttcaccggaaaaagaaaaaaaaacacgagtactccatatatatgtacatatgtaagaataaaaaacaatgaatatattacctactgtttattgaaagaaaaaaactatgcacagacttactgtaaaaacaacaaagaaaaaaaaaacatacgtgtatagtaccataaaaaatcgattatctttaaaatagagttttgtaatatttaaagataaaatctattactatataaatttaagcaaatatcaccgccgatttttaattaaattggtgaacccaatagtttaaaccattagatatattttattttaaaaactaataacttattactctgtgtacgtatgcgggagatatatataacaattaggctagaaaaagaaaaaaaaacataagtagtccctacgtacatacgacttgaaaaaataaataaagcttaaccgctatccatcgaaagttcggaacaaagaaaaatctccgcatggtggtctttcgaaatagtattttcaaaatcccttactataaaaacaaaaaaaaaagcgtatcattcgaaaaagatcgatggtcttttgaaatagtattatataatatttaaagataaatatattactctacaaatttacgtaaatatacgtagttaaactaaatctatattacaaatatgaaatatcccatcaatgatctttgttcgttcgatcttaacatacgaggttgatatatataataattaatgttttgatattttcttatttcacatcatattttagggtgtcaaatatcactcgacaaatattaaatgctaatttaaatttatatttgtgaaaatgaaaacaacacaatttagttgtttcattttacaccgttagattaattgtttctcctatatacggatatatgacaaatatataactgttgaccggaaaaagtactccgtacgtacatatggttgaaaaaaaacaataatgcttacatattgtttgccggaataacataaaacgtatttatgataaagcccccaaaaaatggcagtccttaaaaaataattttctacgaattaaggataaaaatataataatcttcaaatttacgtaaatgtaaatataaaatatacattcaatgcttttaagcattctatcttttaaattattttaaaattatatatccaatttgtgatccggttgtattcctttaaataaataaactactaatatctatagccataaatacattacaattatggaaccaacatgtaataattaatgttacgataataatttcacatcatattttaggtgtgaaaaacacttgacaaatatacaacactaatttaaatgaacatatgtattctccaaattactaaaggtgtctcatgtgattagaaacaataggtgtggaaaacaaaccggacactgaacgaacatgcactacagcacatatatttgtcaaaatatgatacggtactttggagattatcgtggtagtatttagaaaatcaacgtcctggttacgtataaattcttctattgttttgggataaaatttacctccttcgatttatgtgacagagggaatataagtaatataagtctatctttgattagatgaagtagtatcattagttatatttttaatagaaaatatatttcattaatatataataaaattaaaatattacttaaagtcatctatagcatacaaaacaaaaaaaatgttatataaagtttggaaaaattttaaaaaaagaatcacacacaatataaataggtatgaactaactccattattggggcatattttttctattaaatttgaggatatacaggttcaagtaatacacccaacagttattaacgaacatacgtttaaaatagagtaaaaaaatatttcaaaaatatcatccacacaaacattcgtaataataaaatttcaaacaagattaaacaacatgcccgcgcgtatgcgcgggctaccttcctagttaataaaacaagctaccgaaaatactatcggttccaattttagtttatgagttctaaaatttagaaaagataaataaaaattaatttttactactttataaatttcaaacctgttagtaactgatatgaactgtactatatgtcaaagccactggaaaataacagcacactttaaaatttcaatatttacaatattaaaaataattacttgttaaaataaaagaaaaaataataacagaagcaaatattttttagtttttacatttttatgattttagactccaaatcgattacaatttgatatttattgattataatatttcgaactaaatcatgaacaaatcactttgaaaatatttaaatgtcaataacagaagtcgtgcaatgcacgggttggccactagtgtgactaatcaatataaaaggagggaactgtttacatttttagtaggatagatttataaaagctaacaagtgctttttaagatgacaaaatccaaacctatttttatatgtataaactaagtattcaaaaataattggatttttaaaagtttgacagagagtaaaatgtcataaaattctgactggaggggctattttcgtgggacttaagcaatagatccacgtgtcagtgtttagtttgatctatataaccgtaggttaaattaacctgaattctaacaaatatgatcctggtctttcttcgctattccactagacatagttctctttggtgtatttgacagaattggcgtcacaagtgaatacatcacatgaagatgctcttgtgagaactctaagcggttaatccaattccttagacaaaattataaaaagggatgtgtctcttgcatagttgcgttgttcaaactagtgacccaatttgttgtatgcgagaaaattgatgctggtagtagaagactagaaatagtctactggcagcagatgtaacattctaaatatttgcaaataaaattcagaaagcaaaaatccttcaaattgttttgtggaaacctgcatgtcttattgcatctcaattttttggactgcgaagaggtgaggcgggaaggaagaccaacaatcttagtattttcggtgcaaaaacagagcagggatgcccaattttccatccacaactctattaatgtgctctcattcgcgctattcggcaactttggcttgctggttctatcggctgttaagcgcacgagggattccagccgacggattgcttgaacggtgggtaaacactgactgcactctcacgaggcaggagatcctgatccatcacgtccacgcatggttgtctagctcaccgaatcttgctgatcagtcatctagtcatccttaacttgcaagagtaattgcctaattggctacaatgtattttccgcgtttcacttgttccctgaatacctctcattctcatggcactctgatttttttttaaaaaaaaggataattatggcatgtgctccaactgtagatgcacagaacaatacagtgactctaggagggatgcctgcataattccttgatctatcttgttccatcctcattgtctgatctttcttcgtgcccttttatagacggggatgaattatcatgtagtacaaattttgacgggatgtgttttcggtatgaagttattgttcattagttttgtcaggtccattattggttggactgagtgtgtaggagcatttatacatgcacatcagcatctgaataagttgtatccagctggttaaacttgtcttctcatatactttcatgtttggcttttttttaaaagagaaaaagattcttcattgaaccaaaagctggattttatccatcatctacaaaattatgcacatcagcacgagcaaccttatttgttcttccggtcatcacgctcttttgaaaagaaaaaggacttggcataatcttaagaaattaaaaatggaaatttagatcagggccaccaaatggtgtaactcgttttgggagctcaattgtctgggcgtgatcaagcacaagaaattggataattactctcctgtcccagaatacagtaacctataatcggatgggacttatcttattactataaatctggacacgccagatacgtcctatccgatcctaggttatagcttgctatattccgggagagagagtagttgcttgcaagtttgggactgttgtgcccgtgttgaattcatttttttgttaaaaaaaagcagaacttttgaaacacataacaagattattttttagcccactttaaaactaagttttcctaaaattatgtctcgattactaccaaggtaatctaacaaaaatgagtctcatagtgtaattaagtacagatacaactgaactgccaccgtctcaaaatgttttgatagcaaatttggaaccaaattttcagttagccccaaacgtcaaaaaccaaatttccaaaatttgggactcggttactatatagccaggccatcataattaaggtacaaagtgggtttatcatgtgcaagtagggtccacatgccagtgccatacgcctatactgttagctactgctagaatttgcaacgaattggactcgaatagaggagtctaaatcaataattagccactggtcgccccaagcgatttttttttattttttttcaccgttttccctttttcacatcatactttttttataagtttatgtatcaaaagtttacacacctttagacatctaaagtttataagataaaaatttatatataatgtttctattatacacataaagattacaatatatttatttctatgtgtaaaatctatacacactaatattatgcttcttcctatttctctttttaaacttatttttaattgtttaagaaattctagcagggttcgtgagaaacgggagagggacatgcgatgggcatatcgacgagatcgagctcgacgaccacccgattagaagctcccacgaggagtagttcttgccaaatgttcgagaacattttggtaatcctgaacttgcaagcgtaatcggatagaaaagcatattgggcttctgacttgtttcatgaatacctctcattctcatggcacttttaacattttaatgataattctgttatgggctccaattgtagatgcacacaacaccatgatgcttgcgcaattccatgatttatctagttccatcctcatcgtctaatctttcttcatgtcattttatagaccaagatgaattatcatgtagtgcaaagttttgtgggtgtgtgtttgaatttattgttcagcaattttgttaggtcacatattgattggactgaatgtgaatgagcatttatgtacgcacatcaggaaaaggatgctcagatgagcaaccttatctcttcttccgatcatgacactagtggaaatttcgttcttcgtctgacaaaagaaaaagagaatttggttaatcttaaaaaatcaaaactagaaaattaggtccaaaagttttttgataaacataacaatattatttgttacccgaccattccgtaaggttatttgttatccaaacataacaaataatcttggtagaagagtctaatcgtgtaaactaagtacacatggtactgaactgccaccatttcaatgtttcataacaaccaaattttcaatcagccccaaacgtcaaaaattgaactttccaaaaattcaacacctggccccccctcccacacacacaaaacaagatatgtacaaacacgataaacatgattagctctctatctgtttggttctctaacatgggtcacatagtacatattcactacactgcccatgttggcccaatataatttaaattagcttttgtatttctggaaccaacgtttgcgtcatcagtggcgaatgcacgattaaatttgagagggtgtcaatgggacaaaacatagcatacaaactatctattaaatagaactaattgccttttccagtatacaattacacataaaagggatagtaacttagaagaaagcaaaatacatcaaaagagttatctcgatggtatgtaatatgttcctagaaacccataaaaataatataacaaacttgttaaaattattatcttgtattatttgacaatcagaaataatactaaattcctagggatactactaggtagcccatctataggaggtgttgggcccctttgccccccattgtttgtccaccactgcttctcttcgctgctctgcttactagcttatactctgcttcagttacaccatcttgatcaacagcttccgagttgccttcctggtctttattgtcaaatgttgacacatagtttatatttttttttcagtagttcttctggtgagactttcgctacagtttttaaataaaataatattataaaatttaataagtttatgatgttgtggcagtaattttaaatataaatctacatataccttttatagttgtaaacaaaatattttaattttattgataatcaaagtttcaaaagtttgataaagagagtcaaacatcatttttttatcctttttctttcctcaagctataggtccttgtgtcaatttctattttgatctgcatagccataggttaaccctttaacctatgtatgctgcaatcgtttatattactgtttatattaacttgtaattaaccatggtaaagccttacccaaacaatgttttttttcctctgcaacacctgaatttctgtggcatttctacggtgaacatatatagaccgaattaaccaggtgagcaacacaagtggattcatcttctcgaaacattaggatggataacaacaagaagaggtatcatcttacatttcctatcaccatccatcctgttttcgagcaaaatacatcgttacagtgtgtgtgcggtaaaaaaaaaaaaccgctgctgccaggtgtgttctcaccaaatgttcatcaaaactgagatcgtctgcaatgcggaaacttagatgatcggtgtcggttcgagctcccctcgcttgttttctcgatgcctatcattctcaaatctcaaatctgaatgatacctctcactcttatggcagtctgatgcttgcacaactactcaattaatcatgtttatattaacttgtaattaaccatggtaaagccttacccaaacagtgtttttttcctctgcactacctgaatttcagtggcatttctatggtgaacatatatagactgaattaaccaggtgagcaagtgagcaacacaagtggattcatcttcttgaatcattaggatggatagcaacaagaggaggtatcatcttacatttcctatcactatccatcctattttccagcaaaatacatcgttacagtgtgtgtgcggtacaaaaaaaaaacccgctgctgccaggtgtgttctcaccaaatgttcatcaagactgagatcatgtacaatgcggaaacttggatgatcggtgtcggttcgagctcccctcgcttgttttctcgatgcctatcattctcaaatctcaaatctgaatgatacctctcacacttacggcagtctgatgcttgcacaactactcaattaatcatgtaccatccccatcgtcttgccgatctttcttgtttcccttttataggacaaccatgaatcatcttgcagtggagattttgataggtgtatgcgtttacaatagtatggagttattgttcagttaacttgtttggtcccatcttcaatgaacaaagtttaaaccttgacatttatgcacgttaggaaagcattgttcaaatgagatatgaaaattttgttattctcagaaagaaaaatatatgacttaatcttcacaaagatcgaaatgaaaaatatagctaactcattgccgtcgaatcaactgactaggtttttggtagacattatttatattattcttttagtccgtaagaaatctcctgtaggcatacttgtactgtggttctgtggaaattactaaattatagggaaaaaatattgatggactaagttagttaattagtcacgtggaacagcagtgctcaatttatatttctgaaaaaaaaagagagaaaattttggaacaacataacaaatatctagcaagagtttaacaaaaattcagttagccccaacgtttaaaagtgagtttcctaaaattgggtatcagttatcaccttggtccgaggccatccaacaaacattggctcatcgtgtgtctgtaaaatccacttgtcagtgcatagatttggaaataagtacttctgcatatgaatattttgatcaaaacaagtatggctttgtcggtgatatgagcccggggtatcatgtttagttggaggaggccgccccccaatgccacgtggccctcccccaaggggagtcaggcccgaggtggggtggcggccactccttcccaaagattagtcggaggaggcagccccccaatgccacgtggccctcccctaagggaagtcaggcccgaggtggggtggcagccactccttcccaaagacaagtcggaggaggccgctccccaataccacgtggccctcccccaaggggagtcaggcccgaggtggggtggcggccactccctggccgagactagagggagaaggctgccccaggcgccacggggccctcccccgaggggggatcgggcctgaggtcgggcggcggcggccccctcccgtgactaggggtcgggctcccccgaccccctctctagatcaccacgtacaggtgcccacctacctgcatttatggcgacccaagcggtcgcgccacgccgcatttaatgcggcgtgcagtgtactcaaccggtctgtgaccggtcgaatgaccgatcggactggctagtgcgcctgtgcgctgctcgtgtgtcaggcggcgtgcagcctgacatgtcccatcaaataatgatggtgagaggttctcatcatcttatcccagccggagtcggtcctcccgctctggtcaaagctaggctcccgtttcccggtataataggagcccagaagtcttcacccattaaatggtgaatgacatgggcgccccccgtgtcaggcggcatggtgtggtaggccccacgaccgaggcgacgtgtatgcggtatccaagttaaggaacaagacatgcatttaatgcaaagatggtaatacttctcgaggaagttaggttgttgggcctatgtggtatccccttgaactataaaaggaggaccttgcccaccgataaaagggacgatactcagtaggcccgaactcaaggagaagaagagcgagagtgctctccggagtttaggaacccttgtaacactcaaccataatcccaaacacaggagtagggtattacgcttcttagcggcccgaatctgtataaacctcttttgtctcatcgtctttgggggattgaacgccctcaagatcacacagcttcgctcaccaagccctcgaatctcacccgctgcccccggccgaactcacaaaggggggcctcacggttctctgatggaggagttcatcctccgacaggctttatcttcaaaacagtaaaaatgaataatcatataaaaccatacttgttttagtgggaaatttgatcatatatcctttgttttgatagaaaattgacgattactatctcatgttaatgatttgtagggtcaattatggtcactggcatgcatctcccacaatggtaaatctaaattttaatctaaaaagtgggaagatgatcacattttattataacagatttataaagtctaataagtttataagactagaagagtatcgtttacgatggcaaaagtgcgcatgtataccattttctatgactaaaccaagtatttaaaatttattgcagtcgtaatcgtttgacaaaagacaggagggagaatttttgttggacttaagcaattgacccacatgttattctcaaattttaatttgttctaaaaatcaatatgttaaaccttaattctaatatatctgagcgtactctttctcctctccattcgactggtcagaattagttttctatagcatctctgcttttgcatatataatctgaattggcagagttagcatcacaagtgaatacatttcctgaaatgcttgggtagcagccgagtttgtactcttgtgaaaactccaagagtgggtaatatttgtcaaaaaggaagtatgtctcctgcgtttttcaaattaatgacctgatttctgctatgcaagaaaagacagtgagatcctagatcaacgtgcatcataattctttttcttcgtttataccactcggatgacttgttcaccaaatacatcatctacaatatttgtaggtcaaagcacctactacagctatgcttgaggcagatcatgtgtttgtcatggcaatgtcttcaatcatcttcgatcagtgtggcgtctagtgcttctgacctgcttcctggatacctctcattctcatgacccatgtttatacctctcattctcatagcactctgatttcttttaactatgccctctgcatcaactatagacgcacacaacaatttagtttgtgggaactctgatccatgcttgcacaacacacctagattggtctttgtttcatactcatcgtgtaatttttacacttcctttttatacaccaggatgaattgtcaggcagtggaaagtttggtggctgtgtttttcagtgtggagttattgttcagtaatcatgttaggcactttggccccttgctgaatggattgagtgtaaacctttgcatttatttacgcacaaatgagaaacctttttcttttgtttttttgatgacaaagcttgcggaaattttgttcatttttaaatagaaaaagtacaaattaccctccgaactatcacggtcgattgaattatcccctggaccacaaaaccagacatccttcaccctcacccccaactacgcaaatcggacaaataacccccttgagcactgttacgaggtttttgacttgagcttacttttgaaaaatgcaacaagattatttgtttgcccaaattttagaactaagtttttctacaattatgtctcgattactacctaggtcatccaacaaagcgagtctcatcatgtaaattaactacatatgctactcagggccggccctgggcctaggcgggttgtgcgaccgcctagggcccaggccagaggggacccatcacttatcccctcccaccccagcccggccaacaggcctagccacagcccagagccccagacgcgcgcctcaggccgccctcaactgctcagcgaatcagcgatcagccagggagcagtgcgcgtgcgcgtgcgcgtcacttcgcctgccgncctgcccaccggccctacaccacgagaactgcagtgcaggcccaggccgagccgcgtcgcttcgtcgccgtctcgccgatgccctagtccgcgagaggccgccgtgagtgcaaagaccgcatcggccccactagcctatagcgcctgatcgccgtggcccatcggccaagccaccaaggcggtatcgctgtcgacgcttcttgccggcttgcctggatggtggctggtccctgccctacccgcgtgatctgtgattgtcatcggctcatcggccatttcccattcgcccccttcttcaggctgaaggtaggtcacagacctagaagtcaatcgacaagctctatgcagctatgcctttatcaatttactttgcaatttcactgcttcaggtgttacaatgttacctagaaacatttgttgggtgctatacataactcataaggtcgcgaaaaagctcttttttataagggacatgggatatttgtggtctcctattaaggtgttcatactaatttgtttctatggtatttttagttgtcaattatactattgatattatttattaaagattaaattgctctatcgcaacttgcaaactgcttgatttattatttaccgtgttaaaaatgtttatttgtgtcactctatggtatatgtgctttatagagtatactgtatgtattagaagtaaaaaaaattagatataactccttaagggctaactctaagacccatagcgtcaagtctgcctagggcctccaaaatgtcaggaccggccgtaatgctactgaactatgatagcaaccaaagttttctgtcagtcccaaacgtcaaaaactgtttttttttccaaaaaatttgggactcggttaatagccaggctatcatataattaacgtacaaagtgggttcatcatgtgtatgtttgatccacatgtcaataccatactctagaatctgtaacgaattggactcaaatcgatgaatacttgttccatcctcattgtctgacctttcttgcttcgcttttatatactactggatgaatactcgggcagtggaaagtttggcagggggtgtgtttttcgcgcaaatagatttcagatttactagtcgtttgatctacaatatatgataatatgagtagcaccaatctcagttatatttttcttagtttactgtaattgtaaatcggattatctaaaacttgatgggtgtagctatatatatggcgccatatttttcatcaaaaaatagtcggtatttatttacactgtaagtccctaaattacatatgtaattttagtgtatttacaatgtaagtcacaaaattatatatgtaagtactaaaattacatatgtaaattcgaaaattacataccaattatatatgtaagtggggtgtaaatgaggtataactattgtgtaagtggctgaaaaaaaatcgactgtagcatatggcgccatatttctagcaactccgaacttagatatatatagcatggttttctgcaactgcataactattttaggttgggttatatgacacatgttaacacccctgtagatatatgtatcccatatggccttacaattattataacttagtgctcagcagtctgtacatgacaatgcatggaaatttggctaattagtcgcgtgaaatggctgtgcatgatttattttattgaaataaactagtttttgaaaaatatttaacaaaaatattcagttacacttaatttaataaactaaatttctctgaaattgggtattgttatgactcggcgcatctaacaaagcaggctcatcacgtgtaagataaatttccacatcactgaatacagatttattttttttcaaagtactctgatagattaaaaaattgagtatatacatatttttactgttgagttaaaaaagatttgttcaaatgaaagtttcaaataaaaatctacatatgaaaacatgatttaatttaaatatgtatgttctctcctcagaaaaaaataatttatatggtgcaatcatttgtattactgtttataacttgtaaccatggattaagccttctccagacagtattttcttatctgttccagctgaattttgtgtggcatttatatggtgaacatatgtaggccgaattaaccaggtgagcatcacaaatagatccatcttctcaaaacgttaagataattaaacaagttgcacatcaaaaggagagaaaagaagctgtaccatttttgggtaaatgcaagagctaccgtgcgtgcaggtcggagcaaccactgctgctaagtgtgaggcaggattcaatcacattaattgttgtctagctctcaccaaatgtccatcatcagatagagcatctttaatctagacattttctcgatctctttggcttggagttcctctcacttattttctcgatgcctctcattctcagatcttaactgaatacccccaatctcactcttatggtactatgatgcttgcacaattactcgattaatcatgtttcacccccatagttgtccaatctttcatgatttcctttcataggaccaaggtcaatagtgtggtaggggagagtttgatggttgtatgtttactgtagtatggagctgttgctcagttatcgtgttaggtcccatgttgaatgaactgaatgtggaccttggtatttatgcacgtcaggaaaacggtgttcgcatgaaaagtatgaaaaatttgttgttttgggataaattacggcttaatcttcacaaacatcaaaatgggaaaaatagataactcgctgttgtcgaatcaactgactaaaacagtgtttacattatgttttagtcagtaagaaatctcccacatgcgtacgtgcttctgtggaaataactaaattctagggaaattcatgttagtgttgaaggaccagattggttaattagtcatgtggaatgtctgtgctcaatttcagtttttgaatataaaaaaagagggtaaattttggaagaacagaacaaattaatatccattaaaactgagtttttcggtttcgaagttatgagtattaacaaaaatttcagttatgagtattaacaaaattttcagttagccaaagcctttaaaactgaatttttcggttttgaaggtaaaatcattgtttgttgggaaatttgatcaagtaccattaatttgaccaaaaattaaggattttcaatatctatttcaaaagcatgtgggggtaatttgaagtcacttacatgtctgaggatggtaatatcaatttatctacttctataaaagtgcagttgttttcctcacacctcaccacccgaaaaagaccggaccaatttgattgcacactttttgggaaaaaaattatagaaaaccaaatagttctatcgtactatgttggaaaaagaatggcccatataaaacgaatagtttatacaagagtaaagaccatcacctgtccctaaacttgtaccgctgtgtcatagcggtccctaaactcgcaaatcgaccgttcaggtcctcaaacttgttcaactatgtcatcccggtccctaaaattgcagatcactcatttagattctccaacttgttcagttgtgtcacctcggtccctaaacttagatttgaatatcatctgggtcaaataggacggtctaaagactttatatttaaaaataattcataactttttcatgtgaactctaataaagacaaactttatatcaaacttgtagccctcgacacgatctacaactttatagttgattttttttatttcaagtcattttttgtcccaaaatgtaattttaaaattaaaatttcaaaatctataaacatgcaacaatattttgggaccctaaacagttttaattcaaaaacttatcaactacaaagttgtaggtcacgtcaagggctataattttgatataaagtttgtcttcattagggttcacatgaaaaagttatgaattattttttatataaagtttttagaccgttctgcttagggaccggggtgacacaactgaacaagttggaggacctaaacgagtgatctgtaagtttagggactgggatgacacagtcgaacaagtttgaggacctgaatggtccatttatgagtttagggaccgggatgacacagcggtacaagtttagggaccggtgatggactttactcaaaaaccaaatataaacaatgtttacaagctagctagtcagtcgatttgatggcagcgagttagctacatttcccattttgatgtctgtgaagattaagccatatttcgtctgatgttttgccgatggacatctgaagtttttgtcaggaggggttctatgaacaaactagttcagaaacttagaggtgttatgcatttttgaaagctggcatacccagcagctgtatgaaaatatgttggtgttcctttcctttttggttactttgtaagactctgttctgttgttgggcagaaagaacaccataattcatttcaaaataacaaaaaattcatatttatcgtttgaacactggtttcctgatgtgcataaatgccaagattcacattgaattaattgaacaggagacctaacacgataactggacaataactccatagtactgtaaacacaaacccatcgaagtctccactgccagacgattcatcctgatctataaaagggaaacaagaaagactggacgatgatgggaatgagacatgattgatcaaggagtagtgcaagcatcagaatgccatgacagcgagagggtattccgttaagatctgaggatgtgaggcgtcggaaaaacaagtgagagaaactcaaaaatcaacaagtttcaaaattatagatgatctaacccaccagaccagtgaggggcggaccaggaattggaccatatatagccggggccgcccatggaagttttggagcaacacggatttacatggtgaaaaatagtactccctccatatttaaatgtatgacgtcgttgacttttcgaccaacgtttgaccattcattttattcaaaattttcatgcaaatatgaaaatatttatgttatgattaaagaatatttgattacgaatcaagtcataataaaataaatagtaattacataaatttttttaaataagatgaatggttaaacgttggataaaaagttaaattggcctttcgccccatgatcaggccgtggccgatgctgcccaggacctggggttgtccctgcgactcacgacgaacatttggcgatagctagacagatagtgaaggagactgcctgcctcagtacctcacacagcagaagtggttgctttgacctgcaacccttgtggatcgtgtatttactggaaactgggattgacggtgatgggaaacacaaaatgagtttttacagcttattctttcttttcaatgcacagctttttgctatcctaaagttttgagaagatggatgcacttgtgatttctcactcggttaacttaagcaacaatacaaatgattgcagtgccaagcgagtacattatatccatctacttgatttctttttttttttactataattcagactcgcacacattccgtcagtgcatggtaccacatatctcaacaaagattgaaggcatagcctaacatagctttggataataactttaccacatagacatacccacatgtgcatgcatgtatgtattacctacttggattaaattcaacgaaaatacatgcacccattctagattttaagacttgaatccaaatggacgagttccacaaggatcctaacattagacctatcctgaattcacgttagttgattcatttggttgcctgatatggaaggttaagcacttttcgactatttggatggaacttgaagagaaatgaacttgcaaagatataagatggagaaatacatgcacattttcaaatttttggtgaacaacaatgaagtttgtatcctctctttttttttgttgtacatgaacaaaataaataaattaggatttttttaccgtactccaaaactttctggaccatcaatgcattatgttaggatccaagggttaatattcttcttacctcttaggtggtaagttgttactaattagcatttaaagaagagggcaatgtttccttgtatttagaagattcatcagtaataccataattaaaactgcttaaaagttcaaattttgaatgaaaactgtgatagtcaaatgctatttctatttcttgctgcggtttgtatttgaatttagaaaaataattttgaaattttaagttatattttttttttcacatatgacatttagagactccaaatacaataattattttcatgttcaaaaactattttgaaattactttgaatttagtcaaaactctctcacttttttttgacaagaagggtcctattttttttaacagatgatgttgcatatatggtagaattaacatgtataattaaatttggaagtataatatatctaccgttacttccctttccggaattacatcattaatgaaatgatctcatatgtttttatttaacaaaacaattatcaataatcaacggttgggatttctttgagctcttaccccatatggaagtaagtggagcaacatgaaagggctcaataataaataaacataaaagaacacatttggattatttatcgtttccttgtctgttcatggacacaaacaatgatttatgaaacaagtccaactaaattttgtacaagaaaaaccatcagagaggtggaagaggaagacacctgcagagcacatgacgacgtgctcttgctgttggcattggccaatggaatgttggtcttcagtttcccgttttgatgtttctagaggtcacgcgacaatttaaaaatgaacaaaatttttgcaagcgttgtcatctgaaaaaacaaaaaaaaaaaggttgctcatttgttcataaataaatgcaaaggtttacactcgatccattcatcaaggggccaatgtgcctaacatgattactgaacaataactccacactaaaaacacagcctgacaattgggccatgtttagttcacaccaaacttccccccaattttcaacttttcatcacatcacatcacatccaaaactttcctacacacataaactcccaacttttttttcaaactaccaacttttctcaaacttgaacccaattttagaaactaaacacagccttcatcccgagtgtataaaaaggaagtgaaaagactacacgatgagtatgaaacaaagatcaatctaggtgtgttgtgcaagcatggatcagagttcccacaaattaaattgttgtgtgcgtctatagttgatgcagagggcatagtttaaagaaatcagagtgctatgagaatgagaggtgtggctgtgtacaaaaatgagaatgagaggtataaatgtgggtcaagggaatgagaggtatccaggaagcaagtcagaagcagtagacgccacactgatcgaagatggatgaagacaccggcataagaatcacacggtctgccacaagcatagctgcagtaggtgctttgacctgcaaatattctagatgatgtatttggtgaacaaggcggccgagtggtataagcgaagaaaaaaagttatgttgcactttgatttcggattgagtcattagtttgaaaaacgcttggagttttcaaagggtataaggtggtgcttggatccagggacttaactttagtccctatatttagacactaatttagagtattagatatagactacttacaaaactaattacataaatgaaaactaattcgcgagacaaatattttaagcctaattaatccataattagagaatgtttgctgtagcatcacataggctaatcatagattaattaggctcaatagattcgtctcacgaattagtccaagattatggatgggttttattaatagtctacgtttaatatttataattagtgtccaaatatccgatatgatagggacttaaaagttttagtaccatctaaacaaggtctagactccgctgctacccgaacatttcaagaaatgtattcacttgtgatgctaactctgtaaattcagattctatatacaaatgcagacatgctgtagaaaacaaattctgaccagtggaatggagaagaaagagtaggctcacatttgttagaacaaattaaaattagacactgacacatgggtcctttgcttaagtccaaaaaaaaaaagtctccctccggtcaaattttatgacattttgctgttttctgaaacgattacaactacgataaattttaaatacttggtttaatcatataaaatggtatatgtgcgtatttttgcaatagtgaaaagtattgttattgtcttataaacttattagactttataacctatctattatatattaaaaatccattaaactttctacaaacgttctcgaactgccatgtggcttcctcaaaacgctctcaatatgccacatgggcacaacgtgaacccgcgcctagaagttgaggacccacacgtgcgcttttgccatgatcataacatggagcgtatttatctcaagattagtttcctactttgaatcaatgaagctggcaagattagctatcctacgtcaacttaatatcacattatctctacatatacatatatacaccggtcaacttaatatcacattatctctacatatacatatatacaccggtcagtagattagcaaattttaaatcgatcaagcaggcaagattattatctccttcagcaacaccacgaccagatggtattttaatctctacaatacacgactctatctggcgactcatcttggcataagaggtgtttggtgacattagtcaattcaggctgctcatatttggcaaaagaaggtaatcgtgcacctatagaagaacacaataatgctatcctgtattaattaaggctacactatattgcatctattgaataacataaatgtatatattatattgcatatgaacatttgcagataacatggtactttacaatttgattactgcgttaacacagaaaaaatgataggtggacaattaaattaagagtgattaggcaatgggatgcgattaatcctacaatggctgatgagttctatggtatacagatgattctacttgacgcaaggtatcattgttgcaaacatatcatttaatatattgttctattatgtaaatactattttcttcggggcaactcaatacatgccgcaatcccaaagcaattggcaaaccactttaggccaaaaattaagataaactcattatatatttttaaaagttccaaagttatggaacatgataagtattgtgtataattaaagtaagagtgattaggctataggatgcggttaatcttacaatggctgtgagttctatggtatacagatgagtctactagatgcaaggtatgattgttgcaaacatgtcatttaatatattgttctattatgtaaatactattttcttcgaggcaactcaatacatgcctcaatcccaaagcaattggcaaaccactttaggccaaaaattaagataaactcattatacattttttaaaaataatcaaagttatggaacatgataagtactggtaccgaaagatatctcaaaatctttttttatcacgatacaataataaaataggtcaaagcaaaaatgaatgtttctcggactactactttgagtttacagacaagaaaacattatggggcagaaagaacgaagatcaacagttatgaggtatgtgtttaatattgcttcttttaatcattgttattagaactaaatgtacttttttctatttagacgtaattagcaccaatgtttaattcttctgttctgaagaaaaatacaaaactgaggttactccatctcactgatagctgctgaattttaacatacaaatattaaaatccaaaaaacaattaatccactgtaaaaaaattctcaattcttggattcctgggccgcatctcgaactacaccaaatcatattagactatataaccaatgcatttagtggactttcatgtccacccaattcatccattaatagaaaacaataacctatatccaattaaaaagtcttaattttcatttaacacttaatttagtatgcatgcttttttaaagaaaataagcctaccattctttacagttgatgaataacattataaataattgcttctatgtattacataaatacaatatagtataaagataactattatgttacaaaattataaaaagcaaaactgacgaaaacaatttagggacaaaacgtgctggatgttctccggttaatattgtccttatataagtgtctcaaccaaacgatacaacgtatgtccattaaagttcctcaaaacgctctcaagttaccaaatgctacaaaatttgagaaaaaaaacaaaacatatatcccttaatttccacataaattggtgggtccaatattataagccgttagattaaactacgattccacctcttctctccctacgtaccctcctttccttccactcaggaggaccttcctctttttccctttccatttttccatgtatttagttgagccactataattattattattcatgataataaactttacataatagttgctttactaacattgaatgtcaacatataactctttacaattagatgtaaataaattagatctacaatatttaaaaatagagttaacaccattatatgatattatgtaccaattattttagactatttcctaataaaaatatttgtttatcgatttttagttaaaccggtggacatattatttagaccatgagatctagcctcggaagtcctctttgtctctctatacaacacattgacgtctttaccttttacacgcatgacgaagcattggatacctaaaggaggttaggggatcatgatgttatagcgctattgcttcgctaaaatggaaacgtgtcaaatcatcaatgggcaacgattggtttttttaataacatgaaaacaaatcgcgaagatgcaatgtagaaagaagaagaatcaagcactgcaggttgaatataattaatctctctatacagtatataagcagggcgaagctagaataaaaattaccatgtgtcacatacacatatattacacatgtaatattctaattacatgtgttaattaaaaacttgctttggaaaaaaaattggacactgtgtcccatgcatgagggaggaggagcgtggtgttgtcccttatgtaaactaaatagttagacaaaatatggtgtatacttctattataagatgatggatgagtggaagataccaatgaggaatgagcggtccgagaataatgacaaatattttacgtttgtatgtgattgagtgacaatatgatgtgtcagctgtacaaggagtgtttttttttattatgaataatgacaaacacaccgattagaaggagaatatgtgattatctaaatttgaaataaacaaatcagacaaaccaaaattttaagtagtcatggatggtttcataaatttttattaattctggtgatgtaaataatattgaatttattgaacaaaactatattattgatataaccagactacatgatagaaaaactttacttcaaaacacttcaaaatttataagtaaactacccatactaattaaatttatataattatagtcttattttaaacaattattgtttcaagaaaataatgaaacttgcaaaaactaaagaaattagcttcaaacaatgttgatattttgcaataccaagcaaagcgatggtgtaggtgatttgtatgcaccaaaaccttttaaagttcttcaaaactatggagaaaatatgaaattgttgaacttatatacaggggggaaatccaagttttaatttaccattaatttgttcgttatatgccttcataggatgatccattttgagttccttgattttgcaattttcgcttgtacccatatttgcatggtatgtatacaagtgatatggttgataattaagctagcggtagtaaagttgtactaacttaatccatcttgtattcaagagtctgaatgttttttgagttacattaagaaaatagaacccctgaatcattttaaaaggatattgttcgatcccaagtttattacctatgagacaatttctaaataaactataatcttatctttcaacaatataaatgcccgcgcatcgtgcgggccaccttcctagttatattaaaaaaagtaaaatgtgatcatcttctctctttatatattgaaatttagatttaccatcgtgggagatgcatgctagtgaccttacatggtcccacatgtcattgccatgagatggtaatcacgcaattttcgatcaaaacaaaggatatatgatgaaatttcccactaaagcaaatatgattttatcttcaaaacggtaaaaagaataatcaaacattcagatgtagaagtacttatttccaaaactatggcactgacatgtggattttactgacacactgtgagccacaaccgttccacatgagtaattaactaaattggtccttcaataatagtaataagaatttcccaatttagtaattttcacagaagcagagtacaagtacgcctataggagatttcttacagtctaaaaaataatattaacaatgtttaccaaaaactagtcagtcaattcgacagcagtgagttagctatattttgcatttcgatgtttgtgaagattaagccattttttttctttctgaaaataacatttttttttcatatttctcatttgaacaacacttccctgatgtgcataaatgccaaggtttacactctcattgaacatgggacctaacaagataactgaacaataactccatacaactggaaaggcacacatccatcaaactctccactaccagatgatttatggttgtcttataaaagggaaacaagaaacatcggaaaacgatggggatggaacaggattaatcgagtaattgtgcaagcatcggagcaccgtaagagtgagaggtatcattcagagttgagatttgagaatgataggcattgaaaaaacaagtgaggcgagctcggagcgacaccaaacatctaagtttctagacagtgcatgatccaaccactattggagaaacgttcttctgtcccggtttgcaaccctctttactactggattgcggttgaaataaccgggactaaaggttaaaataaccaaccgggactaaagtttttttttcttttcgattgtttttagttgcttgcatgtgttttttttcattgcttttttccatcaatcacaaatcgaatgcaaacggatggaatgcaacaacatgacagattaacatcacaaaatctccaaaaatttacatgacaaaatctccaaaaatttacatcacaaaatctcaaaaaaaaaatccccaaaatacggcgacgaccgcgccctggacgatcccctccgccgccgcgccgccacgcccctccaccgcaccgccatgcctctcccacgctgccgccacgcccctccgccgctgctacaaggggccgccagagcagccgtgcgtgcgtgcagctcctctgccgccccaccatgccgctcccccgctgccacgcccctccaccacgaccgcaaggggccgccagagcagctgcagcgccctgtgaaggggaggagagtataaggagaggggaggggaaggaggaggggagaagaaaataaggataagggaagggggagagaaggatgactctgtagcttggctcttttttctatcccagttgtttaaacaaaccgggactaaagtgaatatatttagttaaagatattgggggacctgacacaccctgacaaaaaaataaacgggtcctggctggtaacaccaaccgggactaaagatcatatatttccgttgcacttttaaaccgaaactaaaaatgatttttagtctcggttttttgagtaaccaagactattgtgatttttagccgacccacgaatgatagtttctccagtcgtgaactcttgtcgaacatttggtgagaaccatacagctagccgtgtgaaggagacagcagcctgagtcccccctagcagtagcgggtttcattgtcctgcacacacactgtaaatgatgtatttgctggaaaatgggaaggatggtgataggaaatgcaagatgagttagcacagcttcttttctctcctttcaatgcccatctagcttgttgctatccatccttacgttttgagaagatggattcacttctgttgctcacccagttaattcagtctatatatgttcaccatagaaataccacagaaattcaggtggtgttgagaaaaagaaaactgtttgggtaaggctttaccatggctaattacaagttgatataaacagtactataaacgattgcaacatatataggttaaaggtttaacctatggctatttagaacaaaataggaattgacatgtgggactattgctcgaggaaagaaaaagggtaaaaaaaaagatgtttgactctctttatcaaacttttgaaacttttactatcaataagtttagttgtaaaaaaactatcaataaattaaaaatatatgttttaaaattataaatggtatatttagatttatatttgaaactactgtcacgacatcataaacttattaaattttataataatatcttatttaaaaattatagcgaaagtctcagcataagaacaactgaaaaataaaaaccatgtgttaacatttgaagatgaagatgggaaaggcaacgtggaagctgttgatcaagatggtgtaactgactcagagtaaaagcagagcagcgaggagaagcagtggtggacaaagaatgggggctaaggggcccaaccgcccaagcactttctacggatgagctacctagtagtatccctagtaatttagtattattagtcgccatcccatgcgttgcacgggctagttttgttaatttaccatactaaatttgtgttattagttgaatattttggttactacattatgtttgaaagtaagttacatgtataagtcgttgtatattttattatatatgtttctggaagtcaaaattaaattaaaatatataactacatatatatatattaattgaattcaattatacatgtttttgaacacaaattatttatcatgactgcaactagaacactgggtctttcaactgattgtgtaattaatgaaaaaactaattaattcaattaagatattaaataataaattatttaccacaatatttaagttcataatgcagatcttaaaattgtattaggaccatgatatttaagttcatgaatagtgaagtacaccatttttaaattgcaatgaagttgtttttatcgagtcagttgacggtgtgtttaaatcctggtcaatcttgtttcagatgagaaacatgtataaagaaacaatcaaattgattttttttaaagaatacgattttaaaatataaattttgaggacgaaatcaaactacttggaccaagttaaatacacacaaactatcaaaagaaaatgaaaaatacggtatattcatatatacatggaaattatcgagggtagctaagtaatacttccaaaatctagttacaaattactcccaccgctccatattggttaccatataactaaaaatctgaattttcaaattgatcatcatgtaagcctcgtctgacatgtagcattattttatgaatgcaaattgagtctgcatataaatgcatgcaggaattttgtatagttaacactcgttttgtatgcatgcggggaagttaaagtctacttgtttgttgatttttttcccatcacatactcacataaaatgaaatatacgggaagtggaagttagggctttcttgatattggtgaaaaaacatgacatgacagcaacagcatcaatataataggatactcgaaccatgtacttttaaaagcttgaggagaaaaatcaaaccggttggacaacaaataacaattcatcaaaacaagaatgaaaaatatggtatatacatatatataaagggaaattatccaattaaccatatgagagacttgtatttgataggtacaaagagaactgttgctgttgctgtggaagcgtctaaaacttacacatgcatatgattgactgattgctagctgatacaataaatgtgttaagcatatcgcaagcgcagaccactgcctcctgcgtgcaatctgctgtatacgtataagctgcatattacctagctaggtttgatagtattgcgctgccaccatgcatggagccgggatgacttgttgcgtgcctgatcaatgtgcgcaagtgctgagaaatctctcgtatttgatcgatgccatgttctccatcgatattcttgtgttctcccatgttgtacgacgttgcagtgtggacaaaacaaaaaaacgaagaggcgttgagataaagacagatattggaaaggtcattaaagtattggttgtttgatgggctttaaagaaggcccataacgttaattaatgcttattaaaatttattataatctatagttaggataattcgatctatcaaatcaacagtgggatgtttctaattaacgtgggagcttctttagagtgcccaattagtataggtatagatagatagatatatttctgattgtcaaataatataagataatatttttgacaagtttgttatattaactttatgggtttctgctagatatgaatgtgttttcacttatgtgtaggctatctgtttgtactaagtataatatgtgcatacgtactttcttcacttagaaagatgtttcaattctcatggataagtaaaaaaattaaaccttatgggattcaaactaattgaagcgtgagtgaacaagaaagtaaagatataatatatagttcttaaaattttcttcgaattaatctatcgaatccggcaaagtagttaattcgtacaaatacatacatttattgtggcaacaatttttttaaaaaaattatattaagtacgtatggcagatatgttgtgtacatacattagtgaaaaattggatgggctttgcgtggcccatgaggccgtgacgttaagtagatattaataatctatggttaagattatctgatctacttaattaacggttagatctgcctgattaatatgagagttcatagaaagtgcccaattagtatagaagatatagagatatagatatagatagatagatagatactcatgttgtgcatgggataatctgacgaacaggatg

SEQ ID NO: 7334 - DNA, 718 bp, Oryza sativa
  unsure (1)..(718): unsure at all n locations
acaaataatcttgctatgtctatcaaaagttgggccaaattcttttttttttctcaaaagaacgaaatttccactagtgtcacgatcgaaagacgaaataagattgctcatttgagcatccggtccatttcctgatgtgcgtacataaatgctcattcacaattcagtccaatcaatttgtgacctgacaaaattactgaacaataaattcaaacacacaaccacaaaactttgcactacatgataattcatcctggtctataaaatgacacgaagaaagatatattagacgatgaggatggaacaagataaatcgaggaaatgcgcaagcattatggtgttgttgtgtgcatctacagttggagcccataccagaattatcattaaaatgttgaacaagccagaagcccaaaatgcttttccgttcgattacgcttgtaagttcacggttacttgaccgacctcgtacatttaggaagaactactctccgagggtgcttaattttctcatcaggtggtcgtgccgctcgatatggccaataggccaatcgtgtgcccctttcccatggctcccccttcacatgaaaccagatagaatttcaaaaacaattaaaaaataataagttttaaaaggataatagaaaataaaataaaaattaagttnnnnnnnnnnnnnnnnnnnnnnnnnnnnnnnnnnnnnnnnnnnnnnnnnnnnnnn

SEQ ID NO: 7335 - DNA, 14942 bp, Oryza sativa
tgtggcatgccaacgtactaactttgcttcattggggttggcaaatattctcttgaaacgatcaatgattggtagataccacacaaccttcgctggaccaccccactttgacttctttccctcgcccgcgctcttctttcgcttgtatcgagaatccttgcagacacgacaagcatctaagtccgcgtattgcttgtggtacaatatgcaatcgtttggacatgcgtgaattctccggacctctaaccctaggggacacagaaactgttttgcttcatatgtcgtctcgggcaatgtgttctcctgaggaagcatgtccttcagtattcccaaaagttctgtaaaactcttgtttgatcatccattactagccttcaacttcattaggtctaatgttgctgataatttggtgtgttttggcttgcatcctacgtataggaggagtctccgagtcactaaccaacctgctgaacttcatggaatctctctcgttcatagctgggtcatcaacgtcacgtaacatatcttgcagcatatcagggtccacatcaccatttcaccggccaatggagatgggacaaacatgtcatgctcttcttcatctccttcttcatgaatgtctgtaccacttccgtctgcagctgcaccatcagtacccagatcttgctctccatgcatcacccaacatgtgtatctctccatgaatccccggcgtatcaagtgagcgtgtacttacttttcatcttcccacaaaatctcattcctgcaatcgctacatggacaacacatgtacttgtcgtttcttcttatcctattctcctctgcggctttcataaaacttaatatgccatctctatactccttgtactgacgcctcaagccagtcgtgtacatccaactccgatctatcgctgaacaatgaacaaaatattagttaacatctcataacataagtactactaaattaataggaaatatttagtagccttttacttacttttatgattttcctgtttttgtttgcaaaaaaaattacaaaaattcgcccccttcaacctcccaccaaaatagtgaacagtgggataaactacagtcaatggactgctggagtatatatagtgtgcaaagtatatctcaatcgggccaaaaaaatgtcatctctaacgggcgcacactaatctctaacgggcacaaatagaagcccgacacctataagagtcatcggtgacgggcattaaggccatctcaatcgggccttctttggagcccgtcaccgatgacactcatctgtgacgggctcagtagttgggccgcgatgaaatagtggagtgtttctcaattgggcctaacttcgagctcgtcacagatgggtcatcggtgacgggctataggaatatgcaccccgacgagtacagtgacaacggctaaaatttacgcccgattgagatgacttagttctaacggtccacgttgtctaggcatgtgatgagccatcacagatgataggatctgtactaatggacgggagatgctccagggttaattagacccgatcttgatctaatttaatcttatatatcgcgaccagatatttggtatttgagaacacgtgcgtaaattcgtggccagtcaagtttagatattttatgccaccatctaatcttcgtgattaccaataatactcaatcatattaatcactaatggcttgtgtaagcagaataatcacgcgtacacgtatggcagagcctctacagacgtcaaaagagctagctttctttgggatcaaactagcttgctacacacataggctgttgatatcgcttccattgcactaaagatgattagagcaagttcaatagtaatctatagccaatgtaatagccaatttatacaatagttgtttactatactattaatacctgtttctacttatcatacatacattacatcttaaagtccgtgctacagctggttacagatctgtagcccgctgctattctctctctttttttatctttttaaaatatgtttatagctggcttatagcctgctattttacatgctcttacacaggttgataggctgctgatatgtttggccatatgtctgatagtttaatccgttgcactgaagaggatttattcgtgagtcgacgtacacatccgtagattacatgcacaggtatttcgtcgaatgtgcaagttctattcaacacagatttttgtaacacaccagccaaccacgtacctagagtgccacaccaagcatacactcaaaccactaactcccaaaattattagaaattttggcagagtctccgctgtaaatacggacatccacgacaggaaattataagtttaactaataacaatatcattcccacaatacgatccatccttataatcatggggaagaaactattagaaatctaaaagattattacaaaaccgaaccatgatatagtttaagtattattatggatctaggcaatatagtttgatagtgtgcagataaatgtgtatataagggtgctacgtcccgcccatgcatgtcggtctcaatatgtacctaaaaccaaataaaacacaagagtataaaaatactcggcaagtacaatatggaactagaaacacatatacacatcattggcaataaagcatgaacagaaggttttctttctttgataggaaacacattttcaaataccaagtcaaagaagatagtagttcccattccgggctggcatgaattgaaatagtagtttctatcccggacaatagtgaatacatcctaacatttgccggcaaagccgagtaagcgtgatcagctcttgcccacaggaatttgaataaagaatcaaattgcactcccatgactacgcatggtagttgaataattgaaaccggaatcaaagaaccaaattaaaaccatattgcacattcatggcaaacagggaacttgaattatttacccagaaccagaatccggaatattgaaacaagaataacatcgtaaacatatgataaacaagaaaagcaaaatagtgtgaacaaaaatatgaatataagcggtcacatgtcacatagaaatatatcggaaataaatagatagagcaaacaatccatcaatcacacacttagttcgtcatgcacttgcctccaatgaagggttggtatcatgcacgatctgaaaaaccaccacctaatcacaaacaaaacctcagcaaacacattcaacatgcatataaaacaatgaaaaaggtgaacctactgccctatcccatcaaaacgcaataacaaggaacgccgcttgcactataaacaatattgttgcttcaaacatttatatcttgaaatatgaaaaggctattaccgcaaacaaatacattttggaaatctacagaacaaggcctacaactcttatgtggaaatcatatttttattatgccattaaaatggtctaatttgcgcttgaaagcaggcttcacaatctgtctagaaattcagactatccgcactaaaacaatcataactggagttctacttgcccaatcagggtgtactttaccaatatggaaagctaagaaaaacctctacaactttgtctataggcgtcttggctgattccactgtttatcccatccaaaaatggttcaatctactactatccagattatgacataaaaacaacagttatactcaaaaattcgtatcatctaaaccacttgagataaaatcgcgccctttggtcagaagatagatataaatattatctacagcttcctagttatacactttcgcagaaaatatcattttgatctccgaaactttgaaaaaccgaaacactgtaaatctgccaacgtgcagaacagccaattcgaaccacaacaaacaaaactccttctctaaccttccttatccacgaaataaaccactaaaaccaccctagaacaattgatatgacaagggaaaaagcctcacctatggtttctttagagaacttgtgaggagacaataggggagactatgatctaacccctccttttactcctctcctcctcctcgttgcgtttttctattttgctttttatccaagttatgaaggcggagatctagggagagcaatttgttgtagaggggagagatgcgaacataggaggtgggagtcggttcccctctctctaagttttagggaaaaactaatgggttgggtttatgggccttctcatgttggcacacttctaaagatatttttcttttatttatttctgttaacttctttattttaacaagtcaacccaaactaaaaaaactaaatatattttaatacggggtattacaatttcttttttagtttgattgaaataatgaatatgttgctgatttttttggtgttgaattatatcttttatcataagtgcatggttaaggtaatcatgtcaataaattagaaaaatcccagacacaactataaaaaaaggtatttaatcttagttttgaaacaaagatatatattggtatattttctgtatacacagttgaaaactaccctctccatcccaaaatacaacttctagcatttaaaaattcaaccaaaaataaataacaactttacttttaaaaaaatatgacaacttctctactaatttttttctcaatcaattataacctttccccaatttaattctacctacttccttcatatttgtgtcataccctaaaatttattatattttgtgaccgatagtaataattaattttccctatgtcttttttttgtgtgtgtgtgtgtatatatatatatccatatgactactgtgtgcagtctgcaatttattgttatttgtacatgccgttacagttttatcatcataccaatttttctgacaaacaacacctagcaaaatattgtgccacagtagcaaaaaacacaacgccctaaaaactacaaaatttggatgatcgagactctaggataaaattgtggcacagtagcaaaaaactcaactccttaaaaactacaaaattcagatgatcgagactctaggagaaatagcaaaactataactgatcttaattagattttcaaatattgagattatttccaaaacaatagacaacaaaacacaccttgattggagtattatttagtgccaataaagttaattatctacatataatatgattcatttctggcatattaaccccacactttccttgtgtagtctgcaaatgttgttggctgggcatctttcataggacagattgatgaaacacaaacaagtcaggaaggtgcaaaatccctgaaattatgctctgaattgagtaagactattaaaataaattaatctacacatgtattggctgcattttgttttatcatgaccgttgatcatattacgaatttctgcaaataaaatataccttctggaacaccatagggtattcttgatttttttaactttaagttttcattccaaattgagtacaacttcaagcttattaattcctgagtttggaattattgaattaattaaaacgataaattcaaactccaccatgacaacaaataggtagtgagtaattcctgattttcaaattattaattagattatgaaatgctatagtggacactgcaaaccaaactgaccacaatccattatgtaccaattattaattttagaaaaaaaatcatgaaaaatctataaatcagagtccaagccatgtacaactcaatacttattaattccaaattttattcattagattaagaaaagaactaaatcaagaatccaatattaagtaaaggtattactaattaattccatcttcgcaaattattaacctaagaatatgaaagtaacaaatgagatgatagctaagatgtattatatatatactttataatagctaatttgaattttgaaattataaatttgaaaaatcgttatgtccttagaacaatgtaataattgtttacatactattaaaatttatctctatagtaattgggcattgcgagtcagctgccacattaaaaaaaagataaagacatgattaagtgatcatatcatcgtgaccgtatattatatactgagaatttgtattgcagataccgtgacactttatattagttcccttttctttctaaaattttgaattaatgaacataaattgtatctatttgaacttagttaacactttcttagttaaatttttgaatgcaaaatttgtagttacaaatagtgactaacatggactatttttgcatcgtaatatgctataattttgacaatgtaatttccgaactaatttgtgcattaaaaccctcatccaggaatcagccgaggtacacaaactgataatttaatgtacagattcatcaaaataactaaaacgataaatacttacataagaggcacttagtcctcaccatgaagaaaactgcagcggaaaataaaatctagcgaagcttcagctccactcccacaggcagcacaactgggatctaagccaaaggtcttctccttctggatcctttttcttcaactgaggtttgatgattattgcaagaatgagcatatgacatactcaacaagccacacagtatatatgcaagtgcataagaataccaaaggatggcataatatatggttcatttgtgaaagcagcatttagcaaagagttgagaatttgtaaaacagtagagtaattaatcatcaatattaatcagcactgaacagcacacccatgctgcataggcccaaccaaacctgaacaaccaaccctggtcgtacagatcaaacctccaaaccaggaattatccattccaaaccaggagtcaaattaattatcacattattatcattaatgagtagtgtgagactaatcacgaaaaatattgttagacccgcccataaccgcgggcacggctattcgaatagttttactctgaccagagatgtaccactgtacccacaagacacgattccacacatgttgccatgccctgaagtaccaccacggcactgcaaagggggaaatcgtgacagtactctttgcacaacacaactcaccacagcgcaccattcctggatcataatcaccccataaaaaaccagaggcatggactccccagtgacccccacggacttctcgccgcttcacagtctggcacaccataatgaatcatgctatacaaaagataaagccgttgcccacgctagcttgtggttggtacgattaatgtctcacaatagtagctcgcgaaccggtccttaattgtcatgagcacgaccttcaaaaccatgttctcacaacccaccattaatcatattttaattatcaattaattatcataacacgattgaccatcgtgagctaccattaaatataaccataaataataatgtagtatatataattcatcccattaatgagctaatgtttctaagcatggctaagcaattatatatatatagcatttagctgaaccaaaccaatatataaggttctagctaatcgaattataacccataggaaaataaagtcatcttcgaccattaattaattgggaaaggctcaccacccgatgacattcaaaaataatgcataagttgaaataaaacaatagctttaaacgggttcaacatgctcaaagggttgtttgggaactgtgtgacttgcctttgaaacaagcgtcttcaattcgtctttaggaacttctccaacgaacgaacgatcctccgaaacaacggaaaacaaaacctagaacgcaaaacgagaaaaaaacactaataaaaaccaaataaacagtacaattaaagttcataaataggtagagcttgaatttagatgaattatgagacttgaacgacctcattccgagttcgtatgaattaaatatgaattttacaaaatttaatttcaattaaacctattaaagaaaagactattccaaattgattaaacaatttacaaatgacttatagctgtgacaaaagattaaaacatcctccggaaatagattaggtcatatttggtagatgacatatattaaaaaggaataatatgccattgaaaagaaagaacagatttatatcgattttggacggctgagattaatctcgaccgagtcgaccaagatcggatggcttggattgacacacggcagcggcacaacagcggttgcggtggcacacatacagcagcagcacgacggcgacgtacaacgtctaaacagcgacgcggcggcaacaaggcagctagcgcagcggcgacgctagggcagcagctagcgacacagcaacggctgcgctagggttagagcaacagcggcggtgacacgaccaagggattgaaacctaacccgaggggacacggatagaagtctcaccgaaccaaagcgaccggagagggggggtcgacgatgacgatccggcgacacacacggaaacgatgacgacgctagggccaaacaacagattggattagattagattaaatccctagggataaactacaccggtaaacgacatgggagagaggagagctcaccggagaagacgacgacgacgaccaagacgacgacggcaaggggtgacggctagcggcagtggcgactagggcagcggcggctagggtgttggaggaggcggctaaacaggaggaggaggaggctaggggtggctgcaacacaaaaaaaaaggaaacaggaggggagaggacggcttatataggggaagattgaataggattaggtgggccaagggaggcccggcagagggggagagggagggactcggaggggagagggcagaggaggagcatggctgggagaggggggaggcgcacggctgggaggaggccgagagggggaggggaaaaagatacgggaggaggggttgcctagaaaggaaaggtgcgggaaacagatgtggtgccgttttgggaaaggaagaggaaacggaaccagaaagagaataggactcggctcgtcatacaaaacgaaatcgtggcggcaaagaggtcggcggatacaatgaaccgcagacagggagagtgaactgggaatgattcacaaccaaaggaggaaaaagaaagaattattaattacttttccaattaaattaatcactgaatgatctttcatttattaaaaatgcttccaatgctcaaataattctgggaaaaatctagaaaatacttggacattaaaaatatttaatacaattttatctatatcaacttaatgttcaaaattttcatagattttattcacacacttgctttaatcattaaataatttctaaaaattcctttttcacaacgatttataatttagcgatttttatggtgtgacaatctcacatagagagttaggagttccaatggacaaagatgaagtagaagacgagagcattccagactgggctcaatatggtggatttgatgaaaatacaaaaggaaggtggacagggctgttgaagataacgttggtgcgaatgatcttggtcagaagttgcgtgacgtaaaggaggacggcaaaagtgaaaaggaggtgcagaaacttgagcgcatatcagtggaccacaaaatgtcgttgtacccaggatgcgatccggggcacaaaaagttgggtaccacgctaggcacaaaattagagcgtatgttaacggaccacaaaacgtcactgtaccacgctggaattctcgcaatggaataccaaaattggtgtgagtgacaaggcatttggcgagttattgaaactcataaagaacattcttcctgaaagaaacgaattgcacgaaacaacgtacgaagctaagaaggtagtctgccctctatgactagaagtatagaagaaacatgcatgttcgaacgattgtattctctatcgcggtgaggagtacgagaacctagaagaatgcccgttttgtaaagcactatgatacaagattagacaagatgatccaggtgatgtcgacggacagccttcgaagaagagagttgctgctaaggtgatgtgctatttccctataataccacggctcaagcgttggttcaggaacaaagcgcatgctagaatgatgcgctggcacgcagaagaatgtcgacaagacgggatgctgagacaccccaccgatgagtcacattggcgaaacatcgatggaacatttcaagacttcggagtggatgcacgaaacattaggttcggtttaagtatgtatggcatgaatctatttggagatgagcagcagccgtaacacttggcctgtgaccatgtgtatctccaacttcccccctatgaatgaagccgaagtacatcagggtgtcgatattattgaaggcccaaagcaacctggtaacgacattgatgagtactaaagaccattggttgaagttctgaaactgcgtgaaagaaataaggtgtcctcgtgcgggatgagttcaaacagaagcaatttaacctacgagcgttgctgttcgttaccattaacaacctatctggacagtcaaacaagggatataaggcttgcaccctgttgacggaaaacacagtggcctaggggatctgcctaactttagtgcaggtctaagacttgtatcgagtgtgctaagggcgtgtcagcttgtttcatcctgcaaccagcaaggaaaaaagaaacaaggtgagttagcggatagccgatcggccgataggctgatgacgtatcgttgatggtctcagccgatatggttagaccaaattggctatagactgagtagatcaaagaatataaaaccctacatatcgtctgcttagtttgataaaatagatttcagacgatatcatgagaatagccgatggaacaatttttagagaaagataggtaaataaagataatatactagctaatactctagtgcaaacttatataaacaaatcaatctatagcaatctatatttagactaattgggcactttctatgagctctcacgttaatcagaaatatctaactgttgattaggtagatagttttatcgtggccatcgatctaggctggataaaattattacggcttggagttgattgttaccgccgagataataacagataattaactaccataattagcgtgatgtgcggcatatatgcagcatagcacggcatattctgccgctagcaggcacgttgagcgttccatccccagcagcaatcaacgtgtactgcatcaaaatcacagtgcctttcatggatcgatgaaagcatgcatagattggcagggctattgctcacgtatgatattcctcatcactcgcatcccatacagcttgaagccatcctgatgcatgcagcgcacatgaaatttgtacaaaacaaatatgcacgcttttttccatctcatccttttttttatttcttttaattcttatgccatttcatccatgctcgagctcttaattaattatttgtagtgatgcaaaacaatgaaaatctaacaaatctgcagctttgtgtgcatgctattgattcactaaattgtactccctccgtcccaaaataaatgtagttttgcactagtcacattcaacgtttgaccgttcgtcttatttgaaatttttttatgattagtatttttattgctattagatgataaaacatgaatagtactttatgtgtgactaaatatttttaattttttcacaaattttttaaataagacggacggtcaaacgttggccacggatatccacgcgtggctgcacttattttgggacggaggtagtattatcgtaaccatatatatcgtgcggagaattaatattaaataaatatacaataggaaatatcgttgactttcactttttctccattgtacccaaataataaagcatgacattttaaatagaaagtcggaattaataaacttgaagttgtacccatatcaaacacataatatttcgaaatttgaaataaataataagtaaattataagtaatatggacaaagttttaaatctaactggctatattttaaaattacacaatatcatgacaatagcccgtgcaacgcacgggttggtgactagtatatcaaattgagatcaattaccaggtttgatgacctagctgattactgatctagacttgatgtatttatatatgttgatctatctatataagtgataaatatacataaaacaagtaaagtagcatgtatattaaaaaaagatcagctgaaactctgattctatatctaattataattaatttcagattagtttttagggttctagacaagactagggatgaggcatctcaaagtaggtaaagaaacctaaagtctaaacaatcaacgaattaattacttttcaagatagtagatgccttagttaatctaatctagtaaaacgatttagccaataccaaaacgagtaccagccgatagagctaaattgagatactaagactaaattaactaagacatatgacaacagatggttatgataaaagaactataacatccaaaacgacatagtagccccgatagcacaagccattgagacgagttacctcttgtcgagagaactcgacgaaaagaagaacaaaaacggatgacgatgcgccgaagttgtattggattatttcccttattacaatgctctggggttcatatttgtaccccgagtacaaacatagtccattatgaacacgactcaaactttcctaaagataagatacaaacaagaccacatggcggtctgttgccaaatctctaacaatcgacttaaatatcctaattaatatatacaattgccttaatcgagctctatctctaattgacaatgacggttattccaatctagacccgaaacgagcccaagtcatatcgtatcggccacttgccatattggctaagccaaacttctattctgtctccagccgatacaatgcccagccgatgcgcggtccgacttcaaatacaacttgatcattcatcaaatccgcttcgatcttgttccttcttttccggatctgatacaaaattctgttgttaacacacccactacatggatgaaactgaaagtacgtatctaaaacattgtaggaaggtagtgtacatgggccatcgtcgattcctttttgcaagccacctgtacggaagaaaggaaagtacttcgaacagaaggcaagccaccgtactaagcctaaacattgcaatggaaaagtcatgtttgctatggtgaaagatctgaaagtagtatttggaaagggagctagcaaccaacctatagagagctaagatgcgcacgcggcgatctggaagaagaagtctattttttttgagagttaccctattgggaagtcttggatgtccgccacgcaattgacgtgatgcacctcactaagaacctttgcgtcaacttgctgggcttcctaggtgtatataggaagtcaaaagatacacatgaagcacgtaatgatctcaagcatatggaacaacgcggtggccatcatccggaacaaaagaagaaaggaagccattacttgagtaaggaagagaacgaaagtatgtttgaatgcctagagagcgtcaaggtaccgtctagatactcctcgactacaatgagaataataagtatgaaggagaagaagttcacaaaactgagcagctcacgcaaaaaattgctagtagcctagtatagccctgaccatgtacaaccttgctacgtagctttgtcagaagtgaaagtaaattttattgcccatccataaagaaggcccatcaacccgcggggggaggggggatggatctgctgccctcgaactccgcccaatgccgtcgtcaccctctcggggccaggggtggctgatccgccctcccgagggtggcgccgtcggatccgctgtcgccacccaatgtcgtggtcacctcttatgtggccaagggtggcagatccgcccctgccgaggatggcacggccagatccgtcggcctcgagctcatcactccggccagatcccatagcctaggacaccgccgttgtcgcccgataccatcaccgccgctcccgccgtcctctgtatcaaatcccgcggccgagctctgcatcccgcaaccgagggcaccaccatgcaattcgagggtgcttccgctgctcccgtcgtcatccacgccgaatccctagccgagggcattgctacggccgcctgagtccgctgtcctccgcatcagattccgtagccgagggcaccgatacccaatacgagtgtgccaccaccgcctctcacaccgtcctccacgctggattccatgtcgccgagctcactaccactcctgtccaacgctagtcgctcctacccgcgaccaaacgccgacccgcttgctgctccagccacgtgctcaagagggagagggagacagagaggggggaggggggggaggaggagtagaggataagagaggaaaggtggagtggagtggatttggtttttatatttagtttgcagtgatttttccaagtggacctcttaaggaggcgtctgtaaaaatctgattttcgcatgtggccacttaggaggctcgcctgaaaaggttagtccatttttacaggtggatctcttaagaggccgcatgcaaatgttattttgcatgcaacgctttgaactgaccccgtgggagggatttttgtaggcggaagcagttatggtccgtgtacaacctaaaaagggtctcatccagaaaaatcaattttgtagtggtggctgtactccgtatgagatatcctatctcacatgattagaattgggaagaaatccacgtaagtaaagtttttcttaccttgactttgcaatgtgttatgcaactacgcctaaccaaaatcaacaaaacatgtcttttagacttgtaggtttcatgactgcatcgttggagcagtatgaataacgacatctacgc

SEQ ID NO: 7336 - DNA, 4707 bp, Oryza sativa
taatgagatcattcgttcttgcttgatggtcgagtcctcacatgctcctcagctctgtcatgaggtgctgccctttgcagttgtgctgaattatccaagaggctgtggaaacatttcggttaaattataaaatggcagaggattctagtacataatctttggttgtaaacaaccacctagcttctcagcatttggctgacctactcacacgaatagcttactgttgcacattgaaaacaaacagcttataaaatagcagaggattctattacataatatttggttgtaaacaaccaccttctcagcatttgactgacctactctcacgaattgcttactgtcagctctgttacgaatacaaactgtataaatcattgtgtcttaacacatatataacaaatcatctatgcaaacaagttcttttattttagacttgaagcagagaaccaactgtatgttccaaagctagttatgcaatggttaattcttcatcttgccgatggacccaacatggacatcgaaaacttgttatctcttgctatattttccatgtcgcccatgtccccatgagcttcctccaattccaggctttccttcaattgcatgaccacggcggacatcattggcctttgagcagcaatatctgctgtgcacatcatggcagcatctagaaccttccacatggagttgacgttataagaacctccaagacgtgcatcggcaactgagctgatgttaccagtgaccatcttctgcttcacacgttcaacaatgtgaccatttccaggtattatggtaggttcaccactagttacctctagtaaaacaacaccaaagctgtaaacgtcactgctctcagtgagtctaccggtgatgtagtacctaaaaatggcccacattatgttaaacacaatgattgcaccaagtgattaaggataaaattgaatagaatcattaaaatatatgaatacacagcacaaaattagcattaattgtgtagaaagaagctcatactcagggtcaatgtagcccatagatcccgctgcaatggctgatatgtgagtctgggagtcactatggtaggtttttgaaagcccaaaatctgctatttttgcttttaaatttccacccaagagaatgttatttgtctttacatccccatgaattattggcaggttacaacccttatgtagatattctagccctacatacaagaaaactacagttagatcaagagatgagcgataaaacatagaaatccatttatatcactgagatcagtttagttcgatgatttgtcatcgattttgtctttcttataatacgccactgactttgtcaattttttctacaatataccattaggggtggatacttttagaaaatacctaaaatgctcttcaagacatacaagaggttacacctactagaagttttgaataaatttgaaaatttttatgtagcctccttgcataatataacagtgtgtatatttcaagatttttcattttgcacgtattaacttttaaaaaatataatttatgttttatatggcaacaaaatactctcgtgttaatattcctttatgtatatcatcattcacatgttgtaccttttttattgtgatgtggctatcttttgtgtatatgattcctctttcaaacactatataaaattattatttaaaaaacatgaaagaaaaatttaaaatatacacacattctatatttcgtaagaaggctaagtacacaaaaactttcatattttttcaaaacttctagtgggttaaacaattgtcaactcttggataactcgaagggcattctaggcatttcagaaaagtatccaccacaatagcttactgtaaagtcagtgccatttatattatagagggagacaaaattgatgacaaattgttaaagtaggataaattcagtggcatagcatagattctttctttgcgtatttgccattgtcttcttactgtagcataccttgtgcagcttcaagcataactcttacgcgtgttgcccaattcatggttccacccatgctagttttaccttcatacattacttatacgcaattaaaaggtgagggggggagggggaaaaggggggtaacggtgttaattgacaagtcaaaacagtattattcctttaaaaaaaggatagaatcaatgtaataatttattagatagatacaaccatctcttgatattactatgtctgcacaatcagtcgagatagaccttcaataatgcaaaaacatttattttgtatacaattttaaacatccacacaatttattattgtgttgtattaatcagatgtctagataatgagatgatgagcaattatgaaaaaaaattggtaatgcaagattaacatattctatacttgagggcagcagaattaagggtagttttttgttttctgtcgtactaaataactggcactattagaaccaaggcaagtttgggcactactaaattttttgtagggtagagttgcatggatcatctttggttagaaccaatttagagccaaatttgattggtacatatagagttaccatattaatataggccttgctaatagtttggctttaatacaaactactcacatctactattcaaaaaaccaatagactggtggggcacattttagtatccaaaaattgctctaaatatattatgatatctttagtgagtttaagcgatggccatgaagccccttaggtagagactaactatgctctctccagtcttttttttttctcaaaatgtctaactatgcactctccaggtaagcagtactacttgtcatagttctgcaaactgttatgcaacatgagttaattggcttcgctgtgagctggttcggtcatgcagagtatttaagttgtaaggaaggaatgactagttggtctacgtaatgtatatgcccagtatcctccctcagatttcccaaatattcaatacttaaagattgcaatggacaaacctctcagataatcactaagattgccactagacatgtactcgtagacaagtgctaaatgatccttctcccagcagtaaccaatcaaagaaacaagattcctgtgattcaccttggtcaagctctgaacctatgtaatgggacaaaacaaatggtcaaatatcttgatgcgtatgaaacctcacagtggatgcgactaagtttacatgcacatatatggcattctaagtattgaatcttttttactgaaaacagattgattttatctatggttaaacataatagtaactatatttggcacctcagctaagaactcatcgagcccgtgggacgatgattcagatcgcatcttaacagcaacctcggtattgtcttctaaacagccgtaatagacatttccaaagcctccatgcccaattaaacatttgaagctatcagtgaacttcgctagttcctcatatgtgaatcgacgattctcaggtttttgtagatggtcccaatgatttgtccaatgtcctggaggacttatctgttctggtaccgtgggagaatcatctgtagaaactggtggagaaagaacatgtttagcagtattaaatgcagatattaaacaatgtgtttttcaatgcagattatagtattacacacaatggggctttcttttggctctccagatcaaatatgctacaacaagcatggcgactacaagcactggagccgctacataaacagctaaggtagctgctctgtttcttgaggacgaagttattggttttttgcacatatctccgtcagactcgtagctgaaattacataaaacaataagtccatggttttaaattggtatgctcgccaaataaaaatctacaccaaaattaaagcacatcaatggtgggaattaaaagtgatattagcagagtaattcccattagaaaggggcaattttgtccttagaaaaatctgagcccgtattcttgttgatcctatcgatcgagcgatggattcacagcgcgggcggcagttcatccaccaaggcaacgaacatcagggtactgctagtaggcgggtgatcgcttccccctactcctagcgatcacctaccaaggcaacgagcatcaaggtactgctagtgggcgggtgatcacttccccctacttctagcgaacacccgtccctccccccctatacactcttcttctcccccttcctctcccttcttctcttcctactacaacacaccataaaatttaaaaaaataaaaaaaagttagaaaaaattatggatagaaatactatatataaaaaatttgaattcaaatttaaaattgaaacgggtatgtaaaattttgacttataaactttgggtctataaactaatatttgaattcaaattcaaatttgaatcagatataattcaaattcaaatttgaatcgggtatataaacttttgacttataaactttgggtctataaactttaggtgtataaactttagatgtatagaaatactttatataaaaaatatttgaattcaaattcaaattagaatcggatatataaacttatgatttataaactttgggtctctaaactttatatgtgtaaacttgaggtgtataaactttatgtgcataaatttactaaatggaaagtaatgcggtaccaaaaaaaagaaaccacttagaggagaggaaggaggggggggg

SEQ ID NO: 7337 - DNA, 9735 bp, Oryza sativa
  unsure (1)..(9735): unsure at all n locations
ctattcccaacagccgagcagagcgaccgtcccggcgcacggcgccgatgacggcggctggcatccctactcaccagaggtttgctgccaccccgaacgcggagccgcttggcagcctgcagggagcatgatgcatgggtggcagcggagaggtggaattgtcggaaattgactgccgccgcgagtcgatcgctcgatcgatatggataggggctcagttttttctaagtacaaaactgcccccttgctaatggggggattactctgttaatccacttttaatatccaccattgatgtgctttaatttccgtgcaggtttttatttgagaagcatagtatcacttcccttccctattttcttttagggtgcccaaagattacaggaagaacaaccccacaatctggaaaatgctaaaagggaaatcaataataatgaaagtaggcacacctgaaaacaattgatccattgcttttgcgaaggtagtctggaattgtcccggttagttggttgcatgacaagtttctgtataaagtgggatacaatctggcattaaacaatagacatcctgacttggtaacaatctgcaaacaaatttatccactaaaaagttttatatgaagggccggcagtgccaatcggacatgaaataattcgcttgaatttttttttaaaagtaaacaggtatattccatcatccaagtggcaatctcacataaaaaaattcctttatggcaaaaatgagatgtgtaaaaggagaattcttttaaacttcagtgcttcattttacttcaattcaattgtaaaaggagatgtgtcgataagtaggctgcagcagaaggtatattttcccttttgtgaggtgccataaatttctggtgtatgttgaaggacaaagattataaatacactagagcggtggatgtatcatattgcctttgtgacttgcactttgaaagtacatatacatgattgttaagagaactatacatgattgtgctctccagtgccaccctcttaggtaggtaaaaggttattatgcaacagacaatggaagtatagtcacacgcttttcattgggaatttttgttattttttgaacatttaaaattttaaatttaaaaataaaccatctcgatacttatttctaaatctgaaccttcatacccactgcgcctcacctcgcttggcgaaacaatagtcacaccacccgcatttgcgcatggcaaaaaaggaacttatttgaaaataagttttgggaaggtttatttttatagctaaaaactaaaaggttcaaaaaaattaaaaaaatctctgattggtcaatattatatttttttctgttcgatttcatatttctaaagagcacatagcttttcaatatgattagtccaattccctgttatactaccttggagttgtatgctcaaacagctagattgttcaactcatccaattttcagatgatcttaacgattgattgttgcagggtagaggcatacaaagaacaaacaataattttgtctctaaaatagctcaaaagaatatttagtgaaattttatcagggtgaatatgttgggatcatgagttcccagtctcaaattccctcgccgcaccaagtgtgaccctttttaatcaccggttcttaaaaatatgtttgtgtgttttgggtaacacaacatgaaaatgcaataatttttgagtgtttttatatgtaaaaacgtgcattgcacgtgcatgattactagtaaatggcaaaagcgtgaagattgttggcttagtgccaatcggacatgaaataattcactcgaatttttttttttaaagtaaaccggtatactccatcatgcaagtggcaatctcacataaaagaattcgtttaaggcaaaaatgaaaattacacagcaatcagatatacttcgtcttgcaagcatctgtttggatcatgatgctccatgttttgcaacatttcattgcctaatcaatgatcctggaaatatctatctaaagataagtcatatcaaattcctctagatgcgtgagccatttggagacattagtatgggaataagaaaatatggatgcatgtttggctcccatattctgccctacagcttataagccactgtcaaaatttaaattttaaaactaacatgatttgaaagtagattttgcatgttttttcatcaaagtttattttttacattgacttttaaaacttttaaactgctgccaaaataatgctaattataaaagttttacacacaaattaatatttttattttgttaataagccgtacagtttataatcagcactagagttacctacagttggacggatacagtgttgatgtatgccttcaattgtgatatctacgaattttgaaagctaagcacatgtgttgaaggaattctgatatattatagaccatataatatatattattcttgctctactttcagattcagattgccccatatgtaataaagaaagattcctccatatgtgtctttcaaatttaaaactacaagagaaaagcctacttttggtcatgcaactgtagccttggtccgttttcatccctcaactacatatgaaaccgattactgctagtctcattctctcgaagatgtggcaccacatggatagtacatgcgatgcaataaacctccactagttcttactcctactccctccgtcccattttaagtgcaactatcagtttctacgctaaactttgatcgttcgtcttatttaaaattttttatttagtatttttgttgttatgagatgataaaacatgaatagtactttactcatgacttatgttcttttaattttttcaaataaaacggacgatggaagttagacacggaaaccatggctgcacttaaaatgggacggagggagtagttaggatgggtttatataattttaattgcaccagaatgcaactgctcatcatttagttggtgttttccggtgattttaaatagcataaaactatccccattaatgtcagtcaggaatttcagatgtggctaatgaaaggcagtgaaaattttatgtatacttacaaatacttgagggcactaaacaatgtgaaattataggatatctgcccttgcaactcgctgttggagagatcactgcataataatttcaagcaatacaacataaatgaaaggtaccaactatatacaataaagcaagtacgatagcacgtgcaaatattccgaataatactcacagagatattatcctcatggttttatcatcaccaggattagtacattccacaccatcccaaacagaattagatggataacaaggatcacccatccaattcttccttattccgtactcatgtttaatggccatgatcgcatcaactagcatatggaaagaaatacatggaagaaacccaactgatatatttaattagtgtacattgttagagacagatagagcttacagtcttgggagaacgtcattggatattcatggatgatgcgactgtagacctcataagcattgaggatcgggggaagagaagatgtggcagtggcaacaagtttgatggacagatcttcagaatcactggaccaattgatgatagaccaacctttcaggtatggtggactgatcggtccactttgcatgccgctgtcaattgaaacggtgaactccctagtcttgttatcctggaagtcggcgaagtgcaggatcaccaagtgatcaccgggaagtctgtctcttctctttgaacgtaaaactagttcattggagttaccaaccggcacaaaagctgtttggagaacacgcaagggcaccataaatgtggtattcagttcgatggctgattgggtagaaatgtttgaataagggtcatttccagttaattcccacgcataccaataacgatcgtactgatcatcanganacctgtatttatgaaatccttgatatgaagnggaacatngcaattgaaaacaaattgacgatgaatacttacttcctctggtcgtaaatatttgactagtcctaaaatttgatgtttgtgacaatataaaactttgaccatcaaccatcaaaaaggaaatgagttatgttgaaaaataatacttatataagaagggttctatgctttccaaaaaatagtgtacgtacgaatccaagagcacttccattaattactgtaaaattaatagttagggtataaaaattaaagtctgatcaaactttatccttaatgtaaatatttttcaccacaaggaacaaaaggacaggttgatatagaaaattaggagttagtaaaatcagagaatatacaggttcttctccaatccatttgtacattatattaaggtgcaaattaaatgagctgctccttaattactacgacggccggaaattaggaaatacagtagtagtgctccaaccttattatatcgacgtcagcacctgatctcatgctcttccgttcatagagggagagtgactgattgtcggtcgggtaggccaagctttcaaacggcctcagctccaccgtggacacgaatggtgtaccaccgccggtattcaccaggcacaccggcgccgacatagcccatgcgacgaacaccgcggcgtatgctttataaccgtagtggatggtggtgtccaagatcacggtgtcccagtggttcaccccaagggtcaggttgaacgtcagggatgcgctgtccaggccatcgtagttgccatacagaaactccagccgaacattgtacttgtccccttttttggtgggtagcgagtagcagctccgttcaccggtaacggatgttgggaagctcctgagcgtgtagagtgtctggtagcgagggcccttccagtcgtccttgtacacggtggtcacccttctattttcgccggcgtcgacgtacgcaccgtcggagacgtaggtgattccgccaaccaggctgtctgttctggaatcttgatccaggccacagtcgatgcttaggaaacctaatacacacagaaaagaaaaatgacgttacacacaagtgatcgaacggaagaatcaaaatagccaaatctcgtcttcattttgaagcaaaccaagacaatacccactggtgtacagggcggaaaaatctcaggaaattggtatggaacaagaggggttttttcatctcaagatttttttcaacaccgtgttttttgtttataagagcaccgtgttttttgtttatgcgcttgaaaaagcatcgagaggtctatatcgtctaaatttgttgtgcagaccataagagatcaccaaaggaaatagccatatttttaccaaagaaaatacccgtattttcacacgcagttcttttaccaaagacggctatacaattcaggagacactaaaaaaccggccagcccaaccagctatggttaaatccagtcccttggactctcctcgtccgctccctcccactcccaggcgtcatggcaccatcattgtcaaccacagctagaaagctgcatactttccctccactacccagccagagtgccacactgattcagcagcatcggcgggcctagacagcaacagtgagcaacagcttccactactagaaaaatggttattaccaataccaggcttttatttctatatggagtaaaaaaataccctctggttactgcttacaaaaatagccaaaggcccccatgatttagtcccgcttggtcgaattttacagtcggagccataagaggttcgcttacgaaaaaagatgaacgaattatcataggtgagatgtaaagatgttagcatgcgaaaaggtacgagcgctcaaaaaatccacgcagctaagtctccatctattattttatcttcatcccttaggctgtgtttgatacttggggttgggaacccaactccaccgcacggaaaacggagcggtccattagcgtgtgattaattaagtattagttaattttttttcaaaaatggattaatttgtttttttaaagcaactttcgtatagaaactttttgcaaaaaaacacaccatttagcagtttgaaaagcgtgcacgcggaaaacgagggaaaggggttgggaaacttgtggaaagaacgcagccttagtctgctcactccctccctcaccctccactcccctcgcctaccctccccctgatctacctcaggggtggaagccagtagtgaaagcggtagagggggcatcgacggcccttccctttcccagatctggccaaagaggagtaggacagcggaggcaacagctgcagcagaagtagaaggctgtggtagtagcagcagaagaagaatcaaaaagcagtggtggtggaggcggcaggagcaacacaaagcagcggccgctacgatggcgggattagaagcagaagaaggtggtgacggtgatagcgaccagcgcatgcaatggttcagcgatagtgacccatgcatagaggtggccaaatgggccgggccaaacgggcggcccggagcacggccgaacctgtagcaggcacggcccggcacggcctgctacagtaacgggccgtgccggcacggcacgagtagccgtgccgtgcttgggccgctggccgagcccgcgggccggcacggcacggcacggctactgtagcgggccggcacggcacggcccgcggcacggcacggcacggcacgccggcggcccgtcaggcgcggacagggcgggcggcggtcgaatgggaaggcgccacgtggcactaacggctatttgaccgttcaaatttgaaaataaccgttgggaggctaaaaaattcataaaaatttcgaaaaaattccaaaaaatctcaaatttcgccctataaatagggcatgaaccccagccatttctcctcatcccacactcctcatcttgtgctctcaagtgttttaagtgctctctttgttctcaagtgtgcatttttttttattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaatggatccgaacttttcataccagtcgccgtcgttcaccttgggtgatttcgaccccaactacatgtcggggtttgacggtacctccggatcggctccaactccaccatctgtggaggaggtaccggttcatacggctgtcgttgaggaggtaccggttcaggcggagacagcttcggaaggattttccggaaccgcgagcggaagtgtttcgacacacaccggctcgaagagatcgagaacctctggtgtgtggcaaagcttcgacgagataaaggaaacctgccccgacggaagggaggtatcgaaagcccgttgtagaatatgtaggcaaattttatctgctcgttcttctggtggtacaggtcacctcaagcgccatgcggagtcgtgtgccaagaagcaaggaatacaactccggcagcagcaacttatggtaaacccagacggtacggtacgcagttgggagtacgatcccatggttgctcgggaatctcttgtccggttaatcgccaggcaagatttacccctgaactttggggagtcccctgcttttgaacattacattcagcaatctcataaccctaggtttaaagctgtgagtaggcaaacatcaactagagatttagagaatgtttatcacaaggaagcaactgcacttaaggaactgtttagtacatgtactttctctgttagtgttacttcagatatatggagtagtagagctagagaggattatcttagcgtagttgttcattttgttgatgatgattggcaattacaaaagagagttttagggcttaggttaatagatgtctcacatacaggagaaaacatagctgaaagaattagggaagtaattaatgaatttaatcttgctgataaaatatttgctgtcaccctagataatgcatctgctaattctagggctattgaaatattgcaacctttattttgtgtgtatgctcaatcttttctactccatcagcgttgtgcatgtcatataattaatttgattgttaagactggcatgaagagggtaggtgaccacatcgatgctgttcgtcaagcaatcgcgtggttaactgcttctaacccgcggattgctgcatggaagaggttttgcaatgcggccggtgtgaaagctcgtaagtttgccaccgatgcagagcatcggtggaatgcaacgtatttaatgttaaaagttgttttaccttatagtagtttactttctgattttgttcagtcacgtggtggcccaagaaacagtgacgggtcttcagtactgaacgagcatgtttgggcaattgtccaaaaattttaccaatttctagaaactttttatgattgtactctaactttgtcacaagtttattatccaactgctaatataattttgcacaaccttcttgaaattgctactttatttaaagaatacgaaaatgatgacgttctaactgaacctgtctttcacatgaaacaaaaatatttgaaatattggaaaaatatacctatgttgtatgctcttgcttttgttttagatcctaggtgtaaattaaggggattgtctgctattttatcacttgttggagatactataggtgtagattatagttctttttatactgaggttagacgtaaattatatgaggtttttggaagatatgaagtaaagtttcaggaagttcgccagcagagaccccctcctatccccactacaggtaagaagaagatacagtggggtaggatttggggtggatcgtcttcaagttcaatccaaggtggtggcagttcgtcggctacaagtggagacgcctcttcgcatgttgtggccgaagagttgtccggttatttggacagcgacgccatccaccacgaagcacaagatttcaacgtcctcgggtggtggaatgaccacaagataacatatcctgtgctttcaaaactagcacgggatgtgttgacggtgcccgtgtcgacggtgtcctccgaatcggccttcagtctatgcggccgaatcatcgaagaccggaggacgactctgcgcagcgatcacgtcgaaatgctactaagcgttaaagactgggagcttgctcgacaacatgcccaatacactgcggacaaccaagaattggccgcccagttcgagcaactctacctggatccagaccaaccccagtagaattttgttagaagtagttctgacctttgagctgtactcttttctttgtcatggttttctcattttcccctatgagtttttacatgacaaagtttttaacgagacagcatgtatcattgtatcctgtaatgatataaacatcaataaaggtcattactatttttaacaaattcttttgcaatattttcgcaagtgtggatttatctttaaattatttcaaaataatgaatcacaatctatatttttaaatttttcaacacaacaaaaaaataccattttttcttttttttaacattagcaaatcattacttttttaaaaaacttttatttccattttttaaataccattttttcattttttaacattagtaaatcattactttttttaaacattt

SEQ ID NO: 7338 - DNA, 1686 bp, Oryza sativa
  unsure (1)..(1686): unsure at all n locations
ttttttccttatacatttcctttgctttttttttaaaaaaaaacactgtgcactgcaggctggcgggctggcggcctgccttcacgggccgccgtgccccgaacggcccgtgggccgcgggcgtgccgtgccggcacgggcacggcccggccatccacgggccgtgcttgggccggcggctcggcacgtgggccggcacggcacggcccgtttcatcagccgtgcctaacgggccgtgccgaaacgggccgtgccggaaccgtgcccgtgccgggccgggccgtgccgcccgtttggacacctatacccatgcacgtgatggatagggagcacggatccacaatatgacttttgctaccggccacggcgcctctaggcctcaggagcttgcatccacaccaccgagcctggcatttcctccttagctcctgccgtcgaccctgcctgcagtcaccaggccttgtgggaccggatcatccagcactggctagcctcaggggcatggatccaccaaccgccagccttgaaagcgtggatccactttccagcctcggaatcttactctttgacccctttttgtgatcaatttattgaatggattttgaggattgtgataagtttgtgaatggattatgggtggcaaggggaatagaggaatttggatctaccatagggggatattttggaatcagcaggtttttttttgcactctgaaaacattttcataggcagatcactttaggccttaaattgcagttgtcgcgactagccgcatgtcaaaaactgttttggccgactatggaaatgctttttctagtagtgtttttgagtggcagatccggcggcggcggctccccaagcagtgggcgctgccgcggcagcgtgatggctcgctgtggacctgcgatggacggtgagaagcaagcgcgaccgcaaggtggagatggaggaaatgttcgatgccgttgtcatggccaccaccaggtgctactcccagccgaggctctatgcgtcgataggatggacatgtacaggtggaggaggcggcggttgcatgcgtgggtgcaccgtcaattaacaatggcgcccgcttaccttctcatgttacgacaaaaggttatggcatgagtgttgattttgtagattagtcattactttgtacaatatatgcttatgtatgtctttctttcgggaatattcttatgtatgttcttataaatcccttgctgggcccattcataatcgaaatcctggcttggctgcaagggataaaaatcattttggactctatctagagactaggtctgtttggagtagcatgcatacctatatgttcttcctaaaatctttagttttttaaacaattcatattttcaatcagattatgaggggtatagttatagaatccagaaaacgaactagaaagcagaaaattaaagataaaaaaatcatctttttttccaattttctcactagctgttctttaaaatcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 7339 - DNA, 344 bp, Oryza sativa
ttgaacatgagaaaagaaaaaaaagaaaaaaacatttagtcccggttgattacattaataggaactaaagatttagtcccggttggtgttacgaaccgggactaaagatgcatttttagttccggttatttcaatcgggactaaagatggacatttttagtcccggattcgtaatcccggttaaaaaaccaggactacagagggttatcaaccgggactataaaccctttctccaccagttatttatataaataaatttttccaactttgtttttttattttttaaaaaatttatggtgtagtaggaagagaagaaggggaggaggatggaggggggggagagc

SEQ ID NO: 7340 - DNA, 9741 bp, Oryza sativa
ttagttcctcacatgatatgtttttctaagtactttaacgcactactatagatagggtttttccatacggctgagaaccatctttccatctttccaagacatcatttttgcatgcggacctcttaaggagacccgtatgggataatcgatttttccatacgggcttcttaaggagctgtttgcgaaaatgccgcgcgatttttgcaggcgccactagttatggtccgtttgcaaaaatcatggggtctcgcacagaaaaatcacttttgtagtagtgcgttgatatgttttaattttgaacagcctttcactactgcaaagagcattttttttcaaatagtcaaaaatgtattttcgcatgcagatccgtggcctgcctgtaactgaacgatcataaaaattcgacattttttttaggctgttaagcacatgcatgcatgtgaaaatcgtttttgacgcgcatgccaaaataaaacactagatcctacaatatataggctccaattcagaaatttacaatacaattctacaatcaatcatcggtgccgaatcagtcgatttagcactgctttccgattcatcaagaagcaggaaactaaccaaaaacttacagccgaggattctcaagggcctcaaggcctgagaaggtgagcgcgcgccatcgttaattgaagctgcacccgcacaaaacaaaacttcagcaatcctcgcagcgcaataattaatagcactggagatctacggtgaatcggcgaggtcgtcgtcaaatttaagtaattattaattattttcctatcatttgatttattgttaaatatgctttcatgtatatatataattttacatatttcataaatttttttaataaaacgaatgatcaaacatgtgcttaaaaagtgtcaaacatttagaaacggagggaatatttacatgtaaacttatagatttgtatttaatgagttttatagttacataaaaggttagatttccacgcatgagcagccacgatttctgcagcctctctctgccataatctcgcttttgtaccggtcccacgcctctcgccgtacgtcccaatttgtacttatcaaatcccagattacattactttgtatacttctctggatcacaaataatcagtactgcacatatttacgcaatatatagtttgaaatatgctaacatatattgtcaacttcttctcaaaaagttattgtttgatataggagctagactagtcgtcgactagctactagctagctagcgatcgacaagcggaaaattgattttacccgagcaacaaaaagaaggaagagaaaagccagccatatatttatatctttcgtattttcttagcagcaaaagcacacgactgtgtgcacgtgcacgtcgtcgtcgttacgcggaggaggctcatctaacttatactatagcttcctctaacttcagttggtgagagatatgtgtcgcttatatgtgaacccataaaaataggttctacctgttagggatctatgtctctgtaatttaaaagtcagatgagttcctttcgcattacgcccaacggtcctttccgaaggagcacaatttgtcaatttgctagagtcagttaaaacccgtacggaaggtcattaataacctacgtttacatatgatgtacgcagctgagaaaaaaaaacaaataattcattcattcggtgctccacagggttattactcttgtaatacgtaatttaatactactcttacatttagaaatggagagtttatgtgtgtgtatatatatacggtgcaaactcgatagcttcgctccagcatcgtcccaggtgatcacttatcaggtctccatggcgctcctggttttgctcgcttactactacgaaaactctttttgcatgcaggcgagaagcatatttgcatacggttgtgcccatcgtatgggtaagaaggtctgcaaaaatcacgtttttcacatgcggccggcgtaaccgtattttcacatgtggtcgcttatactggctacatgcgaaaataaattcagcaataaaaaaaaaaccaaaacaccctcccccaaccctagctgccaccggagcgccgtatccccgccgcccgagccaggcgcacgtcgttgccggcgccagatccatcactcccgccgcccaccgtcgtcaccagccctggatctgttgcccccgccgcccaccgtcgtcgccggcgccggattgacagcccgccgtccacgccggcgcgggatcggctgctccaccacctgttgtcggcgccaacgctggatccgccagccccgccgtttgcgcaagggaggggcgcccttggcaccgaatccgcatgaggcggtgccgcccctgccgccgtggcggtgagggggggagggttgcctcgtcgtcgttgtcggcgttggcagtgagaaggggatggcggtggcgccgctgcccgcgttgccgcccactcgctggatccactgtcccaattgcgcgcccgccgtcgccgtagctgcagccgctccctagggtgacgaatctgaccttcccgagggaggcgccgcctgatccgccgcccttgctcccggctgccggcacccactctcatagagggagagggagaggacaaaataaaaagagagggagaggagaggtgagagagaggggggagagtgatataatagaaggggtgagagtggagatgggttggaaaaaatttgatgtattgggagcgaaaagagggtgtagggagatgaaaaaaattagggttgtatttttgtatgcggacctcttaaggggctgcatgtaaaaatatgagaaatttgaatcgaattttatggtactaaatcaacttatgtgaaaaagttatcaaaaacaaagttgtagaactcattgagatctacctttttcttctggtcatctctccatccaagtttgattgaactatataaaatttaaatattaaaatataagatattcaaataatttttcgggtagtaaatgattttaaatgaacaaattgttaacaacaaagttgtataacttatcaagatctacaacttttgttttgatcattttgctatttgactttgtttcaataatttgaattcgaatttcaaattatgataacttcagacaacattttgaagtactaaacgatttcaactaaaaaagtcgtcaagaacaaagttgtatataactcatcgagatatataacttttattttggtcatttcttcatctgacaaagtgatagtaacattattcataaaatttacacatctcttatatagttttataaaataaaagaaagatatgtaatttttgggaaaatattactatcactttgttggatgaagaaatgaccaaaacaaaagttatagatcatgatgagttatacaactttgctgttgatgaccttttcagctgaagttatttactacttcaaaatattatttaaaattttgaaattcaaatttttaattgacaaaacaaagttacaagaaaaaatggccaaaataatagcagaaagaacacaatgacatgatagagcatgattttggaaacatttagaaaaaatgatcatccaatttggagttcatgagtgagataaactggtttcaattttttaaattttatatgcaggctcttaagtggcccgtatggaaaaatttattttttcatacgggcgtgttaagtagccgtatgcgaaaatgccgctcgatttttttcagacgcggcaagttatgttccgtttgtaaaaattatagggtcttgtatagaaaaatcgtctgtgtagtagtggctgtagtcgtgttagaagcagcggttcgagcggacagccagacacaggtcaccttgatttttctgttctgttgtccctttcactgcaaaactcttactatctaattttacaaggcatgatcttaaaaaaaaatggtctacacatatacacataataaatgagtaaatttcataaaactatagatatttcttttgaaaaaaagataaaatatagatttaaggtggtgttgtatcacgaaactacatacatacatagttttcattgagttcattgtgaaaagtcgctgtatatatggtaaaactatagatcgatcgttaatttaagacaaacctgaagtggagctgttcggtgggacttgttgcagcatcctggctgtgctgttaaggtgatgacttcaaatgtaaatgttaaggttatcaactataaaattataaaattatatatcttacttactgtataattttgatatagagtttgcgtcgatttcaattcatatgaaaattttaaagcatttatcaattagatctgataacttctatcacacatatatatgatcacataaactatgtcaaataaaaaattgttcagcaaccacgttgtagatcttgtcaagaaatataactttggcagaaagtttatctttgatcatcgacttcatataaaaatattattaatttctttatcattttcacttcgatacgcagttaatggtgggctgtcacgcccagaaattcccgaatagaattccaagcagaatgtgcattaaaacccccgtccagtaccggccggggtacacaaacgacaatgttgacatacagatccacgtcttacaaacaatataaaagtcttacataaatgcagcggacaaacgatagataacaggagctaagccttgacttgaactgcagcgggaacaccactccacaggcatcctcgacggcacggacgaagcctactcctcggagaacccgccatcggacacatactcatacgctggggttgggggaaaaataaagcaagactgagtactatccactgtactcagcaagtcataccggaatggggggtatgatgcagggattcaacaagggatagctatacaggttcatttgcataatactggcatttataaacagaagttgaatgcgaaaaacagttgtaatagtttaaccaatattaatcacccactgtccaacgctacaccacgttgcaacaggcccaaccatccacctataccatccaatttcattagactaaactaagatgagtctaatcacggtgaatctggttgaccgcccataaccgcgggcatggctattcgaatagttttactctgatcagaggtgtacaactgtacccacaagacacagccccacgacacgtttccgtgcgccgacatgccaccacgacatatcggaaagagactgtgacaggacccttcgcataaccccctctagccaagtacaccacacctcaggtttcacccccgtccccagcgggcgacgggcagtcccctctcatacctaggtgaatccggaagcgacagaggccgtcgcagggcccaccccgctccatcacgcccacccttgccaggatgcgtcagctagagaaaagctacactacaagcccagccgttgcccacgctggcttgtggtaagtacgaggagttcttccagggtttcccgcgaaccggtccttacttgccatgggtgcgactagcagaactatgcacccacagcccaccatgtgattcattttaattaactaacaccaaagcggtggtactaatccaacattatcatataaacctacagtctatattttaaatgagatttccccattgtgtgctagttgaactaagcatggctaagcaactcctagtccaaaatctattcatgttataacccgagctaacaaaggagcaaggtaccaaaatagtatggctgtaacaataggtaaacatcccatagtgttattgcaaaacaaatgcagtatttgaaggaaaacaatagaacatttgcaatgtaggatcaacatgatcaagtgacaagtatgacttgccttgctctgctgctgaaggaacctcagcgactatttcgaagtacaccggagcgtcggaagagccggaatctaacgacatacaaggcaaacaatgcaaacaggctataagactactgaaacagagaacaaaaccatttttaatggattctacacatttttcttgatttactgcgacttgaatgggcttaaacggagctcggatgaattacatatgaattttagaagattcactgtgtttattactataacagaaagcccttatataatttattgcgccataattcccagggctgacgtcatcagggggggcggcgccgacaggcgggtcccactggtcagtggctcggaagagaggggaagggcgccggcacacggccccactcggcagcggctcaagggggccggtccaccatggaccgggaccacgcgggtggtccaccaccggtccacgggactgacggcccagatcggccccgagccgatcgggcggtggcggcagaagtggccgccgggcttggcttggctccaaagccggccggccggccatggctagcggcggcggcacgcggtcgacggcgacggcgaccggcggcacgggaggcggcggtggcggtcgaaagcgacggcgcgcgatttgaagcggcggcttggcactaggagggagaggaaggggaatagaggagatgaatgcctcaccgcgagtggccggcgctaagggagacgatggctaacggcgacggcgagccacgggaagacggcggcgacgggcggacgagcttcgggatgccctaaggaaggaagagagagagattagagggagggagatgaaccacgcgggccggcatccatggccgaaggcggcggtaggggtagggctcacctgagcgcgaggggatgcgggttccggcgacgaatctcgacggaggagcggcggacgaggtggagttcggcctcgcgaacccgacggcagcgacggcgcggtgcgacggcgaccctagcagcggctagcggcggccggagtagcgggagcggcggcggcgagtggttacacggcgtgggggcgatggagagctcgggagaggccggcggcaaaaggaaaagcgaggaggaggacgcggggatggattttataggggcgggaaggtcgggaacggcctaggtgctcccgatttcgccggcgacgtgggaggtgggaggtggggagagagagagagagagtgggggaattcaaaaaacgaatcccgcccatctcggttgagggcgcgggcgagagagagaggggggtgggcgtggggaagtcggggagcacacgcggcgtggccgaagtggctcagaggaggcggggcggcggtttcggcggcggcggtgacggccggaggttggggaaggacccgacaggtgggccccatctgtcggcgtccccgggagaggagggaggcgggcgggctggctgggcctcggcctgcggccggcccagcgggggagggggagagggagagaatgggtcggcggcccattcgaaaagaaaaggggaaaaagaaaaagaaaaaggaagaaaaggattttccctggaattaaaatattgcttgctcaatttgaattggttaaaattatctctagggctctgaaaattccaataaaaatcttgttagcgaatttcgatatgtagaactccagaaaaattccacatgccagtttcgattattatttgcattactttattagggttttctcttgatttgtaccggcattttcttagggtcatttataaattaaattttaggcttgggaggagaacttcagggtgtgacatgggccagactatgtggtccgttaagcatagtgcctgtttctattatgaatcagcagtgatattttcaatttataccactgtgggttggtattttcaaatcatatcattgttggttcatatcgagaaccgacagtgataattgaagtatcattgctgtttattgttatgaacattagtgttggctcggaataccgtttctatgctataatgaggacatgttagtagaaagaaggaattgtaatggggttgatgaggtgggagaaatcagtaccattgagttgagacctaacatctggagagtgtagaattagaagagtaatagacctataattgggacatattgtatggaggctgccttaagaaattaaacaaagaagttaccacgttagcttctatactaacaggtggagattaaaaattttttatggcatttctctttgggcaataggtttcataagcattgactgcggcctggaggcagacagcagctacctgggcgacctgaccggcctcacttacgtcccagacggcccgtacatcgacggcggcgagaatcagaaggtgaccaccgtataccgcaatcgctggtggggccctgacacacgtactctccacacggtcaggagcttcccatctgccaagggtcagcgcaactgctactcgctgcccacccatatcgggtcgaagtacttggtcaggctggatttcttgtatggcaactacgacggcatggacaacccatcgctaaaattcaaccttacccttggtgtgaaacactgggacaccgtgagtatagacaccaccgacggaaatgatggttataatgttcacgaagcggtgttcgtggcatgggcgagctaggcgccggtttgcctcatcaacatcggccagggcacgccgttcgtgtccacggtggagttgaggcctctcggtatcttgccctacccggctgtcatgggcaatgtgtcactctccctctatgttcggagcaacgtgggatctagccctgacgatgacaatttagtaaggtatatatgttcttaatttccttggatcttgtacattttgcagctcagttagtcagttgtacgttaaccaatatatcacttgaagctattttctgattttattaatttagctaaacaacgcactacaaactgggcattactcgcggttccacattaccagctatgtttgggagacgaccagcagcgatactgatttttacaaaagaaaataaaatgattttaattcatacagacaaaaaaggatcctaaatgcacactgattcaaaaatagattcaatttgaaagtagtcccggtttttggtgtgaaactgtagttgcacttcgtttgaatcattatatatgccattttgatttaataaatccaaatttaaaaaatatgaaaaagtaataatataatatcaactatagatttcttgttggtgtggagtaataattagttttttatgatttaataatttgaagtttaaattaatacatattgtgttgtcctcggaagctcaattgtcatgtttggatgatttaacaattgcagtctgaattagtaaatacctagatggtattgatttttttaagaaaacaaaactatggagctcgtgcgatcactaggccggatccagttatctgtgacgggctctaaccctcacctttgacggatttggttctggtcagagacaagtggtcactgatgactacacctcacttttgacgggtgaaagcccgtcactggtaattaaaacctttgacgggctaaaaaatatagccgtcacaggtgactcacacatgtgacggatgactctttgcaacccgtcaaaggtgacgaaacagctgtgactggttttagttctcacccgtcacagatgtcaaaaatcacccaaaaaaaaaagaaatgcctcagcccaaatgtacgaaatgaagaaaaatcaaatacatctcaagatgcacatgatacaataactttgtattttaaatcaaatacatctcaacaaacaactacacatgaagcaatctgacaatatacatcacacaagtatccatg

SEQ ID NO: 7341 - DNA, 8451 bp, Oryza sativa
ggttaatggctagtattcctagtcaatttgcgtttctattaattggtaatcgtcttatatatcaaatttcacatatacaggtaccctgatgatcagtacgatcggttctggtccacagatgaagcccatcccttgtcgacaaacatttccacccaaactaccatccaacctagcaccgaatttgcggtgccctcgcctgttctccagaaagccattgtgccgagtggcaactccatgaaactagttttcttttccggccaagtagacgtccttcttcgtaaccacttcgtgatcctgcatttcgctgacttccagaacaacaagtcccgggaatttacagtttccatcgacaacggcgtgcatagcagcccatacagtacaccgtacctaaatggtttgtcagtcaccggcagctggtccagcgattctgaaggcaagtataacttcaccattgctgcaactgccatatcagctctgccccccatcctcaacgcttacgaggtctacggtcgtattgtccatgacaatccaacaacgttctcccaagattgtaagctcgctatatctgtcggtctcggttgaggtacactaaacaaacattatcaactctccctcttgaactcctattttttttcctcgtatgctagttgatgcgatcatggctattaaatatgagtatggaataaagaagaactggatgggtgatccttgttttccacatgaatatgtttgggatggtgtgaaatgcagcgatgcaggtgataaaatcatgaggataatatctctgtgagtatatttgaaaggtatgcatgtactagcattattaattgtatacatcaggctaaattttgttggattacttgaaattattatgcagtgatctttccaacagcgaattgcatgggtcgatatccaattctttcacattgtttactgccctcaagtacttgtaagtatatctgagatcccctctgccttcagttgttctgcatttaaaactcccaattgacatgactatgcatcatcttccattaaaaatgaaaaacaccgactaaatattatctagaggggtgaaaatggtacggaaactttccggattctggacctattttaaaaaacggaatctgtcggtcggagtttttttggaatttttcggaaacggaaacgaattcgaaaatattttctcggaaacggaatcggaaatgataaggccagtttccgtcggaactcggaataagtcggaaactttccagaaattttctaactaaaataccctggattcatttttaagcactgaatagtgaataccatggtgtttggctgttattctttaaaatatatttgttatgcaaatctgaagttatataagaatattttttttctgcattgggattaatcaacatcattactctcttaaacatagataatttattccatagattgtgttttgtgatgtactgttgagacttaaaaattggacttatatgattgtgttttatgatgaatcgttgaccgttgagacttgagaattggatttattggtttgaggggttttgtattctcataatttttcgttaccgtattcgcgttggttcgtttttgctccgttttcggtttcgataatattcgattccgttttcatatccggagtttccggttccgattccgattgcgaaaaaaaatgaaaacgaaaacgataatgatggttttcgtccgtttcagtattgttttcacccctaatcaagagtgatgcagctttactttcataaagtggtaaaaatgaactaaaggtatgataactaggggtgagtgcgagtggatattggctgctcttgggctacaagctaccccctgtagtgaaggaatactattcttgagactccagagagggtaccacttagtatctattatttttcattcagaatcactaaatcaattgaaatatataattgagactttaaaccagggacatgaagatcccagttatcatagtacccacctgtaagactgttatcatggttctgaacctataaaagaaatcatatcatatgaaaaacaacctcattaacagtttggccaagtgttactatacgtgtccgaattcgtattaggtttgtgtcacatctcgtactaggtttgtttttttatgggacagagctggtaattctctatgtaccacagtatccaaagctgaacataaaaactcttggtaattttaaagatatctgagtacctgacggtatttaaagtggtttgatacttatacttggaactttacagtgttgttataaaagtctgcagtttgttaacaagccatagacatattgcttaatgccaaaattatatatctctttgtacagaaacttatcatgcaaccaacttaatgggacaattccatactccctcctcaaaaataatggatcaattgatttcaggtttggatatttttattaacgttggtttctttcagtaatctttaggcaaattagcactgaacaacgattcttttgaacccttcaggactgatagttttatgtaatttcagttatgagactgatggaaatatgtgcaaaacacctgttactccatccctgtcaagaaatagagccgttaccttggctgtttccgtagtggccccagtgctggtactggccatacttgttctcacatatttgatatggagagccaaaagaaagctcaatagtacgtatgctctgttataatagtctgtactgaaaataattgactcttatggtttaataactcaatgtaatattgctaatactttttttttttgcactagcttcttcaactgatcttgccatggtaccagaactcaggggtgctcctggacatatcacaaatcattgggaccatttacaagaacctgaaaatcgccgattcacgtatcaggagctagagaagtttactgataacttcaaacatttaattgggcatggaggcttcgggcatgtgtactacggttgtttagaagacagtactgaggttgctatcaagatgcggtctgaattgtcttcgcatgggcttgatcaatttttagctgaggtgacaaattcagttaccactaagttcaccacagacaaagtcaatattgtcactgtcatataacttaatcacagccacagtgagatttcatacacattagtccctcgtgttctttggtgcaagttcccaactttagtccctcgttttccacactcaagtttcccaaactgctaaacgatgtatttttggcataaaacattatagaaaagttgccttaaaatatattaattaatctattttttaaattttttagataatacctaattaatcacacgctaaacctctgctccgttttgtgtgttgtggggaggggttcccaagccccacaatcgaacacagcctaacagacttaaccttcctcttgcttatagtacaggttcagagcttgaccaaggtgcatcacagaaatcttgtttgtttggttgggtactgctgggagaaggaacatttagcacttgtctacgagtatatgtctagaggcaatctttgtgattatctaagaggtttgtccattgcaaacttcaaagtattgaatgttgcgaaatcatagggaggatagttggacacaagtgagcacctacacatagcgtaaactaacttaatgttctacatgctccctatagatgtacgaagcaatttgcagcacaataactactataagtacttaatacacggaatgaccacagttacaagtgagaacttaattatcactttatttagtaatgtgcctatatgtgtttcttaaaaaataaagataccgatttttgtttagtggcggcatattggcaatctctacataagggaactccatggccttcgttaattaaactcactatagatacgacaacaaatttagttgtcatctttaaggaagtatcttgatcttgtatttccaatcatttgtagaagttttgtcgtcattgttttttttagaactgtcatatttgttcattgtttcattctcaacataattgattcacacatcatgtaaatattttaaacataattgcatatggaataattgttttcaattagttggacatgaaaatccatcttgactgatttttaagacatgaatgcatatgtgatgtacaagcttttttataggtgtaatctacatctgtgctttgctagtccctatgatacaaagtgatatctagtatgattcttagagatcaccgcattaactactttttgttgttaaagggacaatactattttgattatttatgttattgctccccctgccgatgtgtgcacacacacaagagacgagtgttttacaactcccttaattgctatttgaagttgctcgtagaattcctttctaactgtttgtctgtgaatatattaaaagggaaaattggtatgggagaaaatttgaattggaagacacgcgtaagagttgcacttgaagctgcacaaggtattctataatagcaaggcaaaaaaaacaaagcaaaagtgttatggctcatcttttcttctaactatagtttccttatttgtaggcctggattatctccataagggttgcaacttgccaataattcatggggatatgaagacgaacaacattctgttgggtcaaaattttaaagcaaaaatagcagattttggaactcatatttcagccgttgcagctggatctatgggttatattgactctgagtatgaatctcttctacacactataatcacttatgcaatctctacatatattaacacgggtcaattttaggtactacaccactggtaggctcaccgagagcagcgacgtttacagcttcggcattgttttactagagataacaactggcgagcctcctataatacctgaaaaaggtcacattgttcaacgtgtgaagaaaaagattgtcagtggtaacattagctcagttgcagacgcacatcttggaggtgcctacaatgttagctccatgtggaaagttgttaacatcgccatgatgtgcacaacagatatagctactcaaaggccaaagatggctgacgtggttgttcagctgaaggaaagcctagacttggtggaagttcaaggggacagaggagacaaggaaaacctagcaagtgataccatgtcttcgatgtcgacatttggtccatcggcaagatgattaaataatacatacctagccttggctttcactacattgatggatccctgtgacaagtctataacgatatatacaatgtgcatgcacagcctgtttgttttgttaatgtcaataattgagacagccagtataaaacatagatgtcatggaaggatcatgataggtgtgtatatggcccataatgtatagtttgcatctatctatgtgtgtcaactattactcacattagctccaatattcttctgatactacaactccaattaatccttagcaaagattgtttgcacatttccttattgcttcttatgtcctatttcacataatctatcattagtacttgtatgctccagcactagtacagatctagacatttgtgatgagcgttcgtgctgagctaaggtgactcgtttgtgctgcatattcatatattttagtgattctatacaatattatccttaatcacttggcgctatcattatgtttatcaatatgggctattttttggcactacatcaccgataggcttactgacagcagtgacgttgacagcttcggtgttgttttactagaggtaactatcggtgaacttcccataatacctggaaatggccacatcattcagcacatgatgcagattgtcactggtaacatcacctcagttgccgatgaacgtctaggaggttcctatattttcaactccatgtggaaggttctagatgccatgatgatgtgcataacagatattgcttctcaaaggctaatgatgtccgccgtggtcttgcaattgaaggaaaaccatgaattggaggaagctcatggggatgggttacttggaaaatgtagtaagagataacacatcttcgatgtccatgtttagtccattggtaagatgaaaaaaaccattgatagctcgctttggaacatactgatggctctcttcttcaagtctaaaataaaacaactgatttctctctagacgatttcttctgtgttaagacacaatgatttatatacagtttgtcttcataaacaatgccggtaggatccttaataggtgtgggtattgcaaagcaatagtttgcttcagtgtaacagtaagctgtttgtgagctttctaactatagggtatcattgctcaaataatatgtaacaaagatatcgaaaatgtttacatgtttcgttatcatatccttttctgtgttgatttttacatactcattatgtattttttaaataatagtactgattatggtaattaatgctgattacgggggtggggattgcgcagcgcgagttgagcagctggcgcttgcgcgcccactaggaagccccaggtgaagagtgatcgctgccgcggcttttggcactaggctttggctgatgcaggccatggacaccatagtcaagcacaaacttttgtccacatgtccgaccgaagcttagatggaaaagcatttcagggagatgcaggggaagcattgcttggactgcatcacaacggcaagctcctgctgatgttggacgagcccaccggagtcttgcttcttttggcatacgcctcatcgccgtctcacggcagtccaagattctgctcccaccgctgcgactgccgaccaaatatgtgggagcgtttggggtgccacgaaaaaaaatatgtggagtaatgccacgagacatgcaccgtaggtggtcaccccatcaacctaggaggctatgagggaggtttgcccccaagtgtcatcttgccttgtagcacgcaaaaagaattgaataacaattcagtaacagaagcgattataaaacaaaataagttatgatgcaagctatatatctgatatatgccagcttcctttgtacgtcaacactagggttccattgctcccatgtccgcctaaccgtgtcgtccaaaacccttcaacgccgtcgtcggtggctctactttgttgcctgcgtcgaagacttagctgttcccggagtcagcgtcaacggcgccaccaaccttcgcggtggctcggactctctaggcggcgacgcttctcctgctggtggctatggctcagctgctcccggacccagcgactcgatgtcgggttctggaggcaacaacagtcgccatttgcaaggtttgtccctcggatttgcttgcctccatcctccgttcttcttgattgtctcaatctgcctcatgccctcatcacctctcttggatctgtcattttgtacctgtcttgtttgtcatgcttggaaatttactagtaattttaaactaatctatgcattctattctcgttcaggtccaatataatactcacaaggaaacaatatgggaaagacgatctagcgatgtcttcaacttcacttccacaggtagctcaactagattataaaccaaaggtcttctccttcagagtacttctccaactgtggtttgatgattaaaggtgagcatatgaaatactccgcaagccacataacaaatatgcagatgcacaggataacaaagaatggcatgatagggattgtttccaaatgtaacatatagtacacgtttaagagtagtaaaacagtagattaattaaataacaatgttgattaacactatacaacatacaaggcccaaaccatctccgaactatcaaactcggctgaagagatataaactccataacaagagctaacaaattatcatcaccaatttagtcactaatgagtagtgtgggactactcacgaaaagcatttgctaggcttgcccataactttgggcatgactattcgaatagttttactctagctagaggtgtagcaatgtacccacaagatatgtttccacacatgttgccatgccccgagataataccatggtactataatggaaaattcgagacaagacctttcacataatgcaagtgggagcagttaaccattgccggactgtcatctatccataacccatacaagactccccatcgagtcccatgggcttatgtctgtcactttttagtctggtacctcacaatgaatcatgctataaaaataggccagtcatcactcatgctggcttgtggttagtacgataaatgcttcacactagtagcttgcgggtcggttcttaattatcatttgtacaaccaacacaactatgagctcacaacgcatcattaatcaagttttaatatgaatattaattaactaaacacgactaaccatcatgagctatcattaattaaccatcattaatcataagtgatt

SEQ ID NO: 7342 - DNA, 10547 bp, Oryza sativa
taatatgaatattaattaactaaacacgactaaccatcatgagctatcattaattaaccatcattaatcataagtgattcattagttattcatgcataaaatgatactaatgtttctaagcatgactaagcaattatacaaagcatctagttgaaccaataaaaaatgtccaagctggttaaaaagaataaggtaatcaatacaaactagtcagcaccccacgcgttgctgcgggcaaaaaggagatctaaatttgattcatattcaagtatttcaaattgtcatatggcaaggtctatttgaattttgtaaattgagaaagaaaaacttgacaccaaatatcaagtatggcacatgaaaattcgtaagcaaacagtaatgtttcatgaaacctgaaggtatgctagttcttcaattatacacttaaccaacattagaattgatgtttctcaaatgctataccacaaagaaagattgaagcaagagtatgtccaccaatgagatattcacctacttaaaaccatagcccatatagctgcatatatgcgattgagtttgaaataatgaaacagcaactgcttttccttccattactgtcaggtcgacaggtagctcaaaaaaaggcaataacatggctaatgaatggtagtattttctgagaaggattggttccaatggaatcggtacaaatattattatgcaaaggattgttttctggaagtaaagaaactggtcaggacacatgcatgtaaatagacgcatcaagacacaatacttcttagaagtgttcgttgagggcaacacacaactcgacacaattaataggcgagaaaataatccaccaaaacagaactattagttctagaaaaagggcccaaacctgtataaagctctgtctttcaattgatctatctagcattaggtcaggtaactagcccccatcattgtcatggatagaaaacatagataagtccccatccaccatgtttcggtctaaaacttctccgctaataactagttgagccctcgcctcttcttcttgttcatccagcttaaagcgccatcgtctttgacatgaacagaagacaatcgcacagagacggagaagagctcctctcgcggttcttcgcttctccgttatcgtaccaagtgctgccggctgggcagaccataaaccttgccaaacagatttgccatgctgccctgtgcttcgcatcaaagacattaaacagggagccttagcttgaagtaagagcaaaatatatgaacacacgcaagaccattaatcgataatgttaagctctgatactattatagagtagggcgatgcatctttattggatcattatttttggtactgagatttttttctactctttaatttggtgccagtgtacagtagaataatcttgtaccatgaaaattaaaatgaattcctagcagattaactgctacacaaaaaggtacgttggtaactgataacactaagttccatatcatcctatatatcggatgatcgaacaattcaatggactgtttatgctgacagtctcaaactaaatatgattacataaatggttcattgatgactctgagattctagtattggtttcattggagaaggggatcggtccgatcgattggataaatagagatcacgctctgttctcttccgaaactgaactaagatccatgatccaagcatccaatgtgctctatgtaccagatattctgatacttggtttggccagtttagggtgttgaatcattagtaaatcaatcaacagtggtatgcaactttaagctagatattctgatacttggtttggccagtttagggtgttggaatcattggtaaatcaatcaacaatggtatgcaacttaacctagaaatagaaatactccctccgttttttaatatatgaggccgttaattttttttaaacacgtttaactattcatcttattctctttgctgaaatagaaatactccctccaactccgcctccttgggagggcttggcctgagggatagagatgacatatgggcccagataattttttattattctctttgctggcgtcacatgtgctagatcaagtcaaagccgctaaaaatagtacttggggggggtatttgtccggtacaaatagttgagggtacaaaacgtgtgttatttgagtttaaggggataattcggtcgactgcgatagttcaatagctttcgtactttttccttttattgtcacttgatttatcgtcaaatgttttttaagcataacttaaaattttatatatttgcaaaataaaatttaaataggacgaatgatgaaacatttataaaaaaatcaatggcgtcatatattaaaaaacagaggtagtactctataaccaaaacttgtacctcgcttgctttaattgataaccggctgcctgtagttagtaggaacgtatgcagagaagagaaagtcaagatagcagctcaggagtactctgaataaaacccgctcttcgcattggtaccgtctctattattgagataaaaatacaagtgatgtagatagccacattcttaaatgtagttactttgttttctttcatcgaccatctatagtatttctctccctgtaaacacaggtggaactgggtacccgtgacattgcatatctacactcctttataattctttataagtagagaaaatgtcaccccacctacttctgttttaattttacaacttactcccttacacattttaatattaaaaacaattaaatctaaatgaatagttatagaatcaaattagggtcgtattccatatgatgaaaagattggaacccatttcatagaaaaaatatttatagctattttagataactaggaaggtagcccgcgcacatgcatgggcatgtacgtaaaattttattacgaatgtccatgtgtggatggttttctatcaaaaatattctttcactttatcatacactaaaattgaacttacttaacatgctttgaacgctggttacttgcaacatataaattctgaaattaaattactttaaaccgtgttgtttctaattcatgagaaaattttgtgttgaaacaatagatgtgtttcctatgaatgtccaatttttttgttaattctgtttgaaattttaaatatattcattttattagtcctgctaaaatatttgaatatttgtatttagaatgggttataaacccaacaaaaacaaattttaaattagacaaatttcattcaattttcatttctttttatcttcattttttggataaacccactttaagaagcatcttttaaatgctttgatgtctgtaagccaggatgaaaatataagtgggttggtcctacaacctggcatggggtaaaggcatcaattataaattatctcgctccaattaagtaagaaaaattaaaatagatgtggtagtatttgctttgcaaattaccactaaactagagcatcatgtaataattatatgtttctagattggtctatgttatgtgtcacaaattcacgatgtactgtagcaagttttacaaaaaaaaaatggatatagtcttttaattcatatctgtaattggcttatatattgctgaggccacatcatgcttgtttcatacttaagatccttggtgcaaccaacacgctcagtacaatcaatcagtatgctgttcaactagccacgtgacttcatatattatatatataatttagatgctatgatcatcttgagattattgtttatctcctaaaatgatcatttattgataaaagcttcaatatcaaaatgtatggttaaatagctcctatatacaagctgagaaaaagttgatagaaagtcgttagatgtctaacggggtataagtaatgggtctaccagttttataaaagataagctgggatattttgatttttggtgagaaattttagtattttcttttatttaggttaaaatttgctaagcgacatctaaaaaacgtgtaattggccggggacacagcaagaacgtgtatttgttgtaggacaccgaaaaaactggtaattagctactggaggcctgcgagattattttataatatccaaaggaaatgcagagacaaacaataacaaaagtatgactttcccctgcctaccatggctccccggcatgcaaaacaaagctcgttttattacataattaactaagtatcaactattttttttttgaaaaatggattaataagattttttaaaacaactttcatgtagaaagttttttcataaatcacacagtttagcagtttgaaaagcgtgtgcgcagaaaacgagagagctgggttgggaaaatgggtggaagaacacagcccaagtccggctcgcatacacctttgacgctgcaaccgcagctgccgccgatgaggtagccctctaggggggaagggggggttcaaggagggcccatgcgcttaggccctgtggctccatgtcgttcccgcactcttcgccacagcagcgcaagggccatgctggcgccgagccgccgatgctccgccacacaccgcgcttggggtgagcgcaacacggactacctcctgattcatttcgagcagggcaccgcagaacacaggctattgttgtcggtctctgtaacatgccaggtattctcatacctagaatgctacacactatggtatagaaaccactaagtcctaaattcattaagaatttcgatagtttcccttgtaaatacggacttccacaacaggcaattatggggtaaactaataataatatcattcccacagtgcgatccatccttataatccatgaaaagaaactaaaatacatctaaaagattattacaagaccgaaccatgatatagtttaagtgtcattatggacctaggcaatatagattgatagtgtgcagataaaggtgtatatatgggtgctacttccagcccaagcatgtcggtctcaatgcgcacctaaaaccaaataaaacataaaagtatcaaaatactcagcaagtacaatatggaactagaaagtacatatacacataattggcaatagagcatgaacagaaagcttcctttctttgataggaaacacatttttaaacaccaagtcagagaaaaatagtagttcccattccgggcagatatgaattgaaatagtagttttcatcctggacaattgtgaatgcatcatagcatttgccggcaaagccgagtaagcgtgatcagcgcttacccataggaacatgaatagaaaatcagatagcacatccatgactcgcatggaacttgaataattgaaaccggaaacgaaaaactagattgaaaccatattgcacatccataacaagcatggaacttaaatttattttaccagaaccagaatccagaatagtgaaacaagaacaacgtcgtaaacataagataaatttgaaatctaaatagcatgaacaatagtttgaacataagcagtcacatatcaaatagaaatataacggaaatagatagatagaacaaacaatctatgaatcacacaattagttcgtcatgcacttgcctacaatgaagggttggtatcatgcacgatctgaaagaccaccacctaatcacaaacaaaacatcatcaaacacattcaaatatgactataataaattaagtggtacactgctacggcccaatcccaacctcaaaccaaacagttaacacctcacccatctaaaaacaacattgttacttcactattaattaagtttaacacagcaaatcaaaattgactgattagatttctctattttattagggtgccacgtggcgagttgagagtatttatatggtgccttgtgacgatttgagagtgttcgtacgatgtttaatggatttttagtatataatagatcgatagatagatagatagatagtatgttcatttggtttttctttttatcttatacggtagaaaattatattttatatttttctcccgattatactacttcgtatgttccttttttttttgactttatcacacaagcattttttttcttccggtgaacggaacctaagctttactcttattttccgaatcatatgtattgaacttatgattttttttgtttatgccgacggtacgtattttcccttttatacagggaaggtattatttatatacctaatgattctaaagtaatgggttcaccaatttaaataaaaatcaactatagagatctaatctaatggtctaaaataacaggtactaattaaatgaaaattgacggtgagattagatagtgctacgtggcgacataagagtgtttatagagtgccacgtggtggcttaagaacgtttttaggaagtttaacagacttttactatataatagatagatattataatatattttctttcatctcagtaaagcacgaacattcagcttgtacggcatcaaagtaatgagaatagtttccaaaacaacatagctgttttgttaaaactattacacgtaattaaaactattacacgtaatttctttcatgaaatagagtaaaaatacctatgatcacatatacatatgcatactcgcatatgaacgcacacatacgcaccatacttatataaacggcctgtaagagactaggccgcatatgagatataaataggagcacatatgtgatgaacattttaccctacctactcagtggatatatatgttccaccataaagagacataactagctaacctatgctcacactataacgaaatcattctgcagaagtatttttatagaggtgaattttaaattatctctaaaattaggtgaatttaaattgtctttaatttttctacaaaaaataaaatgtatctatctaatatttatccacatataagtgttgtagaaatgttagacacgtttgttttggattaacatgtagtgaaaataatgtgagaaatgataatttagtattcttatatgttaagggttatttcagagaagggtacgtaatttttacccggtctctatatatatatccaacgacgggatatacacagccttttaaattgggaactaaacctctcaaacaatccaatctaaaattcgctcatataaaaatttgacttagaaccttgaggtgctattaaagtctatatgcccttttacttacttgctccgtttcacaatgtaagtcatttcagcatttcccacattcatattgatgttaatgaatctagacatatatatctatctagattcattaacatcaatataaatatatgtctagattcattaacatcaatatgaatgtgggaaatgctgaaatgacttacattgtgaaacggagggagtatatgttaaggtttagaacattatagcatgcatgcatgctagttttagtttcttagtcgattgatgtggtatgtttagatgttagcttttagatatataattaatgagttttaattacaaaaaaggtactcgctccgtactcataaaggaagtcgtttaggataatatttaagtcaaaccttgggaatataaatcatgaataactttaaagttgttgagtttgaaaatgtaaaaattatatgaatagatttgtcaaagttgtgttttagagaccgtatcgttgtccaaaataacttcctttgtgagtacgaagggagtatagatttccacatacatgagcagccatgatttctccagcctctctttgccacctactcctatatagctcttgcatcggtcccgcgcctctagccgtccccatttgtacttatcaaatcttagtttatattgctctgtatacttctttggataataaataatcactactgtacatatttgcgcaacataatatatagtttgaaaatatgctaacacatattgtcaacttgttctgaaaaagttattgtttgatataggagccagactagtcgtcgactagtgaaaaactgatttatctctttcgtattttctcgtcagcaacattacaggactgtgtgtgcatgtgcacgtcgtcgttaaagttacgcccaacagtaatatgatagtcctttccgaagaaggagcacaatttgtcaaattgctagtgtcagtcaaaaccggtacggaaggtcattaatttgtcaacagtaaattaaataattcagtcgttcggtgctcccctggattactcttgtaatacgtgatttaatactcgctcagtcgagaatgttgtcaaagattaataaaaaaatctgttacatttagaaaaacggagagtttatgtgtgtgcctgtgtgtgtatatatacggtccaaactccaaactcgatagcttcgctccagcatcgtcccaggttatcactcatcaggtctccatggctctcctggttttggtcgctgtactggtgtttgaagcagcggttcgagccgacggccagacaggtcagcttattttttctattctgttgtcccttccactacaaaatactcttactatctaattttgcaaggcctggttttatcaagcatgatcttaaaaaagtgttctatgcttatacacataaatgagtaaatttcataaaagtatagatattattttatagatatttctttttgaaaaaaatataaaacacagatttaaggtggtgatgtatcacgacgtacatacatatttaacattgagttcattgtgaaaagtcactgtatatatggtaaaactataggtcgagcgttaatttgaacacaaaactgcagcttcctggctgtgctgttaacgtgatgacttcaaatgtaaacgttaaggtcatcaactataaaattacaaaactatagatcttagatgtacaattttgatatagtgtttgtgtctacttcaattcatttgaaaattttaaagcatttatcaattagatcagataatttctaacacatatatgaccatataaactatgtcaaataataaattgttcagcaaccatgttgtagatcttgtcaagaaatataactttggcataaagtttatattcatcgacttcatataaaaatattattaatttcttaataatttcacttcgatgctcagttaatggtgggccgaactatatatgtggtccattaagcatagtgtcagattctattatgaatcagcagtgatattttcaattcataccactgttaattggttggtattttcaaatcatatcattgttagttcatatcgagaaccgacagtgatagttgaagtatcattgctgtttattgttatgaaacggcaatgatacattagtgttggctaggaaggcggtttttacactttagtgaggacgtgttagtagaaaaatgaagtatagcggcgttgatgaggtgggagaaatcagtaccattgagttgagacctaacatctggagaatgtagaattagaagagtattagacctatatttgtaacattttgtacagaggctgccttaataaattgaacaaaagaacttaaacaaagaagttaccccaatggcccattaggttctatactaacaggtggagattaaaacttttctatgccatttctctttggtgcacacaataggtttcctaagtatcgactgcggcctggaggcagatgacagctacccagacgatctcaccggcatcacttacgtcccagatggccattacaccgacgccggcgagaatcacaaggtgaccaccgtataccgcaatgcttggtggggccctgaccgtactctctacacggtcaggagcttcccatctgccgagggtcagcgcaactgctactcgctacccaacgacgtccggtccaagtacttggtcaggctgaagttcttgtatggcaactacgacggcttggacagctcgtcgctaaaattcaaccttacccttggtgtcaaacactgggacaccgtgagtatagacaccaccgacggaaatgatggttataatgttcacgaagcggtgttcgtggcatgggcgagctgggcgccggtttgcctcatcaacatcggccaaggcacgccgttcatgtccatggtggagttgaggcctctcggtatcttgccctacccggctgtcatgggcaatgtgtcactctccctctatgttcggagcaacgtgggatcgagccctgatgatgacaaattagtaaggtatatatgttctgaatttccttggatcttgtacatcttgcagctcagctagccagttatacgtgaaccaatatatcacttgaagctgttttctgattttattaatttagctaaacaacgcactacaaactggggattactgccggttccacacattaattaccagctatatatgtttgggagacgaccagcagcgatactgaattttacaaaagaaaataaaatgattttaattcgtacagacaaaaaaaaaacaaatgcacactgattcaaaaatagattcaacatgaaattaaagtatcagtcccgttttttcgtgtgaaactgtagttgcacttcgtttgaatcattacatatgtcatcttgatttaataa

SEQ ID NO: 7343 - DNA, 10756 bp, Oryza sativa
  unsure (1)..(10756): unsure at all n locations
catgccacatctttacccactagcaattactattctagcctattagaatctcatacaagcatgacacatcatctacaatattatattatagagatcaacaagtatgtgtcaaatcatcttcctcacattattttcttaacatttcaactttcatcatttcgacaatatttaacatatactaatccatgaatcccgcagcaaagcgcggggaatcacctagtatcgcgatgcattggttaatggctagtattcctagtcaatttgcttttctattaaccggtaatcgtcttatattccaaatttcacacgtaatacaggtaccctgatgatcagtacgatcggttctggtccacagatgaagcccatcccttgtcgacaaacatttccacccaaactaccatccaagctagcaccgaatttgcggtgccctcgcctgttctccagaaagccattgtgccgagtggcaactccatgaaactagttttcttttccgaccaagtagacgtccttcttcataaccacttcgtgatcctgcatttcgctgacttccagaacaacaagtcccgggaatttacagtttccatagacaatggtgtgcagagcagcccatacagcacaccgtacctaaaaggtttgtctgtcaccggcggctggtccagcaattctgaaggaaagtataacttcaccattgctgcaactgccacatcagctctgcccccgatccttaatgcttatgaggtctacggtcgcatcatccatgataatccaacaacgttctcccaggattgtaagctagctgtatctattggtctttagcgaggtacactaaacaattaaacattatcaactctccctcttgaactcctattttttcctcgtatatatgctagttgatgcgatcatggctataaaatatgagtatggaataaagaagaactggatgggtgatccatgttttccacctgaatttgtttgggatggtgtgaaatgcagcgatgcaggtgataaaatcatgaggataatatctctgtgagtatagtatggaagatctaaatgtactagcattattaattgtatacatttgctaaattttgttggattatttgaaattattatgcagtgatctctccaacagcaaattgaatgggtcgatatctaattttttcacattgtttactgccctcaagtacttgtaagtatatctgagtgccctctgcctttggttgttctgcatttaaaactgccaatcgacaggactaggcatcatattacattaaaaatgaaaaacacggactaaatattatcgaaagtgatcgcagctttacttttgtaaagtggtaaaaatgaactaaaggtatgataactagtggtgagggctagtggaggtattttgcgtgtaaattagacattcgctggctcgctgctcttgggctacaagctaccccccttagtgaaggaacatggaattaaatttgaaaatataccactcatatgttctttcttagaaatattaggaattcaaattgtttggcacaaatatactatcgatatcacctaaccattgtgcgagaatgacgtggaccatctcgcatggccaaatagcgacaccgtattgaaaattgattaactgtcatgattaccgattaattaataataattagtgattaatccacctaattagcagttaattaattattgattaaccactaagcaagataattaatcactaattaagccatttgaaatgacatgatattcggtcttgctgttaggttatgccagaccactcggtctcgcgcctgcgccgcgcgagagcgaggagtctcgcgcatcactgtgtgacaccgccgaagtcgtcacgtccactgtatatgttgagcgataccagcggtatatttgtaccaaaaaatttgaatcctgaatatttctgagaaaaaacaagtgaacagtatattttcaaatttaattcaaggaacatgttgttttggcattcaacaaaactctatgcttgagactccagagagggtaccacttagtatttattatttttcatttagaatcattaaatcaattaaagtatataattgagacttcaaaccaagtacatgcagatctcagacatagatatgatagatggacacatataattttaattaaaatgatttttttttacttttctcactagtgtgggtatttctagcttttatttctcaattaatttgggggttttcaggagtgccactaattagtatatataaatatatgtgtctgtagatagttttttttttcgagatcgttgattaggtcaatgtggtgttgcaaatcatgcggcttcatgatactcagaggagtgtgttacattgtactgggccattttaacttttaccaccaaattatgatatataaaattaccactaagccaataataatacatttgacaattatttcagtatatcatactccatggtgaaagtttagctttcaaagatatacatttctaaataataatagaaatgttttacagccctggcctctcacagttacacagtcaacaagttctgtccttagggaaaaaggttggtatagagtgataatacaaagcccaagttctcaaataagtaatagctgactaagaaaaaaaatcatgaaaactaactagtactcatctgtaagactgttatcatagttttttttttaggtcattcattaggtcaatgtgatgttgcaaatcatgcggcttcatgatactcagaggagtgtgctatattgtactgggtcattttaacttttaccagcaaattatgatatatcaaattactactaagccaataataatacgtttgacaattattgaaatataacatactccgtggtgaaagtttagctctcgaagatatccaagtcctcaaataaggtaagagctgactaagaaatatcgcaaagactaactagtatccacctgtaagactgttatcatagttcttctgaacctataaaagaaatagtatcatttgaaaaacaacaacatcaatagtttggccacgtggtacttgtcttgtccaaattcgtgatactagaatgtgtcaaatatcgcaatttgttttttatgggacaaagctagtaattctatatgtactaccatatccaaagctgaacataaagactcttgatactttttaaagatatctgagtatctgacggtaattaaagtggtttgatactttatacttggaactttacagtgttgttatcaaagtttgcagattgtcaacaagccatagacttattgcttaatccgtaaattgtatatcactttgtacagaaacttatcatgcaatcaacttaatgggacaattccagattccctcctcaaaaacaacggatcaattgatttcaggtttggatatttttattaacgttgatttctttcagtaatctttaggcaatttaacacttaactacgattcttttgaacccttccggctgatagttttatgaaatttcagttatgagtctgatggaaatatgtgcaaaacacatgctactccatccctgtcaagaaataccttagctgtttcagtagtggccccagtgctggtactggccatacttgttctggcatatttgatctggagagccaaaagaaagctcaatagtacgtatgctctgttaaaatatatagtttgtactgaaaataattgactcttatagtttaatgacacaatgtaatattgctaatacttttctttttgcactagcttcttcaactgatcttgccatggtaccagaactcatgggtgctcctggacatatcacaaatcattgggaccatctacaaaaacctgaaaatcgccgattcacatatcaggagctagagaagtttactgagaacttcaaacatttaattgggcatggaggcttcgggcatgtgtactacggttgtttagaagacagtactgaggttgctgtgaagatgcggtctaaattatcttcgcatgggcttaatgagtttttagctgaggtaacaaattcagttaccactaagttcactactgacaaaatcaatattttcactgcatataacttaatcacagccacagtgagatttcatacacattaaggctgtgttctttggtgaatgttcccaactttagtccgtcgtttttcacatggaagtttcccaaactgacaaatgacgtattttttacataaaaaaatatagaaaagttgccttaagaattatattaattaatccctttccaagttttttagctaatgcttaattaatcacgcgatgtacctccgctcattttgcgtgttgtgggggagggattcccaagccccactatcgaacacagcctaagagacttatccttcctcttgcttataatacaggttcagagcttgaccaaggtgcatcacagaaatcttgtttgtttggttggatactgctgggagaaggaacatttggcacttgtctatgagtacatgtctagaggcaatctttgtgattatctaagaggtttgtccattgcgaacttcaatgtattgaatgttgcgaaatcatagggaggatacctggacacaagtgagcacctacacatagcgtaaactaacttaatattctacatgttccgtctagacggacaaagcagttcacgttgaatagttgtttgcagcacaataactactataagtacttattgtccggagagaccattgttacaagcgagaatttaactatcactttatttagtaatgtacctatattgtgtttatttaaaaataaagagactcatgttatttgtttggtggcggcatatggtgatctctacataaggatctccatggcctttggttaattaaactcattatagataccacgacaaatttatttgtcatctttaaggaagtatcttgatcttctatttccaaacatttgtagaagttttgccgtaattgttcgttgtttcattctcaacataattgattgacgcagcatgtgatatttgattctcttaatttcatatggaataattgtttcaattagttgtacctgaaaatccagcttgactaatttttaagacatgaatgcctatgtgatgtacaaacttttataggtgtaatccacatatgtgctttgctagctagtccctaaagtacagagtgatatctagtataattcttagagatcaccgcatttactcctttttgttattaaagggacagtactatttttattatttatgttattgctcccactgccgacgtgtggtcacacactacacacacacagcagatgaatgttgtataactcccttaattgctatttgaagatgctcgtagaattctttcctaattgtttgtcttgaatatattaaaagggaaaactggtatgggtgaaattttgaattggaagacacgtgtaagagttgcacttgaagctgcacaaggtattttataatggcaatgcaaacaaaatttagcaaaagtgttatggctcatcttttcttctaactatagtttccttatatgtaggcctggattatctacataagggttgcaacctaccaataattcatggggatgtgaagacgaacaacattttattgggtcaaaattttaaagcaaagatagcagattttggactatcgaaaacatatcatagtgactcccagactcatatatcagccgctgcagctggatctatgggttatattgaccctgagtacgagtctcgatctacacactattacatttgtactactacattcatatattagattgatttcatgcaattttcaccttaatcacttatgcaatctttacatatattaacacgggtcacttttaggtactacaccactggtaggctcaccgagagcagtgatgtttacagcttcggcgttgttttactagagataacaactggcgagcctcctataatacctgaaaatggtcacattgttcaacgtgtgaagcaaaagattgtcagcggtaacattagctcagttgcagacgcacatcttggaggtgcctacaatgttagctccatgtggaaggttgttaacatcgccatgatgtgcacaacagatatagctactcaaaggccaaagatgggtgacgtggttgtgcagctgaaggaaagcctagacttggtggaagttcatggggacaggggagacatggaaaacctagcaagtgacaccatgtcttcgatgtcgacatttggtccatcggcaagatgattaaatactacatacctagccttggctttcactacattgatggatccctgtgacaagtctatacgatacgatgtgcatgcacagactatttgttttgttaatgtcaataattgatacagccggtataaaacatagatgtcatggtaggatcatgataggtgtgtatatggcccataatataaagtttgcgtctacatatgtgtgtgaacttttacttacattagcttcgatattcttctggtactacaactcccattaatccatagcaaagattgcttgctcatttccttattgcttcgtatatcctatttcacataatctatcattagtacttttgtgctcccacactagtacagatctagacatttgtgatgagccgttcgtgttgagctaaggtgactcgtttgtgctgcatattcatatattttagtgattctctacaaatttatccttaatcacttggcgcaatcattatgtttatcaatgtgggccatttttagcaactacgtcactgatagacttactgacagcagtgacgtcgacagcttcggtgttgttttactagaggtaactattggtgaacctcccataatacctggaaattgccacattattcagcgtgtgatgcagatggtcactggtaacatcagttgcagatgaacgtcttggatgttcctatattgtcaactccttgtggaaggttccagatgctgtgatgatatttcttcccaaaggccaacaatgtccggtagtcatgcaattgaaggaaagcctggaacaagaggaagctcattgggacacgtcttcaatgtccatgtttggtccatcggcaagatgaagaaaccattgatacctggcttcgggacataatgatggttctctgctttaagtctaaaataaaacaactgatttgcatagacgattagttctgtgttaagacacaatgatttatacagtttgtattcataaaccgagtcgataggatcctttatcggtgtgggtattgcaatgcaatagtttgcttcggtgtaacagtaagctgtttgtgagcttcctaactctcaggtatcattgctcaaataatatgtaacaaagatattgaacatgtttacacatttcattatcattccctttttgtgttaatttttacgtactcattagtatttgcgcacttcaaatgctgtgtcaaaataaagaaaatttgaaaacttcagttctttgggtaatttgcccccccccccataaatttctttactttcaaaaatccaaaattatactctttaaattttggttgtaattatacctcctattttgaatttagtaaaatcctgacctagctacatctctgtaattcagactcagcttcctattaatttttctcatctagggtgaatcaagataatttggtcatactgagaaaaaaaaactagcaaaagtggtatggggtatcatgaaatattcggagcatttcaagtgtagagtaatgaagagcggacacttcatataaaagggttagccaggcgtactatatatggttggagccctcatcttcactttgttaaaagcgttaaccctcatccacctaaacttttaaggtggcactaaaccaccactatagccacatggacctcaactgcacaaatacaggctgctaatgggctagggtgtttcattttctctattagtccattttttgtatgatttttttaatattatatacttgtgcagctttgaactcaaagctcaaactaacatccatgacgatcttcaaacttgtctcatttgcaggtaaattccccagtgatgctgttgagagttctgatataagtccatgagtgtaggtcagccaaatgctgagaaggtgcttgtttacaaggcagcagctcatgacagagtagagcaggatgaggacgtactcgaccttgaaacatgaacaaaatatctcattattcccctttcttcttttttgggggtggatgagatggacatgtatgctagattgctagttctccaatgtgtagaacctagctagatgtccttactctcactggtccaatgaagcagtcatgaaacctacaaatctaaagacgtgtttcgtggattttggttaggcagagttgcgcttaacgcaatgcaaagtgaagataagaaaatcttcactttggcggatttctccctaattctaataatgtgaaaataggggatctcatacagagtgcagtgcaaaggcatttctaatcatgtgacataggagagcaaaccgagtagaatgcaaatgcataggatgcaggaattaatctagtaactttgcagtaccaaaatgaggtccagaagacaccttatttttcttccacacaaaagaaaactaatccaccatcacagtgcatgcatacacaagcatacatcactgttccattacatgaaaaaatatagtttatcaaagccagctgcagcttcatcttgctgatggaccaaacctggacgtagaaaatgtgttatcactgactgtgcttgtgcttcccatgaagccactgtcttcacgagattcctctaatgccaggctctcctttagttgggcaaccacagtggccattgttggcctttgagcaacaacatcaacagtgcactgcaatgcagtgtccaccaccttccacatggagctgatgtcatatgcaccatcgagccgtgcatcggcaatcaaactgatgtcaccagcaacaatcttatttttcacacgctggacgatgtggccttgacccgatattatgggtggctcaccggtggctatctctagtaaaacaatgccaaagctatacacatcactactctccgtgaacctgccggtttggtagtacctaaaaaatacattatgtcaggaaatatgaatattgcattgtatttcagaggaacctaaatggtgcattaattacgtggatataaggtaaaggccatgagcccaaaaccatgtattttttagtttggatctcccaacttgtctagataaggcattagatgaaaatattgttaagaaatgaaaaaaaattgacacaaatatacatactcgggatcaatgtaaccagctgtcccggctggagtgactgatatgtgagtctgcgtctcgccgagataagtcttggaaagtccaaaatctgctattttagcttgtagatttttacctaaaagaatgttactggttttcacatcgcggtgaattattggtagactgcaacccttatgcaaataatccagtcctacatatatcaaatcatatcaagaaactatagtgagagaaggtgtgcatgcacgaatgaacaagtgtcattttggacattattgtcatagataaacttatttcatagttaaacagtaaatttcacaaaactataactatttgatccaaactgttgctttgctacaattttagctacataaatcacaaaaaatgatgcaacaatatcaaatgaattttatgatgaaactgcaattttattcttctataggtgtgtcagatgtcttgagtcttgactcgatgcaaaatattgtcagtatctcatggatgtataacatgtggtattgaacctattgtacgaaaagaaaaaactcatgcgttgatattgaagtttactagaaatcctagctaaagacttctcacaatattctttgagtaaatttatcaaaacaacatatattttgaccagattatcacaaaactacatatttagggtgatatatcataaaactatagatttaacactaaatttctcaaaaaactacctatttaagatttaagttggagtatcgtaaaactatagatttagtaataaaattgtcaagtagttttagtgacaatttaatcacaaaacttacacgtttataactcaaacataacactagtgctaaggatttaaactctaaaatctatagttttgtgataactttgttactaaatctatagttttgtgagtaattttgtgataaatttattgttaaatctgtagttttgtcatacatcaaaatttgtagttttgtggtaatttgatcaaagtatatgtagttttgtgaaatttactcatatttttttttcttccagtgccatttgcatgtgacaattctagctaccatttctatatatcatctatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 7344 - DNA, 3369 bp, Oryza sativa
agatgacttcatgttgtcctttgaactgtttactttaataatcaccgtttgattatcataattcattaagatagctggcgcgcactggtttttcaaccaccagcaaatccatcaggagttcacgaaccactcaacctcaactgtcacaatatctagtgctgtaagttctgcttccattgttaaccttgttaaaatgttctgcttacaaaacttccagaaaacaacaccacctccaagtgtgaacacatatccacttgagacttttatctcatcaacatcagatatccagtttgagtcaatatacccttctagtacttttgaatacccggtatagtgaattccatagctcatagtgccctttagatagcgcattactcttttcagagcctgccaatgatcatctcccggatttgagacaaaccggctcagcttgcttacagcaaatgagatgtcaggcctcgttgcactagccaagtacatcaatgaaccaatgatttgagagtatctcagttgatcccttactattcttcggtttttccttaatagcacgctaggatcacaaggagtaggagctggcttacagtcactatatccaaagcgactcaaaaccttgtccacatagtgagattgcacaagtgtaatcccaccctcatctcctctttgtagtttgatgttaagaataacattagcctctcccaaatccttcatttcaaaactcttgtacagatagtccttgacctcctcaatcacattaaggctggtcccaaagatcaatatgtcatcgacatataagcacaagatcactccttctccccaccacagcgatagtacacacatttgtcagcttcgttcacaacaaagcctgtagatgtaagcgtggtgtcaaacttctcatgccattgcttaggtgcttgcttgaggccatacaaggatttcaacagtttacataccattcccttctgaccttctaatacatacccgtctggttgatccatatagatctcctcctccagctctccgtttaagaaagctgtcttaacatccatctaatgaatgaaaagaccatgagaggcagccagagcaagtagtactcgaatcgtggtcaagcgagcaactggtgagtatgtgtcaaaaaagtcctcgccttccttttgggtataacccttggccacaagccttgccttgtacttttcaattgtaccatcaggcctaagctttttcttgaaaacctatttgcatcctacgggcttgcacccatatggacgctcaacgacttcccaagtaccattagacataatcgaatccatttaactgcgtactatttcctttcagtagtcagcgtcaggagatgaatatgttcttctatggttcttggggtgtcatccacaaggtatacaatgtagtcatctccaaaggattttgcaaccctttgtctcttactcttgtgagtgtctacaatgttgtcctcctcaggatttttctcaggcgtttgatcattgtgttctatcggtgcaaagtgctaggtgtatgtttcatggaaaattcattatcaaagaatgtagcatctctggactcaagaattgtaccaacatgcatgtcgggtactccagagtttactattaagaatctataacccacactgtgaatagcataaccaaggaacacacaatcaacagtatttggtccaagtttccgctttttggctataggtacatttaccttggccaaacagccccatgttcgtaggtatgagagatttaatttcttcctttcccattcctcgaatggtgttacttccttatgcttcattgaaattttattcaggacatgacacgcagtcaaaactgcctcaccccaccattccttggaaagccccgcagtctctaacatggcattcaccatctcagttagagtacggttctttctttcggccaccccatttgattggggtgaatagggaggcatcctctcataaataattccaaactcttcgcaaaaggatgcaaactcattagaaaaatactcctcacctctatcagacctcaaccgtttgattttcctttcaagttggttttctacctcagctttatagattttaaagtaatgcaatgcttcatcctttcttttcaatatatacacataacaaaatctagtgtaatcatctatcagtgtcatgaaatatttctttccccctttagtcaacacgccgttcatttcgcacaaatcggaatgaacaagttctagaggtgccaaattcctcgcctcagatgccttgtgaggcttgcgaggttgtttcgattgaacacaagtatggcacttggaacctttgatcaaagtgaattttggaattaaactcatgttagctaagcgcgtcatacaactgaaattcacatgacagagtcgcgaatgccacacattagactcatcattctcgctaatatggttcacaacattatgattattacacatgtcattcaaagaaaagcggaacaagcctccgctgtcataaccttttctaacaaaagtcccatatttagatacgacacatttattggactcaaacacaagtctaaaaccttctctacaaagtagagagccgctaacaagattcttctttattgaagggacatgctgcacgttcttcagctgcacggtctttcccgaagtaaacttctgatcgaccgtaccaataccatgaacagccgcaagcgacccgtttcccatcaacatggaggaacctctcccgacctgataagaagaaaacagagaaatgtcagcacatacatgaatattagcaccagtgtccacccaccaatcaggtgagtgaaaaacagagagaactgtaggtaatattttaccgtaccccgatgttcctccgccctcgccaatgaccatgttggcagacttcctgtctttgcgctcaggacagtccttggcccaatgcccagacttgccacacacaaagcagtctccctttgcttttcccttgcctttcttcttaaagttggttgcagccttgggtttgacatcaggcttgactttcttgttgttgtaggatgcatgagggttctttttctgtaccatattggcactagaacctccctcaacctttttttcccggatgtccgttgccctcgccttctcctcaacacccaaagagccaatgagatcagaaacactgaactcttgtctcttgtgctttagagaagtggcaaagtccgaccaagaaggtggcaatttggcaataatgccacccgccacaaacttgtccggcaactaacagttgttgttctcaagttccttagctagcatctgaatctcatgagcttgttctactacagaacggtcatcgaccatcttgtagtcata

SEQ ID NO: 7345 - DNA, 18786 bp, Oryza sativa
  unsure (1)..(18786): unsure at all n locations
tctgaacagggtaacaagcagagtggatagaagtagttttaggaaagggttaatttgatgcatgccactataaatattataaatatgacatattaaaaaaatagcgtactagaggagctggtctgaacagggtaacaagcagagtggatagaagtagttttaggaaagggttaatttgatgcatgccactataaatatgacatattaaaaaaatagcattacaatttgtgttatcgactgggtgccactcaaaatttctaaaattaaaaccatgccactctcgtaactaatttcgtcctcctctctcaggtcgccttcctcaccgtgacatcatgcacagggctccaacggcaaggtagggacatcgtgcaccgggctccaatggtgagcttcccaaggagggcggcggcgtacatgcgcgccatcaaaccacggcccgccggagcacgaagcactcaaggtagggtaccatgaaggccacgcgcgaagcactggttcctctcatagccggacaggtcactcccaatcagctccttgatttgggacaggccgtgcgacgggccggacaccgaggtggtaagcacgtccaggtccacggtcgccgtcttcctgacattggtgagctcggcggcgagccccgcggcaatgtccgccgcctcggcggcgctcgacagggtcatctcctgcactacgaagtggagcagcgtggcttcccgtcggtgccctcgacataggtgaatttgagcagcgcttcgagcttgaacgccatggcgccgccgcaggaggtcccaacgttcatcctgttcccggtcttgagcatagcctccagcagcttcaggaataacttgctggacattagctccctgcacgcgtccttccagacaccaagaacagcatgccattaaacctcgagtttaataaattacanatacaagcaggatcgctgagaccggcggccattgcgacgaacacccaagattcacctcgagcatctcgaacgacttcctgatgtgtccgacctcgtcggcgaaggtctcccggtacatcatcgtgattaccaccttcagcagcctttccgccgagaccaggccgtcgacgtcgccgtcatagccggacaatgtcgacctcgtccttccagctgctgtgccgacaggccgttccctgcgaacaattgttatgtggggaattccctttcagcggcacgggcgaacggacgaacgccgtgcctgacgggtgatctagcgccaactgaattcggtggattcggatttgcttcacagtttgtttctgttatcccttttaattagcaagtttgttagcatgtaaggctactattgacgtaaaacacgtggcctgggagatatgcttaactctagtgcaggtccaaaactcgccttcgggtatgctagcgtgccagttgatttgatcctgcaatcaataagaaataaagacaaagaaaccgcggttaaacctataaacgatagccgatcggcttgagtgccgatgacatatcatttatctttgagccgatgtcatataggtatcgatcgacaatcatgaataaataagaaggaactaaatcaactcgatcggatgtagatattaacaatatatactccttatattgatatatacttaaatcaagtgattgggatagatcggtcgccatgccgagacaatataaatcgctttgatcgaaatatatattgataatgggactatatatgttcatagcatagccgatcagatagatctaacatgtatcggctaatactccgataccactctatattaagatattaaagcaagtagaatatatcaaacaaaggcctaataaacttaaatgcaacgagatcttaacataaaggacagatttaacatatcaacgaagcatatagagtaaatatagttaaatcaggtaagatctgatgaaaccctgatatatactatcctaatcggcaaccaagaagcaggccagatattggaattttaatcacgacttataagatcaaactcaactgatgcagctatcgagttttatagagtggtggataccttatataatctaagtcaacatcgatatctaacctaatcggctgccctctaccgacaaatgttagccttttgtaggttagatagcaatattgccagagattatgatatatgataactcgatgaattacataaacaagattagagtatcataaagatggaagcactaatcccgagaacgcaagccgccataacaagttttacctcttgttgaagatcgaaaccgatgcagctcaacctgaaagcaaaaactcgtcgaaacacaacaaaagtaaaagggtggcgatgcgcagagattgtattgaacatgtattaattaattacatggggttcggggtctatttatacccgagaattacaaactatgtccatatcagacacgactcttatctctaacaaactctaagataccataagtctttacggcagacttttgcccaaacatatctctaaggaaattacataaaatatcctaattaatagatacaactgccttctcaggactctatccatgcacagcaatcatcatgaagctcatcaacctaaaccgacaacgtttgctgtgtcatatcgtcggattcagctcaatcggctaacctcgtccaactcgaactctgtcgatcttagccgtagccgattcggactacagccgatcttactatgttctccgatcaatttccatctcgaattctactttgattccatctccatctctgatacttagattaccaaatttggtcgttaacacatgccccccaagtccggaatattggataatgttttggatttgccatacgtcaattccgagaaaactccgttctcgccgtttcccgaccgttattcaagcgctttaaatactaaccattacccccaagaaatctcacaccgtcttcttccgtttccaccgctgaggccaacactgtcctctctctcttcggcgatttctccgacgcacaaggcgatccccaagcgacttcatctccggctagatctccgcccgcggcgatgtcatcctctgccggcccgtctaccgcatcgtcggccgagtatgctgaggtaagttctcatcggctagatcccttttcttcgcaacagattcattttccaactcatcttgttttctccttctcggttcctttggatttgtagcatctctccaacctagttgcaattcccaacctgtcgcatgaaaattactatttcctcggcgcagtcggcaaccctgatcctaccgagttcattatcagcaaaaccaataggattcctttcagattggccaacccaaatctaggtcactagaaaaataccttcaaatcttggccatctctcgataaaactccacccgagaaaagttggactacatggtataagcgcgtatcggctagcaagaaagttcactaggacgagattggaatcggccaagcgcttgcccttaccatagccaattcagctaaagatgaacctctgatggccgccgccacttatatttggtccaacactatcaatgcctttttgttcaaccaagggccgatgactccaaccctgatcgacatcaccatgatcactggattagatgtaacctcatcggctaaccctatgagtatgaacaccaagaaccaatttgatttcaagaccaaaagcatagggggttagtctggctatatagcggcatatatgggcaaagggcctgtcactcctcgggagcatgtagctttcttgctaatgtggctagagaagttcctcttctgtggatccagttgtggtcctacaaccaattggtaatttgtagccgaagccctagaatcgaaaaagcaatttcctctaggcaaaatccttctcggctatctataccaaatgttgaataatgcatcagctaagatagctatcagatcagtagttggagcaggtggaccatggtggctattgcagacttcgttaaatctgatggtcatgaaagttgtcaatcggccatctttgacagaagccgaattcccaagactggagccgattgtagaagatgatggagaagagcgcactcatcgcagatgcatgtcatatggagaatatgcatccacaccaaccgatgccggagcaaaattatcggctgaactgctcaaggactggttctgcagtttctatgatggctttcaaaaagatgttcgagtttggtttccttatgaagattcagcaaaccttgagctcccatcggactttagatttgaagatatcaatcatgaaagataccaaaagtccagggaagttttctcagctgcaatcagcccatgcatgctttctgtcggcatccatcaggggaaaaacatccaagtctcttatgagttctatcatccaatgagcttagctagacaacttggaatgggccaactcctaatcagcttattctttgccgataagatcctgtgccgaggggaaatctcatcagccttgatgatggatcggctgctcaatctccaaggacctcctctgggcagcattgaaaatatagggctggcaaagttcaggagcaaaaactttgacagatggtagggtgaatggaaactgcatctattccatcaatcggcttctatgtacatgacagatctctttccagatgttatcccttaggtatgccttcatttaattaactccgtttaaataattgcttagccgattcataacgtaattaattttctttcctgacttgcagataagggagttcttccttcctcaccagagcaatagtggcagggacatagagtatgctctaggccttattccaaatggaggtggtccatctcctcctgtcatcggctataatgcccccgagacttcaactcttcttcaagggctcatcagagaaccagccgatgctagtaaaaagagaagaaccagattatcggctgtggatacatcggctcctgctccaaagaaggccaaattaaagaagcctaaaccaaccgatgatctgcctgccctagatccatccatttaacaagctctggatgaagaagaaatcggcgaggatgttgatcaagccacagatgaaataagcaatactgaaataactccatcgacttcacctaagctaactcctccgaccccctctgctccagcttacttctctaggttaaatatctttccttgattctctttttataactattcgtcctcacccgatttctcactaatcttttccttgcaaaaaaagagaattgctgtgaagaagaaatcggcatcaacaactctaaaaccggctccaccaataagatatctttaatgctttcactagttgatctcagccgattttgtctaacacttgtctcttttacagcctcctcctcctccttcttctcctgtacaacaatcatcgagtgaccaaactccatcggccgtagagagccatcatattgaagaagaagaacaaccaactgcttctgctatcccagtaagtttccttttgacacaagaatttagatcggccatgtctatttagctctaactccctttaaataattattgcaggtcttagccaatcttttctcttttgacataagggactatcttgacgagacagaagaggataccacaagcaaagctttagcccccttatccgatgatgtgaagaaaattcttgaagatatctctcatcggctagaggcaacatcgttagacagcttagtggttgattgtggctcaattagaactcggctacatgaggttcaagctctgatcccagatgagctagccgatgtccttactccagccgtctatcttgagcagcatcaattcaagctggagaaagccaagcaaagattagctgaacgtcaggggcgcaaggatatcgaggccacaatccaggcaaatcgacagcttgttcataaagagaaggccaaacatgatcagctatttgagggcccgattaaatctaatattgatcggctcgaagctcgtaagattgagctcttggcacaacttgaagaatgcaacgccgagctggatatggaacataaaaagctagccgatctcccaaaatctatcgaagaacataaggcaagactaaaatcggctatcaagaatgttgctgatcttaccaagtctttaaaagtcatccccagaaccaacgctcaagatccaaaagccattgaagaagtagaacaaatcaggcaaagggctatttcagctatccagcaatatttgtctcagtgatatcttgtgtaatatgtcctagaaatgttttgtaatcggctaagaaactttggctctttatcgaacttatcttaataacttttatgtcgattcaatagaactccatattgtgctcaaaaatctgcagttttcatatatatgctgtcgggtcccaaaactattaacttggatccgattgagattaatatatcaatccctggatcagtaaatattgatacatgtaatacagctggttcttcattgcatacgataaagtttacaatactaggggttttacaagggtaggtactcacctaattaaacatagatgctaatattacacagcggaagttctagtacattctaactaggaaggtataacctctaaggattttctaagttatcagggtcatcatagtaatagtcataggggtcctcctcttcacccaaatctgaaaaagggttaataagagcaagggtgagtattcgcaatactcagcaagttaccataaaaatatgttatgcgttggcaaggagtgaagttctttgcagaaagcaataatagacaatctggaaatattaaagcaagagtttgtaaaatatatactttaggtttctaaccagggtaccatatgagtcccggtactcaattccgtgagtacggctattcgaatagtttcaaagatattctactgcagcagatgtaagctttacccgcagtccatgacttgctgataatcatcagctttagttatggcccagtattaggttattaacaattgtggcacctattccatgaacttatatcctcatatgctctgaacgtaatgttaacagcagcaagaggagttctggcgttcccgaggtatttaagaggaactggtcgtatgacaccacgtcatctcggtcagggtttagaaatataccatataatttatagtcgagtatcacaaaccattcacctgtacatggtaatggttaaatttgcctttcgcggctatagttgcctcctgcgcgaggacttaaaaataagaaccactatacagaggtaccacattgctaattaacataataactaggtctgtccccattctacaaactgcgttgtacccgttcgttcgacataagtacctggtgataactatatcgatcgagacagtactagccacccgaaaattatccaattcttacgtactgtcccaatctaagtataaaatattttaaccagattgtaagcaagataagcaatactaaattatctaggtttctatggttgaattatgcatataaaatagagtattgaatagaaggctataaataaataatttgtaaaatataggcttaaaagatcaaaaggtagatagtaacttgccttgctcgatatcctgagattgattgagattatctaataggttaggagactcctcaagatttagggttaaacatgtaaaattcaaattcaaaagagattcgaataaaatccaaaaataagcaaaataaaataaaataataaaatagcaaaagtagcctcaaaagatagagaaagattttggtccaagtttcattggaattgggtttatattttaaaagatatgggcttctaaagattgaatttgaattaaattgagaaattagaaaggttactgtagaggggcccacccgtcaatcttcctttctttttcttattttcttcttcttcttccttcgtttcttctcttctgtttcttccagggagctgagtggagcgagagaagggcgccggtgttctagttgacgggggacggcaacgtcggcggtgaaacatgttcctgagcgacgcgcatccagggagggtggtgatcaggagagggagtgagggaggaggccggaacggcgatggctagggcttagctccggccggtatgggaggtggcggtggtggctagtctcagagggggaaaggcaggggaaggttaggaaatggatttgcctcgtcgaggcgaaggtattggcgagagggcttggccggtaatgctccgataagggagatcgaccgacggccggcattggaggagagagagagctcggtttgatttggggaaaagaggagggatggccggctacttataggcggcggacgtcggtttgcgaaggtcggttcgccggaggaggacgaggaaggcacgacgatgaccttagtgaaggaaaaggggacggtgccggcttccgctcgtgattggctggtgatggcggctgcgtacacgcggcgacgccagggatgttgggcggcagaggaggagaagcacggcacaatgatgacgtcggcgcgactcggtggcgtgaggaagagggacacagcgacggctgcttaggggagaagaaaacggcgccggcggcggcgcgcgtgttggacacggcgacgcgcgcccagagagggggcggctgcttctgccagtgggaccggctgggccaattgagccgaagggagagaaaaggattcggcccaaaagaactattttggaattttgaatattttgcctaaggagaaagaatttatctagatatctttagaagagttttgcaaagattatgcactataacaatgtctcactaatagaagggtaatctagagaaagtttctaaattttggaatttgaaggaaatttgctaaattcactaaggtttaggatagggcaataatctagggtttattggtaaactagcttaaggggcttctaggggtaatacttgaaccaaaatcaagaataaaaagagaacttttaaagagaattttgattttgctagtctaagattaaaaccagtcaaaagccagcatgatgcagtcaaattttagtttaaaatttgagaatgttacaaacctaccccccttaaagaaatctcgtcccgagatttgcttaggagtcttcaaatagataagaggaattccaattgtaaataatattcccattcccaagttgcttcatcctctgtacgatgattccattgaactttaaacattcttattgccttagtacgagttgttctctgtgcttcttccaaaattctgatagggtattctggataggttaagtctttattcagttcgacagtacttagtgatatttctttctctgggatacataaacatttctttaattgtgaaacatggaatgtaggatgtacatcagatagataatctggtaaaaccaattagtgctcatccataaacttctccatcgagtccttgcaacatgtaagctcccttagacacaactctatagatttggaacagtccttcccaattcggcaaccacttcccgaatttgctatcccgagtcccaatcggcaaaatcaacttccatacaagttcaccttccgaaaaagccttgggcaccactctcttgttgtaatgccgagcaactcgttccttatccttggtaacctttgcaagggccctcaatctggactgaaccaactcttccctttcatctgccatgaggttataatactcatcggctgttaaatcattttgcaactacgttctccttgagccgattctaatctcccatggtaaaacagcctcatgtccataaacaagcttataaggagggacttggatcgatccatgacaagccatccgataagaccacaatgcttcggccaaacgagtatgccactgccgaggataatcagaaatctttcttttaattaatttgatcaagctcttgttagatgcctcggcctgcccattagcttgtgcataatatggtgaagaattcaacaatttgatacccatgctataggcaaactaaacaaattcatcggacacaaaaattgaaccttgatcagttgtaatggtttgaggaataccaaatcgatagattatatgttcttgaacaaattgtatagcatccccagaatcaaccttcttcgaaggaatcgcttctacccacttgctaaaataatcagtcgccaccaatataaacttatgccctttactcaatggtggattaatcatgccgattatatcaattccccaacctctaaatggccatggcttaatgatgggattcatagccgacgccgatgccctctggatcgccccaaatttcttacaatcttgacatcccttgtaatttttgaaacaatccttcagcatcgtcggccaaaaatactctgcacgtcaaagcaaccacttcatcttatgagccgattgatgagtaccacaaattccttcatgaacttctccgatggcaaccttagcctgatcagcactcacacacttaagtaacaccccatcaatcgtccgataatagagctcatcatccaataaagtatacttcaacgctttatatcttaatctccgagaagccgactgagatggattctgtaaatattgatgcacatcatatctccaatcatcggctgttattgcagcaacttcaaccttaacatctttgatcatcggcttataccctgatgccccttgggccaaatcattagcttcaatattctgctctcgagatacatgcctcaaggtaaccagccaaaattccatcattagttcttggcacttctcattataaaccattaatgtatcatttttgcactcatattctcctgccaattgactgattactagcaaagaatcccccataatttcgatagcatcggcttcaacttccttgagtaactgcaaccctttaagaactgcctcatattcagcttgattattggtcgcataaggtttaatagtgtaagcaaactcaaaacatgccccacgaggggaaattataactaagccgataccacaaccatgagtatatactgatccatcaaagaaaaaagtccatggcacgatctcaattgagccgattaaatcatcacgatgatcaacaatgaaatcggctatagcttgccctttgatcgccttcggtgactcataccgaagatcgaactcagttaaggaaaatatccactttccaacccttcctttcaaaattggagccgataacatgtatttaacaacatcggctttgcatatgacagtgcattcgttggacaatagataatgccttaaccttgtacatgaaaaatataagcacaagcacaacttctccacaggggaatatctagtctctgcatccaagagccgacgactcaagtagaatacaactctatctttcccttcgagctcctgaatcatgaccgagccgattgacttctcaccggccgacagatataacctaaaaggtatccccttctgtggaggaatcaaaactagaggagagctaagatattccttaatactgtccaacgctttctgttgctctgccccccaagtaaactgttgatcggctttcaacctcaataatggtgtaaaaggctctaacattccagacaaattaaaaataaaccttctcacaaaatttatcttgccgatcatctcctgcaactctgtcttgttctttggagactgaatcttcttgattgcattaacactcctttgagttatctcaattcccctctcatgaacaagaaatcccaaaaactggccagccgatacgccgaaagcacactttgttgggttcattttcaagccatatttcctggttctctcaaaaaccttcctcagatcagctatatggtcctctatctttttagacttaacaaccacatcatcaatgtagaccccaaccaaccagcagatcagatcatgatatatataattcatggctctttgatatgtagccccagcatttttcaaaccaaaagacattacaacccagtcaaataagccaattgtaccaggacacataaaagctatcttatgaatatcttcttcggccataaagatctgattgtaccctgcattaccatccataaaactcaaaatcttgtgtcctgaggcagcatcaaccagttgatcggctactggctttggatattcatcctttggggtagctttgttcaaatctctgaaatcaatgcataccctcaccttgctgtttttcttgataacaggaactatactagaaacccactcggtatatcggcaaggacgaataaaaccagcatcatataaacgtttaatctcagctttgacaggttcgagcatatcggctttgcatcttctcggaggttgttggtgtggcctgacccctggtttgataggtagccgatgttcaacaatcgatcggctgagtccgggcatctcataatactcccaagcgaagcaatctctgaattcctttaatagctctatcaacttggttctgaattccgaagataaattcttactaataaatgtcggccttggtcgatcaactggacctatatcaatctcttccaaatcatcggccgacatgaaaccctgtccttgtttgtcatcgagattttctactgtgtccttggtgtagacatttgaaccctccacgacgccctcaaaataataggttgggttctccatctacaattggttgtatatcaaaatcggacacttttagaaaatctccatcccaaacttttccagataaacaatcaagaccatccatctcccaaagagctaaatctgcactggcaacattgactgacctgtcggctggcacaatttcaatcttgtcgccttgccactgaatcaagcattgatgcatggttgaaggaatacaacaattggcatgaatccaatccattccaagcaacaagctgtaggaacccttcccatcgatgacaaagaacgttgtaggtatagttttactgccgacggttagttccacattcaaaactcctttggtttctgatggattgccaccaaaatccttgagcaccatgtttgtcttgatgagatcttcagtgtttctgcccaacttcctgaatgtagcataaggcatagaattcactgcagccccaccatcgaccatcatcttggacatcggcttcccattgacctagccatttatatacaatggtttaagatgccgattctctgttccttccggcttttcgaagactgcttgctctggtgacaaaatcaatttagccggttcttcttcaacttcgtcaacatgggcttgcttgaccccaaattcagtaggcaacgtgaaaaccatgttaaccgatgtagttacaaaacttttccctttagccaatctctttgcttcatcggctacaggagcttgattcttaacgcgccactcctgcttcggctttgttttttcagtcgatgattgatttcttgctcaacctcctaaaatcattctctgttcctcaacctctgaacacttctcttttgattctttgtaaagataccagaaggacaccattgattctgcatgtcttcattgtcctcttggttataatcttggttcaccgggcccaacctttgatgaacaggaactcttgtttgctttagccgattgcttctattacacgatcggcttgaactttctacaacattaccgcacccaggacagtcctcgatagatggcagcctcttgcccaattcttcagccgatgggattgtatgaccagcaggaagttgaatctgtttctctcggagtaacaaatcaaaaatcttatcagccttggtaatatcaaagtcatacctctccacttttccagaattctttacccattggcatggtataacctttttgcttctcacccattctatctcagagtcatcatcatcatcatcatccgatccatatatgtaaggacagacatgattaacctttttaaagttcttcctgacttctgcaaacctctgttcatgcaaggttaccttctgtccaagatgtgacaggctatcaaagtcttgagacgagaatttctccttgatcggagcaatcataccctgaaaagccaaatcggctaactgggcatcaattaaactcaagctgtagcacttgctcctcatctctctaaatctctgaatatactcatgcacaggctcatcatatctctgcttgatcgctgttaaatcggacaatttcaactcatgaatctcactgtagaaatagctatgaaaatgcttctccaaatcggcccaactgttgattgatccacatggcaaagaagaaagccaagtgaaagccgatccagacaatgacaaccggaacaacctaaccctcaaagcatccatgataaaaatcggctaacgtgttcataagttgacatactatcctgccctgagaattttgaaaagtctggaaccttgaaccggttaggtagagggactttctcaaaccatttaggggaaggttgccgatataagtttccagcgtctttcggcttaagcccaaactgctccttcatcacatccgcaatcatatcggcccatggtcgttgctgaggtactccttgaggttgttgtggaatgagttcgaattgattgtattgaggagcaaactggggttgagccgatcctccctgctgatattaaatttgcggtgaaggaggctgatactgataattcaaattgcccccctggtaattttgaaacttcggctgaatattgcgcaccaaatgctcgggatcaacttgaggtatcatcgtttgatctggctgtacatgatgaaccaagtgctctggcacaacttgattagcagcatgctgccttggctgattgtcaggtgttacaaacccagtcgatgcattcatcaaaccttgctacagaatcggctgaacaacctactgccttaacagcgtttgctgaatcggttgcaaaacctgctgcctacgtggcgtctactgaattggctacacaacctgttggattcgtggcgtttgttgaatcgactgcagaacttgctgccttggtggtatttgctgaatcgacttctgctgggttggatcaacggtaggttgaggaggtaagaacatagctgcaacctgatcttgctttagccgattcacattctgtccactatgctgtgattgctctctcaccaacaatcaaggattcactaattgacctggcgctgatgatggtgcagcaggtgcaggagccgatactggtgccgccggctgagccgatggtgcattaagaggaattgattgaacaactggctgattatcagtgactaatggccgataattcgggaatacccctcctagtagataaacttgtcctgtagcctgatattcagccattgaaccatcaaccattgtcttcaccatgtttgacaaagtgttgactaatattctagattgattgatcaaagcatagtgcacggcatagtcaacctgatcctggaagttgttaaactgtaattgtgctgcattgccgtcatgattaagacctccaccttgaactccctgaacaccatcaccttgaatttcttgagagccatcaccttgatctccttgaaagtcatctgcagcacctttaatactcggttgagccgcgtcatctggagcttgtttcacttctccaaccttagaagaacctgtcccaggaacatcggcaattacttttactttgtacttctgaacaagtgttcccttgcgagtcttcgtgaatgagctcaagaactgattccgtgcttgctgcatcattacctcaagatccttttgctgttcaggtgtcaatttgtccatagtgacgagcacaatgttggcttcatcaacctcagatagacccagcttgtggaccttagctttaacagaaccaagttcaccagccgaggatggcgatgctggcggtttctcggccatgggaaaaactgctgttgtgattttgacttctgatcggtcccactgggtgtgccaaaagcgtgttgacgtaaaacacgaggcctaggagatctgtttaactccagtgcaggtccaaaactcgccttcgggtatgctagtgtgccagttcatttgatcctgcaatcaacaagaaacaaagacaaagaaaccgcggttaaacctataaacgatagccgatcggctgagcgctgatgacatatcttttatctttgagccgatgtcatatatgtatcgatcggcagtcatgaataaataagaaggaactaaatctactcgaacgactgtagatattaacaatatatactccttatatcgatatatacttaaatcaagtgattgggatagatcgatcgccatgccgagacagtataaatcacttagatcgaaatatatattaataatgggactatatatgttcatagcatagccgatcagatagatctagcatgtatcggctaatactccgataccactctatattaagatattaaaccaagtagaatatatcaaacaaaggcctaatatactcaaatgcaacgagatcttaacataaagggcagatttaacatatcaacgaagcatatagagtaaatatagttaaatcaggaaagatcggctgaaaccccgatactaccctaatcggtaaccaagaagcaggctagagattgaaattctaatcacgacttataagatcaaactcaactgatgcagctataagtatggaaagaaggacaatatcaagacaaccaagccattggaagtttcatagagttgtggataccttatataatctaagtcaacatcgatatctaacctaatcagctgccctctaccgatagatgttagccgattgtagattagatagcgatattgccagagattatgtaagacatataataactcaacaaattacataaacaagattagagtatcataaagatggaagcactaatcccgagaacgcaagccgccataacaagttttacctcttgttgaagatcaaaaccgatgcagctcaacccgaaagcaagaacttgtcgaaacaaaacgaaagtaaaagggtggcgatgcacggtcacgcacagaaattcactagtaatttccgaactaatttgtgtattaaaatcctcgtttaggaatcaaccgactaatttgtgtgttaaaaaactcgtttaggaatcaaccgaggtacacaaactgacaatttaatatacagattcatcaaaaatacaacattacatacttacaaaagaaaggagaaaacagcagcggaattacggtctagcgaagctccggctccactcccacgggcagctcaactggggtataagccaaacgtcttctccttcgcaacttttcttcaactgaggtttgattgattattgcaaggtgagcatatgacatagtcagcaagccacacagcaaatatgcaagtgcacaaggataccaaagaatggcgtaatatagggctcatttgcgaatgcagcatttagcaaacatatgagaattgtaaaacagcagagtaattaatcatcaatattaatcaacactgaacaacacacccatgctgcacaggcccaaccatcctgaacaaccatacccggctgtacagatctatctccgaaccaggaatgtaccattccaaaccaggagcaaatcaaattattaccagttatcgcatcatttattatggtgaaaagtgtgagactaatcacgaaagacattgttatacccgctcataaccgcaggcacggctattcgaatagttttactctggctagaagtgtaccactatacccacaagacatgattccacacatgttaccatgccttgaagtaccaccacggcactacaaagggggaaatcgtgacagtacccttcgcacaacacaactcaaagcagtgcaccgtacctggatcataatcacctccttatagacaaggcatggactccccagcgacccccgtgggcttatctccgccacttctcagtctggtgccccgcaataaatcatgctatataaaaggtaaagtcgttgcccatgctggcttgtggttggcacggttaatgtttcacaactgaaactcgtgaaccgtctttaattgtcatgagcacgaccatcaaaaccatgtgctcacaatccaccattatcaagttttagttggcacattaattaattaaccaatcacgattagccatcatgagctacaattaaatatccatcattaagtgatagtgaaacattagttatcccaatcatgtgctaatgtttctaagcatggctaagcaattatatttaatatctagctgaaccaatatataagtccaactagtcaaattgtcacccatggtatcaaagaattaagtaagcaatgcaaagtggtcataacaaaggaataggttcacaccacccggtgacattccaaaaataaatgcatggttgaaataaatagagaatttaaatataggatcaacatgctcaaaggaattgtgtttgggatccgtgtgacttgccttgcaatattcggtcttcaattaatcttcttggatacttccaacgcactcacgaaccttcaaaacgacggaaacgacaagctaacctgcagaacgaggaaaacactaagaaactccaaataaacagtacatataaagtaaacaaacatgtagatcatgattttagatgaattagagtcaaactagtcccggttcggatgacttatctctatcgggtgtattctaaaagcccgtcacggatgactaatctctaatgggtaggactctatagcccgtcacgggatgagtatctctttccggca

SEQ ID NO: 7346 - DNA, 1416 bp, Oryza sativa
caaagaatatttacaaaaatcaaatgtttgtcacatatgcattgcgaatgttctgccattgcgagacgagctacctaggacttcactctaaacatccctttcaatgacaagatatcatctagtatgaattgtgctagctcctctctaatgatttcgaagttgatttccggaatccttcaaataaatttctgcacgttcggcgccaacatcgtccacctctgttatggtgtagacttccttaggaattttattctgggtcctaggattccggctcgatgtagtcccagtagtggtcgtcgacatcggttcgccttgctgcgacatgtcctatgtcactgttgtacggggagaaagtactttttaaacacaaaattgcatctacacacattctcttatggtttgatatacctctatctcctacctacgttcgcctcgtcgacgaaaccatagcatccatactcaatagggccggagcagccgggaactcgacctcgacatcagtataccactcgaacttgctatcaatgtcacttggtgctggccttggagttatattgatctcaatgctgtgcttgggccattgaataaagttcccacgtgcagccccaagggtcagaatctcgtcattaggtgggtgtaggatagtgtagccaacccaatcgggcttcactaagtccacctgaactttggcattgccggcttgcagctgcgccccatgcactcgggtctctgggtaggcttgaatgcttgaccctctgcggcaggaattgcaaatcctggtgtcacccttacgactagggtacacgatgtgggttcctgcgattgattcattagtgtccttagtatatgttgcaatgtattgtggtgctaatataatatatacgttattaagttgtttctaccattatgtggtccaccgcggcggggccttcaggctgttctgccggagcctcagttgatgcgcagctgctacgcctctgcgtggggctcacttgtactacgggaccgggagtggcatcggtcgacctatccctgatgcgtgcctccatccgagccttcatacctaacagctcggcagtgacctcttctctaagctcttctttaagctcctatcgaagttgggccttaatgcgtgcagctttctgcgccttggaaagcttgtgcttcttgtactgccacgcatattggggaaacccaaacttccatggaacattggagccaatgccccttgttcgtccacggtgttcttcgtttcccaatgctttcgtgaggatgtcatcctcgcgtttttgtgagcaaacctcttgggaggcctgtctctcagcattcagttcgacctagagtacagttaggatgcgttagacgaacaacaagatacaacataatgaaacttattctatgtgttcaacatacgat

SEQ ID NO: 7347 - DNA, 510 bp, Oryza sativa
atgaagtctcacgattgccacgtgctaatcacacagatcttgccaattgctataagaggcattctaccaccacaagtccgtcacatgatccaacgggtttgtgccttcttcaatgcaatcggtcagaagattatagatccagaagacctagatgggttgcaggccgatattgtcagtaccctgtgtcagttggagatgtattttccactagctttcttcgataccatggttcatctcactattcacctagtgaagcaaaaaaaatatgtgggccagcttttatgagagaaatgtggccattcgagaggtacatgggaattctgaagtcctacgttcggaacagagcaaaaccagaggggagcatcattgaaggttacatgaccgaggaagccattgagttttgtatcgattacatggctgagactaatcctatcggagttcctacgtctcgccacgaaggaaggttggcaagtgttggcacaactggcagaaaaagaattgttcccgatc

SEQ ID NO: 7348 - DNA, 493 bp, Oryza sativa
tcgctatcaagtcggggtggggggacgacgtcctgctgcgtcactgcagctggcgcttcctccgagctgacgacaggaaatggaattggaatcggaatggcaccggcgtcatcgccgacatgatcgacggccgccgcctggcgaggtggcagtgggtggtggaggccatccccccgaggaacttcatacctaggcctccgaatccttcggtgagcacgtcatgcccctgtttcctttcctgattcttgcataatcgattgcgttactgggttcttcagggctaggctaattcttgatcttttcctgtgattgctggaattttcgttactgggttcttgatcttttcttgtgattgctgcgaaattctgttagttccgcctctattgctaatttgctaatctcgtgttcccgggaaagtagatcttactagcattttagctctaggtgtccattctctatgttgcattcgtaaggaggggggggggggggggtg

SEQ ID NO: 7349 - DNA, 22155 bp, Oryza sativa
  unsure (1)..(22155): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgacttaccgatcaaggtggttggagtttgatttgtgaatgcctaaaatggcctatacttacgtgaggatttgatccttctatgtggcatgaggtaaccctgagtcggcttgggaaaggctttgtcgcgaacctctgacaccggccagtgtctggagtaagttcgtgtcttgtgggtaaagtgtacccctctgcagaggttaactgactgttcgaacagccgtgcccacggtcatgggcggatgtgaggtggttcccgttgcgtagatttgtttgcctgttgtcgagggaagacccccgatcgcggggagtcgcgtgacccccctttcgtgagttcggccgggggcagagactcgtctctccgaagtcgcgtgttcgtccctccgatccccggttagctagcacacaaatggattacccaggttcaggccgctctggagcgtaataccctactcctgcgtttgggattatcagtgaattttaaaaggtttccctccctcccctttggtgggcaaggtcctccttttatagcttaaggggataccacatgcgccatctctaccctccctctccatcggagggaggggagggggcccttctcgctactgcgaccgggtttcaacccgtgccttttgctggaagctaagcatcggtcggtccttgagtggggcccagcgccgtctccctcctgacacggggggcagccctgtcatttcctcataaacaagggaggacttgcggcagccctgcatcgaacgccgtccggatgtgatggggcgtacctaccgccactccactgagacagaggcgacgtgggggcacgaccgcccgtccaatcggccgtgaccggcaatagactggtcacagaccggtcgcatccgactgacaggggtcggtcgggcgcgccgcacgtctgcccccgccgcattgaatgcagcgagggacggttggggcgctgcacatttatggccgctgtcacgcccagaagtttccccctttttccttgctttaaaaatttgttaaataaatcgtccgaagaaattatcttaattaacctagagctaattccataattaataaatgcaattaataatcggaaatagcgtggtggaatttttcttgagttccccatgctccaatacattaacaagatttttagttgaattttcagagccttggaaataatttttaccaattaaaaatcaccaaagtgcaattataatcccaggaaaatccttttttctcttttttcttttcttttccctccttttcctttgttgggccgtcggcccatccctctcccgcggcccctccttcttgtgggccggcccaagccgcccctccctcctctcttgggacgccgacaggtgggccccacctgtcggtcgtctcctacctccagccgttggagccggagctccaaccgctgccgccgaaaccgccgcgccgctgccttctccgttcctcccgcgcccacgccgcgccgctcccgcgtactccccacgtggccgccctctcccccgcatattccggcccgcgcgcgcgctcgcaagtggcgggattcgaatttgaatcccccattctctgtctctccacccccacgtcgcgggcaaatcggccaccttcccggccacgtctgcctcctcccgcacctttaaatcactcccccgagctccctctctcgtttcccccatttgccgtcccctcccgtgcctcctaccgagcccgcgccgctcgccgctagcgccgccgcttgccgccgcctccggccgcacgctgccgtcgctagagccgtcgcctcgccgcgcaatcaccgccgctagcttcgccgccgcgagagctacctcggccgccgctcgctttccgtccgccgccgccggtccctgccgtcggtggtcgtgcctcaccgcctcctcgcctcggtcggccttgaggccgagctgagcccggccgatgcctccctccccctcccttttctccccttcacgcgtgcgccgccgcctttggccgtgccgccgctccggccgtccgccaccgcctttcgcgccgtccgctgccgtctccccgcgccgccggcggtcgtgtgccgtcgccgctcgccatggccggccggccggttttgaagccgagccgagccgtgcctagccgccgccgtgccgtccgatcagcctcccggccgatctggaccgtcggtcccgtggaccggcggtggaccacccgcgtggtcccggtccacggtggaccgaccccctttgagccgctgacccgtgggccccgcctgtcggcgccgccccccttggatgacgtcagccctgggtattattgcgcaataattgattaaggacttttttctttattagtaaaaacacagtttatcttctaaaattcatatctaattcatccgagctccgtttaagtccattcaagtctcagtaaatcaagaaaaatgcaaataatccattaaaatggttttgtttcctgtttcagtagtcttatagcatgttttgcttgtgtgctttgtttgtcgcgtagatttcggccgtttcgtcgatccgcggtttctcgaaggcattgctgaggtctcgtcagtgcgagagcaaggcaagtcatgcattataattgataatattgtacccaatttacaaatatcccgcatttctattaaatgttgcattcttttacaatgtcatgtgggatgggtcctattacccagccatatattatttaccttatgccattgataacttgggtatcaaaatgattagatgttggtttaggaaatgcttagccatgcctagttcaactggtacacaaatggggattacactattacatagactctaactatgagcatagctttggattggtgacaccgcaagggtgttggttaattaaaatacactgaattgtgggctgtgggtgcatggttttgctggtcgcacccatggcaattaaggaccggttcacgggaaaccctgggagacttgccgtgcttaccacaagcgggagtgggtaactgcttgatctgaggtatagcttaacccttttctaggcaccggtggcgagggtgggcgtgatggagttgggtcggccggggtgtccggttgtccagctgccggatttaccgtggcgcaagaggggaccgcccactgccttttgaggggtgggggtgaaaccttaacgtggtgtggatggttaggggagggtaatgcggagggtcttgtcacgatttccccctttacagtatcatggtgatacttcggggcatggtgacatgtgtggaatcgtgttttgtgggtatagttgtacacctctggccagagtaaaattattcgaatagccgtgcccgcggttatgggcgatcaaccagattcaccgtgattagtctcacccctagtttagcttaatgaactggtgtagttcaagtggttggttgggcctgttgcaacgcggtgtagcgttggacagtgattggttaatattgattaatttactacaattgttttactgctttcaactactgcttttaaatgctagctttatgcaaaagaacccctagcctactttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccagtttagctcgcttttatcttttccgctgcatttgtaatcttttctatttttgtaagacgtggatctgtatgtcaacaattgtcgtttgtgtaccctagctggtcctggacagggatttaatgcacattcagcttagaaattctggttcgagaatttctgggcgtgacagccgcccagcctggactcccctttcacacttccccccgagggggggcctcggggtaaaacgacgggagagcccgagggggtgacgtcacccccgaggggatgtcgtcgacccccgaggctctccccttcgccttagtgactcacgaggtatgtgggtgggaccagctcgcagagccgcgtggctggaaagggaagtagctctcctttactccacatacccccggacccatatctccgacacctgtgctttggaaaagttgttgggtgtgggaatcgtaaccagaatcagcctttgtggcagatggatgacctgagtggtcagaaacgaatctgtgtgattcaggatgtctacgggcatcatagactaggcttcccgagtggaagcggattgttgtgctgctgggcagctggactctgggagtcggagaaattgaaaaaggttctgggagccgcctaatcaagtgaaatggctctgggagccgagaagtaatgatctgacccgggaggtcggtacattaccaattgagttgttgaaaagcatctcttaagtcgatttgagacgcaagtctcttttcgacccaaacttaaaaagaaataaatcacttagtgatttcaaaatgttttcaaacaaaagatttgcaaaactgccttgcctctcttctaagcttgcattaaacacctaaattcccgtggcttgctgagtacgaaagtactcacccttactctatataaatatatatagtttcccccgccttgaagtgaagatgaagtgaagtgaagattagggtttcgtcctggttcccagccgtcgcctgtggtgttgggtgttagtccattggttccgctgctgctgctgttgttggtgtttcctcgtccgtgtcgtcggttgcattctcgggctgttctgagctgcaacctaagttaaggtaaataagtcctctatttattttaaggatttgcaatgattcatatttgtcaccgtgggtaccagcactacgtcctgggactggtaccgagatcgcagtttcgtaggaagcggttcgcgccgttattcctacgacacgctcctatcaggtgccgttgtacggcggtgccggattggagtgtgacataactattatgggtgcccttatgtcgccgataacttatttattacgtgagattgcagccatgcattcctaattaaattttaaaaaacacctctatgtcgacttacgatttttagccgtcgaaaaccacacctaaccatacgtgtgtcagcttacatgcctttcaagtaggaggtatgaatatgatgcatatgtccatcattgctaaaatgctgacttatgcctccagtctcatctctttcccttctccgcttgggcccaattaacggagtagggctcgggaatagctcatgctcatgtgttatctgccttttcgcatcaaaactaacgtacgatgtagcgttatttttcttctcaagccttttccaagcacaacaaacaatgtgtttccaaaataaagcttatacatcgtttgtaatttttgttcatcaataaagttattttactgtgggggcttcccctacagtgctttccttaaaaaaaaaagcttatacatgaaaattgcatccatgataattttatatgtagaaactttatacatactttgtacgtgcgcataaacattccattgaaaaacttcctgtaaaaaataaatttgaaacatattggacaaacttttttttttaaaaaggaacaaaacacccttgtgggcccgtgagacccatgtgtcttgcctgctcaatagtctaccacttggaattcaaagtccaccatatccactattctaacagtgtgctaatttcgtaaaagaaaataaaagtgtaacaaaatacgcagtagaaaaaaacatgggacaaaattaaggacataaagtttgacatcccacaagttcattcatacgaacttcgctgaatagtccctcctagagatggcaacggggacccataacccgtgacccgacaggtttttactctattagaagctaattgtgttctaactcttgtacccatgggtatactaatgggcaaaactcttacctgttgggtacgtgggtatgggtccgttctttacccacccatacccaccaacccgtgggtgaaaaaaaaccgttgattgagcctaaaactataagcaatataagtttcaacgactactaaatcatagtatgaaactcttttcacatcttaagcattgttccattctagttatatgaaattattacttgatctcttgattatgtaatgtggctgtataatttttttacttacctttgaactttgaacgctaatgttaatagattgttgctagagaaaatattgatggtttacaactctaatatggctaattatagtacaaaactataaatgctacaagtcaactatatgggtatgggtacccgttggataaccggtacccgcacaggtgtgggtatgaagaaattttcctacccgtgatgggtgtgggtatttaagtgggaatatttagacgtcgcgggtgtgggtatggggcaagggaatccgatggatatgcacccgttgccatcctactccctccatcccataatatagcaatctagtaccggacgagacccttcatagtacaacgaatctagacatgcttcctgtccagattcgttgtactattaagtgttccatccggtcctaagtttctatactatgagacggaaggagtagcatttcccctttagagccatagcgggaaaaacgacactccattgccctgcctcttttcttcgatggctacacgctctaaccctccctcatctattccccacccccaaagccatcgatatattccgcgaggctgtccgctgtcctcactcaggtgaatcctctgccacctctgttggtggtttcattgtggtcatccacgtcttcagcgaggttaccgctctcaggtgagtcctctgccgcttccaccaatcatgagtcatctcatcatcaggtatcgtctcccatcttgcgtgttgctatccacgacattctcgttggtgtgttgagccaccttaatcctcaattttttttgcatctccatatatattaattttttcgcgaacgcgtaaaagcattacacatcaatatattagatctatatatatacaataaacttgtcatttttttattttctagtagggagtgtgtcatcaaccgtcaacaagaacgagaactcatcgcgtttagacttttggaccgagggagtagttcactacagtctactagactactacggatcagaagaactctgggaaaaaaaagacactgaatgaaatagacttgccggcagtttgacaccatgagttcgcaggccgtgtttagttgcaaagtttgaaaaaaaatcacatcgaacttttctacacacacaaactttcaacttttccgtcatattattttaattttctttaaacttttaattttaacgtggaactaaacacacctgcagtttcagacttcttcaggtccggatagaaatatcacggaaaatgctggctcattatcattggaccgttgggtccatgcaacgtcaagcagatactcctgtaaaaaaaataacttttgggtcactcgtgtaatactagcacaaatcaaagtttgcaatgtgaaatgaattagacgaggatttggattttggcacgcttaattaagcttagctgctttttatttttagttagcacgcttttcaagcagttaaacgatatatttcttataaagacataaaaagatgcttttaaataaacaaatttattttcatttttttataatttataattaattaatcgtacgctaataatgtttgtggttgtgcttgcagctaatcatccaacacttattgaccgaaaagaacacgccagaaattgtattgtcatgcagagagcagagaggacctcaagattatctgcattcttctttttttttcactttttttttagatgtccacgacgactaaatggttggaatgattggtatcttggtcgttttcatgtttccattggccttattcaaagccattgtggggttgagtatttgtttcttgcttttcttgtcactttctttaggtttcttatatattacttttcgagaaatacgtaggaatcaatcgttcttggtcgcctttaatggatttctttttgcacgatgaaatgacgtgtaaatctccatcataaatattctcagacagggaaggattcaggcctagggcagccctaggtctaggttcttgacttcatgtaaatttcatttgaatttctaaattttgtatgaatgagtggaacatcagaacaagtaatgcaaatgagactgtgttcggaactctgttttccaaactctcccctctcgtttttcgcgcacacgctttttaaattggtaaacggtacattttttaaaaaaagtttatatacaaaaattgcttcaaaaaaatcatattgatctatttttttaaaaaaatagctcatacttaattaatcacgtactaatgaatcgctctgttttctgtgcatggaagatgggttcccaacacacacctccgaacacagtcttacttgttcttagaaagaaagaaagaaagagacttcgcacattcaagcctcctttgaaacacggcaatttttactgatccttgtaggaattgaggttatcctgaaacgttaacaattttctatatatttgtcgataaattttctcctaaaaatttgacagatgtaattacagtacaatcgtagtgtaattacactataacttgcatgtaattacactgtaactataatgtaacttgtatgtaactttcaaaaatctctctataacatgttatttcggtaaaatgaaggtcgtgggaacaaatcctctcacatatgtgtgtactgtgtttttttcttccttaccagaacatatcttataatagatctaacgattcaaaattacgtgaaacttacatacaagttacacagtagtcacatgtaagttacagtgtgattacactgcaattgtactataattacatctatcaaatttttaggagaaaatttatcgacaaatgtataggtgatcccaaagttaattgcatttgaaaattgaaagggcttcaaagttgaaacaactgtaccgcaatgcaagcagcaactccggcaaaccaaaagcatcacatgactgcgccgaaatgcaggaaaggccagcccactgacccatctcgcctcggatgatgcatcacatgaaggcccgtataaaaagcccacattccggcccattgtcgtgtatggtcccaggttccaaaatggatggaccggaaattgggctttccaaacgaggcctgaccatgatgcagcccaagtgttgccggcctggcatttttgaagccatttccaatttttggtgctcttagactagtggcaactaaaaaacatcccgaattcgcatcccccccccctgaaattcatagagaatctcacaaagaaacgtgaaattcgtattacagagcaggttgatttattcccacaataatccaagctccaaatgagacaatgtttctttggcataccaagttaggttgaaaaaaaactttgggatggatcccggtagtttgagaaacgtcagggttttctggctagctccataaagtggtggactagctagcttaggtttaaagcctcactcattctaattatttgatattaggtcttatatatagatttatagaatgaataatatgatgattatttaaaaaaatatataagatgatcaattgggaatgaagagattaagaccatttgatttgtatgaaaaatatagaaatttaggaggattttatttctatgaaaaaaaaatctacgaaaacatttgaaacaaaggatcaaatcatatcctatatttaaaattcctatctaatgggtaattctataggtactttggaggctctagattatctgtgagagcgctctaaccagtttcactctaaaatcgatttggttgggctttgactctatagaggtggaactagagttggagctttgtcaaacgaaaagtattagattagatggatagtatgaaaagtattagattagatggatagtattgtattatatccgatttgttatgttatggtaggataagattaattttcatctctatctctaaagttacttaaaatctaatccatatatatactgacattcaatacttacaacgtgtccgatgttcccagtaatcctttccctctactatcgatcttttttccacgtcggtcgcggctttttcagtgctttgactggttgactccccgcctcctcttccctccgccgtctgatcgccctcagagtcgaccgttgctgtgggccccacccctcaccgccggaccccgccgccgccgtcgccgtcgactccccgccggcgtgcaacacatctactccaccatggctcccgcccactcccaccggcgtggtgcgacggaggcgaacgagcagatgaggaggaagaaggagaaggcgcttcgagagaaggaggccggcgacgacgacttcgacgagggccgctacaagcgcgccgtcgagcactacgcccgcgccgccgccctcgaccccggcgacatctccttcccgatcaagtgcgccaaatcctacttccacatggaccaggtcagccatcctcgtctcgcccaatccaatccaatccatccccaatttgctactacttagcatttaccttgttcgctgcagtacgaggagtgcgtgaggcgatgcgacgaggcggtggagaggggaagggagctccgcgccaagaaatcgctggtggcgctggcgctgttgttgaaggggacagcgctgctcaatctcgccgactgcgcttcggattgcaaggcggcgatcagggcactgaagcagtcgctggatgagcattatcataaggggacagaggctatcctggacgaggcggagagcgccatggaggagatggaggagctggagaaggaagctgccaagcaccaccgagaaaaaggtttggactctctctctctcttttctcctcttgaggaagaagcataatcgttgatcaggagacaggagtacagtttaatgtgaggttttggattatggggaaatgaggagtgcaaatgggtaaaaaaaaattgtttgattccttgtttggaatgtttttagaggctgcttggaccttgggggaaagaagagggtttgggaatcttcagacttcagctcatgaaaaataaatagatcacaaaagaatatatacagtcttaacccaattcaatcccatgacataccaaactgaaaaatcattttcagtttaagttctcagcaccaccaccaacaacaatctgatccatctgaactgtgcacagcgattgattgctttgtactgatcgtttgttgctgttggtgttagttcagttgacatccgcaattggatcagataccttctactcatgtagccatgcatgtaggatcgcttgtcctttgttaagtgtcaagtgttctaaagttctaggaagttaattctgtgatttaacttgatatttgcaaggacaaacataattattacgagttaattacagaaaacaacatacctctagtgctttgttaagaacaccatgttttaagtgatatttgtaatagtaagcattaaaatcaccttttagcaaccaacttgccaacagaccagataatgtggatagggatgtcatgttggctgggttacagccttagaggcttagagcaagtttaatagtagaagtgattgttacctcttaactttttccacatcatctactcatcaattgtgaggcaacatatacaatacactagctctaacatactggttcccaatgctaattttattttattcatttgctctcgatttactctttatcttttctttctctggaagtttgtgtacatgttacctcttgcataagggtggctcacaggctcctcctttctctactcccttctttcctccacctcatcatatggcatctgtggcatcctggggatagaggttaaggccgtgtacttcctctagaacttgtactttgcaacaagtgttctggttgttacagtggaagtagagtaactcaaagtaagctgaatatctggatggggcttgtattgtaggactatttgtctacatcctttctttaagcatgatataaccagctcctaactagtactagtaaaatgataattgccatctcattgagatgtacaaatgccgctgctgagtatgtacacatattgcaggcaaagaacttctcagtaagaaaaagtacaaggaagcagcaatccagtttactaaagccataaaaaggaatccattgaatcccagagtaagtattgataccgctactggttgtgagtcgaaagatattttgttctttggtgaaagatatgtctcgagctactcctttttaagttttggcattcattttttatgcccttttatgattgatcacccagaattttagcgacagagctaaatgccgcatcgagctaaatgcattggctgaagggcttgaagatgcagataaatgcattgaggtagatcctactttttggaagggatatttttgtaaaggtgaagttcagttcttgatgcacaattatgaagatgctatgacaacttacctagacggtttgaaatatggcccccaaaaaacaacaatttatgatggaataaagaggtacattcccagtcctctgttatctttagtgatcttattttgattatctgaagtaacattttgtccggtttagatgtttagaacaaattaaaatggctaaggaccgtgatgtcagggataaggacttgtgggaggtattgacccatttactttctttcttttaacaagtcttccatgataacctgttgctttttcagacagaaaggaatatgtcttgcatgtgtggtcaattctagtatagtaaaactgagtcaaaagggtcacatatctgtgtaataccgatactgctcctcataacttgagagattccttagataccaaaactagttccacaagtgggagtaggattgacaattcatttgtataattgtatctgctcttgagattttctacgatcattgagagatattggtaccgactgttagtcaagatatatgtacttttgtaattgacaggaaagatcatcatccaatcatttcttgttgtcaaaagttagattgcatagaatataggatgcaagacaacattcaacatccatttactcttgctgctgctgctaagcttgctatttgcaatcttggaacagaccaatgccactgtatttagtaccaatttgcttactcccagccaccaaagcagaatcttcattgaaaccaacattcccttgtcatatgataatactttttgacattcttttccctattcgaaagtatgggatgttgcaagctattaaatacacccataaatcaaaggtatctatctgaattatttgaatgagggtgtttggtttgtgcaggcattcaaaaaatcgagttctagccaagtcgaaaaacttacgatgcagcgcgatgtcgtcactgtggagcttaagtcagccaaggagcgtaacgctaatctagaactgcaactctcagaacagataggccgtattgaacggcttctgtcgatccaaaacagtgaacctccacatttcatctgtcctatatctcaggtgagcggaaaacgatatttcaattttcttggttcatgctggtaatactttttttccccctgaaaaacactggctactgtaagagtataatctttgtaccattgtccaatgactgaccataacattacttacatacgtggtcaaaattccaggaagtcatgaatgatcctcactttgcagcggatggacacacctatgaagctgagcatatcaggaaatggctcaacgatggacatgacacatctccaatgaccaacgagcgacttcaacataaaaaactcactcccaatcacgcactgcgctctgctattcgggagtggcaccaacaccgaaacatgaggcatacttctccgcggcgccaacagctttttttgtgaatttgtgtgaagcaagttgtaactatgaaaatttagccgcagttttgatccttgctacagagagagtgcttgccgcgacatggctagatcgcaatccacattttgtaaagaaccatcattaagatttagtactaagttatgtgacatcgtatttcagatattattcttgttatatgtacttctgtatgtctcacttgtgttggatggctaaatagatgaatgatatttattggagggtatacaaatgaataaattaactgttataaagttaaacaatagacttaaaattatatattatgtatgaaattcatacatatattgttagatgcaaatagtatgctctctagttcatgtagtttcaaatattacatgaatcaggccctgtttagatgggactaaaacttttaagtccctatcacatcggatgtttgaaaattaattataaatattaaacgtagactattaataaaacccatccataatcttagactaatttgcgagacgaatctaatgagcctaattaatccatgattagcctatgtgatgctacagtaaacattctctaattatagattaattaggcttaaaaattttgtctcgtgaattagcttttatttatgtaattagttttgtaagtagtctatatttaatactctaaattagtgtttaaagacagggactaaagttaagcccctggatctagacaccacctcaatcttgcttgtagtcaacataactgattgaccatggtttctgggctgaagtacaggactgacggacacggcgacggggcttacaatttcaacccagatgaatagaatggatgcagaaaccagaatatggcaagaaagaatgtcttctggggaaaaaaaagacatgatgaaaatagcatggatgctccagtatttttttttagcactatggtacagatacaagacactacagacttgaattgcaatttattcagtactttttagtgaaaactacaaatctagggacaaatgcataatggaataatttcagaaccattctgatttctgaacatcaaacaaaacagaacaagtgtaggataagatgaatttatcgcatggagccagacctgatcatccactcaaattgcaatcagttcagacaaatatggacagaaatttggggataaaacagattacttcggttgcaatttcagaataaccagcggttacattgcaactaagaatcaaagactacgacatgacaaggcaaggatctaataattaacaagaactggtagaacatgacaagtccctacgaaccaagcaagaaccaaaggagggcggatcgcctaagcgcgctcgccgcggatccggcgcgcgagctggatgtccttgggcatgatggtgacgcgcttggcgtggatggcacacaggttggtgtcctcgaacagcccgacgaggtacgcctcggcggcctcctgcagcgcggcgacggcggagctctggaagcggaggtcggtcttgaagtcctgggcgatctcgcggacgaggcgctggaaggggagcttgcggatgagcagctccgtgctcttctggtacttgcggatctcacggagcgcgacggtgccgggcctgaagcggtggggcttcttcacgccgccggtggccggggccgacttgcgcgccgccttggtcgccagctgcttcctcggcgccttcccgccggtggacttgcgcgccgtctgcttcgtgcgggccatcgaggaggaggagaggagagcttggcgcggcggagaaggcgaggcggcggcggcgagtgatttctttggatttgagacttggcggtggtggattgagagggggggaattcgcggtgtttaaataggcgtgaaatttgggagggattcgctcattcgcattcgcgcgcagtggaaatgttcgaaatttgggcgaaattttgggtttggaattttggggaggcgcggccccgcgcgggatgcgaatgcgatccgcgcgcagctgctccaaccaatcacagtgcagagctcatgctcccacggatcgcgatccgcgttctgcccccgagatcaaatctgcaccgtcgattcgaacgcaatcgtacggcgctggttccgcgcggcaaaaaaaatccaatcctattaaaaaaattgcattttaaatttcgtttaaaatttctgcatttgaaacagcgccaaagttgaaactctgtagggctgtatgcaaaacctaagcatctgaagactggcctgcttcgcaagaaggcccaggccctcaacccataggcccatctctcctcagatcatgatgcatcatctcatcttcctcgcatgggcctatcctatgtatgggccggaaaatttaactaattatcaggcccatccatgtgaagccccgggagcttgggcttttccagacgcctggatgggaaagtattgctggcccggccatttttctcaattcataccgtacgctgccactcatcgcttaaggccgtatggaaataaaaccgccgttaaatttcctgaaaattggtcatactgtacttggttaatgataacaccgagtattattttcacaatatttttcagttattacaaacatatttgggtgtgccgaaatgcacaaataactttccttttgaaatctcgccatgaatttggaatggattttttttataaaaagaaatactaggttcctttttgaaatctcgccatgaatttgtaacattttttcatgtagtggaaatagcaactagtacatggttatggagaaagcacacatattaacttgcaggaattcttttgactacatgctgaacgcgttttgaaactccttaatattaatagacatttttttgtaagcccagctgcatgctgtagtggagggttggtcggttggagacttaagtcggtcaagaaagaaaatgaggtcattatgcccctaatggcctgattaattagaggtgaagctacgtcggtcgagcttatctgctaatcatccctgaagagccaaagagtttgtacgctgccctttggcctccatccatccatccatggctcccgtcgtctcccgcggcggcggcggcggcgggcgcgcgatgggggcgaaggagcggaaggaggcggcgcagcgcgagaaggaggccggcgacgaggcgtacggcgaggagctgtacaagagggccgccgcccactatgccgccgccgccgacctcgaccccggcgacacctcctgcctcatcaaacgcgccgcagccaacttcagcatgaacaaggtcagttcacttccaatcccacacgcaattccgcggagaaaaccgctccgattcacctcgccgctcgccgccggcgcgtttcagtgcaaggagtgcgtggcggactgcgacgaggcgttggggaggaggaggaggagggacgcgcgctgcggctgcgacgagaagctggccgccgacgcgctgttcctcaaggcgctggcgctgctcaacctcgccgtctgcgccgcggatcacgagccggcgatcacggcgctggaggggtcgctggagctgcgccccggcagcaaggagacgcgggctaagctggacatggcgaagaggaacagggacgcgtttgcggagcaggagcggctcgatcaggaagctgccaagacccaccgagacagaggtttgtgacatttttatttcttcctcttcccctcttgacgaacaaccactaaattcatccctaatcacacacaccatatatatttaaatatgtaattgtgcacatcgatcaacacacagtatgtaattgtgcacatcgatcaacacatcgtatgtaattgtgaacatcgatcaatttactctgtaccgatcactgacgttgttcagtttcaaaaaatcatctgacgttgttgatgttgattcagtcgagtccacaataggatcaggtacccatctatgtggaagaatcacgcgcacacactgctatggagtacttgccatcgcacatgcacggatttgtagtcaccggtagtgagttactactccataagcagagcagctgtcctgctcccatctgtctgttgtgctcttctgtgagtgtttggtgtagtgtgtagcgctttgcgccaatgcttctttctcctcaacgatcctgttgttgattcatgtaaaattgtaaaatgtaatgctttctccacatcttactataatcggtcggcattcttccgccatcccagcgggggaaaaaaactgtagtgcattgctaaaacacacacataggtgttctccaaaaaaaaaaaaagaatacataggtatatcttcaccaccgcaactatatcaaagtgagctggatatatgggagatatatgggacctgtgctgtttacagactgtgtagtagtctacgtccattctttaagcatgatataaccagctcctagtactagtaaaaatgctaaattgacattccattgagatgtacagatgctcatactgaatctgaatgtatacacaccttgcaggcctagaacttctccgtaagaaaaagtataaggaagcagaaatgcagttttctgaagctataaaaaggaacccaaggtatcccaaggtatgtaattgataccactacactagttgtataacaagtctaatgaaattttgttctttaattggtgaaagatatgtctccagctgctcctttttaattttggcattcatcttttcatgaccgatatgatcacccagaacttcagtgacagagctcgatgccttgtcgagctaaattcattgcctaaggcgcttgaagatgcaaatcgatgcattgagctggatgatactttagggatgggatatcttcgtaaaggtctggttcagattgcgatggccaaatatgaggatgctattgcaactctcgtagacggtttgaagcatgacccacaaaatctcagtattcataacagcctaagagagtaactttccaatcctctgttacccatattgtttgcttttgatattattatttgaggtaacatcttctctggtttagatgtgcagcacgcattaaaatggctaaagacagtgatgccatagcaaaggacttgacgaaggtattgatccgtcaagtctttcttttaacaggtcttccatggtaatttgttttgtttttcacaatgaaaaggatatgtcttgcatgtgtggtagtaataaccggtcaatatagccatatgttcgtatgctcacaaggttctcttattttgggagttatatacctcttcattacttgagagatactctccacaaaaggatgtaccgaaactaatcttacaagtgagagattatctatgttcctgagtttttctacaatatatgaaaatatagttattttgtgttagttaggttctatctaacactatgaggtatatatgcctatctatagctctcaatgacaaaaagattcttactttactacaccttttgtctaatcaaatcagtttaaaatctttacattagggatcttcaaataattgggaggcacataccttctaacatattctactttatcagcaaactaatggatatcttacatactttcagcaccaaagagaaatagaatgtctgcataaacaactgaacgaaggtgagaacaaagcatccaaggagcgctcaaggcggatgaaatctgaaaagctggtaaatttattactgttttactaagtgttatatattaatcatttatgtctgcaaagtagcttgatcggaaatatatcatcatacaatcgtttgttgttgtgaaaagtttgattctatagggtgcataacaacattcacatttatttaattttgcagctttgcaatttatcagttgcttgaatttttcctaactgtttgtcacctacactaagataaggtgcaaactagacttgcgcaaataataaactaaacttgcataacataggagttagattttgtaagtttaagttagaatattgtttgtctcacaaaaagaaaaaaaacataaatatgagtaattggatattgtcctactgttggaaaaaatagtcaattgacaaatagacacaataaccccttgatcttggtgttccaagaaatgggtgatcttggagcagaccactgccacttatatactgcaaattgcctaaggaaatatcagactttttccctaaagaaatataggatgtcacaagctattgactacacccataatctaaatgacactccctatgaatgacaggtgttttgtttgtgcaggtcaagacattgtcaagccaagttgaacaacttaggtcagccaatgagcggaatgcaaatctagaacgcgaactctcagaatgcagagagcgttttgaacggcttcaattgatccaaaaccgcatacttcaacatttcacctgtcctatatctcatgtaagcccccaaaaaaaaaccctcaaaaaactatactaagtgccataaaatacatactagtttgtttataacttttgcagacagatcctctgcaatattgctcctgcagtgacaataactagttactgcaggtgtaatattgcagagaatccccacccattttgtgactgatgactcacaataatttatgtggttaaaaaatttcaggaagtcatgaatgatcctcttatggcagctgatggacacacctacgaagctaagtttatcagggattggttccgcagaggccataacacatcaccaattaccaatgttgaacttgaacacaagaaactcgttccaaatcgggcgctgcgttctgctattgaggagtgtcgcaaataacacaatatgatgctacttttaacctctgctacaagcatcaccaaaactgttttttgtgttaagtaacgaactgaacaactatgctttaataacgaaccatgatatagcttttcaatatgcagattcggatttgtaaactgagtttgtgtgaattaaactatgaccattttgtaataatttattacagactcttggtagaccagttgaaatgtttgctcaattataaaagaaaatactctatgcaaatttagaatgccttctccacgcataactcaattgatgccaatatgtaacactaacgcatcattcagtaagaaagcgaggccactttaatcctgcagactctgattctctgaactcggaaaggcattccacacattcatttcaaatctttcatgaaaaacaggcaaaacaaatggatagatttgaacatggaagaccgatttctcattcataatcagctcaacacttcacagccgtgctgccatgcattgcaggtttgcaacaagttacattactactactccctagcaattttctggtaagctcagaccaagcgactaaatcaatcaggcgcgctcaccgcggatccggcgcgcgagctggatgtccttgggcatgatggtgacgcgcttggcgtggatggcgcacaggttggtgtcctcgaacagcccgacgaggtacgcctcggcggcctcctgcagcgcggcgacggcggagctctggaagcggaggtcggtcttgaagtcctgggcgatctcgcggacgaggcgctggaaggggagcttgcggatgagcagctccgtgctcttctggtacttgcggatctcacggagcgcgacggtgccttgcctgaagcggtgcggcttcttcacgccgccggtggccggagctgacttgcacgttgccttggtcgccagctgctttctcgagtccctgacttgcacgccgtctgcttcgtgcgggtctgtgtctaacttattatacgtcaacaaaaccaatcgtatgcttctagatctaatttaattcgatttttataaatcaattaaggatttaagattttacgccgtgttcggaagggagggaaccctcc

SEQ ID NO: 7350 - DNA, 20578 bp, Oryza sativa
ccaccctctcccctatactactagatgtactcctccctcttcccccttcctcatctccttctcctctttcagtagaccacacaaaattttttgaaaaacaaaagttagaaaaatttatgtatagaaatactatatataaaaaatttgaattcaaattcaaatttgaatcgggtatgtaaacttttgacttataaactttggatctataaactttagatgtatagaaatactatatatagaaaatatttgaattcaaatttaaatttgaatcagatataattaaaattcaaatttgaatcgggtatataaactttaggtctataaactttacatgtatagaaatactatatatgaaaaatatctcaattcaaattcaaatttgaatcggatatttgaattcaaattcaaatttgaaacgggtatataaacttttgacttataaactttaggtctataaactttagatctataaactttaggtgtataaactttatatgtatagaaatgctatatataaaaaatatttgaattcaaattaaattttgaatcggatatataaacttttgacttataaacttttggtctctaaactttatatgtgtaaactttaggtgcataaactttaggtgtataaatttactaaaataggaaagtaatgcgatgccaaaaaaggaaaccaggtggagggagggagtggggagcgaatctgatcgctaccccatccccacggcgatcaatcgcccattaggggtaccccctccctcctggcacgcaaaacaaaactcgttttgttgcatgattaattaaatattaattatttttttttataagatagattaatattattttttaaaatattttttatatagaaaattttttatatatcattataaaaaacgtgcgcgtgaaaaacgagaaaggcaagttggaaaaatggtgataaagaacaaagctttaatgatgaataaactcgacgtaaaatatacgggccagtaatttacaactgtattgggctgattacagacctaacaggatcttatggtgtatttggataatgggaaatgagaggtgggattgggattgaaatataaataaagagttaggattaaatggaagagggagaatgaatggttaagatttaaagatggcttttggtgggagggaaatcatttccataacccattagccaaacaaggccttaatgtgaagggtaaatttgctacaggacactcaaagattgtggtctttgctgtgagacacccgaagatcgtgtatttgctcgtgaacactgtaaaaaagtggtaattagctgctggacattcttcccattattttattatttccggtcaagatggagagagaaagagttgtgtaagtaccaaaatgcccctggacactgttcttcctctctctatctttttttccccttcttcttccttgcagcagagcaaaggtgcgagtgtgcgacggcggctggcccgagcttggacggctcagccacggcgaggcggcggcggggcggtgtaggccccacatcctttctttttctcttctttctctcctctctcgagcaggcgtggtggcagacttgcgtgaggcggccggcggcggagcagggggcgcggcgctggagagagggagagagacggccgacgcgatggcgagctcggcggcggagagtagcggcgcgcggcacggcagcgggggagagggggcgcgcgcaccgcccgtcctccatagcgatggcgtgtagcacgttcttgtcctccagcgacgccggcgtgccgacgtcggaccacaaccaggccacgttcttcttgtcccggaagtccagcaggatgatgaaggaggtgtctgtccgtaggaacatggtcgctgccatgagcgtgctcgtgccgtcgagccactggagcttgtcggcgtcgccgagtgcacagcccggcggctcgtagaagaagtcggcctgctcgccggtggtgcagtcccagacgccgatgccacctatagctgactgaggtcttatgatcattgtgacaggatgcaccctgcatccttaaaccgtgacagcctctgcaaagccaacctcatacacactttgctgctcattgctgatcgatcacatgatgcatgatatggccattcatgtagagaagaatccggacaagaataactactagtggatcatggtgcagttgcagagattggggaggaagaagaacactcaatgaatgtcccttgttgcccgagacgcggccgattcgcgcctgccatctccagttgtacacgcgcgatgcggaagaggtggcgcgggtcgccgggaaggcagttatacacgcgcaggtcgccgccgctcctccatcgctcatttgtacacgcgcacagcgctgccgtgcgcgacgcatcatccgccgttgggcacggcgcgaacatctgtcccgtcgccctcggcgtttcctgccatgaacgccgccacatgcagctggtccccgtcgaccggcccccaccgtgcctcgcggaaccggtctagtagcccgtaagagaccgaggtagagcgcctcgcgccccccggcaaaaccttcgcgttgctgtcgaagaagaacagagaaagagagattgacaagtgggccatggacaaacttgtctttaacttaagtttctctctccgttttcatcgaaaataataaaataatgggaggagtgtccagtagctaattaccatttttttaccgtgtctacaaacaaatacacgatctttgggtgtctcacagcaaagaccacaatctttaagtcctgtagcaaattttgtctaatgtgaaagacacagggaatatcaaacctggtctacaggtatccgtcggctgctcctggcccagctgcaggagcagcagccgccgccaccaaccaagctcgaaaatgctactaggcgcggccacgtagcatcgcgcggagagccggacggcagagcgacgcgtgttgatacggggtgggcagaaaaataccgatccaaaaagaccgagaccgagaccgagaaattcggtgatcaattcggtcctaggtagcgaaaaaccgaaatttgttcggtcaatttggttagtctcttcgggtaaccgaatagaccgaattatcaaaaaaaattgtcaaaatacaacctacaatccactatgtctaataggattaaactttaattttcacatccctacttcttctaggcatttaacctaataagagtctttacttataagtgcttacgaattttttttttatgatttttgtgttgaaaatttccattatttctttgcatatatgaaaatgttgttgaatttcggtcaggaccgagaccgaatttgtcggtcctgatattttttcgcggaaattcggtcttcacttttcaaagatcgaaaagaccgaaagaccgaaaccgagatcgaaattttcggttagactgaatgcccacccctacgtgttgagacttgtgagaggactggcgcggttttttttcgggtttccctcgttttttttctggtttttccgatatttctgcacgtatataaagtttgtatacgtattggtttttccatttttaatacgtatgaatatataaagtttatatatgcatgtacacaaaatttgtatatacatatatagaaactttgtatatgtatatagtaaaattttgttagtatacgtataaaataattatataaatatatatcatacatatacatatgtgtatatatacgtatgtactgtatattgtattgatgggttagatgggggcggaccgacaacgcggctggccggctgccggctgcagccccgcgcgcaaccgatcagccacccccaacaagctgggctccagtttggcgagtcaacgagcgaaatcaagtagtagacgagcaacagtggacgccagcaaataaaccttcacaatgtaccgtccaaatctcaaagccccgaacgttcgacgagcttcgggaaagctctatcgggcccttcatgtacaatgtaccgtccgaatctcaaagctccgaacgttcgacgagcttcgggaaagaacgaatcgttcgcaccggttataaatagtgtgctgcgaacgttcactctcacaaccagtcaaccacaaccatccgttcgattgatcgatccttccaaaccctagcttagtcgttgactcctgcgccgtccggtgagccagccatgtctcccgtacgcttcaacccgtggcgtgcggcggagccagaggtgcaaggtgtgaaaaggaaaggtgactcctgctacaacaaggggagctacgggaaggccatcaagcactacacccgcggcgccgaactcgaccccagcgacatctccttcttgatcaagcgagccaaagccctatcgggcctgggacaggtcagactcctttttctttccggcctgattgaacaagacaagggaaagggtaggggagttgtttagacggtgggattagtcgacggacttactagtaacatcttttagttcccatcccttgtttggtttaagatggagattaccccgggatttgggggagatttggcacaaaatgggcatctctggaacgtgaatcgagtggcacattctgaaacgagtgtgaattgagtagcatataatgaaatttcttccaaattgatgttcctcgcggatttaattttttttttcgagggaaccctcgcggacttgattaacgccctgttcgtttcagtaccaggagtgcgtgagggactgcaacgacgcgctgaggaggggcgaggagctcggctccggcagctccggcaacaagctgatctcggaggcgctgttgtggaaggcgtcggcgctggagcatctcgccgactgcgccgcggattacgagcaggtgatcctgctgctgcggcggtcgctggaaacgtgccacagcgaggaggcgcagattaggctgaagggggcgttgttcatgagggagcagtacgaggaactcaaaagtatggactttcatttcctctgctttatcagtatacgaagccagttgattactgtgcacattgatcgattttccttgtattttcaagatatattcctccctgacatatggtcattgaatgatctactacctccgacccataaaaaaaagaccagtactgaatgtaatatatcatagtactacgaaaatctctgtctagatttagatttattatgctagaatatgtcatatctaattatatatttgttttttttgagacggagggagtagataccactttacccaagttttactttaaaccatctttagcacatacagtagtattatttcacatcctttgagaactccgcaacaaatgttgtggttgttatagtggaagtgcagaacgcaaagtaaattgtatagctcatggggcttgcaatgccagtgtagttgtaccaatatgccctttctttaagcatgagtatatatgggtgtgtttagttcacgttaaaattggaagtttggttgaaatttgaacgatgtgacgagaaagttggaagtttgtgtgtgtagaaaagttttaatgtgatggaaaagttggaagtttaaataaatagtttagaactaaacaaggccatagtagcaagttcctgagccctacctagtactactaaagttctaaattggaattgcattaaattgtaatttatagtcattcttcctgtaacatctctaataattagaagttgtagcttctttaaagcagagttcggaatgaatttcgttattaaaaaaaagtcccattaagatgtacaaatgttacaggccaaaaacttgaatgtggtgcttatccaacttacacgcagcatctttaccccgcaaggtacctttccagtcatctgttatccttataaattttgctattattattggaactaacattttgtccggtttagacttgaagagcgcattaacatggataaaaccaggctcaacaccttgttgaaggtattctacccatttactttctttcttttaacagggatgtattgcttgtgtggttatctctaatgttgtaaaaatcagccaaagtggccacaaattcgggtaataccaatatagctcctcacaacttggaagatacaatctgtaccttcttatggaggaggtaccgaaactaattctacaagaggaaataggattgaagatttttgactctcattggtatttaagggttagttaacagataatggaaaaaacatatatacctcccgagtcccgatatctctcccaaccaaaaaaaaaacaaaccttatattgccgactatacaccttcccaaggttggaagcagtgggccaaaacggccttaggctattacgcattcttttctctttcattttaactcatttcgcatagcacatatatttttcctttttgagcacttctaatatggtggaatattatttatttttatcagcaagctaatggatgcctatttttagcatgcaacaaaagaactacaaaaaaatgaggacaaattatccgaggagcgctcaagacggaaggaatacgaagacatggtaaaaaccattaccgatttgctaaatgtcactgcattgaacatttatttttgcaaaagtttagcttgaccagaagcgtaacatcatgtcatcaatcatcctcaattgtttcttattgtgaaaaagtttgattctatagtgtataacagcattcactgctgctattccaagatatggacgagcttggagcagatcattcccatatcagaatacttttcgattacatttttttttccaaaaattgaaaactgtaggatgcagcgcgccattgagtacacctatcaataatcccgatgtatgtctgaatgatatgaatgtgtttggtttgtgcaggtcatggcaattcaagcctcgattgaacaacttacaatgaatcacgatgcagaacttaagtcagtccgggaggataaagcgaatctagaatgtcaactcttacaatgcacagagaaacttgaacggctacaatccatcttaaaccgcgaaccgccattcacctgtcctatatttctggtgagcagaaaatgatcattattttttccttttccagttcatcttattttttatatacaattttctgaaactattgactattgtacaaattgtttttttttccttcaggggattttcacccattcttgtcatccaaacaatcataaaaaatgatgagttaatatgaggagatggcaccttcacaaatgtgctggtttaaattcaacctatatcacttgaagccaaaacactatttatagtcatatttattatttttttcaactggccttgaatttaagcttaaatgtttgtgaatcaatgttacataatattctttcttgccaaaatttttaataacttttagatgtcatgcaaaacaaaatctttcctgactacacttattaccttgcttggtcaaaatttcagcatgtcatggaggatccttacattacagcggatggacacacctacgacggtgaggcgatcagggcatggctcgacgctgggcatgacacatctccagttaccaacttgcctcttgaacacatggaactcattcccaatcgcgcactccgttctgctattgtgtggtggcacgaacagcagaacgcggcacgcgaacaccgcgacatggcgtgaactacaactcggcgtttcatattgtaaaattcttaattgttgtctgtacttttgaacaattttttgctgtctgtagttacttgttagccatgtttataacacacaggttgaaattgtaggctgttagtatgccttgtacacacaggtcgatataattcatgccagaatgcaacataaacacagcattcagtaaaacagctcttaatcatatgactgtgaaacagtaccaaatatttcacaaaagcaggtgaaacaaatagcaagatttgaacatcagaaagatttcccatttataatcagagcaacaattgacagcaacagcaacaagccattacatcactactactaagcaattctggtactagagctatcacagatgaagcgactaataaattaatcaggcgcgctcaccgcggatgcggcgggcgagctggatgtccttgggcatgatggtgacgcgcttggcgtggatggcgcacaggttagtgtcctcgaagagcccgacgaggtacgcctccgcggcctcctgcagcgcggcgacggcggagctctggaagcggaggtcggtcttgaagtcctgggcgatctcgcggacgaggcgctggaaggggagcttgcggatgagcagctccgtgctcttctggtacttgcggatctcacggagcgcgacggtgcccggcctgaagcggtgcggcttcttcacgccgccggtggccggcgccgacttgcgcgccgccttggtcgccagctgcttcctcggcgccttcccgccggtggacttgcgcgccgtctgcttcgtgcgggccatcgaggaggagaggagaggagagcttgacgcggcggagctttggatttgagaaatttcgcggcgaagtcggcggcggcggagtgggttgagacagcgagggaggcgacgcgtttatatagggggaggctggggtttggaatttgagagcgcgaaaattttttgggtttggattttggccgcggggaatcagcgccgttggattgcgtgcgaatggacggtgcagattggatccagggggcatcacacggatcgcgatccgtggggggtcgagttctgcgctgtgattggttggagcagctgcgcgcggatcgcgttcgcatcccgcgcggggccgcgccttccccaaattccaaacccccaaaatttcgcccaaatttcgaacattttcactgcgcgcgtactatgcgaatgcgaatccctcccaaatttcacgcctatttaaacaccgccgaatcccaccgcctcaatccaccaccgccaagtttcaaatccaaagaactcactcgccgccgcctccgccgcgccaagctctcctctcctccttctcgatggcccgcacgaagcagacggcgcgcaagtccaccggcgggaaggcgccgaggaaacagctggcgaccaaggcggcgcgcaagtcggcgccggccaccggcggcgtgaagaagccgcaccgcttcaggccgggcaccgtcgcgctccgtgagatccgcaagtaccagaagagcacggagctgctcatccgcaagctccccttccagcgcctcgtccgcgagatcgcccaggacttcaagaccgacctccgcttccagagctccgccgtcgccgccctgcaggaggccgcggaggcgtacctcgtcgggctgttcgaggacaccaacctgtgcgccatccacgccaagcgcgtcaccatcatgcccaaggacatccagctcgcgcgccggatccgcggcgagcgcgcttaggccatcagcccacctttggttcttgcttgattcatagggacttgtcatgttctaccagttggtgttattattagatcgtcgctttgtcatgtcgtagtcttagattcttagtttccatggttgcaatgtaactgctggttattctgaaattgcaatcgaagtaatctgttttatccccaaatttctgtgtccatcttgatcctgtgaacagattgcctttgactggatgatgtgatgttcagaatgtttctgaagttattctgatgatctgaactgaatatttcggttatcctagtacttgtcctgttctgtttgatattcagaaatcaaaatggttctgaagttttccgattgctggtatggatttgcagcatttgtccccaagattggaagtagtagtgtttttctcaaaaggaaaagcattgaaaagaattgcagttcaagtctctgttatattcatacataaaggcaagtactctatacttctgtagtctgtttcataatgctcaaaatctgcaattcaagtctcggtaccgtagtactgtgtattagtaggatatacaataaacatgattttattcttagttgaaggtttgaatatcaaacctctttatgtactactgactactgagactttcatactatttacaacatctcttttccagaagatgtgctttcctgtcatattctggtttcagcaactaagtatgactagattggtgctgtgattatgctatgggctgtaggtggcaaagtttggaaagatcaaaaggtggatatgaatatgagccgctcatcaaggaagatgctatgatcttgtttgcagcttctgtcgcatggattccatcccagctcacgtagttctgtggatcagcacaagcttttgcggttaccgtttggccattcagcaatttgctgcttccacagtacacatctgggttgaaattgtaagccccatcaccatatccgcagcaagccttagtcccatacttcagccctgaaaccatggtcaatcagatcagtatcacaacaattgctgacaataagcaagattgattcatgtaatacttgaaactgcataatgtaccactactagagagcatataccatgagctttaggatggcgaaacagctcgagcgtcacagcgtgtttgtcaagatacacaatagatgcatcctgcagcttcttcctaacctcggccaagctattgttcagcagttcattgtagtaggtcactgcactgttgtaggttttcatgcaaccatatccatccatgtcattgctggtatgcgggagtttcgtgaggaatgccgggtagcatccgataggcgccatgttaaacaccataatgttgcgagcgccaatgttgtacaattcctgcgaagaatcgaataggtgagtatggaatatgcagttaattattaatctccaatctcttatctttctcaagttcagctaaattctaatttgcactatttacctgcacagtagaggagatcttgctaacaactgaagggagactttgcttgaccgtctcaatgctctgtgatcccaggttggaggtgagatcattttgaccaatgtcaattgtgtacagagcattgtgcagaacatcaggtgcaggaagttggtctgaaaattaatcttaactagattagcaatactatctctgtcagtagcagataagattgttactacttgaaacaaaaccatcactgttcagatcaattatcctaaatattctcttcagaaattcagcagaatctctgcactgacgcagggcatgactgaactgtctgaaatctgaacaggataccatcactgttggcgttgggcgagcataccgttgttgccattggaggtgagcaccttggtcctcagctccttcatctggttgagctggacagcgaggaagaaggggctgatgccggtgacgaacagcgaggtgttgggctgcagcgccgtggacgccagcgtcgcgaagttggcgccgtggcggtagccggagccgacggactgcaggtaagggctcagcagcggaagccccatcgcttgcactgagacgaacacaccaccatttccttattcagatgagcaatccatggcgcggcgagcagaggaaggagaaggaatgaagaagacgtgcttgcctaggaagtcgacgacgaggcggccgtcggaggcgcggccggcggggcggcggaaataggtcataccgaacggcgcctgctgcgccgggaaggcggcccagaagccgccggtgtcggagttggagtcgccgaagttgaagacggccgggaacctgcactgcgccgtcgcactcgccgccgcgacgaggcagcacagcgccgcagccgccgtcgcgagccacgtgatcctcctcatggcggagagagagagaagagcagatagctcgtaagcttcgatcggcgataggcgggagacggcgcgacatgccgtcgttttatagcgggagagaggaaggagatgggagatcgtggtgttgggctggaaatgtaattttcttttttcttttcttttcttttttccctttttctgagagaaattgagacggcattgcaacgattttgttttcttttaatgagagaaattgagacagcattgcaacgatttcgttatgggggagagaaggagatggggatggattgtggtgtttgttcttgttcatgctcgttgttgctgtccagtgatgcaaagctcatcctcagcagaaaaaagatagcgtggtgaacagtgatcctcgattctagatcaaacgataagttcttcaatgacatttaggccttagtgtgtggatggaacagtcaccggccgacacatattctggacttgtctgcagcaccacagtacatatgcttgtttcatacggagtatgcccaaaccagtgctttaggcatgcaaaaaggtgcactacctccgtccaaaaataagtgtagtcatgagttttcgcactcaattttgatcattcgtcttatttgaattttttttataattagcatttttgttgttctgagatgataaaatatgaacagtattttacttatgacttatgttttaaattatttttaaaaaaaatttaaataagatgaacggttaaagttgggcgtggaaaactatggctgcatttattttgggactgaggtagtaattgttagcgtgtttacttaccatctggaagttgttcgtcacgttattgaacgagtgattttgccaccatgtcaagtgacaaccaaccgtcatccacggacatgaactatccagtagtgagctccagccagcaaattgccacaggaatctggctgctgctgtgcagcacacagcgttcggagcttactgaacaacggcgggaagaaattgctgaatcgaccaaaaaggagtagcaaacgtatagcaaccaaagtttcagcaatcagaatcatcacctactggctctatatatccgacacaaaaagcaaggttaagtttatgaaaccgcttgggaagcacaacaatagtcagttcatgaaactcgtagcggaaatacgcgtacaatagctagcactcgaaaccatcattaaaaacgcgacatgtatggcgcttgccagcgtaagatggacctatacatgggggaatatgtggagagttttgttctggactatgatgtgccgatcaggtgctggataactttgtcagggtcgttgtcgtggatggccagcagttcgggaacatttgaggatgtgaagcccatctcgtggagagcgttgtaggatttcacaaactccttcacctgcaagtacataggattcatccttgtcagtttctctctcttttttttccactgtctacaaatgctcgtggcgattagaatggcagaagacacttctatctccctgagaagtagaaaatcgaattccacaaaaactaccaactggacagaatggcaatcactgttttgctagaagaagaaaccctagtgcttctgcaaatactgattgtatatagctatcttgttgacctttgaaaacctttttgagttatcaaagcaatggtttttgttcttgatgatatgttgaaagaaggtaatgataaatcacaagataaataagggaaaaagcatgccttcgctggattatctccatagttcaacacagcaaatgagacagcttcacgtccaagccccatggatatatacttgtccacaactggatcccctggagtagcctgcagaagggcaaaaataaaaataagttttctagggagatggcattacatctctacaacttcctagggtacctaacttgttataaacagctgatattgctatcatgtgaaaggatgccaagaagcgaaaaatctcttgagtatcaggggtattagtccccatttgcccaaggaactttatatattagcccttgcaatggattatcgatttttcaacaacagcctgctccctgatgttaagtacctagcactatttgtgtaatacacaatactatatggaagacaagaattatgtagatattattaccacagaagtagtgggagttgtgagttttgggcctcttggcggctgtggtggtggtggtggctgactctctatcacaaacttgctccagttggggttctccttctcagcctcagcaagaattttcctttcatactcaaaatcaaaattgaaggtactgcgaggaatttctgtaagctgtggcggcaactgaggctgcaataataaaagcaaagcacacattagaggatggccaatgatcaaatatacgagggaagtgtagataataaacgttgatgcatttaacaaagaaggatgcataaatatgcaaaatagatggaagtttgcaagatgatgccatttgtctctagaaagaacagctaggcaagcgcagtacatggaacaagttttgagggagcccattatagtatgaatcatgtctgcaagctaccaactagaacaccatattcacagtaaaagaatggaatggccaataaatgaataaataaataaaggaaaagaacaaacagaatccatccacaaagtctactatacggaataaactgcactatctatatcttctacgatgggcttctaacaacataatagtccatcaagaaacaactagaccattaagatttgtgagcgttcagaacataatagccccatgcagattgaataactagaggtgaatcctgagctaatgctactagaagtccattatttgtgaatatttgtagtggagctatttcctcatctctaattttacgcacagaagcacaaaccaatatacagagagacagtttataaacaaccatatctcctgttacactgcaacataatatcttcgttccttttcaaaagccaaaggaggataatttcagcagttcaaaactatcatgacgctatgatttatgtctgctttcaatacacaaaagttagaaggcatcaatttgaatctgaaagaacagtgtttggctgtttgctaaataaacaccaagttactccaattgaattaccaatcttaactaaacataaagggaatttataccaaacatcctgcaggcattaaaatagaaaatttggtaccaaagcagatgaacaattctcatgtaggtgaatacagcaaagtgatgactgaataacaaacttagtgacttacaggaggggttatccgatatgctggctttatcacaacttgtatgcccactgcagcaacaacaattaatgatgaataacatgctcttgataattggcaaaaaaggaaacgctacagggcagtttctaaatctggcatgatatcaacagtaaaaacagggatgttccaatatttttgtcttcaaataacttttgggaaaaaaattatatcgatgggcccagggaattctacaattttaccaacttcggctatgttgaaaacaccattaaaacaaacacttcaatgttttcactcccacagtcaatgtttcattagcaaaggtgcagaaagaaccctatgctgttgcatttatttgtctttggctagtgaaaaaacgcacacatgcaaaagccagattttctcgcacactttaaaatatagaaagtacagcattttcaactaaacaaagctgttacttttgagaactcaattttgtacataacgagaccatgtttaggcctatactgaggtcaactagaacatataaacagtagtagagctcgttcccttatccaaagacaaggtttaatctaattctgttgttgttgctgatacaagtgcccggtacgtcccctttttcattgctagctaggaagcatagcatggtgaactaactaatcacaccgatgtgcaaatgattaaatcgaggcaatttactgcatgaacaagcttggtaggtctgacaagccacctagaaaccaaatggtagtagaagttcaatgcacaactcaaaaccaaactagctcagtttcagggataaatcgctcgggatcacgatacccctccaaccggattacaacatgagatctgccaatctagcacgcaatccaatcaggtagaataagctgttcacaattcgatcgagtaaacatgacacgcagttctctcttctgcgctacccagcgattcactatgcagagattcagtatgcacagagcggggagggagggatttactcgatgtggaggacgaggcggggacggggtgcggagccgcggagacggtgggggggccatggtggtggtacggcgcggcccgcggcggctccggcgggggcgcgttggcgacgccgtgggagggctggccgacgcgcgggtagagggacgacgaccccccgccgccgccgacgccgccgccgtaggatccggagcccggcctgccccggtagtcgtagtccatcctcgccgcgcgcgcgcgcgcccgcgccggtggggctgagctcctcgggtgagagctgacgcgcctcgccgccggtggatcgcttcgccgggaaggatggaggaggacgcggttgcgggtgggggagaattggagcggagaggtggacggagtcgccatggtcggggaaggaagaaggcaacgtgatgggccggatcacgaggcgggctgggctggggttgtgctcgcgtggacgccgcttcggcccgcatcgaccgggctttgcggtgggtgggtctcggcctgcctgtgcgtcgagggtgggccatgtagggagggtgggccgcgtgatccgaagttgacgaccacggtaggaataagttcagtttaactccctcagatatatctccaatctaattcatatatctaaaccgctactggatatcttgaatcaacaaactattagaattggtgtaatttgactccttcaaggtttaggagggtcgctaatgtggcactttgatttggtctaaccttttgagtcatcctatgggacccaaccatcagtaacccttatatttcttctcttcctttccttttcccttcgtcggatcggcgccgccccctcttcccccttctgctctgcgctggaccgccattagagatttttatgggttttagggtgctgttgtagcacgaaggggcaaattttaattcttttgccacttgtcgtcgtggagggggttgtctgtaaatatgttgcctacgtggaatgccacgtcagcggttagctccagtcaagtgaggtttggactggctacgaatcattaaaccaagatgacagatctatatgtgtaatttttaagtttacggacctaagtgacagctactttcaagtttaaagacagtcatgtattttacttaaaaaaaatagcacttattcaattgctccaatgtcatgatatgtgagcaaatgggtgcttgcatttacggttaattatttttttattgataggtgatatacatgtcggcagcaaagacgttcgtagtgatttcatcatcttcaaaatatatcggtcaagtttttataaggtacttacagtatacgcgcgttatgaacgtccgtatttgtattcgtatagtgtgtttctaaaataatagtaagagtggaaacataatcgaacagaccaagtggcgaattaatcatgtctatcctatcaatggatgcatgcatgcactcttccgttaaattagcgtgcaactggcgatggcgatggcgaccgagtctggccagtctagttaatttctctctctactatactcaacttatacagatgcttacaaataatgcaattatgtatcaggtggagtggcaacggcgctcgatcgatggccttcgattcccatttctatggctggcgtttttgtccgttgcgttggctgcagcgcaggggatcggcatgggtcgtccggccaccgtaccggccgggctaccggctcgtttcgccccgcgcgcggctcgatcggcatctctggatcgttgcatgtcaccgtgcgcgcgctggcgttttgcgttgtccggtcaggcgcgctaggcctagctatatatcgatcgcgcatgcaggcttcagattgcccgggtttcactccctttctctcccagatacgcagatagttagatcacagttgttacatactcccctacatgagggtggcggatctgtcatgggggcgatagagcctcgagtactcactaccgatgttacaaccatgagagttttcattaagtttccactaaaaatttttatcatacatatattagattattagaataatgagttatagttttttataacttgttcagccctttctatgagttcttcttggatgcaagcctttgcagttttcatcccataaaaaaaaatctaagtagggagtgtagttcgagatgtgataatcttattactaggatgcatcacatctagtttgtttttattaccatccatattagtagtattgtgattgtcatatcctgtactagatttattttttataggatgaaataagtagatggagtagatcgtttggaacgttcctgtttaattgattcagttatagctaataagacatagaaatataaataaatgaccatacaaatagtttgtaggtaaacttgcatgcatgtttcattaatttgtagttatggttaaaaaaaactcatgtcggaaaatacaccacttatacggtaaaagatatctcgcaatcaactctatatttgaatttcaaattttaatttttggctctgttacgttactaacatgtttacgatttctagttttttgtaaaaaaaaaaactgtgcgaaatttattcgttcatcttttttccatgaagtgtgtcggctctatatctcgatacaagttgaaagcaaaatgccaacagttttcttctgttttatttctttaaagagatgccaaaaagtagatatttggcgtataccttctgttcccaagcgtatctaaactaaaacatgatgcgtttaatttgtccgtgctccttcaaacatgtcgctgtacgttggcgattttggcacgttgcgtttgagaggggaaaaagaaacaaatttgggcgtccattaggcggctaatcattctgctgcttttgtgattatgtcaatagacatacatatatagggagtgattgattggtttgctcgtcctgttatgtcttgatctcgtcatagcgaagaactctgctgattccttttagacctttggccggccattattagattaatttctcacatcaattaatcgtgtgtgttaattttatgctgaatggctaaatagataaataatttatactaataactattgagagcacaagcatgtgaattaactattataaagttgtaaatgtatttaaatcaatattataggaaattcaaaattcatatataaaaacccgttcaaaaatcgtttagaagcttcttgcatgttcatccgttttcacgtttcacagttttcacatcattaccttctctttcttcaagtcttatgaagctgctatatagagttatatataaggcaagtttgcatagctctgatctaaatccaatatatttagaactagatattcatagctccagaaatacatttttatggatatgtcattaaattgataatgtttgaaaaaaaccattttattcctatttcagattaaattccttaaaaaatataaaaaacaaaatattgtaacttaacttacaaactctacatcagcgtgatctaaagctgtgacaaacaaaatatctaacttgttttcggaatcaatttgttcttcaaacctctattcagggtcaatatagcagaagaaaagggtagattcttttatgattaggagtggttgaggagcgcgccgtttttacggatttgcttataaactgatgatttaacagctgtaaaatgtactcaactgttgcatggtcaaccgcgcgagcgagactgcgcacgtgacgtccgcatgggcccacacgtcggtgagtcatttgccgagaggcggtgtcgcgtggcgggagtgcgatcagctgtgccgcttacacgtggccgaagagattaaagatgagcactttgtttttttctaaaaaaaaggttaaagaatatttactgatccaaacaaccaattaaaataagggaatttaactatttgacacttttaagatggataattaagaatctgtcacccgcaatatataacatgcggaccaatatgtgagtccttaattatcacttgtaaaattgacaaaaagttaaatatctctacaatgcaatatatgacatgcggaccaatatgtgagtccttaattatccttgataaaaagttaaatatctcaaaaatagaacccaaacaatgggtgaaagaagatctaaaggatagatggtatcaagtcaaaatgagagggagacaacagtctatatacgtacatatgtaacaaatcatgagtgattaggaggttgaagattttgcaaggatccagatactataaaaattcctccttgcaattcttgagccttaagaatctcttcgtatagcttcgttctctctccctcccttttctctcgcactgcaactactaccgtatcgattgatcagtctcctctccttcatctccattaatttgcttgcaactactaccgtatcgatcgatcagtctccacctctccttcatctccattaatttgcttgttgagagcttgagatcaagcccaatggtggaagtt

SEQ ID NO: 7351 - DNA, 16095 bp, Oryza sativa
  unsure (1)..(16095): unsure at all n locations
gtggggcaagtacggggcggagatccgcgtgtcgcagcagagcgcgcgcgtgtggctcggcacgttcgacaccgccgaggaggccgcgcgggtgtacgaccacgccgccctccgcctgcgcgggccgtccgccacgaccaacttccccatgacgccagcggcgccgtcgcctcctccctcgcgcgccacctacgccggcgcggcgtccgggtacgacgagtccagcgacgagtcgcagctcgtcggctcgccggtctccgtgctccgcccaatgccggcgcgcgcaacggccaagaaagaggccaagaaagaagacgactccgcccccgatatcctcggcatctccgccggcgacggcttaatctctccgttcacatgcgacgtcctgaatttcccaccgcccgacgaggacatgtacggcggcggcatctctttcggcgagccgacaccgccacccatggtgttcgacgacgactgcatggcgcgcctcggccacgcccccaacgacgacgagcacccggtgacgagctcgtccttcctcgacggcgatctcggcgacctgccgtcgtggacgaaggtggacggcttcttcagcgacgtcggcggcgacgacctgttcgccgccgagccgttcccggcgctctgagactgacagttttgtcgcgagctttgtctacgtacgtacgtgtgcttgtgtagtgtgtgtttaattaattcgtttattattagcgattgcaaatatttcttgtgtcaccgtgagatcaccggagatcgccgagggaatacaaatatttcttgcaaatatatatcaccggagatcgccgggggaaatgcaaatatttcttgcaaatatatatcaccggagatcgccgggaatgcaaatatctctttgcaaatatatagcggcggagatcgctggcaatgccaccggtgacggcagcaaaccggcgtaatatagaagacgcgccggcgtaatatagaagacgctgccgatattatctaaccttcggatcccatgcataaaaagtgcatctggcgggttcggagataaaaatatccgactccttttgggcttttttcctttttatgttttctttttctatggttggaccatgtttcccgcttggttctccgtgcccagtgtagctaacgggccgatgtaattgtgccgtccaatgattttagacccaacgtgcaccgtgcgaaatagaataagttcactttggatctctgatcttgacaccaaattccacttggtgctatcagtctgtttctacagtggcaccgactaggacaagaaattgggctagattaaaagcccataatttacacggacacgaaagttttggcccatgttgatgaataaggtggaatcgaaccctttcgaattatttttcatagttttcaaattaggaggattcggagattaaaacatcggccctcttcattatttttttctaccttttgccatcatggcctgataactttgggacaactttggttaatcgactcgaatattacggacgcaacaatcgttttaatatatcagcaggcttatacttgaaaaaaatcagcaattgcaagcacatacgtaattaagctcgtattaattggcttgtaatttacaaattttcccttgttttcctcaagttttgcccttttttgctgtcatcgtaatttacaagtattacgccttacaaatgcacatgaacgaatgaatgggtcgacgaattttgcaagttattaattgatgattgttgtttgattaaattcaccacgcttcttcgtagtggccacaatggcggcgacggaggctgtgacgaccgacgacgcgacgatgatggtagtgtgtagtgtgtgtttgatttattcgtttattattagcgattgcaaatatttcttgtgtcaccgtgagatcgttgggggagtgcaaatatttcttgcaaatgtatatcaccggagatcgccgggaatggaaatatatatcgccggaggaatgcaaatatttcttgcaaatatatagcggcagagatcgccggcaatgccgccgatgattgcggcgagccagcgtaatatagcagtatcttatctcagacgccgtcgacattatcgcgtgaagacatggatgtatcgagcagttagatacttagatcgccggatcacatgcaaaaaaaaaagcatctgcggggttcggagataaaaacttcgaccccccatttggacctttttccttttcttttaatttcgtttttctcatcaggttggatcggcagtgcggtgattttagtcccagtgtgcaacatccaaaatccactcggtgctatcaggccatatccatagtggaaccgaccaagcctagaaattgggctagattaaaagcccatagtttacacggacacggaagttttggcccatattgatgactaaggtggaatcgaaccctttcgaattatttttcttggttttcaaattaggagggtttggagattaaaacatcgaccctcttcagtatattttttctacctttttccataacggcctaataactctgggacaactttggttaatcggctcgaatattatggacgcaacaatcgttttaatatatcagcaagcttatacttgaaaaaaatcggcaattgcaagcacatacgtaattaagctcgtattaattggcttgtaatttacaatttttcccttgttttcctcattttttcccttttttgcggtcatcgtaatttacaagtattacgccaaatgcacatgaatgaatgaatgggtcgacgaattttacaagttattaattgatgattgttgtttgattaaatttttcacgtttcttcctagtggcgacaatggcggcgacggaggttgtgacgacggacgacatgacgatgatggcagtgtgtagtgtgtgtttgatttattcgtttattattagcgattgcaaatatttcttgagttaccgtgagatcgctgggggaatgcaaatatttcttgcaaatgtatatcaccggagattgccgggaatgcaaatatatatcgccgggggaatgcaaatatttcttgcaaatatataacggcagagatcgtcggcaatgccgccgatgattgcggcgagccggcgtaatatagtagtatcttatctcagacgtcaccgacactatcgtgtaaagacatggaagtatcgagcagttagatacttagatcgtcggatctcatgcaaaaaaaagcatctgcggggttcggagataaaaactccgacccccgtttggacccctttttttcttttaatttcctttttctcattaggttggatcggcagtgcggtgattttagtcccagtgtgcaacgtccaaaatccactcggtgctatcaggccgtatccatagtggaaccgaccaagcctagaaattgggctagattaaaatcccatagtttacgcggacacgaaagttttggcccatgttgatgactaaggtggaatcaaaccctttcgaattatttttcttggttttcaaattaggatggttcggatattaaaacgtcgaccctctttagtatttttttctacctttagccatcacggtctaataactttgggacaactttggttaatcggctcgaatattatggacgcaacaatcattttaatatatatgcaggcttatacttgaaatgaaaatcaacaactgcaagcacatacgtagttaagctcgtattaactggcttgtaatttacaaattttcccttgttttcctcaagttttgccttcttttggagaataaaatggaattttaggtcatcgtaatttacaactattacgccttacaaaggcaaatgaacgaataaatggatccacagattttacaaggtattaattgatgattgatgtttgattaaattcacccacgcttcttcctggtgtcgacaatgatgacgatgatggcggcgacgaccgacgacgatggtggtgtgtagtgtgtgtttgattaatttgtttattatttgcgattgcaaatatttcttgtgtcaccgtgagatcactgggggaatgcaaatagttcttgcaaatatatatcaccagagatcgtcgggactgcaaatatttcttccaaatatatatagctggagttcgccgatggaatgcaaatatttcttgcaaatatatagtggcggagatcgctggcaattccgctgataatggcggcgagccggcataatatagcagtatcttatctcagacgccgccgacattatcgtgcgaaggcgtggaactatcgagcagttagatcaccgaatcgcgtgcaaaaaaaatgcatctatggaatctccgaacccccatttgaacctttttctttttcttttagtttccttttctcatcaggttggatcgaacgtgaggtgattttagacccagcagtgtgcaacgtccaaaatccactcggtgctatcaggccgtatccacagtggaaccgaccaggcctagaaattaggctagattaaaagcctataatttacgcggacacggaagttttggcccatgttaatgagtaaggtggaatcgaacccttttgaattatttttcttggttttgaaattaggagggtttggagattatggggctgtttggatgctatactaagtttgtcaccattcaccatacatttataccacacttgcctaagttgtggctttaaaaaagaaatccacactttgttgagttgatgacgtgtagggtcataatatatgagaaggagttttgccacaagtatggctatgaaccaaataatagactaactttgtcaaacttgcctaatataaagtgtggcaacctatggcaaactttgggagcaaaccaaacaacccctaaaacaccgaccctcttcagtattttttttctaccttttggcatcacgtcttaataactttgggacaactttggttaatcggctcgaatattatggacgcaacaatcgttgtaatacatcagtaggcttatactttaaaaaacagcaactgcaagcacataggtaattaagctagtattaattggcttgtaatttacaaattttcccttgtttttctcaagttttgcctttttttgcgggagaataaatggtattttaggtcattataatttacaagtattacgccttacaatggcagatgaacgaatggatggatccaggaattttacaagttattaatagatttgttgtttgattaaattcacccacgcttcttcctggtggcgacaatggcgacgacggaggcggcgacgaccgacgaggcggcgacgatggcggggcggtagcggacgaagaagttgttcatccgcttctcgtggaacaccttcaccttctcgacctgcacgtccatggccatgaacaccgacgggtaggtggcgtacccgtcgatcttcttgatgagctcgtgcacctcgccggcgcccctggacccgccgcgcacgacgccggcgcggcggaggatcctcacgtcggcgacctcctcgacgagctcgttcatcagttggaagtagcgggtcaccggcttgctctgctcctccagctcccgcgccaggaggttcctcgccaccgtggccagcttgaagtcgaacaccagcgccggcagccgcagcgtcgcggcgtcctccttgaactggaccacggcgcggccgtcctccacgccggcctcgagacggacgcccgagcggcggagctccttcgccgtcgggatcctcgacgtcttgccgcctttcacccctcccgcgccgccgccggcttccgacgacggcggaacaaggctggcgtgcaggcagtccaggagcgtgagctcgccgaagatggcggcgtcgtcgggtttcttggcctgttcgtccttggagaagaacggcgagtagtacgagcagaacgagcggatcacgccgtcgaaattcgcgcgcgcgaatccgagcttgtattcccggagcgccttcgcgacgtcgtccttgagccccgggatgtcgccggcggcggcgtggaccgccgcctcggcgaggtcggccacggcgagcaggtgcttgatcgggagctggttctcgagcttgatcacgtccgtgacgatgtcctgcatgtgcgtcgccttgaagctctcgtcgacggcgtcacgcctggcggcggccgcggcggcgcccttgccgccgccagtcgccgccgccttggtgagccgcgggaggaagccgacgacgaggaagatggcgtcgatgacctgcttgttctcctccgtgccttcgtcgggatgctgcgtcctcttcgccagctgatcatcctccgctttcttcttatcctcgtctgacacataatattcgagtaaattttgtcaaattgctccaaccaactacaacgctcttgggttcgtttgaactccattaaaacacttccttcgtttcaattacaagtcgtattattttttttctaattatcagcatttacaatactgaattagtcccattaaaactaacatttaatatgcttgttttatattgaaaatattgctataatttttataagcttgatcagaacgactttaatatataacgccgttgatttattgataaacgtttaaccatttatcttatttaattttttttgtaaatataaaaaaattatgtcatgcttaaagaacttgacgataaatcaaatcgcaattaaataaatgataattacataattttttttaataagacaaatcgtcaaatttatcttaaaaagttaacgtcagcaataaaataggagttaaagtatataagaaataagattgaatgtgatatttactacttcctcagtttcacaatgtaagttattttagcatttcccacattcatattgatgctaatgaatctagatagatatatatatatttagatttattaatatcaatatgaatgtgaaaatgctataatgacttatattgtgaaacgaaggaagtagtacggactatctatccagattcatatctaaagtagtgaaaaaactaaagtttttcatcatctcagtgcgccacatcatcaattaaatacagaccatccgatggaagaaagattcattttgaaccgttggatctggagtgtgtctgaggctcagtaaaattctattgtcgcttccatctcacgttcaagcaaagaagcacaggcttcaggaagcttcgcccatcttcctgtcactcccgtacttgccatatgtgatcagtgatcggtggtaaccagacaaggatgagtctcctctgatgtaaagtcagaggaactttgtcactgacatgtgggagtgacaaagtccctctgactttacgtcagaggagcgcgatccagcagacaaatagtctacttatatgatgtgtgttaatatgcatatgtaaaagtgtagcaagtcttcttttaagcatttttgttaagtactttctctgtcctatattaagattatttttagctcatcccatttatctcaaaataaattgatttttagtaataattatatcaaagtttataaaagtaaagaataattgcattggaagtagataaagtgataaatagttatattaggatgagataaagtagggatattttagtcttttgatgtttgtattggtatgtgtaggatgagtgaacaataaacttattttggaacatctgtattactaatatgcatttgtactaatttttttaccaggtatgcatatgtacaaattactccctttattttaaaatgtattgagatatatataaatataattaccttctcaaacaaactttccaatattatacttttaactactactgttttctttcgtttattatcaatacctacaaaatcgacgccatataaaaatagtcaaataaaaatctaacaatactactttattatataatgatataaaaatcaaataaaaagtcataacattaatcacatatccaaacctgtacttttaatccattcattagacaagtttttatgttttgatttttctcaaaataaaaatgccttatatattttagaatagacgaagaaaaaagttagtattcctttatcatacaataatactctattgtcataaatatataacgtttgttttttcttgagcaatctttcaaaattttttccatcaaggagatctcaacaacagggcaccgttggactgacctatatatacacatattttaaacgggtcttaatagccacacaacgcgtggcttatgtggctagttaatagtagaaaatgttttattcagttatatgtccttatattttgggacgacgtaagtatttaacaagcctctgaccttctgaaagggcctgcggtctacgtggtgaagggtcggggtggacgtgggggcatcagtaggcggcgaggttgaggaggaggtcgcgggagaggtgcctggtgtggtcgtcgacgtggtcgccggtgacggactcgtagacgagcgccgccttgacccagaagctgttgccgcggtcgatctcgttctcgaggccggcgtgcgagaggaggaccctcctcggcatgaactccgacgggttctctgcacgcatccgcgtgtacgccgccgaccccagcatccccgccgccgccgtccacgccgccatggctttgctcgtgcgtgcgtgctctggttcgatgggtggtggtggtggtggtgatggtgagtttgattgcgtggtggatgggagggaggagtatttatagcggtgtcgtggatgtggggggcgatgggcttgcagtaatccctttcgtgacgtggttacttaactggagggcagctgacgtgacaggggagaagaggaatgtaggagtactagccaatggctcctacagtagtactagcagcaataggcacgttgctgcattgcattccgccaacttttcttcagaacaagatgagtagtgattgatacacccccattccaaaataagcttatttatagttttttttaaccgtttaactatccgtcttatttataattatttttataattattattattattattattattagatgattaatttatttcttttaattttttgtatttttttaaataagacatacggttaaacgttgaataaagaaatccataaataaacttataacttattttatgacgaaaggtgtagtcaaagaagatcaactagagaagtaaggtaaagtattaggaaatgttttttttttcttccatgtgagcatttgtaatggactattggactgtgtcccttcctctcacaattactcatttttgttttacaaaaattgcattgaagacatttttccttcccaacttaatgtccatcattttggttcgtgtgttcgaggctttgagcaatgttctctaccttggtcccagattttaacacttctctaaatatatttttgtgaaccaattataaataatgtttcatctacttccttttctcaaacaattataatatttttcattcaattttaccgttatcttgatacacgtgtctaaccccataattttataggaagaaataaatgagcagctaaaaaaacagtataaaaattagtggcgaaaaacaaaatattatcctaagatcacaaaatcccttatacattttaggacaaactaaaaaagacagaatgtcaaataccttatattgcgcgacggactgatgtacagatgtagtatttgtttctatcttgcggtcgatccgttgatggctcatgaatcatttctctctctttttcgaaggacgggaatctgggttggtcactcacaaagatgaaggattgataccttaatgagatgcctggacgtctaggtatggagcactggaggctcttctctatgccattaggccatattgcccttacagcaggttaatgagataacaaggggtaggtgatcacggcatcacgccaaggataattggataaagcaacttgatttgattacaaggggtggaaaaatgtgctgcatatgcgagtgcctgtgcctgctaacacaaggcacacctgactgatgccgcatgcttccaaacactactccctccatttcacaatataaatcattctagcattttccatagaatgacttacattgtgaaacgaaggaagtatttagtcttcaccttgtgatttccaagatctcttttgacacttgacatcgcagtagctacagcttccaaacactatttagtcttcaccttaagactcaacaatacagttacctaatggactaaaatttatcttcacacaaatataagaacagcacaggcgacaaagtattaagcaaaaaagggtacaactgtaattgatgggagctaaatcctattgattccaagactcacatttcgatgcattgagaggttgcttgcgtggtatcagccacatgtgaaaccgcttcaagcatcctcatcttattcttcactactcacaagtgccattcatctgaacctgactctgcatatggtcactggaaccatattggccaagtagcaggcctacaagggtaaccttgagtgatcgtttgcaactttgcataactggttccctttccatgtagtgtacaaagttttcattccgctcatgaaagacaggaagattgagggtcctcggagaaattcgctgcttccttcaaatccatttacatgacatatggttgatccatgaaggcccattcgaagatctgttcatactgtgaggcggcatggtcccatgtaaagtcgcttgacatgcctcgcttcattagaccctcccaagaggacttgtgttccctgtatgtcgaaattgccatccgcaatgcctgcaagaaacgatgcaaatttttagtacatactccaaaagttcatatggtgtaatgcttgtgccctgaaaataccattttcaatgaggcttttattactgattctacaatgttttctcaacaaagtttgtagctttccctaattattatcttgactacttgagtacaaggcaaaacaaaactgactagtactcacattaaattgtagacaagcaatgcaaatctttccttgtcaaatccatttttttatcagtttcatttgaagtgttcaatgacacaaaatgggccctgtttccctgtttccacattcgaagtatgtaccaaacatgcaattcaaatcatggactggtcagtcgagcaatttagcaacctaagcacatatatgcttcagggttctattccccactaattccagtttcccattaacccaccaagtgctgagccgctttcttctttggatttcaatcacgtgtgttccttttctttagtttgcttgtcaactctttcttataatatttacttaaatctgaaaactaacaagtactaggagttcaatcctactggaataccagacaataaccagaactggctggaacatacgtcatgagcctcaccttgttttatcctttttacttctggcaagaatcaaactacattatgattaccggcaagaaaaatagcagtatacgatacaaccaaaatgcatagttgaaatcatcatgctattgatgttaagagggccaatagtattgatgttgtatggcatatataatgggattaaggaatggatagaagaactaaaactaggtgcaggttcaacataaacttacccacagcattttttcaatggttagtggcgagaatgcccacctgcaatatgtcccaagtagcaacagttaaattaattggttataaattgaataatatacaaaaaaaaattgaatttaattaattccactaaaataaaataaatctgcaattttactttaatgaagcattccttaccctgtaccctgctctcctttctcagcaaacgggttaaaattctccactgtatcctgttgaataaataaaaaaaagtgagcagctctgccttgggtgctgtgctgacataagtgtcacactataggaaagcttactctgaggcctccagttccatgaacaacaggcactgtaccatattgcatagcatatagctgattgaggccacaaggttcgaatctggatggcatcaacaatatatcgcaactgtacaaaaatagaggcatcaatatttcaaatgtaactttatcagcaaaattaattgagatttcaaatgtaaatgcatccttagctgacaaatgactattattggcgaagttattttgcataccctgcagttattcggtgggaaactggaacactaaatccaacccatccacgaaatttatccctgtaccctgattctgtggatctcatccatccttcaaaacctgggtcaccagatccaagcatgacctataccaaaaaaaacaaaaggtgtcattttttttaagaaaaaaagaagtattaaaaggtgtcattgatcaatcgatttcagttggtggctaaaatatgtggataaaatttttaaaacccactcaaacactactctgttttagtctccagttgaaagccagaaacccccaacaatgaagtatttgggataagcacgtggttgcagttcatcaagacatttgctgcctacaagttagatcctactgacttaataaatggtgatccttttgtctgcatgtatacgcgtcccctggtgtctgtcagaagatgttgtttagtgtacccanaatgtataaagggtggaaataacagactggctggccaagcaggtgctccaattgatatcacactggatggttgctaataagtcatacagtggtcaagttatactactgctatctttcttttatgacttgcatatgcattttttcttatagcactaatatttgcatctgaaatactagtttacttgcatatgcgttcacaatgaaagcaatagctgcatattacattccttagattcatgataacaagctatataagtgtcaatatactactatatacactaagatctatcacattcactttctagtctcacgcagaaaaagaaaacagaacttacgaattgaatattgtcccgcatgagatctggaatggcaagtttaattagatcaatgcctttttgatagtccaatcttccaataaagccaatctgtaaataaagctaataaatccaactgcccataaaagaatactaaaataaataatttcataaatatttgtatctaaccagaggcacatcgggccttataggtaaacccagctccttctgcaattcagctttacacttggcctaaacatgaattcgaggtttcataaattagtctgtgaaagaaacgacgaggtgcaaagaaaaaaatgaaacgagatgacaatctgtatatacatggtactatacttcacctttccggacaggtcatcaacagaataatgataagggagaaacttgtctgtggatgggttccaatcattaatgtcaattccatttacaattcctacatatccagggaatagattgaattaatttgtatcatccaccctattacaatgatcagtccaagaacaaaatataaaaacccaaatataggtaccattcaatacactcttccgggagcttaagagctcattgaggccttgcccaccttcagcagttgtgacctcccatgaatacccctggtaatgaaacataaatgattccttaattgagtgcaagacaaaatgaacgaagaatttgcggtttaaaagccaaggcataaaaatagactaggatgggaaaaaaaaatcaactctaaggttaagttcaaatttcaaattttgactgtggccgtaagccaactagtagacgaaaaggaaggaatctcacctggctgacagtcacaattcgatctgctgtcacaactgcgccttttaaaaaattgactgcctcacccttgtcaagggcatgccgccttgcccactctggaaacacccattctaatgctccataccattcaggtggcaatcccaggtcaggatatgtactggcaggctccacaccctatcacattgaaacacaatgaaatactaacatactgcacttacaaagtgccattacaaaactacttaaaagatatgcaaaatgataggctcaaacctgatgtgctagattatgtatgacaagaacactgcgggcatccctgtaaacaccatatggtctatattttgcagcaagaaggctggataaacaagataaaagttatatttaaattgatatgtaaggaaaaccaatttaacattcagcattgaagtaaaaagggactaaaaaataagtgtgatgagtttttcactggcattagtatcttatccaccgtgaggaacatgccaaaacaaaggagtagcaatgtagcatctgatggatcaaaccatattcataatatgcagcgaaagacattacaccattaacctcatgttgttctgaagtgtcttagaagttagaaagcatgtaccacgcactctcttaataattataacatcaaattatggtgtgaaacaagcagtttaaatttaccacaaattagagggttgcaaactatcacctcagtcacctagtagcatgataggccatttagactacaggatttttcccaaatcctttgggtattgaattgtatctgtagaagatgaactcaaaataggcactaccataataagaaacttcgcactagctcagaaatattccaaaaaaaacataggcagggagattttcagatcagctatgaactagtgtagcacaaaactaaatcatttaaacacataaatgatgtactggactgttcatgtttttggaaatatcaaaatgattgagaaaataatgaaatgaatcgcagttctcctgcgcttttgagaaaaaaaatgattgagaaaatcctcctattcactcaatctaatattttgttcctcttatctaacatagacacacacaaacacaaagcaaacgtatgaaaaaaatggtttataagagatattcaatgttaatcaatttggttgcagagtttcagatccagaacatacactggcacaagactggcatgccaatcattcacaacaaacatgcatttctgtccatagatatatcctcccagttcaagaattaatggggcttcacacgccgcatagcacaggagtgtgtatctgaactgcagtatatagggaagtcaagtcgaatcaatgactcaatgtgatataatttagactggtcaaataggatcttgatgtaagaatacctgattatcgccaaaagcaccaaaattatctccatacaaatttccaggtctatgatatgagggatgatcaacaaacacctgaacaggagaagtgaggtgtaacaaaaaaataagtacccaaaatgcaggtatgctttctacaatcagcatgttgtgtcatgggtgatggtgctgcggagtgaacactaccaagttccaataggaataagtaaacatttggtaaactcaacaaggaatcaatcttgcaaccaaaaatgctagaaatgtttcctcctaggttatacacatccttgttccttaatgattatcatgtcatgccatctacatctattaccagttgtgacaatacatgtttcaatgtaacccacatgttcactttcaagaaataaaaatgcgattgaagtacataattcccatgatataactacaatgttactgatgactattaatgcaatggaaaagccaaacagtacaacttattaatattaagtgcttgttgcaaacagaagtcacaaatgcttgagacataaaatggatacattaagtcatatgaaggaatcttttgcattttgatctggaaacaccagacatcaaccagtgcacaagtgtatagacagtaagacatagaaacagagtacagaatatgatatgatcatgtcttcagtgggataagaacaaaaaagataagcagatagttgttttcatcagaaaatagtaaggagattgaatactcacccaatcaacagaaatcctatactcgtgaaaaaaagtaacttcatgttctccgccaaagcatggaatcttaatgtgcttctcagtgtaaaatgcgtttgcaaaatttttggtcaaggccccgttcatgtatctcggcattacaaccatcacacgatgaccacgaagagcaagagcaattggcagtgaaccacaaacatctc

SEQ ID NO: 7352 - DNA, 25066 bp, Oryza sativa
  unsure (1)..(25066): unsure at all n locations
cattgctcccttctgccctctaaataattggattttagagaggtgaggtgaggtgagagtacgtcatataatcaggaaacacatattggtggcagcccagagaatccaacagatagcgaggtgggtctagtgataggaaaagcacatattggtcccaggcgcccatgtgattgtctaggtacacatggaccgtccacagaaaatggcgccatcgaccacaattcagtgcaacgaaaattacgaaatgctactgtcactctacagaaaattcagttgacggctgagaattgaactcccaacttgagtatcgcatatactccgtacttgcctaaggaaaagacaaagtcgtcaatttactcagtttccaacgcttcctacaccaaacctcaccattcctcttcccactaaattacgatatcaaatactactacatcaatggcgtgtctgctcaaacccagccacgtgcacaggcctcgaaacctcccaggtgcccaccccatcgccacccccatcatatcgcgatccaataaatatatatattgtgtatatgtgcagtataaaaattgttagtgatgtgctcgaattggggttccaatttctcgcgtggtaattaatccgcagggtttgttcgattaatcaagtgatcaaaggcgcgcatggaactgcacggatcgggcattgatacgggaggagagggaggatcagcacgagacaagccacgtaccttctagatcgggctcgatctcccccacgccggagtccggcaacggcggcggggtcggcgccggcgccggcgactgcgtgggcgcgggtggcgtcaacgtcggcacgaggaaggtcggcaggaccggctgcttcaccagcggcgccggtgccagcgggcgctgcgccgacccaccgtccctgctcagttccggcacgcaccgccttcgcacccgctggagccgcaacctcctccccggcctcacctgcggcgccaccaggcacgccgccccgatccccatccccgccgccgtcgccatgatcccccctcctctccgccgatcctgctgctgctgtgtcgggcgggccgcgcttggcgggcggtggtggtggtggtggtggtggtggaaaaaaaggagtgggctgagtcgcggagacgatgagagagagagaagaggtgggtgtgtgggtttggttttaagcgagggagaggcgctgaggcggtggggcacagcaaaaacggatcgcggggtggatgagctggttcgctctcgctacgcgcgtggcgtgcgcgcgcgtcccaccgcttccgttccttctctccgttgcttcacgctaaacgaagaaatgtcatttcgccatttgcatttcacttcacaaattcaatttttataaatcacaatggaaaaataaattaaactacaactaatccttttttaaaaaagggtattatttatccgatatgtacatctaaccggatatatataattgtttaaattgaaaatttagctctcaaataactcaatctaaaattcgttcaaatggagatttgaacgtacgatcttgaggcgctaatcaggttaatacatgttctttcgcaaactataactaattaacgtatattcaaaattatttttttttattttttttgtaaaatgtagaaagttaaatttgatcatgcaatgttatgggtttgtgaagtgatatattacatcataaactatattattgaatttttttaaaaaagtttataatgacatctatacctaataaaaaaattcgtaaggtttccgtatggttttttcgtccgtcatccgaatcagaatcatgttgctaaaattgttttaatccgctcaatagtcgggatggatccttttggatctacctcaaaactaggttaatataggatatgtattaattgatgtaacatgtgatcacaagtagcagcttgcctacttggttagtgaagaaaatcttcattgtggccaccagggttcgttcccgccaccctcacctttttactcttattattacaggctttggcccatttaagtttctctcctacctattgattcatttttctttatttgtttttttttcgcttttttcttgggaaaaaaattcctcccgacgctttatctttttttttccttttttatgcggtaagttaggataataacaggtagggaattcactaaaaacaaagttcaatagaaaaaacacataaataatttagttaaaacttttaaaagaatagttgaaaatttcaaatatgtagttgaaagttttcgaaattcgagttgaagtttcgaaatcttaagtgaaagtattcaattttggtatagcttatttttttataactttttaattattaaagtaatttttaatttttagtaaaaaagagaagaagtaaagtagatggtaatactggaaactaattacgtaaaaggaaaaaaagaggtgcgaaaacagaaaagaggagacacggtagcaaccaactgtgcgaatttttttttcaatttttatccgactccttgcgcaagaggtgcgaaaaaatagagaagacaatgtggcaaccaactgcgtgaaaaagaagtctcgaaacaaaagataatataaaaaaaggaaaataggtcgcacgcgactgtgcgatggatgggctcaaaacgcgcaccacttaaattcgcgacgcgtatgcactaattaggagttttgtattattactcgcactgtctatgggcctctcctaggccagattgacctaccctacctaaaacttttacacttattattactcggaataagtctactttgtctccatatctcaaatcctatttgcgtgcaatttttttctctccgccactagcacggaccatgcacatcctttttttttctctccaccattagcacagaccatgcacattcgatggctgaaaagtcaaaagttttatacctctttcttcaacagatatttagtgattctgaaatcttataatgaaccagtttttaatttgaaaattaaacataatttttttttcttttcgtcatctgcaaaacacgacatattagagtccgcaccatctatcgtccacgcatgagctgttaagcgattcgtctccacgcgaatccgtgttggattttagaagtaatatcatgcgcgtgccatgcaagagttgagagagagcttgtgttatgacaatatgagtactatatcaatatgcaatggtgtttcttattagtcttgattatcattaacccaatgaacaatttatctatcttgaaatattattacatacatgttaaccgtgtatttatagcatttaaccttccattatacccgtagcgaagcacgggcattttgctagtgtaaatttacatatggaggcaggtgatgtccacttgatcgctttggcccgttggtttcacggtttttcaccgagtcaccggggactcgtgactcgtgtcgtgtcgtgaccccgctttacgtggcgcgttgccggatcgcgagggcgtcctctgcgtttctctctctctctctttcttttttgtttgggcttggttgtgttgggacgtgtacggtgtgtcctgtgttctgtgtgtgggctgtgtggcctttttgtcagcttgttgagataggttgtcaaaaactgagatagactttgcttgattgccttgtttttgcttttgccagcttgtttcagctgggttaacgtgattgttctagctagattttttgcagggggtgaagtgctgtgttgcactaatgatacagtggttacaaaagctgtgcacagattacaggtagtaccattggccatgagtgagagtttggttcatttgtatttttcttggaagccagcatgcagaggcctaaactatctgttgtttggctttaattagactacttaggaaatattacaatcgcatattcgcatatcaaccagctgtgaaggtgtttgttgctaatccttcattcattcatattcccagtttaatacgtgagatagaagaaccgaagtctcacgcattactctaaccggagtttaaattaattaagctttacttattttagtattcaaataagtgccaaatacttatccgcatgtaaagtttatttcattcacattagtaaatgtcgtcattgtcaagtgcttgtgacaatcatcttgtaactcaatcacgcaagtaattttactattagatcatgaactattgagttgcatgcaccgtacgtctccctcacgcgaggccccctcaagtctctagcgtggaataaaagtatgctgaaatttttatttaattgcacgccagccagaattcgaactcgagacatttagctctgatactatattaagttgcatgcatcgaccagtttaacccaaaagcttaagctgatgagtaaagacgggcaatttactttatattccaacatggaccgtacgtttaattgatatatcgagcacgatcaataatcaacaatgccacatttcggtcttgtttagttccaaactttttcttcaaacttccaactttcccatcacatcaaaactttcttacacacgtaaactttcagctttccatcacatcatttcaatttcaaccaaaatttcgatattggtgtgaactaaacacacccttcattgcatggtagagtatgtaattgaaaaaagaaactactcctggctaaattaaatcgacagcgatgggttacatatatcctaattacatactctaccggctgatcgtccgcgactggtgagttgggccacagccaatggcaccggagttgtcgtcggcgccacgacgacgagtaccaccatcgccgccggcggcgggcgtagctgctcgcaccgagtcgatcatcgtcttgatgacagcctgcgcggggaggatgacggtcaccctgtcctcccggagctcgcggatcttgtcggagagctcggcggcggtgtacgggcaccggtcgttgtcgatggcgtcgatcagggccaggatgtaggccttgttgccggcgatcgacttcttgttgctggcgacgagctcagagatccaggtgagccgcatcgccatcgcctgcctctcgtccatcgtggccagcttctctctcatcctcatctcgtcctcttccatggctggctaagctctggctgctcgtggcttctgcctgctaggctgctagagtacgtgcgtgcgtacgcgtggacgatgagtacgttgaggactcttgctgctgctgatgccgccgcgatgagaaaagtagacagccaggggtctggttatataggcagcaaggcacgcggtgagcngacgagccagtcgacgattcggagcgcggagtccgtgtcgnaaccgaaaagagctcggcacggattatgttgggctcgatctgtttagaatgtactgggctaaggcccgacgcccgtatccgggccgccgtcaggggttagaattttgaaaaagtatatactccctccatattttaatatataacgccgttgactttttaaacaacgtttgaccacatgtcttattcaaattttttatgcaaatataaaaatacgtatgtcatgcttaaagaatatttgatgataaatcaagtcacaataaaataaattataattacataaattttttgaataagacgaaaggtcaaacgtttgttaaaaagtcaacggcgtcatacattaaaatacggaaggagtacgaggttccttatcttgtcatccctcgactaacaaatccgggttagtctgtgttcctttgaaggggttgggaatccctcccctccgcacgtaaaacggagcgatagattaaaacatgattaattatgtgttagctgtaaaaaaaaacttttaaaatagattaatatgattttttaaagcaacttttatatataaactttttgaaaaacacgcaccttaaggttgtcagtatcccgattcgtattcgaatatcttacgatactacgatcctatcaagccgaaacgataccgatcacacatagaatcctaattttcataatatctcgatcctactattcattactacacgatccaacgaaatcttaggtagtatcccgatgttagggttacagataaggcataccttctatcctacgacttatggaatatacgaatatggtataccttcacgtatacggatcgttcccgtgtacgtggtagaaatccgttccaaattatggaaattatctctacgagtcaagcgatgtccaaagtcctactcggaaatgtatagagtttctgttataccgtaccagatcaaatatcctcgaatctttcttaggggtcaatacgatccacggtataaaagggaccctcaaggaggggtgtgaggacatccaattccatcgccaacacacccaccatagtttacgaagccggagtgcgcggagccaagtcgccgggagatctcgtcgaactcatcgactacgatcttatcggtatcatccgtttcgtctattctctttgtaatctgttctcaccatcatcaatctcatataaactggactatggctattacctgataaggggcttgagccagtataatccttgtcttttgtctgcttgatgttgtactacgtagacccctgctccaacgtaccccaatactcaactcatctggtccgcgagtatcactcgtcgacacccgattctacgatccctacgacactacaaaatattatttaaaataacatggtttgaaaataatgtaaataaatatgctcaaatttatataaaaatcagttaaatatatcaaaaccaacgtggtttttctttgataaatgtctctatttgcatgacatatatcattactacatttattttatatagaatggctatatataattaatataaatattaattaaacttaaaaaagaaaatctcatattattccgatactacgatacgatattactttaaacaaaacgatactacctagtatctcgatcctgacaaccttggataagttaggaactaggaggattcttagacggttttaactcggttttatctgatatagcagctgagtcagcgtggaacccacatatcaggaagaccacatcatcaccctctttctcctcttctctcccttcctcctctctctcactctcctctgggcaagtgaagtctgccgcccggcggggcgaggcggaactcctccatggtggtgcgcggaggtggaggcagggcggagcgctgcggcggcgaatgcagggctccggctgcactccgccgatttctcgccggagccgggccggagcatggcggtgggcacggacagtggcggatccagaaaatcgattcgttggtgtcataacgtgtctatcggtgtcatagtatgctaattatgtttagatcatagtgttataacatatggataaacagttttgctataggttttgccgaaagtcgtcggtgtcgcctgacaccgggtctagtactgtagatccgcccctgggcacggaggcggaggcggaggcggggtcaggctccgtggtggttggcgcggaggccggcgccacggaggtgaagacgggcgagagcatacaggcgggcgccacggcgacggaggcggggctccggcggaactccgccgtcgagacggtggctttccaccgtgctcacggcctctgcaaccgccgcctccgcttctcgcgcgttgttgtcgttgccgccgccgcctcctctctccttcctctgttctccttcctcctctctccttcctctgttctcgatttctatgtgggctcgaagggaaggctccttatgcatatacggtgttcgatgaaatgtttatcaggtatgatttgctgttttcatcgcattttcgccgcccttttgaggatcaatggatcatcagatgataatgacatgatctacactacatcgcagagaaatgatcggcgccctcgacgtcggccggttgatggatcgatgggctcgggcagcccgtggcgtttgtggccggcgcagttgcagacgaacaggaggacgcctgacagacacagcctctctggagtgatgacctcattgagcagaacgaggccccacctggtcagtgggacgaccaggacgcctctgccgtcgggcggtgacgtcattgcgcaggatgaggccccacctgtcagcgagcaggaggctcgtgcaccttttaaagtgctcgccttggcgctcgcccagagccccaagccgtaaccgactaaccgtcgagctcctcctacctgcgtctcgcgccgccaagaaacccaagatcatcccaccgcgcccccgtttccgcctccgcctccaccttcggcgttgctcgccggagcccggaagcgatggagcagttccacgacagggaccacgtgcggctgcggagccgcgtgcacggcacgtacctccacgccgatgaggacgggaggggcgtctccctgcagccgaccggggcatcgctcaccgcggtttggacggtgcacctggagggcggtagcccccagcgccgcctcctgctccacagcgccgcctacggccgataccttgcggccacaggcaagccggggccgagcggcctccgtggccaccgtgtcgcgcttatcaacctcgaccggctggacgacgagtccgtgtcgtgggaggcggttcggacggcgaaaggagatgacgtgctgctccggcacgccacggggcgcaacctacgcgccaaccatggcgctggcgccaccgttgacgatagatacagcaggatgctgctctgggtggaccaggtggttgaggccatcccctcggcagattccgtacccaggcctccaccgatctcaagggtgagcacgctacaccctcttccatggtacatcccgaattggttgggggcaggggagcgattctttagcccattactgcgttacctaggttcttgcagccaagctccatttctggttgtattcttgcgtcagagttagcgcattagcagagtttcatcaattgcattgttcttgatgaaatccttgttgtgttcttgctagatttcgtcctttgttgttaatcatttgcaatgagtttgtggcggtgagattttttgtgcaattttggcttagggggtagattgagttcatgaaagtggttgttggttccatctgtagttcttttggtcgaggtgctgaaaatgtgtaacattcttgttcttttaggaacttcttgaaaacactttcattttctgttcttgtgttatccaaatcctactaattttcagagttcataggcaggttggcatcacataaccgttgctgttcgtgttgtcttgcattggattcttcaacgtatatcctgttctctctatctcaactaatttgcggcgaatctgtttcagcgccaggacgggcctgagataagaaccatccggtttgtgccagcagctcctaatgggaccattgccgaggattggagaacctttcaatttactggaagatcagttcagcggttaaaggaagagattacaagccgtgctggggaggcaacccagtactgtgttcaagcaggccggtacggacgtcttatccctttgacacatgagcttcctcacaacactgagaccattgatatcatcattatgatgactggtactacaggtgaggagtttcccttttttattttcatgttctcctcgtatttttggtgaaagaggctcgcttgaatttgttgcactgagctaggtcaatagatattattgctgctcttactttttagttgtgcatgatgtcttaagtttgattctagtcagcaaagtgttataatcttctgcttgaacagatagtccttgtctggttagaaaaatatataaaaatctcattctatagattatatgctcaaggtagtttatacagtattgaattttgttgcgcacttgcgcacattgcactgagctaggcaagtagatacagttgctctaccatccatgcatatttgttcataatattattttagttaagtgtaatcatgtgcaaacgtatgcttataaatacaggcatttctatataccagataataacaatcagtattacattgcagatccccacatggataatagcccaagaacacaactttctgctcctgagtccttgggagaacatcgtgttgctgacattcagacatcatactcgcaccgtctgcatacaaacaatgtacttgagagtcagcaacggaaaacaggtataacacgagctgaacttgaattgaaaactaggaatatccactggggagatttgaatttggaggaaaagaagaggacaagaaaggagttgaaagcagaatacaatgaactcttagctgcagaaaattgcatcagtaaatcgcaggaagatgatgtaattacaaacgaaaattatgaaagagcgtcactccgggatccatgagtccgaggtaaggagacaggagtagaacctgaaatcttcagaattttttcgctccctcaggttccaaaaataagtagctattcagagtttggcttgttgattttcaatctgcgtaaagttgctaaaatatggcctgaagctaattttatgattgggaacaatgacttgttagttgcatgcacactcatgctaaatcctaacatgaaaaatactagttttatattccagtcttcagttaagaaaattgagttgcttcttttattttcatgtccagaccatctgtcagctccttttcagtctaagaaatagtgttagattaaggcagtcttacatgcattgcacatactttaaatataaatagttcacttgtactgctgtattgtatcatacaaataaacaatagacaactccattgccattaaatcatgacaacggcttcagtatgctggtttctagatgagttatccctgttgattttagataatttatgaatattgaacggcttgtgagttgtagtgcctgtaattaacttgtctttaatttcttgtttgatcattgcaaattcagctgctgatggtctgacgagatagaagtcacagaactacaatagcagaacctctgacatcatctcttcagtaattttcgtatcttcagatcaaatgacagagattggatgtcttcttgttgttcttttttgttgatataggcttagaaagggaaaccataaactcttctttgctctgaagtttacagaactgttgtaaacaccaagtactagaatgtatgcatgaacaactgtgcgttctggcatttgctgtagtttcctactttccttggatatctgtatataatatgattgatcataaatttgcggtgtggaatgttatgctctatttttgacaactgaaatgttatgatcaagtctgaatacaaggcaactctttcataacctgttcctgtatttttatacagatgggcggttttgatttccccccttcttgtctgtggcaatatatccatgtaacgaagaacaaagtggcaaatcctttgccacctcacctctccggagtggcaaaaagttaaatatgccatttgctgtagtgctctgaacttcaacttctgaagcaagtaagcagaatgcctgaacaattttgtgctgtgacaatcttttgtcgggaatacacaaaagatatgcgtattattgaattacatttttgtgatgtgctgtgacatttgctatagtctccattttatctgtatgataggaccgaccatccatacatctgctgaagtgaatttttaatgccaattgtaaatgcatgaggtaactctttcataacctggtcctgtgttgtcattcagaaatcaggtctgttgtgttaacatgcacagagaaaagaagggttagtaatctcggactgtccgacattagcttttcggtacaaaattgtctccccagaactacttttttttaaaaaaaaaaactctaacattatacatcaaaccttacagaacaattcgatactacctggaaatgaggcattccatgcttcttttttttaaaaaaaagaaataaaacaaaacagaacaactcctaaatcctaattacatgatcgcgagcaccatgggacgaagcgcgggtgaggatggctcgcacgtcgtcgagcatctccttgatcccgtccagcgcggcgtcgacggcccttgactcgcggaggtcgcggatctcgtcttggagctcggcgaaggtgaaggggcatgtgccgtcgtcgatggattcgagcaggtcacgcacgtagcctctgttcctggctatcaaccgctcggtgtccgcgaggaggtccgagatccaccccagctggatcgccaccgcctctctctcagcctcgttcatcatggccctatcttgaaatgaactagcagacgatgatgacgacgatgacaacgacgacgactcgcgctgagatggaacgaacgatgagacgcagcagctgagaccgggagttcggttatataataggcgccgtgcgcacaagcgacgaatcggaatggggagtccgcgtcggaatccgaaagagccgttgaatccgacacggattgtgttgggccgctttctgtaggatgtaacgggccgagtccggcgagactgggccggcacggcggataggaatgcagatgggttcaaccggctccgatcatccgatggacttttggtccgccgacctcggtggctcgatcagaatgtttttttctttctgacatctagtgagaattcgttatttagttatcttctttacggttgctagctgttacttcattttttttcctagctgttgactaagagatagtctgatatgagctcttagttaataaatacttcatccatcccataatataaggcgcccatgcatttcaagatttcatcttcataatattttgactaacatttagtacaatatgaattgaattttacttactaaaaaattatatcattgaattgacatttaaatttattttcatatggttataattttgttactacaaactttattatatatgagaaattataagataaaaattagttttgtagaccgtgtcaagtttgactataccttgtattataggatatagggagtactcacttagtgactattctcctataataatagttgagacaacaattaaattttttaaaaatgttgagacaacaaaactttttaatcattaattccccccaaaaatatattactcttctttccttttctctatcccgtgcaacaaaatatcatttaataaatgctaagattccccccaaaaaaatatattactcttctttccttttctctatcccgtgcaacaaaatatcatttaataaatgttaagagtcgcctatgagcttttgtaggtcatatttaaatgtagagcccatatagactcttagataatgcatgtttattaaagactatatccttacaatggtagagacaccaaagactctaaaccattaatccacaaatattatctttttattatggttcacacactcatgcaacaaagttttcattttatagaggctaagagtcgttaagcagttgttaaccgtagcaacaatgtctgtctcttcttgcttctctctcttccatctaaccaaattcaattgcatgttaacgtaaagagctcgttaataagaatcttgtacatgcccttgctgtgaagtttacaaactgctgaaatttcaaactactaagtagaatgtgcgcctgaacaattttatgttctgacatgcgctgttagtttcaatggttagttttttagttcgaatggttattgtgcatgataattgatgcaaaccgatcatccacccattccagaagcgaaatatacatatcgttcaaaaaagaagcgaaatatacatatgctcaattctccaattgtaaattaattcatcaggcattgcctgtgtacctttttcactcaaaactcaatttgtcccaacataagtacataggacttgaacccagaaagaaaaaagaaaatcaatccctggcattgaggtgggcccgcccctggacggctggatcagatcgacgggcagacatccaacggccttgattaaactggtcttttttttttgaaaggaaggcaagaaatttgccttatatattgatagagaaggaggattaaactggtcttgcccctgttctgccttacggacgactacggtgaagaccgtcccggactcccctgtccgttatccactccgattcgacgatgatggttcatcgtgtcgtacgccgcggcccaataaaaacagcatgtaaaaatgtaccatcaaaacgtgaaaagctgcagcagcagcaggaagaagaaaaaaagacgccggccgaatcgtcgacttggcgcgtgttccgccgattcgcaaaccccgctcacctgcaggctgcagcatcatccgcagttcccgtgtcgatgtcgacggcaggttcgtttactatcaccccaatccttcggtttttaaccagtacaattttgttttttctatataagatgtactccctccatataaaaagtctaagacatatttcattctttgtttttttaaaagtctaagtcttatttgtagtcactatgtggtaattaaattgttgattggaaccgaagtcattttatattagtacttattggtttcatgctcattggttttatcacatggtgaataaattaattggtcattggtcttgataaaaaagaaatatgccttagacttttcaatgatggagtatttggtcaaaaattttcctaaatgggttattatatctttttaaaagatttgtttcccataatgggacataatttgatttaatttgtgcgggcccatctattttatgtgcatttagctgaatatcttcgaattcgtacgagatatgttacatcgtgtatgtcttctcagactcatgacgttttccgccctacttctacaattactcgtgcttgtctatttgtccactcgtgacggacctatgtttttttttcttttgtcctgggtgtgctcacatagtcccaatcagagttattcatatacacaaacacactaaaagatcttaatttatcaaaagtacattaattacaaatagtgcaaataaagtcttacacacataacgtataaacaatgaaaacaaaatatatttgtgtatgctttttatagcaaatatggcttgattacatcatgattagtgattcatttctaatcttaggaaaagctatatgaaggtgctaatctttacacacttgatcctcctcatatttaccttactaaaaagaaaaatgctaagatttccatacaaaattcttggctacccatgtacttgaagtctagaatttacgtccccgaaatgtttatattgagtaccaaatttgaatcatataaatacttatatttagcaataattggagtaattgaataaataatgtaggtcaaaatttaggaaaaactcagtagtgtcatatacgctccccccccccggccattaccaaatagcatttgtagtattcaatttttttaatataaaataagcattttttttgggacaacgattcgccaagcattttcagccaataagatagaatttgtagcatccaatcttttatacaaaataagcattttgagaacaatgattttccaaacatttttcagctaataatatacttagaagggaaccaagaaattcaaattcaacccatgaagtgactaaaaggatatattttctcgtatatgcgtgcaacaatctaaaaagttgagaaaattttctacatacccctgaaaagttttgtaatctcttctacgccccttgaattttgcatcatcccctacatgcccttgagtatttattttgatctcttatatccctactttgttaattggctgttagatttttctaaaatgaccatatcgcccatttcccatacttacatggggtctacttcataatttacaatgtgaaaaattgttattcctgataaaatcaaacgggggcataattatttattgtaaaattcgaaaaagaaaatttaaattgttgaacaaattattttttgacaattttagctagaagttataaacaaaaattatatatttgttgggctcaaattttgatgaaaacagtgaacgaattacataaaagttaattcaaaatttatttaaaaattctagatttttttataaaatttattgtcatccattgttttaagaattgtgtttttatcactaaactagcacataagtataagagaggggtaatataatcaatttaaaaaatatttaacggtcaactcatgatcaactaacagaatgagcatagagaaaatcaaattaaaaactcagggtatataatttatgaggcaaaattcaggggcacgcaaaagattgaatgaattctcaagggtatatagaggattttctctaaaatgttaggaacaaatagaagtatttaacatcggaggaactgaaattgcgcactgcatagccttgtaatcttgggcttagcaatatgtattccttccttaaaaaaagattaattctgggtatgaacctcgacatgcatgcatcaagattcgcagttaggatataatatttttatagcacagaggtgtaaatttaatgtgactataagtttctaggcgtatacaaatcaaccaaataccagtagggtctttgattcgtgcaggcaaaccattagtcgtcttcttccttcctcgcgtcgcggcatccgccatcgaagctttgctcgcggctttctggccttcctcctgccaccggagacgccaccgccatcgccgcctcctactcactcctctaggaacctacgccgcagaaccctctcacctccctcctccaaccccgcggctccgtccaccgccgcctcgccgcccccgaacccaaatctaggtttttgttttggttcgggaaatctatggctgtcgtcaccggcgccaaagaggagggagagttcgccggcggtggaataataagtcgacgtccctccggtgagctaccctctctcccttccccctcatcccgaggttgaagatgcttcccctaatcctgaggttgaagatgatgccctggcaattggatcataacaggggcgggcccactattgattcaagggtattcagacgtatacccaagatttttagacaaaaaaaataagtatatgtactctatacctcgtatatgtattcaagaaattaaagaaaaaggctaaaactactcattttgggccctgtttcatcgtttcttctctattgggcctaaatttcccacttccctcccctttcatctcagcccacaatcagtttgggccacaactagttcatttcccctcctcgcctaggcacagcaaaccaaagccctaattcccaaatcggccaaaccctaaccagaggaccgaggacgtgcgcggtgtggcggcgaggacgtgcggcagtgcggcggcggcgacttccggctgcgtcggcggaaggcggcgccaaggcgggtaggagcctaggcagcgcgtcgggcggcggcgactgcagtctagtctgcagcgtgctcgtcggcggctgcggcagaggcttccggctgcggcgtgcgcggctgcgtcggcggcaggaggcgccgaggcgtgcaggcggcgcgtcgacggctgcggccgtgcggcgttggggctcggccaggcgtgcaggccgccagtccaccaggccaccacacaggtacgcgatgcggcagccgaacgaccacggcttgccggcctggcatggattgcgtgaggggcttgattcattgattcattgcattgatttgttctaggtagttcaatagtagttatgttttccggtggcgacggcttgtttcattgatttgttctatagtagttcaatagttcactagcaccgaaggattcaacttcctcagttcctgtcttctttatttttcagagtgttaactgttaagtgtatatttattgacagattgatagtataaagctgtaaatattaggaatttagataacttagaaccataatatttaattttcagtgtgttaaatttatatatatgatgatagtatgaggctatatatgagctgttgttaggaatttagagaatttagagagggtgttttcttcgatgaactatataaaaacaagaagcaagatgagcaacaatctacatttattggaagagaattttttgtacaagttaaaggatgaggacatcatcactcatttttaaaatatcaagcattgaaaagttctcctctaaattgtaagttttttttatcattttaccattttctatcctttacatgttatatatgttgccactttcatatgtcgaacaattagtacttatatatgttaaagaatttggacttatgatcaattctatcaatttataaagttatggccatatgctataatattatacaattagtaatgtgtaatattataccaattaattattggacttctagaagtaaaaagaattttgttttacccctacctatttcgaatacccaacctctaaatcctgggcccgccactggatcataatccaacggccaggtccaggtgactgaaatgtgcctagcgaatcctaacatattcgttctttggccccggcgatgagtagcaagtttattactctctccgtttcaggttataaaacattttgactttggtcaaagacaaactgtttcaagtttaactaagttagtttcatcaaatcaataattgaatatatttttataataaatttatcttgggttgaaaatgttactacctttttctacaaacttgatcgaacttaaaacaatttgactttaaccaaagtcaccaaagtcaaaacgtcttataacctaaaacggagggagggagtacatgccaagttgttgtgaattccttgcggataataaaagtcatcatcagtaaattctatatatttttcatatatatccaaacattatttcttttatcagttctacacatacttattgtggtatcagtgctttgatgagacggataccatcctatggtcgtgtatcagaataattaggaaagcctagtgctaaaagctcgaatacctatcctaaaatttctgggaccctgcttgaaaaccaagattttgtctcaattcagactgaaaatattttacacagtgaagaaaaattgtgcagaaaccaaacgtaaactagatggatcatgcattgtttcagcaccttctaattagctagttgtcttgaacagtacactccttgattcttctgtatttccacttattgttccaattccatggataacagaggaaagtaaccttgttgcattcggcatagaaatgggtaacaatttaatacaccaaagaaaactacaagatcgtggccatggtaaacaaatcgatgagaatgcaagaccaggtgtaaggcttgaagaccttccatgggtatgttcatcttaacttcttttctgtttgagtgttgggtagaaatgggatttatttataatctccaaatgtatgtgatgcatttgctgcaggaccttgtagtatacaaaattttatctaaattaccactgaaagaggctgcaaaaactagtgttttgtctaccaagtggaggtgcatctggttgacgtgccccagattgtgttttgatggtcttgcgatgttcaaatgcgaaaggggtgaactgttcttacacgctcggcaattcattgctcaggttaatgctgttttgcaaaaataccagggagaagtggttgaggaatttcatatcagatttgattttcacagcataccagctcattatcttgataattgggttatcttttccttgtcatctaagatgaagaatctagctttagatctgcaaaccaatgatattgaacgatatcctgcacgctacaaattcccctttgaacttttggacagtggaagcttgtccggtctacaacatgtgcagttcagttttgtatctatcaaaccaccttccaagttcagaggtttccctaacctgagaaagcttgatctgcaacttctagatgcctcttcaaaggattttgaaactatgctgtcaaattgcaaacttcttgaatggctaagcatggacagatgccgcctgaatggtgaacttagggtaggtagtccattgccccgtctggtatacctacaagttgtgtactgccaagtaaccaagatacaattccatgctgtggagctagctaattttgtatataaaggagactttgtgcccatagccctcaagcattcgttgaagctggaaaatgcaaacatcaggttatatagtttgaatgatcggcatgctatcagtgacctggtaaaatgttttccgaacttgcaaaatctgaattttcacctttcttggaacgatgcagaggtttgttctcagaaactaaccctccatgctacagttttagcttgtttaacataatctagtgaatgatctttgtccttttgttttccagactaagttgttatcagatacaccttggaagttttctcatctcaggtacttgcggttgaaaaactttgcagattctgggatcgtggagacgaatttttttgtctcttttctcagggctgctccttttattgagaagttagagatccatgtaagtgctcttatcagtaactactactattctccaaactatttcttcacttgtatgttgacatgtcatgtaatactgatctccttttagtatcctgggtataccatgcagtaaaattaggtcagtctgctcacactggtcgttcatgtcttggttttagcatgttataattgactgcatatctgtgtattgtttctgagaatctgtctctgcacaatatatttttgtacttctattcagaaaacaatttcgccgttgtttacccaggagcgtttgcttaggccgtgtttagttcgtgtgccaaatcttttttgaagtatacggacacacatttgaagtattaaacgtagactaataacaaaacaaattatagattccgcctgtaaactgcgagacgaatttattaagcctaattaatctgttattagcaaatgtttactgtagcatcacattgtcaaatcatggtgtaattaggctcaaaagattcgtctcgcaatttacatgcaaactgtgcaattggttttttaatgctccatacatgtgtccaaacatttgatgtgacagaatttttggaagtttgaagggaactaaacactgccttagcaaggttttctttcaatagagtcaagtgagagtatacaattattactttgcagagtgggtatattatcgtatttttgcaaaatttcccaaacagcttcactgcttatgttacatctggatacacacaaacatacagttacattttcttttttttaaaaaataatgatgatgataacaatcactagatgcagtatgtatcatatcctaggtacacatatattaaaggatgtggatctaaacccagctgatcacatattgttatgttttaaccatgcagttttccatgaatttattaatactggatgaatcgcatgaggaccatcctnnnnnnnnnnnnnnnnnnnnnnnnnnatacaataacctgaagaacatgcgtatcataggatataaaggttcaagagatcaggtcgaatttcttctacatgttgtggagaatgcccctgcacttgaggttttaactctagaggcagctggaatagagtaccaggaggtttcatttgtgttgaatgaagcgtggatcgacagaattactcagagtgccgatagatctgctctgattgctcaacagtatctgagggagaaacttagctcaaagacacagctttgtattaagactactagttccagatagagctagcgctctatgcaagccatgtgaaaatagccattagtgtaagattaattaaataatattattataaacttgaaaataattgagtttatttgatttttctaaaggaatttgaaagttttttttaaataaaaaacacattgtttagcagtttggaaaacatattcacggtaatgaaggaattgcaaaagtaaaaggaggaaaaaacacacccttaacatttgttactctatccatcttaaattgatcatcatacacccttagcatgtacacattctctcttgctacattaattgtattcggatgaaatctgtgtccatgcagttatatgatgatcaatttgagaaattttggattttattatatgataatcaatttgaacagatggagtattggttagttttaaaacaaacaggtcctattgtttagtagtatatctcttctctacaacttaaaaagtataagaaatttccgtcgtccgtaaaaaaaatatagagaaaagaaaaactaaaaaaagaagtccgattccccttaaaaaggaaaaaaaagttcgagaaaaaatagcgaaaaaaaggtagatccgattcccctaaaaaggggaaaaaaaagtccggttcaaaaaacagaaaaagtggcgaaaaaaaatagatctgatcccttaaaaaggggaaaattttcctattcccacgcacggtttttctttttttcttcctttttttcgtttcttttcagttttttctttcccttttttctttttctgtttttttatttcttaatactatgtatgtatacaaactttatatatacacatatacaacctttgtatacgtgtattttttatatgtttgtatataaactttgtatacatctctatctctactctctagtctctatctctactacttaaaaaattcaaaatgtttccttcgtccgtccctacttaaaaaattcagatagtgggaaaaaagggtttgtaaacgagaaaaaaaagtaaaaagggtgggaagcgcagcaaaaaaaaagtccaatttcttcgttttaatagtccgtatatatctcttctctatgcctaatctaatctaatctatttaaaaagagatgttttcatcgtataactaaaaagagaagttttcatcgtacaacttaaaaagaaaaaaatgcgcgagaaaataaaaacggtaaaaatgaaaaaatgcgcaagaaaataaaaatggttaaagaaacacgtgaggaaaaaatgtcagagaaaagcgctaaaaaaaggtttccgtagtcctaaaaaataaaaaaatgtacgagaaaaaaaaatatttccatcatccgtaaaaataataaaaaaacatgcgaggaaaaaacttttagaaaaaacgcacatttctaaaaaatggtttaaaaaaacctcgcatgaaaaatggtttgaaaaacgctaaattgatggacgccttgggtcagataggatccatcgatttttccatctcctacacaacttttgtttggtcatctattctcctgtattagagaccctgcacgtctctatatgcaattatcagactatttttgttaagtatagctactattgttgataacatatgatatggatataatattaaaaaataaacatatttttaattgttatttagagaagagttcacagtgactctattttgtgtagatttgaccatgcgaggtaatgtaggatttgattgatcgtattattggttgcaagaataagattcaaagagtattttagattatatgcatgttgtcacatgaataatctaattattttaggtaaagcaagcatcagtgaggttgtcatcgttgaggttgggccatttcatttaagatgttacaatttttttgattgtcttagctacaaacgatccatacaaacattgtcattgacatcgttatgtatgaaaatcctattttattattagaagtttttcacccgttgcaacgcacgggcatttttgctagtattataaaaatgagacatgcatgaaaaaaggagaatgcaccgcgtggccgtaactaggggtgaaaacggtacagaaattttcgagatttccggctaccgtttccagcttgcaccgaccgtttcagtcggtatcggtaaccgattgtggtggaaatggaaacgggtgatatcttctggaaatggtagtggaaatgggatggaggtttttccgaccgttttgtcggtaaccatatttgtacggtaatttctgtcaaaatttcgaaagttccccagcggctcagctagctcaacccattggaagcccatgaacagaaaaaaattctggtaggcttgcagcccataaaaaaaggggaagtgaccagggaaaatgctgttaaacctatgacatggcgtgtggattttgctgaactttggtctcctcaacttatcgatgtataagtattgttgaactttgtttatattgtttgtcaaacttattatcatatcattaatcatcatataacggtgttatgtggagtgtgatgatgcaagaataaagttaaaaagtcatctacgtgcatagttaaatgtgtgttatgccacactctggtgattccgacatgaattttcgacttccgaccaatatcggtatattccgttccgatggtcccgtttccgatataccgatatcggcgatattgccgatatcgttaccgtttcaagtaccgttccgattccctttttgagaaaaaaaatatgaaaatgaaaatggtatatggttttttctggcactattttcatccctagacgtaacaaacttgtgtctcacgatgtgtgtggtgtgggccccacccccagccgtaacagccggataaggggaatttaactatttagcacttttaggtttgacaattatctaaatgccctttttagttagatttgcagttaattttttgcccctctaaagaggtggtctcttagggcctgttcactttaatgccaaaaaaaaatcttaccaaatgctaaaatttggtaaagttgccaaaattttggcaacttgccaaaattttggtaggatttcttatatagttaccaaaatttaacagcaaactaaatatagccacttttttggtaactttatcaaaatttggtaagattgaaaatggcatcaaagtgaacagtcccttaactatttgccacttttgcccacgccgtggcgcgccagggtggcaaactttggtgaaaaactccgtgggacccacccgtcagtctctccctcccttttgtctcttcccctgtgttcgttgccccatc

SEQ ID NO: 7353 - DNA, 3776 bp, Oryza sativa
ccacgtgggtaaaaagtggcaaatagttataccacctctttatctttataaagaaaacccagaaatatatttaagatgggtatttgaataattgctaaatctaaaagtgacaaatggttaaattccccggacaaaaaccctcccttctcccccaaatcacacctgattcgggggcgccgcgccgcgaatcgctcctcctcctcctctccggctctctctctctttcctccatccgaaacctccaaaggcaggcgagggcgagggcgagggcgagggctatcaatggagtcgcgaggcgagggcgatggcgaaggagcctcaatccggcgagggcgagggcgagtaatggggtcggagggcgagggcgagggcgaaggcgaaggcgaggaggtgaagtgggcgatgctcttcaccctcccgatcccggtcaccgacgaggagcttcctccgaccagagacctggccatgagcaagcagccgccgccgctcatctcctttctctgccttccgcagcggagcctcggcgaggccgcccactgcttcgttgagatagtctgcgcggattctgctggtcggcttctcttgagcgccaagccgcggccagcaccggccgcaaccacctctgctgctctgcctcctcgtcaaggcgtcatcatcatctgcgacgccacaaacctcaaggtcatgcgcctcccgctgccagtcggcgcgacttgtgatgacaacgagcgcgggttcccatgcctggcggtactcagcgatccgcgcgacgaggaggatggcgatgcctacatcgttgttctactccatgcggacgcgagcggagccttccaggaggttctctgctatgaatccaagaccggaggagtactcgacacacagacccatgaccaggactggagcgacacggagacccacgaccaagactggagtgagaagttgctgtcctgcaattcgcagcagccaccgaggggttggcacagacacagccacagccaccgtgcgatacctctcgatggcgaggtctgttggattgatgctgcttatggtttggtgctatgtgaagttctgttggaggatcccaggcttcggtacgtccagctcccagaaggctgcacgatggatgaagacgatgacatggggtcgcctgctgttgtagagaagcttaggagacgttgtattggtgttagtgatggcaaacttagataccttcagatagacagttcaggacagtcgattgccgtgtggaccttgatgactcttaaggatgtcacattttgggagcatacattctcagtcgatttagtatctcttcgtgctgataagagtttccaggaagcaggactgaacccacacatattcccctcagtggcaggcattcatcctatcgacactagtaccattttcttagtgcagaactcaatcatattttctgtcagctcagatacaacaacttcttctatcaaagttggtgatcaccacaagttcctgctcaacgagaatgagatcactccgagtctgtttctccttccgtggctggttcatgacccagcagacctgcttccccaagagacaccaccgagatcaagtaagcacttctagtttcccttgtgattactacagtgtcatttgatacccccatcatatattgttagtttgctctctatattctgaaatgccaaattgtttttgctcctgccagcatgtttttatcttgtctgaaatgttagaatggctaatgtgggttaagtcatgttgcttgctgtttaggttattcaaagaagtgcctccccgaatatacactgtgaattgataccatgatactatattgttagtttgttctctatattctgaaatgccaaattatccctgccaacatgcttttgtcttctctcaaatgttagaattgttaatgggggttaagccatgttgcttgttgtttaggttatttaaagaagtggctcctcggatataaactgtgatttgataccatgagccatggtatattgttggtttgttctctatattctgaaatgctaaattgttcttgtacctgccatcatgcttttgtcttctctgaactgttacaattgtaatggggattaagccatgtttcttgctgtttagattgttcaaagagatggcttcgtgcccttaaactaaagcaagcactcaagagggggatcgtgtggctgagtgataaccatgaagttgtaactcacgttggagatgtaatagattttcttaccattcctgctggcggttcctttagatctgcagctatttgtgtcaagaaggttggttcctattgttcgaaaacagggaagatattgaaatttcacaattcgaggttacatgcaaatgatccggtcaaggcattgccaatggaagatttccaaatcatcaatgacgtggatgaagatgtcgagtcattgtcaatggaaggtatccacatcgtcaaaaacgtcaatgaagctagaaggtttatcaatcagtggattagctgccagcaaccacatagttgtataatggatgtggctaagtctgtgggtgtggaagagtgcattaatatcttgacgtaccttgggggtgaaaatgccacgttcatgctgatgaattccccgacattccttgagaaaaccggcaacaacttacgcaagtcttctgatttgaaggagtgggtctacctaaaagagtagcagccatttactggagacttatctgactgtataagaggaagacagatacaggagcagaacctctcatggtaaggtttccattttaccccatgtatggctggtcatctttttttttccctgacacagtttctatgcattaatagtcattcacttgtgataatcctttagtcttcagtttgtattttgtcctgcatcttttgtgacaaacttctgcatcgatttctttctaacagagcttggtactgttcttaataaagttatatccatttgtcctctaggaaactgtatagcatgtctggtttggagagacttacctgaaaactgttggaaataatggtttgttggttgccatacatactcatgccccgtccttgtggattttcaatctgtgtacatgtgctaaaatatggcctgaaggtagtttagtaattgggaataatggtttgccctggtatcgaaaatactgggtttatatcccaatccttggttgagaatgtttatgtcctggtagtagtgttgaaggatttaagcccaggtaatctcagtaatatcttttcagtctaagaaacaggttatttgttttaagataatcttgcatgctggttttcatctacaaatgtataatacacaacgctgctgacgttaaatcaagacccagcttatgatgtttttatatgagttatccattttatatttctatatatttattttcttctataacaagatgttttgttagatgatttctgatattgaacggcttacaggttgcgatatatgtacctaacttccttattgttttgtttggtcctctgcaaattcagctgcaatgtagatgcggtctagaggaagacagaactacaggagcctccacttgttcattcgtctcttcagaaatttttgttgcttctgatcgaatgacgcagaattggttgccttctttttgtaaagatagtagataggcacatgctcagaagccaaaaagaaagccgtcaacttttttgttttcctgttactatgtgttggccattatgccgtgaagtttacaaactgctgaaatttccaactacgtagaatgtg

SEQ ID NO: 7354 - DNA, 1965 bp, Oryza sativa
cggcgtcatctattaaaaaacggaggtaggatttagcagctgatgaagtaccgagacacgcagatgctaatgaccactagaggaagacagaactagcatattttacccacttcatccatctcttcagaaactttcgctgcgtcagatcgaatgatacgagacggaaaaaagaagaagaatggcacgagaattggatattcttttacatagatggtagatataaggtcagaaacaaatccatcaggcaactcctccttaacatgttcgtgtactgtctcacagaaaggacgggttcagatcctcttatccatcatatatagttgactgtagaatgtgtaggttggatttctttcgtgtgatcgctctgtaactgtgattgcgtcaaacatactatctgttttcttcttccccaaagtacaaactgtcgtcctaccgttaggacagcttttacccattttgaaatacaaacagtaccgtaaaagttatcgattgttagaaaactacaagaagatgcacacggcaatatggacttccatgatagttaagtaggtatagtttttttttttaaatcgaagccaggcaaagttggagttatattaaggaaaatagaaagtatttacaatatcaccaggaaaggtgaaagagacagaacaggggaaataaagaagaaaagcaacaaggaaaacctaaaagggagacctaagtggatattctcgtgatgttttttttgccccacacatactccaaagtttgatttcgtcttgtattttggcgagtagttgcggcatggttttctcttgattttgaaaaaccctcctgttccgttcacaccatacttcccataccaccaacatgtggattgatttgagtgctttggccttgcttttgcctccttctgatccaccattccaacagtacttcgttttcatcgtattggtgttctatatcgttgcagttcagtatactcaggaccctctcccagatatggcacacaaaagcgcaatctttaaaaagatgttgggcggtttcaaggttcctatagcatagttggcagaaatagttgtttggccattgtctgatttgtagcctatctattgtccaaactctattttgcaatagaagccatgtaaagtgtttgcatttggaaggtgcccattgcttccaaatcagttttacagctgcagagcttattctaccattaaactgcgctatgtagaatgactttgcgctgtacttttcatttgccgtccaccgccaagttatggtgtcctcgacaccttctgtgagtgccacgccattattccacgcatggtagaataataatacatgaagtgtgtaatccgtggccaattatgcaggacaattaggatatgatgatgttgttcacaccaaaattagtccatatctttattttctccgcataaataattagctgcataaattagctacggactttggaacttaatttgggaaaaagcaaactctttttattcagtacattgtgatatgatgtcaaaacaaaaattcttaaaactagaggcggcagctgatctggagttgtgtcccgtgactcgtgtcttcgccgccgatgccttcctcaccggcgccgccgccattgtcatcgtcctccggaggcaaggatgcaaatagcgccgcgaggctggcgtcgatctggtccagcgagtcagcggccaaggtttctccggcgtcccggatgtcgcggatcatctccaagaagtcgtcggagtggagcgggatgaagccggcgtcgacgaactcctcgagcgtatcgtagatggctctcaacgaggcgatcagctgcctggtcgtcgcgaggtggagcaggttgcagcgcagcagcagcgagccgctcggcgaatcggacagcttcgcctgcagctacttggcgaacgactccctcgcatccatgtatttgttggcgaacgacgacgtactgctactatg

SEQ ID NO: 7355 - DNA, 6302 bp, Oryza sativa
  unsure (1)..(6302): unsure at all n locations
ttatatctcgaaaaaataataaaaaacatgggacccacatgtcagctaaaaataataattttaaaatggtggccccacatgtcagctactcctcccttcttccccctcccttctctctcatattcatcgtcctctcttcttcatgtgcgcagggggaaggaggcgaggcgaggcgacgggaccatcccccacaccgacaccacccccagcgcgccgccaccgccggcatcttcgtcttcctcctccgccgtcaccgcctgcatcttcgtcttcctcctcgccgccgccgccgccgcggcaaccgcggcaagcaggccggcgacgacgacgtggagatggccgaggggaggaacaacaaggtcgccgacggcggcagcgccgatgactcgacgaccagcggcaaggcggacaccaaggtgtagctctggcgtctcaatcgatccatgagcgatcgagtagctcagtagcatgcaatcggctaagatttgctgcatgtgttctagtactagaagtaataatactccctccatctacttttgatagtgatatttccaaatctgaaaattttatttttgatagacatatttcaatccaacaacctatcatcttaataactttctcggatttaatgcacgactctccattcttccacacatgattggctacatgagcattgaaaaatgtaaatattaatgaatcgtttatttacgaggaatgactagtagcatgtttaaatagatgataagtagaattacttatccttggtctatgtgcaaagatgaaatatgactatcaaaagtagatagaggaagtattagctatcctaaaaggctaaaacacataacgtgtatgaaaggaaagtactatcctaactgaataaaacagcttttacaggcacaagtttaacataatatgtctgctttgatctttatttggaagttgtaattaaccatgtttgtaataacgcgataattaaacgagagtatccatgtgtcaagaggtcaagcgtgacctctcccacaccgtccatggcttccccgccgatgagcaccacgtccgggaggtgattgcgctcacgctccactcccacgcctgcgtcgcgtcgctgtcgcgctgcctgggcgtcacgctcaagatgctggtgctcgtccaccgcctcctcgccgacgcgggcccggcgttcgagcaggaggtgttttacgccatgcgccggggcacccggtccgtccacccccaccccccagcgccgccacgccgtggcccgctccagccggcctccttcgtcgctcgggccgcccgtgcgccgttccagccgcgcctcctcgtcgctccgccgcccatgagcgggagagagacaagagggagagagaggggacagagagaagaggttgtgaggataacgtgtgggtccacatgggcccaccttttttttattaatttgtgtgtgcaactgacatgtgggcctcacaagttttattatttttttcggatctaattgccacatcagcgccatgtcaataacacgttggacaaaaatctagtcaaaagaagccacgtcggcgccacctcagccaaaaccggagtcaaatactgccgagggaccttatttaaacggtttcgtaagttgggggatccgtcgtatcctgttttgtgactaagggacgaaaatcggactgggcaacaaataaagggacccaaagtgaacttattccgaattctttctaccacggattctgttgggccgtttctagaagaaaaaggaaaagggacggcctgtaggctgcattgggccgagcccagccaggctgagccagcacgtggaacgggccgaattcacggaccagtgcagtgcggttggtggggaataagttcaccttacgtccctcactttacacgagtctgtctaagttccctaatccccaatattagaaatcttcacccataaactatacaaaaccgtgtaaaagtatggatatgtggtttcactgatgtggcaacctagtcagcaagataaaaaaataaaaacgttatggggcccacatgtaagtgagaaggaaaaaaaatatggctattcaaatagattcgatgtaaagttaagggacgtcaggtgaacttgatggacacgaagttgctattcagttgaagatttattcaacatttattgtgatataaaattattctctctcattttttttccaagccgaacaagaccttagtttgatgttggtacggaaaagcctactccataatccacagtttggtgacaccttaatctgagagagtagttatctaggttatgcgtgcttcaggtccttacgctctcagggcaaataataatgaaattcacattacccacataactgtcttttagtgtgagcgtcttcatggcttaataagcccttgtgcaggcgaactatattttcgctttccacaatttataaaatttttaataaacaactaaacaaaatcattttagtattgattaaactacatgcggctcataactaatcatttaactatttgtcacttttaagatgtaatgataataaatttaccactcattttctatggcatatggtgcctatgacatgtgagtccagtgataaatatgttatcatcacttgtaatagtggcaaatataattattcctttatttttagccttccacaatttatagaatttttaataaacaactaaacaaaattattttagtattgattaaactacatgcggctagtaatctagagttgtgtcccgcccggcgccgcctatatgacttcctcatctggagttgcctctcgtcgccgcagctcgtcgccgtcgctgccgccactgtaatgatcatgagctggccttgaggtgtcacaccctgaagttttccccattttgcttgctttaaaaattggttaaataaattgcccgaagaaattatcttaattaacctagagctgaattccttaattaataaatacaattaataatcggaaatagcgtggtggaatttttcttgagttccccatgctccaatgcattaacaagatttttagtggaattttcagagccttggaaataattttaaccaattaaaaatcaccaaagtgcaatttttaatcccaggaaaaatcctttcttccttttctttttcttttccttcttttttctctattgggccgtcggcccactccctcccgcgctcgggctcctttctttgggccggcccgttccccttcccctctctccgggacgctgacaggtggggcccacctgtcaggtcgtcccctttcttcagcccgccgccccacgacggcaaccgccgncgaaaccgcccgcgccgncgccttcttcacgtngngccttcactccgcgcccgcaccttgcgcccacgtncccgccctcttccccgcatctnccggcccgcacgcgcgcccgcaaatgggcgggaatcgatttgaatcccccccactttctctctcttttcccccacgtcgccggccaaatcggggggtttcccggccatgtccgcccctttcgagcccctataaagcttccccgcatctccctcttccttttccccttttcgccgcgctctcccgtgccttctaccggtcgcgcgccgctcgccactagcgccgccgccgcctgccgtctcctgccgcgtgccgtcgccactagggccgccgtcgcgccaagccgccaccgcctcgcgtcgccggaaccccaccggaaccctatctccctcgcgagccggtgagctatccattcccctccgtctccggccagccattttggtcgtcgcggtcgctttctccatccctaactcctctcctcccctcctctaggtgtctccaccgctcgtccgcccctcctctcgtcgggtcgtcgtcgccgccttcgtcttccgctccggccgccgtgtcgccggtgagtcctccctccccccctcctttcctcaccttcccgcgagcgccggccacgtcgctgctccggccatgcgccgccgcctttcggccgtcgccgccgcttcccgcaccgccggtcaccgccgtcggtggccgtgcctcgccgccgcctcgccttggtcagccggtcggccttgaggccgagccgagccggccggcgcctccctcgcctcccctttgagccaccgcctggtggggcccacctgccaggcgccacctccctccctttggagccgctgactcatgggccccacctgtcggcgccgccccccccttcgctgacgtcagccctgggctttattgcgcaataaattgattaaggacttttctttattagtaaaaacacagtttatcttctaaaattcataagtaattcatccgagctccgtttaagtccattcaagtctcagtaaatcaagaaaaatgcaaagaatccattaaaaatggttttgtttcctgtttctgtagtcttatagcatgttttgcttgtgtgctttgtttgtcgcgtaggtttcggccgtttcgtcgatccgcagtttctcgaagacgttgctgaggtctcatcagttcgagagcaaggcaagtcatgcaatacgtttgatcatattgtacccaatttacaaatatcccgcatttctattaaatgttgcattcttttacaatgtaatgtgggatgggtcctattcctcagccacatattggttaccctatgccattgataacttgggtatcaaaatgactagatgttggcttagaaaatgcttagccatgcttagttcaactaatacacaaatggggatcactttattacatagactttgtctattggcatagctttagattggtgccaccgcaatggtgttagttaattaaaatacactgaatggtgggctgtgggtgcatggttttgctggtcgcacccatggcagttaaggaccggttcacgggaaaccctgggagacttaccgtgcttaccacaagcgggagtgggtaactgcttgatctgaagtatagctcgacccttctaggcaccggtggtgagggtgggcgtgatggaattgggtcggcaggggtgtccggttgtccagatgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtttggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgattggttaatattgattaattactacagctgttttactgctttcaactactgctttgaaatgcctgctttatgcaaaagaacccctagcttcctttggttatatcctgcatcatacctcctcttccggtatgacttgctgagtacagtgggtagtacttagtcttgctctcttttcccccacaccagagttgaagttcttctcagttggagatgtcttgaagaggtgggtttcgtcgctgccgtcaagggttgcctgtggaatggaatcgcccgctgcaggagtcaagtcttcaggcttagctcgcttttaccttttccgctgcatttgtaatcctttatgtttttgtaagacgtggatttgtatgtcaacaattgtcgtttgtgtaccctggctggtcctggacaggggtttaatacacattcagcttagaaattatggttcgtgaatttctgggcgtgacatgaggcatgggtggcactagtacagaagagcttttttcatacgggcgaaatggatctttccatgcggctagcctgcccgcatggaacaaaaggtctgtaaaaatcgctatttctccatgcgggcaacacaaccgcatgcaaaaaggggattttcgcatgcggtccacatagccaaccgcatgcaaagatattttttagccaaaaaaaaaaaatccaaaaaccccccgaaacactaacccgccgcccgccgccggacgccgcgtgaccggcgccagatccacgctgctgcggccgccggccgtcgcggcgcagagccgtgcccgccgccctcgccggctgccactgctcgccgtcgccgtcgccaagcgtcgtgctcctccgtagggcggcggatccggccctcccgaggacgatgccgccgccgctctccgccg

SEQ ID NO: 7356 - DNA, 2376 bp, Oryza sativa
cccctagggtggcggatccggccttcccgaagacggcgccgcctgatccgccgccgctcccgccgtctcgtcgtagggcgtcgccaccgcggctccttgctgccgtcgcccgctccctcctcgcggccgccgctacgcctccttgcttccgccgctactcccgccatctcgccatcgcccgctgcctccttgatgtcgccgcccgctcctcctagctgccgccgccgccgctcccaccgtcgcccaccgcctcctgccgccgcccaagtgtgagagagagagagagaggacttcacggcggtgaggagggggagcggcagtgaggagggatggcagtggtgccgccgcccgagggagtcaccgacgacggagggatggcgggggagtgagaaagtgagagagatagagagagacgagagatgagagatctacagagagagaggagataataagtgaggggagaggaagagaagataaggtttggtgtgaaatttttgaactggtagagagggaaggaagagggaccatttttacatgcgggccacttaaccacccgtatgcaaaaattgattttttgcatgtggctttttagatttcaaatcgatttttatgtcactatattaactcatatgaaaaagttaccaaaaacaaagttgtagaactcatcaagatctacaacttttattttgaccatttttctatatgactttgtttgaatagtttcaaattgaatttcaaaatatgacaacttcaaacaaaattttcaaataataaatgatttcaaatagaaatgtcatcaacaacaaagtggtataacttatcaagatctacaacttttgtattggtcatttttctatatgactttgtttcgacagtttgaatttgaatttaaaattatgacaatttcaaacaatattttcaaatactaaatgatttcaactgaaaaagtcatcaatcacaaagtggtataactcatcaatatctataacttttattttggtcgtttcttcatacgataaagttatgtgtaacattgttcacaaaatgtacatctgttatatagttttataaactatagagagagatatgtaaattttgtgaaaatgttacgatcactttgtcggatgaaaaaatgaccaaaatagaagttatagatcttgatgagttatacaactttgttgttgatgactttttcaactgaaatcgtttattgcttcaaaatcggcgaccagcggaacagggagcggaggtctatgcgtttggcggcgagggccctcgttggtgggcttggcaacggcataccaattccatcccctttggcatcgagtcattgtatgtcagccatggtgccttgtaacaatgaccatgataacgacggtggtggcaacaacaattgtagtaacaccaccagtaccgaggaaggcttgtggcggcgacagtgaagttcatatattaacctcatgtctaggaatcgagaaaatgatcttatatattcttggaataagtttgtttagagatttatttgtaaaataagttttttaaaatggtcaaagtacttttaaaaaataaaaaaggtatatgctacagtgctacatgtcggctgcgcacggcagggcatgtccaacgccgtgacagcaggcaggcatttgccatccgcactgcatttttttgagcgaaaaccgcattgcacatagtccgtggattcagctcatgccgctcattccatgtgccagatcatcctaaccggacataatacaatatttaggtgacatgcaagaaacgataagatacctccttaaaaattcatctctacttttcccttctcttatagaaacggcccaacacaattcgggagaatttactttttgccatcctctaaaaataccagttctcaaatgccactctccccaaatttcatttccaaataccacctgcgtccacatgtcagccggtgattattttgaaactcgatgacaacatgaggggcctcatgtgaactttttcctacagaatcgaatgacaagggccggcccaattgggcggaatccgagctagtgcggcgcctccgccacctcctccacaaaccccgagccggcgagacgagcacctgccgccgctgccgccctcaaccggcactagcagagcgcagatgggcatcgccacattgccgctcgctgccttcgcgacagggacgagttcggctccgacctgaggcctctgcatgcgcatgcgctgctttggctcgcgccatggctgctcttctacttgcgcacacgaggtgttcgttgaaatgcttgggaagtcatcgcttgctaattactccaatctgatacccttgtattatatgtcccaggggagcacgtaaccaaaacatgg

SEQ ID NO: 7357 - DNA, 3455 bp, Oryza sativa
  unsure (1)..(3455): unsure at all n locations
ggtgcacgtgctccaccacttcgacggccgcatgctcatgctccacagcgccgccaacgggcggtacctggcggccacgacctcgccgtgggcggcgaccgcggcgcggttcggcctcggcggtggcaaccgcgtcaccctgcgcgacctcgaccggctgccgatgttcgccgccggctggtttcccatcgtgtcggcatccggggacgtcctgctgggtcacgctagcgaccgattcctccgagctatcgacagaggggatggcaatggcgtcaccgtcgaggtgtccgacagccgcagaccgaacacgccctgggtggtggaggccatccccccgatagaatccatacctcgccttccacatcttgtggtgagcgcgtcatgccctgttttttcgatcctttcttaactgattgcatgagttgggttctttggggatcaattgctgatgctttcttgaaccagagcttgcagattgtggcaagttgagttagttttgctcttctgggcgctattatttggttctgatgttgcgttgtttctgcctctgttgctaatcgtgcgtcctgagttgttcatgggaaagtaattcttagtagcattagtagcatttgggggtcatggtgtcaattctatttctgtatgatacattcgtagtggggagcagttcttggttccatcaggttgccatcttggttcttcagttcttgcttgtccgcatttgcttccttccagggtgcagttcttgggtcacaaattccattttcggttccgtttacttaaattttctgtccgctctatgaattttccttttccaagattatttcagtacggttcttgaaaatggcaacactacctgatcaccattgccgttctttcttaatgtgttcttggtcctcggtcacacagtgtgtgatgaattcttgcaaattgtaatgaattcctttgtgccatcttctttgctgcagggcataggacacattgcacgggcaatccggttcgtgcgagcagagcgggcatctactgatgggacctttccccatgtcgcctgggcttgtttcgagttcaccgggaggtcattgttcaatctgaggacggagctggcgcgtaggttgaactttgcagtggtctccgatgtcattatgtgtgttcgagcgggcttgtttggacggctgactcctctgatcaccgatctgcctcccaacaatgtgaccatggagatcatcgttgtcacggctgggacgattggtgagatttcgtttttatgtacctgtgtattactggttatcgccttctcttttcatgacagttctatagattacatgctcggtattccatagtcttggttagtcatactgttgctgcattttccctgacaacttttgtattgacatcatctagttaaggagaaactactgactactgtactgcttttaataaagttctatcacttgtcatcaaggaaactgtgcacatgtatagtaaggagaaacttatctgaatgttcttgtagataaggaaagaaagaagttgagtgaaaataagtagttattaagagtttgtcttgtggattttcagtctgtgtacagatgctaaatatggactgaaactagtcatgtgatcaggaacagccattttttagttgcatgcatagtacatactcatgctcaatcttgatatggataagactggttttatgcatcctcagtttgaataactcggttgctttttttttctttattttgccctggtattagtgttgaggggtttaatcccagatcatctcagtcagctcttgtcattatgagaaatggggccttcgatttaagacattcttacatgccttgtgcctactctaaccgtaaaagagttcacttgtacattagtaccatatcaagatacaatgcaaacactgtttccattaagagcaattttacggtccttaatgaggtaccatgaagtaccattttttctattgtaaatttggtacctcatggtacctaggtactatgaggtactaaaatttacactaaaattttagtacctcatggtacctcctcaaggaccgtagaattactcttccattaaatcatgcttccggtttctgctcactatgctggtttctatgagtttttcattttcttctttaacaaaagggtgacccagatgtttacatgatgtctgaattgagcggcttgcgagttacaatatctgtacctaactgccttattattttgtctggtccttttgcaaattcagatgccaatgagttgagattccccaatgttggtgcagtctagaggaagacagaagtgcaggagcagaacatctgacagtcactcccccattcatcgtttcagaatttttttgctggctcagaccgaatgacaggagaaatcaatggaataggcttcagaaaggaaaccaccatctgttctgtttcccggttgttagctatgggatgctctgatgtcttgaatgcctgaacatcgcgttctgacatttgctgtactttccattgtcatctgtatgatatgactgatgatccatacatttgcagatgtgaaatgttgtgctcaagtctgaatacacagagctcatctgtatgatatatagtactacatcttttgacattttttgctgtgattcctgtgttatcattgtgtttgatttcccttatgtctacaccaaaaagcagtcaacatcttatccagataaatagtggtggttggttataaagatttgctgcaatgtttctgactttggcaaattattttaattccattcacttatatgtattgtgcataagagtaaatataagatcaaacctaagcaaagtcagtttagtacttaaagtcttaaactgcatgcggccgatctggagtttgtgttctgttgctgccgatgcctttcctcacaaggcgatgggcggattgcgcgcgccngccggcgnccggcattcgncgccccgtcggcggggttggacanaaaacccgatcccgccgttggggcgtcggcaccgtcgcaagagcgccgcttgntgggggcctccactgctttntcttgctgccngcggcgacaaggatgaagctctgttcttaacttcgcacacgaggtgttcgttgaaaatgcttcggagtcggttcgcttgctaatcaggttgcttcttgatgtcacagggaaagcacacatatcgagcatggcattcacgggcgcggtggtcgtggacgacgacgccggccgcgccgtggtgagcgcgtgcgtggcgtgtggtgcaagtgcagcagctagctctcgttgcttccggcgaaacgggcatgacgtcatccagcatgtgggaccagcgggcccacctgtcagaggagccggaactgcggccccacctgtcagcgaagggggacaactcctttaaattgcggccggcttggcgctgacgctgagagccccgagccgta

SEQ ID NO: 7358 - DNA, 24651 bp, Oryza sativa
  unsure (1)..(24651): unsure at all n locations
ggggggggggggggtggaacagttcttcgtttcatctgtcaggttgccacctatgttcggttcttgaaaatggcgacatccccactgctgttctttcttactaagttcttggtcctcagttacttcgtgtttgtaacgatcttctttgctgcagccctcattcggtttctttgcgcgtcgcatcattttccggcgattaacacataatgatttacaatgggtttggatctggttcactgggaggtctgcgctccatctatggaaccagctgtcgagacgaatgggcttcgaaccagaccccaactccactatgtgtgttagagcaggaacctacggacggctgactcctctggtgaccgatctgcctcgcaacaatgcgacaatggtgatattcgttctcccacctgagtcattaggtgagatatgtacctgtgcaagacttgctgtcgccttcttgttttatggctattggctaatgttctatagattacatgctcatggtattcatttagtcttgaatctctcgtgcgcattgcagtgctctagatcagtcgtactgttgctgcatgtttcatgaaaatttctgtgctgatttctttctaatgaaatgctatcaataaagtccaatccacttgtcctcagggaaaattcctatagataagaaaatggactcaagtaagaataagtaggtattcagagtttggcatgtggattttcaatctgtgtacagatgctaaaatatggcctgaagttaattttatggctgggaaggtagtagtgttgaggggtttaagcccagaccatcccaaatcccaatgagatcttttcagtctaagaaatagttgtttttttttaatttaaggcaatcttgcatgtgttgtgcatactctcactgtaaaaaagacaataagttaatcttgcatgcgttttgtatcatacaaatatacgatagacagcactgctgccgttaaatcattacaccagcttctgctcattatgctggtttctagatgagttatccgttttattttgctgttcattttcttatttcacaaaaaggtgacctcagatgtttttagatggtttctgaatattgaatggcttgtgagctgtaatatctgtaattaacttgtctcatcgttttgtttgtccctttgcaaattcagctggtttggggttgacgtgccccaatgttcatgccgcttagaggaagacagaagaactacaggagcagaacccctgacagtcacttgttcattcgtcccttcagaaaattacgctgcttcagatcgaatgacagagaactgaatgtcttctctctctctctctctttggtatcaactcttctgtttcccggtcattagatattactggccattgtgctctgaagttcacgaactgcattaagcaactaaggagaatgtgtacctggcaattgtgtgttctgacatttgctgtagtttctccatcgttatctgtgattctgtatgacacgagtgatgatcatccatacatttgcagaagtgaaatgttatgctcaagtctgaaatatagatcaggcaactctgcaaaagctgatcctgtatttttcatgcagaagggttgttttatgttttcccttttgtctgttgcaatgcatccatccacgtactgaaacttttatctgttaatgatatcggatttgcaccttgtttggtagaaaattgagccctcccagactcgagttatagagtcatctgggtgcaggttccaaattaattactaattaccgctgcagtgtatttcagacttgggagctgcagtatttgtgcttcccttcatgtccccagttttcagataggagtatgaatttactgttctgatcagttttcgcagtcttctttgcgatcatagaggatcacagcatgaaacattttctgtatcccagtcagaagtgaaatgttattctcaaatctgaatacatcaggcaactctttcagatatattgctctgtagttcctgtgtgtttgtatagaaagattgttttgaacttctgattttccccttttttttctacaccaaaaacgcagtcagatgaacaattggtggttggttatggatatcagcagctgcagtgtttcagactttggatctttgagcaaaaacaatttattttaattccattcacttagatacagtgcattgtacataagagtataacatcagaactaaaaaaaaaaaatcaaatcagtactgtactaagtgatacttaaccacatataacgcggctcatctggtgttgtgtcccgtcgccgccgaatcaccgatgccccttcctcaccggcggtgccactccaatcaccggcagaagcgtagtcgtcgacggcgcgtggaatgggccgaacccaccgactagtgcagtgcggcagcgctcgccgcgccggcggcggccgtcgtggcggcgttggacacacctgagcaatggcaactgccgccgccgccgcgctcatcggcctgtggccgcttgcgccgtcggcttgggttccacactggtgttctctgcccgcgcggccggcgacaggacgggttcggttccgaacgcctcagcacggctgctactcgcacaccaggtgttcgttgaaatgcttcggaatcgttcgctgctaatctggttggtttttgtcacagggaagcatgacagcacgacgcgtggcattcctagtcttcaccgacgaccgtggcaacaggcagcagcagctagctctcgttctcctctgctcgacgcctccggcgtcgcgagcatgacgccatcggcattgtgggccccatggcccacctgtcagagaagggggaggggaggtgcaggtgtgggcccacctgtcagcgaagggagagaactccttcaaattgcggccgccttggcgctgtgagccgtaactgtcgcaacgaactcctcccctccctccgctctcccctcgccggaaaaccaagaaatcaagaaagcaagagaaccctcgccgcctccgccgctcgccggaggcaatggagaagttccacgacgggcaccacgtgtggctgcggagccgcgtccacggcacgtacctccgcgccggcgaggacgggagcggcgtctccctgcacgagggccgcgcgtccgtgcacgcggcgtgggcggtgcacattctccacctcgacggcggcgacatcctcatgctccacagcgccgcgaacgggcggtacctcgcggcccccaggaccgggtggtcgtggaacagcgtcgacctgcgcgacctcaaccagctcccgtcgttcaccgtcgggtggttcgccgtcacggcgggttccggggactacgtcatgctgcgtcacagtagtagcgggctcttcctccgagctgatggcgggaacctcctgtgcaatagcgtcggcgtcgtcgtcgacatgttcgacttccgccgcagagagatcaggcagtgggtggtggaggccattcccccgagagattccatgcctatcctccccaatccttcggtgagcttgtcatgccctgtttcctttcctgatgcttgcagaattgattgcattactgggttctccggggatcaattcttgttcttgatcttttcttgtgtctgattgctgcgaattgtgttaattcctttctcctggatgcgattctttgctctgtttttgccatagttcaaggtgtccattctctatggtgcgcattcgtaggtggagcagttctctatgttcttcagttcttggttgctctgcatttgcttcgctccgtggtgcagttcctaggacggttcttgagaatggcgacatcattattgctgttctttcttactactcgtatgttcttagtccttagtcacttgtgcttgcaatgacttcttgtatacttttgttttgaaacttgacttcttatatgccatctaattctttgctgcagcccacagctttcagctggtgccgcatctggtacgtgcgagcatctcctcaagggaatttccgccgagaagactggcgttcgttattgttccatgggaggtcagtgttccatctaaggaacaggctggcgagtcagttgcgcatcagagagtcctctgacgccatattgtgtgttcgagcgggctccactggacgggtgactcctctggttactgatctgcctcgcaacactttggtgatagacattgtcgttatcacagccgggacgaatggtgagatttccttttatagtgatagattacatatttacatgttcatggtacttcttaagtcttgaatctctcgtgcacattgcactgagttaggccagtcataatgctgttgcatgtttcatgacaacttttgtattgatttctttctaatgaactgcttttaacatagttctatccacttgtcgtcaaggaaaatgtatacatggtttgttgagagaaacttatctgaaaattcttgtagataagaaaggagaaacaagtgaaacttcagagtttggattgtgaattttcagtctgtgtacatatgctaagattcagagttcagtgccttcgggcatccatctgtaaataacataaaaaataaaatgacttgttagttcagtgatctttgtaaagcttctttgttaatgaattagacaatcctgaagctagttcagtgattcagaacatgacttgttagttgcatacatattcatgctccttttgttattttgtcttgttagtagtgttgatggatttaaaacccagatcatctcagtcagctctttcatgtctaagaaaaagggtttttgactttcagacaaccttacatgcattgtgtatattcactgtaaaaaggttcaattgtacagttgtttcatacaaatatacaatagacaacactgttgctgacttacagttaaatcatgacaacagtttatgctcattgtcctggtttctagatgagttaccccttttattttgctgttcattctcttctttctcaaaacggtgaccccagattttttttcaactgatctctgaatattgaatggcttgtgagttgtagtatctgtaattaacttgtcttttttttttttttgctcctttgcaaaattcagctgccctctggttgaggtaccccaatgttcatgccgcctagaggaaggcagaactacaggagcagaacctctgacaatcacttcttcattaatctcttcagagttattcgctgattcagatcgaatgacagagaagtggatgtcttcaatttttttttggttgattcaggttcagaaagggaaactgtcaaaaaccttctgtttcccggtggttaattagctataggccattatgccctgaaagtttacgaactgctgtaagcaactaagtagaatgtgtgcctgacgaattatgcgttctcacatttgctgtagttttccatggttttctctatgattcgattgatcatctttttgtagagtgcaatgttatattcaagtctgaatacatcagccaactcgttttcataacctgtgaaaaaaaaaaggtgatgggctagacgtcctgagttcgaagcctcacccattctaattatttgatattaggtcattctctgatattcgtgtttttttttcataacctgtgagtgattctttgcttccatttgctagctgttggcctaacgctctgaagtttacaaactactgaaatttctaactactaaatagaatgtgcgcctcaacaattttgcgttctgatatttgctgtagttaatttccatggttactgtgtatgataattgatgcaactgatcatccacaaatttcagaagtgagatactgagatatatgctcgattcttcaattttacattaactcgcatcaggcattgcctgtcatctaacctggagtagtaaatttgacatcaaaactaaaaagaaaaaaaaatcaattccttcagtaattggttacatgcgcgattgaggtttcttcggcggtgggtgttcccaactccttaccttcgttttccacgtgcacgtttttaaaactgctaaactgtacgcgttttaaaaaaaaaatagaagaaagttgctttaaaaaattatattaatccattttcaagttttttaagctaatatttaattaatgagaacttttacggtacaatatactactagtatatactgccaatataaatgatctaacggtgtagattgaattacttaccacttacagtataaaattaaaaagggcatatttgtctttctattttattgcgctggggcaattccgttaattccagcagacaagcacactactgggtgttccttgcaagatccaatagtgattccccatgcccgtcattcaccccaggctaaggccgtcgttcacccaggcaaaggtgcaccggtgtgaggctgtcagatattgattaatttcctagtttgcattgttgatatgatgttcattggatgtttggaagatgtagattaagcgtattaattaaaggaattaatggtgattaagtactacatgcggctaccctgcttaagattgctgtatgttggtagacggtacagcccgagcaccggcctcgggttgccggacctagctccgccactccctataccattgccatcttcagattaaaatggcatagagtatttgtaagaacatgacccctcttgcagattgcatgaacgaagaagagggtaaagagtaaataacatacatctgtagactgcacatgtatgcatttttatgcacagatcagggcgtatgcttgtagagtgcgcatggtgtttaattctactccggctcggcagagggcactgcgttgccggctggcttgccgccagtatgcgggactgcatgtggccatgccaccacagggagatggcggctgttcgctttggcgggaagagggacaccgaggaattccgccgccgacgaggacgaattgcgccgccggtagggctcatctctccctctcactcgcacgacggcatcaacagatagggattgatctgaaaagcgaattactaaattgcccttacatttttttagcatattcctataatacccttgaaaatacttgcagtatatactaacagtatattgtactgtaaaagttctcttaattaattacttgttaatctatcgctccgttttctatatggaggggaacacaagtagtgttcggttgctgccgaacgctgccgacgtcttcctcatcgccggtggcactgcaattctcgccgccaccgacgtcgtcgtcggcgtcgaggtccctgcgtatctgatccaacgagcggcggaccgcggcgcatccctcctcccggatgtcgcggataatctcgtggatctcctcgacggggtacggcgagtagccggagtcgacgatcttgagcagcgagtcgacgatggtgttcatgtagccgatcagctgcttggtctcctctaggctcatgcatctgggctccggatcatctgccaactcggacacctgcaccgccgacgactccctctcagtctcagtctcatccatggcgattcttggctcgttcggcgacaacgacgatggctgatacggtggttcgattgagtcgatgagatcgagaatttgagacggagcgttggtctggttatattggcacgcacgcaggccatgcacgattcgtacatggactccaagtcccaaaggaaaaggatttgtattggccggttctaaaaagaaaaggactcacgtgttcgacaaccgaaccacgatcatgcagtgggtggtgttcatggtccaccgtacagtacatatatgtatgagaatcagggtttaatctggcggaaaaccgacaaatcccgaaaaaatttcgcggaccaaaatttgaatacaaatccctaagcttactgatatgttcacaaaagccggtcagcttcggcaaaattccaatagaaaccatcaaaatttcaataggaaaccaaaaggtaaaacgtgctgaaaactgtccggttttatcgaaaagccgataggtatcttcgaaaaaccgataagaaaaccaagtttgttttttgttagaaaaatatagaaaaaaatgtgataattgggaaaaaaaatcgtgaaaacgttatttcctataaatttgataacctcccatcgacatacccacgatatgtaatatatattcataaaagacagttcatatcactcaccaaccatcggccaaatagaatgcccatcaccaaatacataactctgtgaccgatatattgcaagaattaatatatttccagttgtttttcttccctgaagaagcatgtcatacaagctgctccttcagaagttcactattcgccgggcttcagaagttcactatggggtgcattactgacaattcaaatttgccgcagttaattttgaaatttggatttgggttatgaaatttggatcgtagttacatcatgtattttcttggacctactgaaagttgctctactgccaaagtgccaatgctggtttgggcctctctcagcgaagccttcatttgggcgcaattttgcaaatcccccaaccaagccatttctaccgccggccgtcgcggcgttggacacaccgaacccccgagccgccgccaccgtcaccgccgccgccacgcgaggtcggcacgtcgcagaatgtatctgggacgtcgacctgcggccgctgcctctgttgaggcctctactacagctgttcgccgtcgccgcgacaggacgaattctcatcttcttccgctccgttctactcgcgcatgaggtgttcgttgaaatgcttgggaatcgttcgcttgctaatctggttgttttttttttctgtcacagggaagcagacaatcgagtatgtgtatggctttccttctcctctacttaccagtagtcgtggacgacgaaactggctttttcgccgtggcgccatggaccttggtgagcgcgccatggtcgggtgcagccggcagctagctatcgttgcttccggcgcaacgagcacatgacgtcatcgagcatgtgggcccggaggcccacctgccagcgaacgcggggactgcggccccacctgtcagcgaagggggacaactcctttaaattgcggccgcgcttggcgcctagaatcccgagccgttaccgtcgcaacgacctcctctcctcccttcgctctcccctcgccggagctccaagaaaccaagagcgccgcgccgcgccggctctgccgctcgccgatcggagctccaagaaaccagagccccgcgcctcctccgccgctcgcccgagtggagcggcaagaagccaagaaccgcgcgtcgcctccgccgctcgccggaggcaatggagcagttccacgacgggcaccacgtgtggctgcggagccgcgccaacggcctgtacctctgcgccgacgacgacaggagcggcgtctccctgcagcaggaccgcgcgtccgtgcacgcggcgtgggcggtgcacatactccacttcaacggcggcgacgtcctcatgctccacagcgccgcgaacgggcggtacctcgcggcctacagggccgagggatcgtggaacgtcgagcggctcaacctcaaccggctgccgtcgctcaccttcagctggtacgctctggggtcgagatacggggacgacgtcctgctgcgtcacttcaagagcatgttcttcctccgagctcttttcaggagggatcgtatcagcaatagcggcgccgtcggcctttgcgcgatggaccggggcaccacgaccatgcagtgggtggtggaggccatacccccaagagagtccatacctacccttccagatcctttggtgagcacgtcatgccctgtttcctttgctgatgcttgcagaattgattcttgatcttttcttgatccttcggtgagagtcgattgcattactgggtccttcggggaccaattcatgatctgttcttgcgtcagatttctgcaaatagtgttagctccgttcttatctgcaattcttggctccattcttgccatatttcctcctctgttgctgatttgctaatcgtacatcctgcgttcatgggaaagtaattgttagtagcattttagctcaaggtatccattctgtatgttgggagcagttcttggttccatgtgtcatttcttcagttcttgccccctctgcatttgctctgctccagttcatgaaattggcgagatcacaattcctgttttttttccttactactcatatgttcttagtccttagccagtgcttgcaatgactggtgtgttctttgcagccgcccagttctttatccggtgtgtaccgcatctggtatgtgcgagcaaatcctgatgggattatctccccaaacgactggaggctgttcttattctacggtaggtcagtgcgcaatctaagtgcattgctgtcgattgagttgggcatcagaaggccctccgacgccattttgtgtgttcgagcgggcttctttggacggctgactcctctggttactaatctgcctcacaacaatatgttgttgaacttggacattgtcgttatcacagccgggacgagtggtgagatatccttttatagtgatagatttacatatttacatgttcattccttttgtcttgaatctctcgtgcacattgcactgcgctacatcagtcgtaatgctgttgcatgtttcatgacaaattctgtactgattcctttctaatgaactgcactagatcagtcataatctggaaattcttgtacataagaaaaagaaatcagctgaaaataagtagctattcagatttggattgtggattttcagtctttgtacatatgctaaaatacctgaagctagttcagtgccttcaggcatccctgtaaaactcctcttttattaatgaattaggcatcctgaagctaggtcattgattcagaacaatgacttgttagttgcatacatattcgtgctccttttgttattttgtcttggtagtagtgttaagggatttaagcccagaccatctcagtcagctcttttcagtctaagaataatggtttttgatttaagacaaccttagatgcattgtgtgtactcttttttgtttttgctgggccggcggaagagaagtcgtctgattttttgttaaaggatgaccccagatgtttttagatgatatctgaataagtgaatattgaacggtttgtgagttgtagtatcagtattaacttatgttattgtttcgtttggtcctttgcaaattcagctgctgatcggttgagataccccaatgttgatgctgcctagaggaagacagaacaacaggagcaaaacctctgacaaagtgacaatcacttcttcattaatctcttcagagcttttcgctgcttcagatcgaatgacagagaactggatgtcttcttttttatggttgatataggttcagaaagggaaagcgtcaaaccttctgtttcactgttgttctgaaggttatgaactgctgtaagcaactaagtagaacgtgtgcctgaacaattgtgcgttctgacatttgctatagtttccatggaagtgcatgattcgattggtcatcgttttgcagagtgaaatgttatgctcaagtatgaatgcatatttctcatgaccttttccctgtattttcgtacatatgtactgctttgtgtatggcaatgtattcatgtgccaaaagaacaaggcttaattttcttggctttgcattttggtagagaattgagcctcaaatttcagagccatttgggtgcaggttttcaatttcagatttagagtaggcttactgaataccttacttttgcgtaggtatatgttctgaaaaaacggagcaactcttgtgtttcctggttgttagcttcaatgcagacatcaaatcatctgtttgttatccctggtgctgtttctccctgacaagaagctgtgtatgttttggcctttatgttatgaaactttcagactgctgagtgctgacagcattaggtactagaacatatgcctgaacaattgtgtagtggtattggttataattttcaccttcgtctctgtgactgatagcaagaacatatggctgcttgacaaataaattccgcagtcaatttttcgaagttggatttgaattgtagaatgtggatcgtagttaacatcatgtataccaaaagctcagcacagagatatcatcctgtgtatttgttgtcgttctagctacagtagtaacaatgagtattttgtccttcaacctgttgaagttgttttcagttgttcacaaataggccatatacatttgttgagaaaaaatatcatccgagggcgtttggtctagtggtatgattctcgctttgggtgcgagaggtcgcgagttcgattctcgcaacgcccctattttactttctttttcataatttcatttagtgctgactttgttgcaactttgaactttcatcatgtagaattttcctgaatcctgatgtctactcacaaattatcttacgagccagtctttgaaattcatttggatttgaattttacgcaattttatactgaatcacttcctactttcatttagtgctgacttgttgcaactttgaactactttcatcgtatagcattttcctgatgtctactcacaaattatcttattaccgtattacgagtcagtctttgaaattcatctggatttgaattttacgcaattttatactgaaccacggaatcagttcatctttttttagcattgaaaaagttcaggcctctcaagcttggactgccacttgctccacccaacgcgcgagtctgtgtgccgccgccgccgccgccgctccgatggaaaccgccgcggcggcgccgccgcgcgtgcaggccctagccgacgccggcgtctccttcctcccggcgcagtacgtccagccgccggaactccgcccggaccccaccaccaccacccaccgccgcgccccgaccgccgcctccctctccgtccccgtcgtcgacctctcatcgcccggtgcgggcgacgccgtccgccgcgcgtgcgccgagtggggcgccttccacgtggtcggccacggcgtccggccggggctgctcgacgcgatgcgtggggcggggctcgccttcttccgctcccccatggaggagaagctccggttcgcctgcgaccaggccaggggcgccgccgccgaggggtacggcagccggatgctcgccaacgacgactccgtgcttgactggcgcgactacttcgaccaccacaccctcccggattcccgccgcgatcccacccggtggcccgatttcgtccccggctacaggtgattgcttgatcagttcatgccttgaataattgcaactggtacagatttttgcatgcttgaaatcattgagaaaaatgagagtcaatgttcagatatgataacaaatagaaagtgggcaaggaaaatttggtatcctacattttgggttgcctacttgcctctgttgttgattcggggttcatgttcaccgtggaggaatattatgtcatgcagatgatatgattatgagacttaattttgtactttcatttgaagcctgatagttctgcgcgtgtttgaaggatttttcggaatgctgtttgctgttgcattggcatcattgcatcatttctgtgtgtagtcattgcattgagaaaagaatgactcaaaaacatctagtgtcattgactcattgtacagtggacatatccatggaccatcacatattcgcatgagctgcggctttaacagataagctaataacttaatgttcgcagggacactgttgtgaaatacagcgacagcatgaaagatctcgctcaaaaattgctgcgcattgtctctgaaagtctgaacttgccaccttcgtatatagaagaagcagtgggggaagtttatcagaatattactgttagctactattctccttgcccacaacctgatcttgctcttggattgcaatctcattctgatatgggtgcaataacacttctaatacaagatgatgtgggtgggcttgaagtactgaaggacgggctgtggatacctgttccttctttgcctgatggaatccttgtaattttggctgaccagacagaggtaatattccttcacatgctttaatatatgctataccttctaatgctatctaatgtgtaatcaatatgctccaaactaccaaaatacattttgctactccagatgattttattcaagtattatttttatggtacaaattatctgttaggtaatttttgactctttaagtagtattaatctggcatttgcaattcattttagtttcattgcgaacttaagataagaatatggtcctgtgatacttgttcttgctactcatcctgcttgtattgtttcgaatagcttgtttactgttgtattccgagtagctgctaccaatgcgttctttccatataatttggctcctgcaatccaaatgctactaatgtttgcctttctctagatcataaccaatggaagatacaagagtgctgtgcatcgagctattgtcaatgctgatcgtgcccgcttgtcagtagcaacattctacgatccatccaaatctcgaaaaatttgtactgctccacagctcgtttgcaaggagcatccacagaagtaccgggatgtgatatatggtgactatgtctcatcttggtatagcaaaggcccagagggcaagcgcaacattgatgccctcctgatcgagcaatagaaccagaggcagcattatatagacagaatagagacattcatgcgtgttgtgatgctgtccaagattgccgatcttgattaataaagagaataacattgtaccatatgaatggttcctggtttttgaagtttctatgattcttatcaatacttcccttgaagcaaagctcacaattgtgatttctgaccaactgaccatcatattacaacatgacatgaacataggaaagaggaaaagatactgattcttaacatctatttcttgctaatatgatcatgctgtggagtaattcccagcttcctggagcctcacctccagtagctaagtttgtggtagtgggagtattgcactggtagctggtcagctggcggtagtatgtttcttcttgggatcagtgccattatgctgcagcctctcaggactctggaatcaccagtcaccaacagcatcaagctcctaagttcatcgctgaggtagtactgcactcatgcttatttctaataatgtaaatacttcttacacttcattgatgtgttgttataagttctatagcatatacgatcacttgtagaaaaaatttccatgaaacccatatggaactctttgaggtaaagtgattttcaataccggttcttctgcaaatctctttgcatcaataatgtaaacctacaaaaatgatgttcaataattaaggatatgcatggaaaacagggtgaagtcatgtcatgtgcttcctttaccagtaaatcatctaatgaggtttaaatacctgagacacattagttaattcatcatggacatatgttattatccatccatcatcttcatctattccattttcctttgcaacaaactgaactccagagcagaaggttttctcttttaaaacgtggtactccactgatttcagttgtttgttttcctgcggttgttctgaaacttcagtccaagtaaagtcatagacaaaaaacagttgatacttgtgcagtattttctgaccttatcttgcctgtcgaagtgtacctttgctatcctattatacttgaataaacctgcagcattacacacaatcgtacatattcagtatatgaagattgcatgagtaacttaaaatgaacaagcacatactgtaacaagacatgacataagcaattaaactgtcgagaacaattatatatataagtctcttttagtctttctgcaacttcactggtaggcaattacctatttcactggttgctactgagtcaacaacctgtgcatatccgtagttgtttttgaccccaacaaagtcttcattgataacaggaaaatccattgcaactttctcatctgtaagataaccttcttttgtagttccgcttttcaagtttagcctccattcatatggacgagaaaagagagtgccatctactgatggatcaaaaccttctgaattcttatctggctggagaaatgctcttccagaacattttgacttgtcgtcatcatgacttgcactagagagtaccgaatcaagtgttcgacaacctctgataacaacctgtttacaggcttttgccaatgagtataaatagacggaaaaaagcatcgctaatctatattttctatgagattatcctcatgtatgtgacataaacccttttatgttgggaaaattagaatgtttgaaccacaagaattacacggaaaaattgttctattagattgattttctgattttgtttctgtactctaaatgcatctatggtaaattaatgattacataactaggtccatctgaagtttctataagcgtaatatcgataggatttttggatctcgtgtgataatttaatacatgaatactgattttgtaaaggttctagcgaaaatactggaaaaatagccaaataggcagtccatagctaagtaaagctaggtagttagcatgttgcacactacaattttgattcataaggcaaaactacagcagaatataaagctttttctggataacagctaatcatatctatatatttctctggacaaaaataataagaccatcaattgaaatagcagaaagattaatccagaatgtgtattatagttgcctacagatttttttaaaaaacgatttcagtatggtgaacatatatacaagtgcagctacatgcctcatgcaccagatccactcatcccacctctagtatgaaattatcagtagtgttataaaaaaaaagaagcaatgtctgttctgaacctccaatgaccattaaagctgtttcatgatccttaattttatcttttgttaaaattgaacaatcacctcatttccatcctcaaagcaattaaataaatggtaactgcaatgattctccacatcaaaccagatgatggaatcagcatcaccaaacctaggcatcactccaatgcgtgatatcccgcccatatcattttggatgaatctgaagagaaacataaccacattattatggattattaagtcagtatgcatatttcccacagaagtggttgtcatagtaaagatggtgtatatgtatgggacccacggtttgcgtaaaattgtccttattaagccgaagtggagaggatagtccattataatattgtacctacaatataataattagtagttacaagaaaacgtattgttgacagcaatataagatctcataaataaaagctagcatactgtgcagttactccgatgtcatgaatgagttttccttcctcgaatttgagatcgaccttgtgaagaagcctctcaccatcagctagttcatgtgaaagaacatcacttaataatattgtaataaaatctaaaagatcatttttgcccacaataatagcaagcaagacacgtgtgtggttgagaaatttatattggttcttttgatacaatgtttgttgatatttctaatcttatctagctgtctttttttttcatgtaactattgccagttactatagtaatattgtgttccgtttacactttatttttattacttatatgccactcgataatttgcaaaaccccagcctggacaggcgctatcaaacaaggttcaacatggtggatctgagtgcatgtgctagttaaaaatacgagttgcatataacaaatgctacaaaaggttggtgtaatatactctccctgacccaaaatgtaagggatgttgggatagagggggtagcccattttcatgtattgttttacacttgtctagtgattgcatttatgttccaccaaatcacaacttacaggaaattactccaagcacatagtggggtttttcaatattagttcccatcgtcacgagttctccacttccacaaatcttctgtaaataaaatcatatgcatgtaagcccttgctatagatgaatgatgctgctcacaacagaacattatgaacaatttgagtaactttagttggcattaaaaatattccaagaacattatgtgtttgaactttgagttgatgatccatgcttcagtaatcattcaccatgtgaatttgtgaagttaagaaatggtggctgatggattaattgatgaaagatctctactgaaaattattgaataataatattaatatatcactggccttgcctactgttcatactaaaacatcaaacacacatttaaagaaataatgagcaagctgtaattgcataatagaatacctttgggtggctagtgaaaggttggtcccaagctccattaatgttgtaaggtcctagggtgcggagattattgatgtcaatttcgtaaggtagatgattttctgtggcagcaaaagctcgtccagcatgctgaaatatggaagtatttgcactgtccttcacaggctttccaaatctcacctataaatatcaccgaagatgatatgtagtgttaaccatcctcaagaccaagtttaaacaaaaaaatcatgtgcatctgacaattatatagctactcaaattccatgagaaaatgattcaacagcggcattcagctttttccactggagaaacaactaatttgttgagtttcagatattatgtaaatctattccactggagaacagtggaatttttacatctttctcatgtcgattcttcttgtattgaaataagaatatttttttactatgcagaaaaagactgtttcttatttatttgggtatgtatattggactgccttttcttatgcaatgcttatgtcacatccagtagttaatctgttctagatattgatttaacctgcacatcatattttcgccgtgcatctgcacatcatattagagctcaattatcctatccacctagtgtttacacttgatctaatactaaactatttaaaattaggaagacttacggtattaagaagaaaagcaaccagtgttgcacatggctcgccttcagcagatggaaggaaagctattttgttcttctttctctctaattcaaaagtgtctgtgtccacatatttgttcttgtacgaaatcctccattctcctaaattgctcttgctaaggtagatagcatgcaacattccatgtccttcataatacatgtatgatgttgggccaaagatggactctgcagctgtctgtgatgcattaagagggtttggacctgttcaaatagatcaatgttacacgtgcatagaagtttagcataaatctgattcattattaactttttttggttggaaagatgtatataagcttgtgagcctggaagtatcagaactcaccatttcttatatagacaccctcaggaaaatcttttggaacctctccattgagatcgtcaatgaaaacctcatcaccaatttcgtttacaggtccaaaattcccctgtagaagactcagatgaaaattatgccaaattgatgagtcagataaattggatactacaaaggagatggaaaaaaaaagttgctcgtcgacttcacaaatttgatgctgaacaatgtcatgtttgcaaattatatagtagcacatgcatacattaacaatctttatatttacctcattcagataaggctgctcagaaaacttgtacacggagtcgatgaatcggtccagcagatctgaagagactgatttcagagcttttgtcaattcctgcatcagtggctgcttattccacccagtaactgaagattgcacctgaaggatggtacattttgaggtaacctatcccttcttatattgcacaaaatattgacttaagaaaaacaaacgcagagatctgaaggtcctattgaggtagatgtagctttatctcaactgaagaacacaaatttgttacaacacattgaaaagtttctttgttttttttcttgggagaacttacaacacgtttcaaagttagtacttgaactgcttgctggatacatgtaggcaggcatgttccatccattggtttgtctggagacatcaagttaataaatcattattatttccagattagttaccttgacggcattaggtggagacaatgaggaagcttgatcagctgggctcttccctagatgaatgcatctagtgacctgggagctgcaccctccagctctgaacatggcttgctcaggttattcgatcctctcttgtcagttgtaaactgttactggatgttatgcctgctagttcgagcttgttgcattataaagtggaggagcagtaagccagtaaggcatgcaagaacacagacaaatatggtttatcccttgctatgcatcggccatggggaggaataaaatggtctgattggttcagactagcttaagagcaaacactacagtagataaggagcatattcttgatggtctgtgggtgcaataagacagggttaattaatcaagaacaagttgattaatatatggtcgcagaaatcagtctggaatcagctcaacaagggatgcaagtgcaactaggactgatttagtcatgtagtgatgtagatcgtgatttgtgacctgcgacctttgtgattgatttgctgctgggttggcagctctgtccgtgctatgagctcgtgaatggaaggaacaccagtggcgaatcacaatgacgctcatcaggtcaatgtctttttttgatgtaaaatcaggacatgttaatcacgatgatgctcatcaggtccatttcttttttaaaaagtaaaatctggacaagttaatcaccacaccgctcattaggtcaatttctttttttaaagtaaaatcaggacaagttgtaccacatggaatttcattacggaagtagttcaaattaggctggcttttttgttgtctaatcactcttgttgatatgtactccttccgtatttaaacatgtcattgttgattttattagtttgtggaaatataaaaatcgtatgggtccatttttccttataattttgttagatactatcgttatatttaaatacgaaggtagtggcataattgcagtgtaaaccccccaaaaaactgaagagatgcaggttttttgtacttagcattcgcaaatacagtaagagtttggttttgttcgtacatacatgcacgtatatacaagttcacaagaacagcagtcaaatgtggaccatgcgcaatggacgatgggttccaacttccaaatcttagtcgggccgttgcttcaccatgtgggctaaagatgccacgcgaccaaagcccaccaccacaagtggaccaaaagcccacataaaccgagggtaattggaccgacccaacctgggcttcccacatgggcttaaacttattcgcgccttctccttaccaggcagcccatcagaataggccagccgcgtacattcccaatgctcagagagatggactattattacgcatcatcaaaatgttaaacgaccactttcaaaagaaaaaaaaaagagcattgtacttgtacgaacacatataccttcgttgcaatcacaaattcgcaatcaaaagatccaagttcatcacatggccaactgcgcgagagatgacacaacacggctgaaccgctaaaaaaccgctacgaaaatgttttaggatcatctgtgcattcttctctgtttaaggttggtaacagagcatgcagtgctaccttcgtctcgggctcgtggcacgaaccgccaaaaatcgacggcgatatcaacctcgttttgtttgtgaaacttgtatgtccgtggtaggttgtagcggagctggaacagagggaaatacagattatcatagcaggaacaaaactggaaacagaaaacatatgttttgacccgtaaagccttaaatgtagaataaactcatctagaaaccaatcaactttttgccggatttcaagcaaaactagaattgctagtcaagtgttatatcccggtatttcaaataatataaagaaaacaggtgcaaaaatggtttaaaaaatcataggtagctcaatatcgcatttcaccattctatttgcccagatttcctacagctagcaggcactgaatacatttggtcctccaaactttactcatacccaaatgtctgattcagtctaaatggaagcaagaaaacaaaaaaaaaattaacaggataatttatttactacttccccattgaaatactgaacaacatttttagggggtagatgcacaatacaaaatgataagcgcctagcatctatttagttacctcacatagaacctcggcacttatggcattgcagttgcgcaaggctaccttcttgatgtgctaaagatcagacacaaaaaaggtggacaaaaaatcaattaataaaacttccatgctaactacaagatggaacattgataaatatggttacttcttgttggaaatacactgttgcaaatagagaagggaataatcaaacatttatcatcagaatctaataaaataaaagagagattgtttctgacatttgtaatccccttgaggaacacttacttctctggtagaagtcttgtgtagcgaatagacagctcgagtggcaacctgcaaatagcaatagatattaaaaattttaaacatcatgcaataatctcagtcatgtgtatgatggcaactgctgcccagtgccctcaccttcatgcccatagaaatgaattccatgtcagctccttttctgcttgtcccaaagggaggattcatgacaacagtgtcaacaagaaggcctacttcaacaggtagctaaaagatcagggaagcttttcaatgttgaaagcatctacgcttatgtgtataaatatatgattttgtttcaataaccattcacattttttttgtgacactatattatctttcttgacctgaacaatggtgcacaggctattgaagtactggagagaaagtaaatagctgactcgtatagtagcatcagctaggatactactctggatatcttctctaggtgctatctacttatgtatgaaataacaaataaataacatgcaacagaaaaaaacagtgtgaaaaaaaaactatgagaagatcagaagcaataggttatatagaaaaataattaaaaaaaaaactgaactaaaggtgcacttaaactaggtagagtatgtcatcatttaaggacaatacctctcaaatttaaattctttatatcacactgaattaagtcgatatccagctgcacatcaaacatttaacaaaagaaacatgtcattcacatagtcaagtattgttactgatcctagaaataactatccctgtgtccaaaaatatagctgtttatggctactatattttgggacagagggagtgatacattaaatctgagtctctgctttcagccctactttgccaacatttgcttagccatgcaaatttgaccactaatactaaagaacatgaatagagacagagacagtaaaacctatatttaaaaggataatctagacagattagtagatcaattgaacagaacaaaattattgcatctttacaaaagaagggaagcatactaagccatttatgaaatttctatgatgcattgataaaaataatccatggcagtagtacatataaagaaatgcaaactgcaatatttgaatataaaaaacatctcagatgtggagaactgaaaacaaaaatcaacacctgtagtgcatttcagtagttgcagaaagctgatttaagcatacaactttccacaatgctatttggcaggaagacgccattaacaatttgcactacatacagatgagaactatcagaaaattatgactacaataacatgcatagtttggtggtgatgcaaggaggatgctggaaaaaggtgaaaacgagagggtacatagacaatgtgaagatttttcaacttcaggctaaaccaatggttatattcggaaccaaaaaaatgctatacctctagatctgcagcattttcttgagcaagttcaagggattgcgggtcaatatcaattccaacaacatgcctgtgatttcacaaccaaagggacataagattagaaattgtaactgaacaaataacaacaaaaggcataaagatactgagtgatgaacctcattttcttgtttctaatactaatcgacgagcacttaagttctgtaactaatgtggtgagcaagtggctaggtgaactaatgtggtgatttactgtccactaagttctgtaactgatggtatatcaacacacaagcatcatggacagatatacttattaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 7359 - DNA, 775 bp, Oryza sativa
atacttttttcactctatttgtccaatcgtaaatcaattcatcaggcactgcctgtatacttttttccctctatttgtcccaacataagtacataggactaagctagtaaattttacatcaaaactgaacccaaaaaaaaatcaatcccttcagtagttggttacaagcgtggctgaggttgagcagcgttctgctgctgccggaggccgatgccttcatcaccgccgccgccgccattatcatggtcgaggctcgagggccgccgccgccgctagtagcgcctcagtgtccctgcgtatctgatcgagcgagcggcggaccaaggggcatccaacctccctcatgtggcggatcatctcgtggatctcgtcgacggggacgggagagcagccggcgtcgacgaacaccagcagcgcctcgatgatgctttgcatatcggcgaccagctgcttggtctcctccacgcggatgcggctggtctccgggtctggcaactccgacagctgcactgacgaccgcgccgccgacgcctccctctcatccatggcgaccttgtagctgctcgtcagctcgtgcgtgtgcgtgtgtccatgagaccgtgactacgacgatggcgatggctgatacggtggttggttcgaggggtcgatcgatgagattgagacgtagcgtggtgtggtgatatattcggacgaatcggacccggactccggagtccgaaaggaattctaaaagaaaaggaaagggaaaaaaaaaaaaaagagagagagagag

SEQ ID NO: 7360 - DNA, 1525 bp, Oryza sativa
  unsure (1)..(1525): unsure at all n locations
gcgatctaaagtatctaactgctcgatacatccatgtcttcacgcgataatgtcgacggcgtctgagataagatactgctatattacgctggctcgccgcaatcatcgcgggcattgcgggcgatctctgccgctatatatntgcaagaaatatttgcattcctccgncgatatatatttccattccgcgatctccggtgatatacattgcaagaaatatttgcactcccccaacgatctcacggtgacacaagaaatatttgcaatcgctaataataaacgaataaatcaaacacacactacacactaccatcatcgtcgcgtcgtcggtcgtcacagcctccgtcgccgccattgtggccactacgaagaagcgtggtgaatttaatcaaccaccaatcatcaattaataacttgcaaaattcgtcgacccattcattcgttcatgtgcatttgtaaggcgtaatacttttaaattacgatgaccgcaaaaaaaggggcaaaacttgaggaaaacaagggaaaatttgtaaattacatgccaattaatacgagcttaattacgtatgtgcttgcaattgctgattttttttcaagtataagcctgctaatatattaaaacgattgttgcgtccgtaatattcgagccgattaaccaaagttgtcccaaagttattaggccgtgatggcaaaaggtagaaaaaaatactgaagagcatcgatgttttaatctccgaaccctcctaatttgaaaaccaagaaaaataattcgaaagggttcgattccaccttagtcatcaacatgggccaaaacttccgtgtctgtgtaaactatgggcttttaatctagcccaatttctaggcttggttggttccactatggatacggcctaatagcaccaagtggattttggacgttgcacactgggtctaaaatcaccgcactgccaatccaacatgatgagaaaaaggaaattaaaagaaaaagaaaaaggtccaaatgggggtcgaagtttttatctccgaaccccgcagatgttttttttatgcgatccagcgatctaagtatctaactgctcgatacttccatgtcttcacgcgataatgtcggcggcgtctgagataagatactgctctattacgccggctcgccgcaatcatcggcggcattgccggcgatctctgccgctatatatttgcaagaaatatttgcattcccctggcgatatatatttgcattcccggcgatctccgatgatatacatttgcaagaactatttgctttcccccagcgatctcacggtgacacaagaatatttgcaatcgctaataataaatgaataaatcaaacacacactacacactaaacactgccatcatcgtcgcgtcgtcggtcgtcacagcctccgtcgccgctattgtcgccactaggaagaagcgtggtgaatttaatcaaacaacaatcatcaattaataacttgtaaaattcgtcgacccattcattcgttcatgtgcatttgcaagg

SEQ ID NO: 7361 - DNA, 6620 bp, Oryza sativa
tttggggcttagaattccattgaggattaaaattttcttgtggtacttaaaaaaaggggttactctaacaaaagataatcttgcaaaaaagaaggtggaaaggtagcactaagtgttgcttttgtgattctaatgaaacgatacaacatctttttattgattgtcatttggttagattaatctggaatgctgtgtctataacctttgggatccatccgcctactagcattactaatctttttggtaattggctgaatggtgttcaacctaggcttaaacatcaattttttgttggcattgcagctttgtgttgggcggtttggctttgtagaaatgatgtagtctttaatggctccaaaactaactcctttgtgcaggtaatcttcaaggggacgtattgggcacgtcaatggtctttgctacttaaggaggatgatagggacaaagtcaaggaggggcgcactttgttggaaggaagaattttggatttcttctctaagcatggatggaatttaaggcgaaggttggatgtctagatgtatctttgtcttgttttgtgttgtttgtcaaagttgtaagatcacccttgtgaggactgagaggctaagttctcttgtgttggtgttgatgtgtcgtgatgtttgtttgtgaacctttgtaaggtggagtctaagaactcttgttttattgttggctgtgtacatccgatcggatgtagaggccgggtttatctcattttctaaaaatgattagtttagtagaacgtggggtgaatttttctacagctacggtggtgtatcatttgaaaattatggtttatcttccgtgtcataatttgagatcccgggaggccgaggccgggacaaaaacagagatcatcaatgttgggccaatttagttttttatattaaattttaggatcttgctaaccctggattatgtataataaattatggaatgaactctccagttatatttgaaatctggggaaaactctaggggagatatatacgttaatagtgacacttttttgcagcatcatttatcattctgtgagcttattttcctgtctcccttaaattccttctttctgggagaacatccatagtttgagtgtagtttgggggatctcgggggcatattctaggtaggcaatgcaattttatgaaactaggaaccaacttttatttccttttaacagatgggacaaagggtttagagttcgcctctcaacttttttttttttgctttcttgcattttggcccttcttcgcccctttccttgtatgtgcttactgtcctgataggatccatgtgttctgacccatgtatgatgtatctttaacaagacaaacaaactatttggcatgatttacctgattaatatcctttcagtacaaacaaactattggaaagatacacatgaagcagctcgtcatgacttaaataatgccagctagatctcttactatcgtgtaccatcctacgaaataatgtgctctctgcattaagtatctggacaagtctttcttatatgctggctatatgaatccacagataactttgagtttgctatatctttccaattcatcaagtggttacatcaaactcagtttatgtctctaccgtgttatggatatctgcatgttatgtctctactgggttatggatatctgcatgttatgctatcctgaccagttatttcatttaagttcaaggacttcctgtggttgcatcaaaagcctctaaatttatttcatttaagttcaaggacttcctgttggtgcatcaaaagcctctaaattgactgatttggatgcacctatttcaactagtcaaaccaagtatcttgagctgctaaccaggtattatgttctcaaaggggagcatattgctgctgctagaatgttgttgatattggcagaaagacagtgctccagtgcggaagaagcttcaactcttgaccagaggtctcccattttgactcaacttctttttggttacttatttgatttttgctcagttttgtccttgctttcataaggtccatgtgtcatatggaatgagacctactttttttgcatccaggtatcaatatctgagcagtgctgcggttcagggcaaaagtgaagggattactgcagattcctcgaggaaccctattgatagcagcgcagtagatcgacttgaaggcaaacttgcagttcttcagttccaaatgcaaatcaagtaagaatagttcatggcttcacggcttgaaaatctgccaggcagtactgaatcaccaaatgatgccttcctcatgataacattctagctgatgtggagactgctagatgtcccatggacaaggctaaagagctttcactgaatctcaagagtattactcaacttttcaacaattatgctgttccttttaatctttgggaggtatggctatctttgtttcttggagattttttccttgatcctgctttcttctctcttgtaagagggttactaggcaataagcattttttttactattgatagcagcacagcagatccacttgtttttaccaggaataaccaacatatctatggggatcgtgacagttagtagaactgtgaaattcacttgataagttctaaactgtcataaagattgcacttcttttactgttaaagtcatatgaactgataccacaaatcagtaggatagactatgacgtgttgtggacttgcggtggtagtgtgatcatacaatgaaaaccggtgatctgagcatatcctcagcattccattgcgtctttatacatttaataaatatacttgactggttactatatacagaattaccaataaggtttcggaagctttccacataactacattaaatgggtaatacaactttctcagtgtaaattgtatctcaaaagagtttacttagttgtgtgaaaataagcaagcactttatcaatattttttacatgttacgataggtatatctaaatcctctgaatttgcatccacaaaaaactcttttcgaatttctcatgttgctgagtttacagtttgtgatatagtaatatagctctataactgggtgtgggatcacagtaaattctcacaagttgctgctctaaagttatatattatggtctgcatttttcttgtgcagctgtatgtagtgctttacttgcacttattcacttggtaaggtaaatctgttttagatagtcactgtaatttttcatgatgacttgaaccttcttgttaactttgcaaattattctggagatgctgacagtaaaattatttgagaaatttgggccaggctccttggccagtacaagaggtggtgttgcagaagcatgttctgtggtgagaagagtaggttcaaaacttgatcctgcagatggctcttgtttaccattggatataatatgccttcatctcgagaaggctgcactggtaatctgtcaattctgtctataaataaatggtattttctatactaacaagtaacagcaacccattttgtagtggcatttacatagctatgctatcatgctacaggatagattaagctcggagaaggattagttggtgacgaggatgttgcaagagcccttcttggagcctgtaaaggtctacctgaacctgtgcttgccgtgtatgatcaactgttatcaaatggcgctattgtgccctccctaaacctgaaggtgtggcttctgagatcagtccttttaatccttcgtgaatgggcatgactgtcattgcacataaactaggcaccacaactgctggggcttcattctttcttgatggaacattttcaccgaatcaaacatggtctttaaatcaaggcatccgggataaaataattagtttggcaaactggtaagtttacttcatctaagtggcatttttaattctcaaaattctcccattcttagcgtgttttacaaagtgcaatatttttgttgttggacttctgtacaaatatgcactagatagatacctcacgcattgctgcaggatatttatattcttatagaatatgtcatgcaattttttaagcaccgagctaatataatttactatagaaaggacagtgttgacctaatttataagggaaatcaagaaaaaaaacatagaattgcaccactaattagagaggaaccacgggagataaccacaccgttaattgccaccccaagatttcccatgcattcaactgttattcttgatttgaataggagaaaaaattgtaaaagcgacagaaagtatttgtctaaaaggatgcttgataggaaaaagacaccttcaaaattgagcatatagtttatataaagaaaactgaaacaaaatgtgaaatatccgtgcggtagctatgtgtaattctgagttggaatttgcataacatgcaaacgggatgatctgaggttaatctagcatggattaaataccacatataatacgggacaaaataaagtggattagacaaaataaaatggattagacttcaagtataaactcagatgtaaaagcacatacctgcacctttatttcgaacaaagtaccaacctatataaatttgcatttgtgtaccatcagaaaggtaaaagtgaagaatccaatccaaatatttttcagcatgaggcggtaacaaaacttaaatgtgaggcgatgattggcacctggtacttgagatccatatgaattcctttttgcgtagtagtccatctttatatccatttgctgcaaatgtttagagagggagagacagtttctaatattctggagaaaagtagaaactatcagttcacattgatgagcaaacaaaagtacataatgaaccaaaatcaagaagtggtacagacgaacagatatgatagaaagtgcagagtaagcctaaaaaattcaacataccttcaactctcaagtctaaattccatgcgtgaaccaaaaaacaaatcagtagctggaaacaggaggcaacacatgaatttagagaggaaggagaggaggagagatcatgtaaagcttgccagatgatgattccatagcctgctcacggtgcgctgcgcagcctgaggttgatcgatgaccttgcgaaaggaattgtggaattaagggatgatcttgaagggaggattgcaagcacaaatcgccaattaatctcgttggaagctgtttcttgtggcagtcgaccaaccgacggtttcaggcaaggtagaatgtgattaagcgaattgatggaccgggagacagaacgtgcacatgtgcgggcacaacattgaagtgaaggcgattgaaacctgcgtagtagatttttacacgcacgtcacacgacatgcatgcatcattggaaggaaaccgatcggatacattggatcgcttggtatactgggtgggctgggctcaatatatcagcaatgatggacagagagatgggaatcaaggagcgttcagaattcggatcagatcaactggaaggatgaatgggtctaatctcccttcatctttgatccaaggcccaaggcccagggatcttctcatccaacggttcatatgcgatctctttcaccgatcgaacggctgagaattagtgatgacatggaacgctgaggtttcggctttgggtcttaactttatagaaagaagtcactggccttatacattggccctacctgatgtgtggtatgctagccaggtagcaactacgcatcatgaaattctgaaccgaatcatcacaatttattttgataactaagatttgaataaattatcgtgaaatttcaattttatctttaacatggcattttttttgttagttgtgacattgccaaaaaaaattgtaagcacctgatccccgtaagcaattagaaaatactcctgcttctttgtactattgctatctcaacatattttcttgtatatcatgaaaccactttacagttagagctgattattttccttctactttatgttgtatgtgtaacttcaggttggctgagatgaggcggttcaaccttccacagaaccaaaaaaagaatgactatcgaggtttccgagagttagaagagaaattattatctaataagtagccatttcaatttgtattctcggcactgtaaaacatgggattgtgcatttgctctaccaagtagagagaaagccagccatcctggttcaattggacatgatctctgatatgctcttcctgtggttgacgtcattgcgagatcccaagggtaccaagagactgcatatcaatcaaatattatccatctgtgcaacctccttattttagccaaacaatcagtatgaattacggaattacggctgttaatgtggtaaagttattttgggctgattgctagtaagtcctgcgggcgatgccattcgtctggcattacttgcggtggatcaggattcaggagaggagtgcaaagtgaactagagctcttaaaagcgacacaaagatctcttgttgcattcatgttctacaacttcaatttgtaccgtgttgtaaatttccgtaccaaacgattctttaaggatgaacgtttaggttttgtagctttccatatatttttttgagataatccattgtatgccactgagtttgt

SEQ ID NO: 7362 - DNA, 14153 bp, Oryza sativa
aaactcagtggcatataatggattgtctctattttttttcagaatattgtttctgtagctccagacatttgtaacatgctgagttttttgggctgatcaagttggggaacagcttatcatagcttacatgtgatcaggtggagcacctgaatctttgcttgctactctgtcgtgctaaaacctgtccagttctgcactttggtatgctttaacgtggggctggtacaacagtttttttaggtggttattttaggacctagggagtacacctcatccgtaccttttattagcaagtagaaaataattgatagttaaaacttttatatacgagtttttaacgacaaaaaagtaaatgctgtaaaataaatcatgattaaaaaaccataaagtataagcgaaaccatagggctgttaatatacctgtgatccaagtttttcctttttatagtggagtggagaattttttataggccggaaacagccaagaaataacaagtcagtggttctcgtacattgattaatccaatcacatttataagtgtaaccataagttttcttgcccagctttgatcgtccgtcttatttgaaatttttttataattagtagttttatctactatctactactacttaaaaaataagaggtgcttccatcgtccgtcaaaaaaaccgggtgaaaaaaaaccgggcgaaaaaaaccagtttgtccgatccaaaaaaaccggtaaaaaaaccgggtgaaaaaaaaccgggcgaaaaaaaccagtttgtccgatccaaaaaaaaccggtaaagaaatttccgtttttaattataaaaaaattacccacagaaatagtttctgtccgattccaaataaaaaaaattccgagcgacaaaagagtttccatcttcctacaaaaggaaagaatagtgcgaaaaaaaaagtttctatccgaagggaaacacgcgtgaataaatacctaattaaaaataaatatctatctctaaaaaaccttctgtcgtaaaaaaaaggaaaaaaaaaggaccgactcctgtagagaaaaaaaagtccgactcgtgaaaaagaggttttctcgtccgtaataaaaaaaagaaaaaaaacatctaactcaaactccgtaaaaagaaaaggaggaaaaaacgacccgaccaaacttaaagtcgccccttgttatccgtatatatctctttaactctaatctaatctatcaatctaatctaactttttagaaagagaagtttccatcatccgttaaaaaggaaaaaaatgcgcaagaaaaaaataatttccaaaaaaatgcgcgggaaaaatacggtttccttcgtctgaaaaaaacaaaaaaaatgctattaaaaactatcagaaagaaatacaccatttctaaaaaaaatggtttcaaaaaaccacacaagaaaaaaaaaactgtttataaaaaaaagccgctctgaaaaaactaaccgatgaaacactgtttataaaataacagatccaaaaaaacaaacggactcaacacgcgaaaaaaaaccgatgtttcaaaataaggttcgagaaaaccgtctgacttaatgcgagaaaaaaaccatcatttcgaaaaaaaatagaggaaaccatccaactcaatgcgagaaaaaaaccgccgtttataaaaagaaccgctccgagaaaccgtccgactcaaagcgagataaaattgatggacgcttgggtcggataagatccatcgatatttttccatctcctacacatcatttgtttcctcatctaatccctgcactttttgtatgcaattatcattatcagactttttttaataacatattatatgaaaatagtattaaaaataaacatatttttaattgttatttagagaagagtgcacggtgactattttgtgtagacttgatcctgagtgtaggatttgattaacctattattggttgcaagaataatattgaaagaatatttttttattatatgtatattggtatatgaataatccaattattttagttaaagcaagcattggtaaaaagattgccatcatcgagtttgggtcattacataaagatgctctaattttctaattgtgttagctacaacgatccatagaaacattatcattgatatgggtacgcttgaaaaatgtctattgtcattggattattttttttacccgttgcaacgcacgggcatttttgctagttattataagatgataaaacatgaatagtactttatatgtgacttatgtttttattttttttaaaaaaaaattaaataagacggacggttaaaattgtgcacggaaaatcatggctgcacttggaatcatagtaaaaaaaccagaccggcccaacggttcaaccggaaaaccggaaccagtgcatgtcacggttcggtttacagaaaagacagtcaatatatttgaaccggtacaaaaccgtcgaaccagcaggttttctgttgaaccggcttaaaaccggagcggttggaccgaaaaccgtgctagctgcatggaaaattttaaattttacattgaaccggtaaaaaacatcgaaccagaaggttttctgttgaaccggcttaaaaccggagcggttggaccgaaaaccgtgctagacatgacttaaataccggttcatggctaattattttttacttcataattgactttaaactgctaaatagaataggtatttcattcaaaccaacaaatatctctggcacagttggtttggtgggaaagttcaatgaatgcagcgccacaagcatatgaaagtcaattatgacttaaaaaataattagccatgaaccggggaaccggcggtctgaccggtgaaccaacgagctcaccgggtcggtccccgctccggttttttccgaatgggacggagtactgacatatggatccgagaaaaatgccggcctagtcccaccgtcatactcatcgggggctcgcccgtctccgcagagatcgccccacacctgagaaagtgagaagttgaatcccttcgccgccgccgccgccgccgccgtcatgtgcggctccgccgcccgagccctgaactccgtctcccgcgcggccttctcctggaaaccagtgagtaagatggtttgcaaaacacttctctgaatctccgatactgactaatccccctttctctaccagacagggttgccgcagcagacgctcgccgctgcggtgagcaggtcgggcgtggggcttcactcgggggcgaaaaccaccgccacgctgctccccgcgcgagccggcgaggggaggtacttcgtcgttgagggggaggagacgagggtggcggcggaggtggcgaatgccgaggcgcactcgccgctatgcaccgcgctgcggcggggcggcgcgcgggtgcgcacggtcgagcacctgctctccgcgatggaggcgctcggcgtcgacaactgccgcgtcgaggtcagcggcggcgacgaggtgcggcgcccttttggtatctcgaggagcttgatagatgttgatgtgcgactgcactgccacgagaaaaatgtttgcacatgatgccttcccgatttatgtgaactgttcagcgatgacagattccgttgcttgatggatcagcgcaagagtgggtgatggctataagaggtgcaggtcaatgtgcggccaaggattccagtggccagaaactggagaaactggctccggaaatccatgagcctgtttacttgcagaagtctgattgtttcatagctgcactcccttcctcaagaatccgtataacctatgggattgattttccaaaagtatgttttatctcttccttttatgatcaggaaatgctaacttctaagcacattcatttattttatgcagttcttttaaacccttatttgcttctatttcttcttctaactttcttataggattactgataattaagttagtcttaccttttgtaatgttgattatgtcttcattatgctgcaatacatgtgattggtatgtaattgggtttaaataatgggtgttttgttaatatgcactgaaataaaggtcagcttacccaaagtttcccttattttggacctcaagatttttgtttctaaggttcaagaatcacatgaataaaccacatattatctattccctcaggtgacaatacagtgtatgctacctactgcctttgtccacaaatataagcatttgaaatttttctagatatataagaagtcctaccgaactacttatcccatcaatcacctcattcaaatttatccccatcttaccctcaacaatcctctcacccccaatcatccctcattcgatgagcggcaccaaaaatattttctcctcaaccttaatctctgctaaacaacctagaaatgcttatatttgtgaacagagtgagtaacagtaacttataaacactatctatcagctatcaatatcttatgagaatatattggaggtaaaaaatgcacagattgtcaataaaggtagtatcatattattatatgtttaccatcttaactacgtcgtaatagaaattaatagtcaaagttgtgttttcaaaaccatgtcgttgaatgtccaaaaaatcactctatcagaagggagtgtctttattataatatttggaatatttaacttggatgtcaatgctaaaatatctcaaaatatatgtttagaacttgagcagagcatgcatcctgttgcaggtgccaggaattgggtgtcagcgcttcgcaacagtcctagatgctaatgtctactcaagcaagatagccccagcaagaactttctgtatatttgaagaggtattttacagtagttgatgttatacaatatggatgttgccttctatgttttgttcatgcaacttatggtgtctcttacaagaatcatggcaatgtaactttccatatatgctttcgcgttcatctactttgtcacgatctcatgttgcattagatcatccatctttcaatcacatctgttttcatatcttggagtagtcagcaatttctcgaatcttgcacgggtaaggcctaagtatttgaagtacttacattttctgctagttgtgctgtccacattattgttttatcctctcttccatttttttttaattttgaccggaagatcatttttgtattttgctgcatttatggaatttataggttgaaaaattgcgttctgctgggctcatcagaggaggatcgctagaaaatgctacggtttgcaggtgaggaatgatatcctggaattttgtgttctttgtcgtgggttggtgattttttttccttgacgtagttctgagaagcacatacctgttgacttattgcatgatggattttgatattgggcaataatcagatcatggcatcatcccaacctgtatggatttagaaatttggacttccacttgttgctttatttcttaaatatatcgggttgtttcttaaatattgtctggcgcaatgtctgaatgagtaacaagtcaaatgatcttataattgctagttattttaaaaaataggtcaacctgcttagtgctttctatttaatgtttgtattgtctaggttagcatgaatacatatttcaggttttctgaaaagaacttaatactatgcacaatagcttagcagtgaactttattcgtgttctatgatcaccatccaaagttagtatactgtgtacagttcaattagtggcagtgcaactatttttacaaagatatgcctgttgatgatgttgggctcatgtggctaggcgttgaaattgttgcacagcttaaactgcagattacgttgttctaattcaattatataattgtatactcattggctattggcagtatttctggtggttggcttaatccaccactgcggtttgaggatgaaccttgccgccacaagattttagatcttatcggtgatttctcgcttcttgcacagaatggtaaccagggttttccacttgctcatgtagttgcctacaaggtatgttcttgaaatttaatttactacagcattgttatcttctgatgctgttcgtagcacatgccatgtcagtggtaatatagtatagcagctttgagatggcatgtcagatttttccagtaaaattgtcagcaagtatgctggagttatcacatatagaatatccatgttcacatatgggacaaagctgtgagtgaatgtaatctcaacccagtagtctacaagtataaaaccagttctacatgtgaatactaatctatgtgcctatctaatgagtggaaagatagaggaaattacggtaatgtactgggatgccatgctgtttatgagaacctaagcgacatgatttcacgtgtatatgtttcagtcagaaattctgtgctagcttctcaggctaatgcttcccacctgagtagcatcgtctgataggtggtgccactctgattttacatggaaactaggaagggcatttctgtctagtatggtgtgaggcctgtgagaatctatgtttaaccattcgtaaaatgaaatcatgcccaaatacacaggatacaagatccttacgtaaatatgggatgctgggaccagtcacacttgctatgagctatatatttcttccctgccctgaaaactagtgtgtgttgacaccttgaacatcattttttttttctggagttgtcttccatcatttgaattatttaagttcaccactggtcatccagttccacgcttggatttgattaaccagtggtgagttatgtagaactgcttgtcttgattgtttatcttttgccaaataattcttgaacttgtactaaatcttggagataactgaagggtgtgctactatggttgagagttgagattagtttgtttcgtgaaatttcatatgtgcatatttttttttgaaagaagtcaaatttcataaattgtacgtgtggttatgctcatagttgacttctacaattccatgtacttgttgtcttttaggtttgtgcagcaccctttctttttaccaatcgcattgacctatatttttagctttggctggattagaccattctgttaattacttaatttcattccattttaacggtagctatatagcttctgagttctgaagttcatgacaatgaaactgtggatgctgacttctgaccattggtaaaacctggtctaagcttagtaaaagttaccattggtcctaaagggaacatcaattaccaaccaaaaagtattattattgtgttatgctgttcaagtgaacgtttcataataagttgcaaaaatactcattattctgattgtgaccttaaaggtttaaactacatacacatttttgtttttgctgatgcatcacaacctcttgctttcaagtactgtctatagcatgtggtccttacactaaaaggtttatctgaagccataggatattccttatcatattgcctttctgcagaaagaaaattctcttgtatagaacaaattgcaaacttctgtgctaatttctacttctacaccttttattctatccctaaatatctgtaacccagtttgtgacatctaattttaagctttccttctgtgacaaaggctggtcatgccctgcatactgatttcctacggcatttgttgggaaggagcgctgtgggccaagaaaaccttgctgagcaatgttgaaagcatatggataccgctgctccgtcgataatggcaaggacgcaaaatttcaaggatacaaacataggatggtcgcccttcttccagctaggccatgcagtaccaactattcatcttgcaattatctgccagccatttttccatctattcctttctctctctttcttttttgatctgatgaatcatgtagcccatcagcatctgtacaacctgtttagtcttgcaaagttgcaattcagcatagaagtagatgcccatgttatctgtgtgtacagttctgagcagccaaatacaactcaaactgaacccttctctccctttttatcctctgatgtggatggagaaagctgccatccaaccagcgatcacccaggcctcgccacgtcgtggggtggcttggcctggcctccctttccattccccgcgtgcggataactacgaaggaagccgaggtggctcccaggcgggcgggcgggcgagcgacgcggttggatttggaatggatgcgaggcaggggtggagtcgtggaggcgcgaaaagggacgaaagcgacggcgcgaccgtggagaatgtcttcacggggaggaggaggaggaggtatcgaggtagccgtcgatgatggatgagtcggcccgcgtcgtaggctggccggctggctggctgggtgcaggcacagcgcacggcacacaagccgaccgaaagcgcggtgcacttggactttcccccgcgccgcaaatgtggcgtcgccatcgcggaggacgccgacgtacgcctccgtggtggtggtggtctggtgggtgttaagcctgggcctcttatcgctacagtttctcctataattacaaactttcttaatagtttcgcttttagtctaagatttaaaaaggtatagttatataattgaagaatataaactacgagctattaaaaaaaccagaaaacctagacaacagtatcccgttggaacgggaacgggatatctttctataagacagtatctaatacctgatacctattgtgttaccagctgcatggtacccgatacctgtgatatctgttacccggtatctgtgatacctaggacctgatacctgtgatactcgtgcaagagaatagttaatatgtctatcccgttacaacgggattccgttttgtagcagtcctctaaaaaaaccctactccctccctccattttaggttataagacgtcttgactttggtcaaagttaaactatttcaagtcggattaagtttataaacaaatatagtaatatttataatactaaattagtttcatcaaatcaataattaaatatattttcataataatttgtcttaggttaaaatgttactactttcttctataaacttggtcaaacttaaaactgtttgattttgaccaaagctaaaacatcttgtaacctaaaacggagggagtagttttttaaattattaaaaggtatattaatcaggtgtttctcataactgtaactatgtaagctctctaaggctgtgtttgagaaagggaagatagagaagattggtaagatacgcaaaacgatgtgagctattagtgcatgattaattgagtattaattatttcaaattttaaaaatagactaatatgatttttttaagcaactttcctatagaaaatttttgcaaaaaacacatcgtttaatagtttgggaagcgtgcatgcggaaaacgatgtgcaatctatctctaatctcccagaacgaacgctgcctaaatttcccaagtgagatttggctttctctcactgaggcgagcgagctggcacttgggggttccagggcgaaggcaggaagtgacggaaagcgtgcgagaagctgacgagattttcatgttggttggtcagagttggacggcatgcttggtgactactggtccttgtccttactctactcgctgctcaattattcgtcgctttggtccagtcgtgtgcacctgtacgtgttcgcttgatcacttccaaatcaaggaattcgaggagttctacatgtaggaggtcaagctcatgtcaaaattggaacagaacagaaaaagctactatcatgttcaaagccagtagaaataggcctgtatcctgtagagagccagcatttttcttggaggcacgtctcaagttgcaaggtccaagggctttttatgtcacatacagataggtaccttggggattggattagacatgaaagagtaaacatctacagcaaccagaagaccgagcaaatggatccaacttgggggagcagaccacaaagcacgctacagcttcaagctggccatttggcttaatgatgctaactaaatcgctttcctgcaaattataaggcgtagcatcaagttgttgtcatgcaactgcttgcgtctgcatacacaacaacggatgcctgtcatgcttttatgaggcccctgcataactaataaccaacaaatggcacagaagtacacaacatcgatgtcaaacaagacgcaaataacacaacacctctcgcaaatggacaggcatctacagcagaaggcagcagctgcatgctgctacttgtagaacaagtggagtacgtgctgtgcacttgaataaaatttggagttcattaaaaagccccaacttgattaagcgctgctctgccatgcccatgcccaaaaagattcgccatcaggtggatttagttaattaaccgcttgctaaccatcgaaagaagaaccaaaccaatcctttctcgggacgcacgaaagaagaagaaaaaaatggagaagaaaaattgagctccaagattccctagcaagcaccttgaacgcacaccaacaccagtagtgccgctcttttctcccatcttttggaggttactgcagttttcatggcaggatccagatcttctcctcgtatttttatactgcagataaacctggcacagtgtgctgacctgctgatagtgcggccatggtttcgtctgtgtcatgcaatgacacatgctttgttaaggtggtccctgatcagtgatcacccagtgcacagcgcgtgtacgtttgagttgctgctcggctggagaaaagttgcagtaaattaagcgtgcaagtaagttaagataggagtatctcataggcgtctcggttaacacagtaatctatacccaacaggtatgaccaaggaacttgtgtatcatcatttctactaggtttgtagtgtctagtgtgtattctcaatgcagagcccgagcccgaagtatcttacgatcttccagtatctcagggctcctttgatttgtaggaaaaatgtaagaattttggaggatttcaatcctattgaaaaaaatcctatgaaggactttgaaacaaaggattgaatcctatccaatcatttaaaattgctatggaatgggtaatcctatgcacagtttggagaaaagttagcaagaggtctaacatcttggaacatttcctctgagtctatctctctcatctgattcctacattttttctgtggtccaatcaaacggtcattcctgtgtttttcctgtgttttgcaattctctgttttacaactgtattcctgtcagaatcccatgtttttcctattcctctgttttttcattactacgattcaaaggggctcttataaaaaataaatcatccttaagatagaacgtgttttaactgtaaaaaagctttaatagtatatttttcttatactatttcgcttatggttataaaattatagtcatacgaatgtatttttaaacatgaatgaaaattgaataatcaacgtcttatattactgaatggaaggactatcattttcagagaagcaataggatcttattaccatttgatttctggaaccctgttattcactaatggtgtagtttttgttaaacaaagaggtctcctaacaatgatcaagttttaattgacttggaaccaaaacattttgaatgaacagaaaagaaaaaaaaaagagagtaggtgctctcctattatgtgtgccattttaaaacatcaaaggttaggtgcaagatcaccggagaaaaggagtaatacaagtactagtattactagattggtcgattggttctgtgcacgtagatgaaatcatgaaagcataatgatgtcaaaagagcttgcgcaaggcaatttcaggtactcgctcatcacgagccgagaatggatggatgatccagcgaattttcttgggcagattttgctggatgatgtgactatagttgtactccacccaacagtggggcaggcagttcgagcggtccggttttctaaataagttcagtttggtggattgcttttgcgttggcagttacccatttgctgtgtgcaaaactctgattttactatggttgtttatcgttgttgttggtcccaaaaccgagaacgatctctttggccaccgacccattggtctgttgcttatattaggatgaacattttgtttggtatactggcgtagcatttttgtgattgtttttattcttaaaatatactccctccatctacttttgatagtcatatttctaaatctgaaaagtttatttttgataggcatatttcaatccaacaacctatcctcttaatgattttctcaaatttaatgcgtgactcaccattcttccatacatgattggctacatgggcattgagaaatgtaaatattaatgaatcgcttatttacgatgaatgactaatagcatgtttaaatggatgataagtagaattaattatcattggtctgtgtgtcaagatgaaatatgactattaaaattagatggaggatagtgattaacaatcaaacatgatacagtattgaccattgacccaagtccaaaatagatcattagagctaattgtgcataacaattatggtacgatttaatattcttcttcttgtcattctatttcaatttttttaagataataattcaccctgctttgtttacctcaaagctactcccaccgtcccaaaatataagtattttttaacttcgacatgatctttaagatgctactttgactaacgatatctataaaagtgagatgtttcaaataaaaagagttgtatattgtgtttgtttaatgataaatatagtaacatcaattttacatggttgatcttttttatctttttgctattaatagctaaagttacaaatatttgacttgacactatactaatcatatttatattttaggacggaagaagtatacgaacacatcacaccgtactagcactatacatatcctagtactactagaactagtaaaataccctactccatttgttttcttctacagtgatgtacttagtgtatcaaattgatcatctctgggcaactaaacaggcaagtacctgttggcctgactgcttgagcctgtcaagtgccggaagttcacatgattcttccatcatgccctgtccgggcactttgcgccagccaagtcccatcacatgccacacatcggcgtcacctcatttgatccccaagccacgagtaaaccttgaccaatcatagccccatagtcacagagcgcaggttttattctacgcctttctacggtgtgaccaacgctgtggcgttggtaggaaccgcaggtgtttgggacgtttagagcaagtttaatagtatagcccactgctagctccaatatagccgatctaatagctaatttatacaatagttgcttgctataagattaatatatggtcccacctgtcatacacacattgcgtcttggagtccgtgctgcagctggctacagatctatagcctgctgctcttctctctcatcttttatctcattaaaatatatttatagctggctaatagtttgctattgtgtaacaccctgaaaatttgaccgacaaaaatctaaactctaaaaatatgggccttcaaaaactttttaaataaattgcatcatgccaattttattcgcctattccattggattttgatttcggagtttgttgatcgcgaataaagaataattaattagtaataaaacctaaaattaaatgagcaaaataaataactgaaatataatttaaaataaaggttgaggtggggatagaaatgaataaaatatcatcgcagtcatatttgtattaattaaatctaaatacgacggaataagaattaaccctaattaaaaattcaaataaattatataaataaaatacgagtaatattaatctagagtaaatccattggttagaatgacacaaatattgagtaaacttcatttatacaaaatccaggatttatagaatcaaatttacaagaaataggctaaaatggggattaaataggaaaagacactattcatcggccgccaggtgttcgacgtggtcctctaacccaacccctcctctttccccctctctctgtcgccaccttcaccacgcgccaccgcccgtcgcgcctggccgtctcgcgtccc

SEQ ID NO: 7363 - DNA, 20075 bp, Oryza sativa
ctcccctgtaaaagccccaccgttctcccctctcctcgctccatcttccccctcctctccctcttccccttctccacgcgccgccgtcgtcgtgccgccgcgtcaccgccttcgagccgccgcgccgccgccctcatgctgtcgtgccgccgcattcgtaccgtcgcgtcgccgcctcagtgtgccgcaccgtgtgccgtcgtcgccgccgccgtcgtcgccaccgccgccatcggtgagccgctgcccccccctgtttgtcgccgtgccgccgggtagtgagggagccgagagagagagaggaagggagaagccgagggagagaaagaagaaggaaggaggagagaaaccgggagggagagagagagaaagaaaaagaaaagaaaaagaaaggaaggaaaaagaaaaagaaagggagaaaaagaaaaggaaaataaataggaaattagagggagattagggaagtttagaaaatttaaaataattacaatttaattatagattaattatagtcgaagaattgcgaaatttaatataaattatggattattcttggtaatttctataataaatcaattcgcggtagtaatttagatgtaattaataactaaacaaatagatgaattcttatagattattatagattatttttgggtaatctctataagtaatcgattcacggtagaaattcggatttaattactagggattttagccgtgtgttatatttaatcgtttaatcatagactaagttaaatcgtacaatattataagatgatttttggattttgtccgatatttagctcgcgatacaaaattctaacatatatataatgctcgggtagattaaattaaaaacttatgataatgacggagcttggggctcctcaccgggagaccgcgcaggcccccctttgccggttcggccgggggcgctatgtgaggttcttcgccctcgatctgaggaatgtcagcgagaaaaagcacacgagacacgggcgacgtagacagattcgggccgctgagaagcgtaataccctactcctgtgttctggtggatctgtgtgtgaaggaatacagagagctccagagctagagagctcgagagcgagagagagttctcgctctggaatccagtggccagagtccccctccctctctcgcttctccctcttttcttttaggccagggcctccttttttttttaaccggttcggggtcaccacatgggcctctagatgcctaagaaaagaaacatgatttttacaatgagggctaatctacagccggaaatgacctctgacaagcagtacacacgcctcctgctccgctcgtcagctctcccggtggacgcccgtttcaaccttcattcaatggccagcgactttcttgccatgcttgcgctgaagcctggaatggatctgaccgggactgacataccaactccagaagtcagcacgccagctccggctagagacgagagccaggaagctctcatcattccgacgggacggggcgaggcgtgcgacaggccgcctgttgccacctaacccgcgatctgaccggtctgtgaccggtcacataccgcgactggtcatagaccggataagcatgcgctgcgccgcattgaatgcggcgtggcgcgctcgtctaacccgctataaatgcggttaggtgagcgccactgtgctcacctaacccacacacgtggcgccaacaccacagggggtcggggtgccccagccctcggggccgaaacaggagtggcccgacccctcggggagactgagggaggggcggccacgtcaccctcgggcccgaccccccagagggggtcaggccacgtgggtgaccgcggctacccaagcctctagtcacgatacccccggccccatgtcaccgacagataacaaaatatttatacccgcaaaaattgtttaggatgtataaatcgagattgggtttgccctagttcgcgaatagtgaagttaatataaaagagtcgactttcgcattcgacttccatttggatttatttggatttttatttgaattctaaccgaattcaaatcaattttcgcacgtaactatagagcccgagggagttgcggatccaagtgaaggccaagacccgcaagactttgaacaaggcaagtcatcactattctttgaacatgttgatcccaattccgaaattatttttatttacaaataaaaattgtatgcaatgatgaacatcctacttgtgattatgccttgccttgattattgttacccttaaatccttgtaaccatgatttacgtataagtccctagtcaactatgacaaatgcttagaaatgctactctagatttatgcatactcatatttatcaaatgctatatgcttgggcaattacctttgggaaggtaattgagatgcggcatgtggagacatgagcgccacattgccatgatgttgatgatatgatttgtgaaaggagaaataaaattaaacaactgttttcgactggggcggacggaggatttgggtggtatctggaaaaggctagtaccgtccccgatcaattaaggaccgagccatgaagttaagcatgaaacgacccctgtacaaccgtacttctcgtatgggtatagacctagcggattagatagccgagcggaggcagtatccctgcatagatggttcacccctgagtgaggcaggtgcgctacggtgggacaaccattgaggtagggccgagaggcgtgccctacatcggtgtcgccatcggtaggactgccatgagtgtgtgagagagagaacttaacttgaaccataatttaatatgtgtgtgagacttctctttcccgggagtgccagaactcctctcactgctagaaacatggacgcctagagtgcatgaggatttaagttcatggagcgggtacgaggctcatgtgttgggcagtcgcggagtgcgggtaaagtgtacatccactgcagtgtgagtaaaccaaatctattcgaatagtcgtgctcgcggttactgagcaccgggacatgtattacacttggctagactctaaattcttaacttgtgtgggatgggatattgcatgataatttctatgctgatggagccacttcctgagaggcgggaaggtggacgtcctcagaaaaccatgtcgactcaatagcgggaagctatccttgggatcacaatggatggtggatagaaccgtcattgtttaatatgaacactggtaataaaatttgatcagtctgtgctaggtcttaggtttgtgaaaagaattacaaaacttgctttgcgcaaaagaatcatagccatcctttgaatacccctgtcatatgcattgttgctgtggtggcttgctgagtacgggtggtactcacccttgcaatatacaaacttaatcagaggccggagatgaagcttcggaggatccctatgcctattaccaggagggtgatgaagacgatgacgcccagtaggtctcagttacggtcgttgcctgtggcaatggcgtgccgctgccttaactccgctgccttatccacttctgtttttggaatgtattccggaccgctcggtccgatgatttaagactatgcctgcgggcttatgatataatgattcgtactagacactcgtgtatgtgcacttggtatctcagctacgaattcgtgtgtaccagactacttgatccaggaaaatggtactgtttgcacgattgactcctgttataaaaacgggggtcgacatattgtacctgctcttattaggtggggagggacatggccctttattttcttctttttcaggggataagcattgttttatttttcttttgaaaaaagtggtatcaccaggatttcccttaccgtcggcgccggagttaccgcaccctgacgataagcacggttgccacgcggtaaccgtggcaaactgtataaaatttatcaataatttgaattattttctaaatttatttgaattttaatggggtttccgcggatttatctttatcgtaccctggaggtaagcgcgataaccgcacggttaccgctggttttgtaaacattgggtgtcacaaacttatgaactttgagtttttgcgtaatccatttgcaatgtcttatggtgctcaatattagcaattttttccttctaatttgatatctcttagccaaaatatagaaggaagcaatccatctgacatagagttcattttgtagttggaagtagcttttaggtttcttatagtattagatatattgaatccatgggttgaaaaatccttagttgatgcggtaggttggtgttgttagagttcgaatgcttgagttgaagaaactatttgtcctcaaaagtaaagaaaagttattttttgtccaaaggtaaagaaaattattttaaagtagagtaaatttcacaaaactacacgttttgtggtccaagttacagacaaccacacacactttgacacttggcgtttaagttatattttggtagtgtagtttcacaaaaccacactatcaatgaatggattcacccgtgatatgacgtggctgttccacttaggacaaggacgtggcaccctattacaagccatcgcatgaaattaataggatgccacgtcctcatcgtaggtagaacaaccacgtcatctcacaagtgaatccattcattgatagtgtggttttgtgaaattataatgccaaaatatatgtatttgagtgccaagtgtcaaaatgtgtgtgttttatgtaacttgtatcataaaacgtgtagttttgtgaaatttactctttaaagtataacataaatcttggcaataaaaagttttatatgggagttgaaagtttgtgttcgttttacttgaaagctttttctcgagatgaaaagtgatttggtggtggcaatctaaacaggatgaggcgatttttcctttactttcagtaatataggataattgctaaaagcaacatagtaaaacattttgttaattcaactattataccattattcttttattctaaaagagacctttcgatgatctaccgttggatcagcatcacatggatctatgtctaccctgtaccctttatatagccctcttcctccttcacaccctaaccctagtccaatacctcctccctccaccgcgctgcgccgccgccgccaccaccaccctcatgcttagatcttgccaacaattcagggcggtaatgatgttcttcctcaatagagtagagatggacgcgatgtactcactagtttcctttgcaggtgctctttctaacttgatctatagtattcttctaatagtaccaggcctccttttgcacggagggattttgcgggaatttcacgggaattgagttgattcctgaaattcctgtaaaattcttgtgttccaaaggagcccttgatgttgatatccctggccctgccccctagatctgagactccttagcttctataacttcgatattcatcggttttccaagaccgaaggtggaagtgcaaacgttgcattgccaccggtagattccacaaaaaagagcatcacgatgcgaaaatcatgatagccgccttcgaagcccttattggagcatggattaaaacaacaatcagttggtaagaaaatcaactattttcactataaagttcttcaatttattcattgtgcatcctttagattgtataaattttctattgagatagtagtagcgcggtatatattttcaagggaagaaatggaaataaaaaataagcatggatggcaagacatataaatttctttttcaatactcatttgattgtctatatttattattgaattcgttcaataacataatcagcatgatgtatcattttcccacacatatatatatatatatatatatatatatatatatatatatatatatacatacacacgcactatatatcaatagatgtatgctaattactaacacacatggcaagtggcccactacatgcaacattcaagagaaaaacagagcaatttgttgttgtaggattgctaattttcctgttttatattgacatatctagtaaaaaaagaacgtgtgaggtatatcatatatgccctcttgacctacttgtgataaacaactaattaatttaagattcacctctttattttgaactttgaggacggacaaattatactagaatgagggaaaacttagttgtccatctgaagacaaagatcctaatattggtgactccatttcttttctaatcagcgagggataattatatgtagcatacccttgctagttaagccgctttcatcgtgtcaattcataccattgacgtttagaaaatgtcgaagatgccttctgttattttccaatgaaaaaccttgaatttttcgtccgttagacgcccaggtggaaaactagcattaaagtaattaagtaaggctaatgaattaaccaggtgatgctaagaaaatatattttgaatcagatcagcttttgatttcgtatgaatattgaaacatgcgtgcctgcattttgattccgattttatttatggacaccattcacgtgcatatataatcagaagcagcaatggtgtctttcccagtataaaagacagaaaacatttgctctatttgatgacactccggtgacgtgttctccatacagtcaattctagtagtccacatggaagaattctcatcttaatttatctgattatctggtttttcaaattcaaaattccatactcaaaacaacacgtgttacaaatacagtggaaacctcacggtgtcattacgcgtaagcatggctgttaaggtggtgctagccatgtacctgccatattggcaatgccacagaaatcctgatacaactgtgtttgtatctgtactaggggaatttttattgcaattcccaaaacaaaggggggaaactcaactagaaaaagggaaagaaatcaatggaaaatcaatgcggcccattttttttaataaaaaaagggaagcgtcccggtagccgccagctcagcgcgcacgcagccatctcggggcagaaaaggcgcccccaccccacccgcagccgcaagtggaaagcagagagagagagaggcggccgcggcagcagtagcaggcatcattagctgctaatccctcaccccctctgtcgctaattaatccctcggatcgccgtatttactaggtttactaatcacgttttggcgatttagtcttctctcttctctctctctcgtctctctctcccccacctcttcttccctttcccccgcctccctctcctcttcgtcgtcacccgccgcctcccgctgaatccgcggcttgggaggagacgccggagtcgggggcgtggacgggggttggatctgcttgccttgatggtggcgattggagcgtgaattcgtgaggggggcgtggtggtggtggtggtggttatacggttttcggtttcgtgggcgggggagagatggcgccggtggaggatggccgcggggtggagttccccgtggggatgaaggtgctggtggtggacgacgaccctacatgcctcgccgtgctcaagaggatgctcctcgagtgccgctacgacggtgagcaagctctgctttcgcctctgcctctcccgcgttctctgtccttgtagtctatcgcttgctgtgctgcggttgtgtgggcgtgacatgattggttgcgtggaggcggttggtcggataagtttcgttgtttcggttagtgtttcgtgttccgatttgtctggggttggggaggagtcggctgctccgtgggttgatttgcttttccgtgaattctggggagtttttattttttttctgcacatctccgttattgggaatttttgcccttattgtcggttttctcaatctgggaatagattgttgagtttatatagattagtgattgtattggagatctgagcgagtttgcggtgtgaaatctgaaccgtgttgctaatatctaatcctgcctttttgtttgtgctaatataagcagtagtttttaagattcttaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggccttatattctgtggattcatgcgggcttcgaattactattatatcatcccaacctaagacttgcaatatattgggaatatatcgtcgatgctcctagcttttgttccctatcccgataacattttgttatgcctaatgactgtgaattatcacccatagtaatgactgcaaattatcacggaaagtttagcttaggatcaggagtttattagaggcgctatgcatcacccacctaccccacagttaagttttgttgcaacaggaacgaatactccaaggatgcaatgcggcatatctaggttgcagcctatatagaatctttgttctgtaaagtgttgctattcctttctagtttctgttctgggcgccaatagttcacatatgcgcatcacagcttaggggaaataacaaataatataatgggtttattactgatctattttttcttattatattacagttgatttatttcctactataagttgaatgtgtgcagcatgagaaactgttggattttattccttatccagtcttctctattgaatgatctctgctttaaaacgaacgtgaaaagcattaggcatacccatggaggtattcagtattcataatgtaatgcaattgtacataaatatcatctgctgcttttatgccttcaaatacacttttaagtttatatcatgttgtgtgcagtactttttcgttgctttgttttgttttcactctgttgtttccgaaaattccactcgttcgtgggaagctaatatcgtaatttgcatctgcttcatttgtatgtctgaatagttattttgtttactttgttttttttgggcagcgacaacttgttctcaggctacaagagcattaactatgctgcgagagaacaggcgtggttttgatgttataattagcgatgttcatatgcctgatatggacggattcaggttacttgaacttgttggccttgagatggatctcccagttattagtaagtagattaatattctccaccctgcttgttaattctggtttgtcaaaggcattactgaaatctgttgataatattgcagtgatgtctgctgattcaaggacagatatcgttatgaaaggaataaaacatggagcatgtgactacttaattaaacccgtcagaatggaggagttgaagaacatctggcaacatgttataaggaaaaagtttaatgaaaacaaggagcatgagcattcaggtagcctagatgatacagatcgtaccagaccaaccaataacgataatgagtatgcttcatctgcaaatgatggagctgaaggtagctggaagtctcagaaaaagaaacgggataaagatgatgacgatggtgaattggaaagtggtgacccttcttctacatcaaagaaaccaagagttgtttggtcagttgaactccaccaacaatttgtaaacgcagttaatcatctggggatagacagtaagtttttcctacttttggcacttattttcatcaacagcaatgtttggtcggctgtacacttgctaatttatttttcttttggtgttgtttaccacatttgaacacctgaaccttgcaattacatcaaatctttccgctttcaagcttacacaaattttataattttctcttcagaagctgttcccaagaaaattttggagttgatgaatgttcctggtttaactagggaaaatgtcgccagccatttgcaggtttgattctggttttcatttttaatcacgggtcctttttcttgtatcatatttagcatggtgtggtggatgttatgtttactggcaccatggaatatctacccttttgtattatcctaattgttattattcgtatttattttacacatccttgctctacctgaatgtatctactctgatttaattagcagtagaaaccaactaaccaaaggacttgctcctggaatgatcttgtaattccagggacttgtacatacactattttagtgctgttacactcttttattgtagaatgaaaccataccaaattatagatcattcaaccagtgcagatggcaacgaatcgctctataatagatgtttgataataaacattgtttttctgttgttcttattgtgttgcctggggatcatccatttgaaggttttgtctacagagtaaaattccattggttaccttgtgcatttgtgctgcttgtctgttgagctccaatctccctgttaccttcatttttttaatatataccaggacctgtttaagtgcttagttcaatagtcatgatatacagtagcttagaccctgtttgaactcaggacgtccctaagttatcttgaaacaatgtcgtttttcttgggcatattgaagttgctgaaacagtaatgaagtatctgtttgctcttgctgtaacttccagttttttagttatgtaatgataatcatggtgatgcaatgagttttttttttctattttcagaagttcagattgtatctgaagaggattgctcagcatcatgccggaatagctaatccattctgcccgcctgcttctagtggtaaagtaggctcactgggaggacttgatttccaagctttggctgcctcaggtcagatccctcctcaagccctggccgccttgcaggatgagctcctagggcgacctacaaatagtttggtattgcctggaagggaccagtcatctttacggcttgctgcagtcaaaggaaacaagccccatggggagagagaaatagcatttggtcaacctatatacaagtgccagaataatgcatatggggcattccctcaaagcagtccagctgttggaggaatgccttcattttcagcttggcccaataacaaacttggtatggcagactcaaccggcacattgggaggcatgagtaattctcagaatagcaatatagtcttgcatgaattgcaacagcagccagatgccatgctgtcaggaacccttcactctctagatgtcaaaccttctgggatagttatgccttctcagtcattaaatactttctcagccagtgagggtctctcccctaatcaaaataccttgatgatacctgctcagtcatctggttttctagcggccatgcctccatccatgaagcatgaacctgttcttgcaacttctcaaccatcgagtagtctgttaggtggtattgatttggttaatcaagcttcaacaagtcagcccttaataagtgcccatggaggggggaatctttctggccttgtaaatcgtaatccaaatgtagtaccttctcaagggatcagtacttttcatactccaaataatccatatttggttagtccaaattctatgggaatgggctccaaacaaccacctggtgttcttaagacagaaaactctgacgctctgaaccatagctatggttatcttggtggtagcaacccccctatggactctggcttactctcttcacaatcaaaaaatacacagtttggtttactgggtcaggatgacatcactggtagctggtcgcctctgccgaatgttgacagttatggtaatactgttgggctaagccaccctgggtccagttcatctagttttcaaagttctaatgtggctcttgggaaattgcctgatcaagggcgaggaaagaatcatggatttgttggtaaaggtacttgcattccaagccgctttgcagtggatgagattgaatctccaactaacaacttgagtcacagcattggaagcagtggagatattatgagccctgatattttcggatttagtggacagatgtgaaggcttcttgaatttgtaagtaggtaggtacaatatcctaattttggtagcagatagctttggtgttcttaccccaaatattgctttaatgcattttgtcctctctataatgtgatcgtctctacctagtgatcccatcaattttggcatatcattcatgttgcttctttggacaatagtagaccttggttatgtttcaagctatgaacaccttgatggcttggttgctatatttattttacctcgcgcatttgttatggagtatttgatttgttatgcctatggtaatttagcgaactagcagtatgttcttcgtgagtcatgttcataattgatatttcaagttgactgtaccttttgccttttatgcaaaaacattgtttaattgtgcaattaccgaaacctcatttttctaatggcattgtttatttgtttatgcagggtaatcactggaaacaatttttagtgggttgatgaacggttgccgtgtttttcatttcatccttttttttttccttctgtaattggtttataaagggaataatttatgtgacagcatgtcgaatcttggtttatagaaggttgttcggtttaaacaactttggattatttagcctcatgtgacatagctcattttcctttgttcattttttgtgtacagttttctgattttgttgcaaatcttcttctctcactagttcttcagcttttctgttttccttgcgatcttccacttaaattgttaccaaattagctattcatccttgcatctcccaatgagcaggttgcaattcatttgctgtacatgttctaatcactcttactcttttcatggagaagatgttctccaagtgctcgttacttctcccatttgagttaccttgcgacatattctgcgcataatgatagctgctgaaatacaatgttttgcattccgtaaagttcaaatgtatcttaagtactactccgtccaaaaaaaaaaaaaacaaaccctagctacgaaccatatgttacgttcaagttcatagctaggattaggtttttttgggatagaagggtagaacaactccatttgcatgtacatttatccgagctagtgggtctggaccatttttatccgtcagttcatcatttaacagtctgttttctagtagtactctcttccattcagtatatgacatcgactgcatcagtatccatctaccaaccggaagtgaaatcagacatgcagatttgctccagatgaaggaccatgcattgattaagcagcagatttgtcgagatatagttcaacactagatcacgtgttgctcggagaaaaatatgataattgttgcggtaacccgagctttactagatcaataatactctcttactgatgacaaaccaattcatgatgctctaaccaaggactaaatcactactccgtacggtacaataccctgaagaatcataggaaatcatgtacacctaactagcaactacgacccatcaaacgctcaaaccggggggaactaaacgaggctctccggtgcaccgcactgcctaatcctttccatggcacgcctcgcgcgccctatgggtgctcattcgtcgtcgtcctccggggggctcgccgcccgagccagctcgttggagacggaggccaagccctgcatcagcctgacgacctccgccgtgtcgtcgaggtagtacttggccttgctcggcttgcggccgacggtgcaggcgaagacctccgccgtggccgccagcgactcgccgcaggtggagcttgtgatcatctggaacatttcctcgtcggagcggtcgtccccgatgcacagcacgaagtcggtgcacatgcccctctcctgcatgctcgccagcagccgccgcgccaccaggcccttgctcacgccctgccaatggcaaaggtatcaaacaccgcgaacgaccatggcgctcgatgctaacaacaacgaagatgacgaggattaggaggaggattcacctgtggcttgacctcaacggaatggccggtgctcttcaccgagacgggctcgttggcgagcacgctctcgaggtggtcgacgagctccttggcttggcatgaaccgaagtcagggtctgcgtcctcgtagttccagacgagcaccgtctccctgttctcgatgatcgagccgtccgtggtctccctgtacaggcacatcaccggctccgcgatctgcttccagctgcagtccgcggggggaatggaaatctcccactctgcatccctcgatgaccttcagaaacatcatacagatttgtcaaagtgttgaaaattgctcccctttgcaagaaacatcaaggcagaaaaggcgtttatagtgttgaaaggttttctcatttggccatttcaatgttactactgaaacatttccccatccatgtgacactatgttttactagtgcagatcacaatcatgtagtactacgcttttcattaagtaaaaagaatgtactaatcttttaattcatttctagtcatgaatcttgttatcttagaatcaggttagctagatggtccgtccacatgcacaattcggtattttgagtcatgaactgtccttgcaagaacacaaaccagagtaagtcacaggatcatacctcaggaagtaaccgtgctcagccgccaagccaaggttctcgcaggggaaccagtcatggagtgttcccttctcgaacccgctgcagaggaaaaccttgttgctcttgtccctgcacaagctggtcagcgtttcgacggaattggcgctcgggctcttgttgatcgcctgcggcatgagcgtgccgtcgtagtcgagcaggatggcgcgcgtcttcgccctccggtacgccatgacaatgtgctccatggcgagcttcctgaagctgaggtcaagcgacaccaccctgaaccgcagcccgaagccgatgccccagcaccgccgctgcgcgtgatccttgcacgtcctctcgaggtcctgcaggaagctggtcgcccagtagcccacgtcgtgggtgtccacgtagcggtagtgcttgtcgtggcgcatccgcttctccttctccggcagcacgagcgcgctctccatggcgtccgccacggcctcgatgttccacgggttcaccctcaccgcgccgctcagtgacggcgagcacccgatgaactcggacaccaccagcatgctcttcttctcctccggcttgctcggctgcagcatcctgtcgagcgcctcgttgccctgcctggacacgatgtactcgtaggggatcaggttcatgccgtcgcggaccccggtcaccaggcacacctcggcgacgacgtagtacgccacgcgctcgtagaactggagcggctcgtcgatgagcaccaccggctcgtacccgggcgcgccgtacgcctcgttgatccgccgcaccatggcgtacgtctcccccttcacctcgtcgacgtccttgccgcgagccgcgcgccgggttcgcgacctggacgagcaccagcttgccgcgccactcggggtgctgccgcagcagctcctccatggcgagcagcttgaggctgatccccttgaagatgtccatgtcgtcgacgcccagcatgacgaccctccccttcccggagtaagtcgccatcagctctgccaccttcgcctccgtctccggcaacgcgagcaccgtcttgagctgccccatgttcacccccaccgggaggatcttgatgctcaccgtccggccgtagtactccaagcagatgtggccacgcttggactcgtaggagagccccagcatccggccgcagcaggagaggaagtggcgcgcgtagtcgaaggtgtggaagccgatgaggtcggagttgagcagcgcgcgcaggagctcctcccggacggggagcgtcttgtagatctccgacgaggggaacggcgagtggaggaagaaaccgagcttgatgcggttgaagcgcttgcggaggaaggttgggagcaccatgaggtggtagtcgtgcacccacacgaagtcgtcgtccgggttgatcacctcgagcaccttgtccgcgaagatcttgttcgccgacacgtacgactgccacagcgcgcggtcgaagcggccgccgaggtcgggggagagcggcagcatgtagtggaacagcggccacagatgctgcttgcagaagccatggtagtagcgctcgcgatgtcggggggcaggaacgccggcacgcagttgtacgactcgaggagcgcctgcgcgacggcgtcctggtcggccagcggaatgtcgtcgcggaggcagccgatgtagatgaactccatggcgggggaggagcacgagtgctgaaggtgccgaagaaggaagtcctcgtcccagaaaaggtccacggctccgacggcgacgccgggcggtgagcccggataggaaggtggttggcgaccacgatggtgcgcgccccggcgacggggacggcgtcgagggggacagcggggagtcgtcgatgagccccgcggtggtcaccacccgcggcagccgccgccggagcgcgccgagcgccgccggcgccggcgcttggtccgccgcgccggtggccaggtccagcaggttggagtaggaccgagaaaccatggcttctatctggttcaaagttttggatcaaagatttgggctctcggttggggaagaacagttgctgctggggaatccaagaattgcgaagaactgaatccaaacagcgccgcaattggggtttaattagccaagaacagagccggtgtgttcggctcactgtttcttgcaggaaagttgcacactcgcactcgcagcagtggttttttttggcctttcgggagaggtggcacacgcacctggattcaacaagcctccaaatgccagtatcctcactgtgcccttctctttaatctcgaatcaatatagttgtggttataatacaagggagagaaccttctcttgcaaattggtgatggtggtgttcctttccaagttctagcttggttggtgcaagaacatgggaggcactgagaaacacagctcagatactgtctctgcggtaaaaatccaatccttttcagctaataatgaccatcaagatttgatctcctgcaaataaggcaccacccggcaagaagaaagaaggaaaaaaatatcaggtaaaagtgccagaagaactcaaatgaaaagaacccaaaaaggaatctgggagcctccgtgcctcacacaacagttgctccaaccccggacgatctagggctgctcatgtcgtgtgagagggagcgaggagggagcaagaaaaacagcttttaataggagaggaaggatgactcacctcatcaccagcatcatctcgttgagttgtccttggattgatcaaacgaccgggacaaaataatcgcatgggacagcaggagtgatggagactgcaaaatttttctcttcctctcttttttgtggttgatggatcaattcaaaggcgagcaagcgaagggaagtacaagaaaaggcgcaaaagagacgcgagattattcggagattgagaggggctttgcttggtttggttttggtggtggcgtttggatctttcggtggctcacagtcacagccacgcagctgctagattagttgaactgagcaagaaatttacggaggggaaagagagaccagtggccgttccaatcaatcaatttaatcgttttatagtaggacacagtgaaagagcgtgcaggtctaacactttatggatttgtttctcttgtggaatttgttccattatggttaggataattttcttaggacaatattccaatcactggaatttgtttcatagaatttgtttcggaggacaatatggcatggcatggaacaggtaaagaactgaaatagcaaactgaactgactccacccacttatcagagccaaatacaggctagattatatgctctctacccaacagagagaatattgcttcctaatttaagctgccggtagatgagatctatccatcaaggcacagtcgccatcctcatcagttcgcaccaaagggataaaaaggactgcattactaatctaggtttagcagcagggaatcttgaattcttcatcacccttaagtcttagggctagtttggtttgtgaactaaattgaccttaccaatttttgactatgtcaaattttagtaagttttggcatgacaaattttgggaaggcaaagttgtatttggattgaagccaaaatagcctaagttaactattgaaatggcctattttcgtaggcatgctaaaatttggcttcaaaacaaatagacactaaacattattaaaatttttaaatattggtaagtcaaatttagacctcaaaccaaaccagcccttaacctcacgccggtcaaaacaaggagataggagatgcctcacgcatttggttggagccaccggacaatcttttgtgcatcacgattgtttgtttaatcgaagtggattccgctctccaccgatgactcttctgcccattgaacactgacaaacctctagcctgcgtgaagatgccatgcgagcgagccgcgatcgggagagcgagcgcgaacggcaggggagagagcgagcggcgagcggcaacacgtggcgagcgcgggggccgcggctgtccgtgcggcggcaacagcgacggggccggcgtggcgcgctgcggtacgtccgcggcggcgagtccggtcgggccagtgcaccgggaaaaggcttgacaagtgggtgccaggcgcgcgctgttcttttttctcggggagtgcgatagatcgaggaagagtgacagtgactagtggtaaatgtcatactccatgttggggacggtatctgaggctgtgttcagtcccaaccaaagtttaaaatttggttgaaattagagacgatatgactgaaaagttgtgtatgtatgaaaggtttgatgtgatgaaaagttgaaaatttggaaaaaaaaatttggaactaaatacaccttgattgggtttccactttactgtcatccacgctggatctggcgttctccagaattgtctcccaaagagtacaattcacccattttaagccactcctcgtttaattatctcctcatcgtatatataatactccatatatcgcataacactctttatacgcccaaaatatattttaatttgtaccgaaaaatgatttattattgagtaaatttcacttcgggccaccttttgttacctatgtttcactttggaccaccctttaagcaatattttcactttggattgggtaaacttacatttgtttcactttggaccacccaactctcttctcaagcatatgaacgatctcgattacgctgtctcctactcgtcaatgaactaacacagctatatgtaagactatttcttcgacatattacaagttggatgtagatggataaaagagtgagggtggtccaatatgaaacaaaggtaaaaatatccggtccaaagtgaaaacattggttctaaggtggtccaaagcgaaacgttggtaataaaaggtgggccaaagtaaaattaaccctttattttaggatgtgtgcactaccagtctaccaccaagttattatgcagagaacactaccaccaagttacaggactgaaatgtgatgtcattggaatggtactcttcaatctatatagtacagtactgaaatgcagagtagccgcatcctgttctgccgagcctgtgacttgttgcggtgtcaactgggccacaaagataaggttccagc

SEQ ID NO: 7364 - DNA, 8854 bp, Oryza sativa
tatttgcgacctcaccacacgatgattcgtcgacgaggaaacgtgacgagccgcgagcaggcgcggccccgtcacctcgccctcgtggcacgaacgataaccatcatctcatcaaaccgagaacgcgcgtcgtgatggccgagatgacccgcgggcaaacggcgcacgtactcctccggtcccgaccatccgactattagccgtgcgaaatccgtcgacgcgacggctgcggtgcttagcgctacgagatcttttttccatactccagttgcttccatgggcgtgcacgtctcgtcgctgcaacttgccatgtataactgcggccccgagtcatacggtttgctccactgcaactggtggtggctgtcggtgtggctgatcgcactgtagtactgtaacatctactacaggggagcaactttgatgtgaggactagtaaggggaaggcatgccacagtgccgcacgcaaagggcgttccactgataaggcacactgtacgtgcatcgtgtctactaggagtagaagtactgctattattatctgttattttcagcaggttgggcctcgttgtcaaaggagtcaggtagcgtatcgagtgtttaatctcctgatcgtgacgtctgctgttattaacttctatagctccagcaaccttggacgcaagccacccgcagataaaatttccaggtaaatatcgtgggtgtgacgagccgtgagatttgagaagactgtaaccgatgtcggtctcattggatcgctatattttgggcctttgaactgtcattggtcggtaacctcttgaggtctcaggtatgacttacggaacagtatcgttttcgctaaatagaagtacaagtgacttgcgtgttgcatgtcgaggttgacttatttatttacagatcactccaaatataggcccactaaatctcaattcagcagaatatatgcttcgacttttgcaacttaggtttggtacaaatccaattgaacgaattaagttagatactactccatccgttagcaaatactccctctgtactcgtaaagaaagtcgttttggacagcgacacgatctccaaaacacaattttgaatttttgtttctataaaaatatttattaaaaaatgaaatatgtatacttttattaaagtatttttcaagacaaatatattcatataatttttacattttcaaactcaacaacttgagagttattcatgatatatattcccaaggtttgacttaaacattgtcctaaatgactttctttatgagtacggaggaaatataagcattttagtagttttagataaaatcaccttgtaaaatgtcgtcgcgagattactttcagaaaatatcatactgaaagatgcaatcaccaatgagcaataaatgcagcgtttggatgaattgaaaaattagctctcccgttttaaaacatgactttgaatttttcttatcaaagtttatttttatattggtttttaaatcacaaaggacgtatatataaaagggtttacctagaaattattattcgtttgctaataaatcgtatggattataatcaatatatgattaattgatgaagactggtactagaaatatttacgtttttggataaattttaaacgataaaagtagttatatttctgaacgacggcaatatggcaatatgagtttcaaataattagatcacaaaacttcttgtgctactagtacttaacgccagggtttacgttaccatcggtaaccgcgcggttaccgtggttaccgggcttaccacggggtacggtaatataaataccacaataacctttttaaatttaaataaattttaaaattaatttgaatttttaataaattttgcatggttttttatggttaccgcggtaaccgtgcttgccgccggggcgcggtaaccccggccctggcggtttgggaaaccctgcttaccatctcaaacctttgagcagttgcacatgctaccactctcctctctagacttgcctacttgcctctagtcctccgttggtctgcgtgctctctttctaccaacaatccgctcaagatctcgcgcttctcacatgtggtcatactctacattttggcgcttcttgttactttatgttaatctcaagttctcaacctctactctcgcccatagcactagtgatgggttacgaatactggcctgtttgctttcgaccattgggctgccacccgatctttctgtatccccacgctgttcattttcatagaagggatgaatgcacgtgtttcttgagctttaaaccggtacgaattttattaaaaacaatctatgtattaaattatttaaattatttttaactataatagttattattaatttgtaacctagaataattctcacaaatcatcgtggtattctgtcacccagccatttagcgcaaaaaaaaaaaacttaacaccctcatattgctaatgaactttttattcgtaacccaaagctccgatctgataagagaaggctaacccgccccaatcgcaattgacatccaacaaatagagattttgctcatttttgggaaagaaacttaaagtaaattttgtttggcaaatcccttaatcaactatttattctataactacgagagtttagggaaaaaacagttaatataggatcaattttgtattgatggtacagaccctaaatgctttaatctggataagattcgcagcttgtacaacaactctcgcttttaatatttctaggtagcagatactcctacaaatgacttggttgatgtgcgggccgtgtcaacatatcagcttaaggaccaagctgccatttaattgggtcgatctcgtggcaattgattcttcatcacgcagaagaaagcgaggacacaggacactgtggctgtttttttgtaagcgtgatcaatgtttttggcacacacactgatctcgttccgtgtcaactcgtcatcaccaaccttgcttgccattttgcctacctagtacagctactaatcctaatcctttcgtgattatccaaatggtcgttgcagccaaagcttgcaacaaaccaggaatggctagctaaataatctggcaaactatccacaacttctcttgtgaaatgtagtctttgatctatacgcattcttcttaaataaattggtactaccatgcttttcgccttttcctctaaaaatatctcacactgtctctcctaaaggtgtgcttatattacttgtaggtaggcagttgcttgtcactatcttttcaattagatggaaatgattgggcaacgtaaagttcagttaaaaatcttcttttccgtcaagaaaaaagtaaaaaaaatgttttccgagacaaaatatataaagcattggtaaattttggccctttcaacatgaacagagatgaaactttctgttggctaaacacgtttggctgcacctcttgttcggaaggtctctaggataatacagtaatactcacccatttgttgagtacgcactacaacagctaccatatcatcaggtccaaatgatataatgcaacatccgacaattggtctaaaattagtgattagataaagatacattttgtgggggacaaagaaaggttgatgccttgttagtatcaacttggagaagattcattgaacctgggacggtgagagcaacgccccatcgaccagttgtagaatactgcatccgtttctaaatatttgacgccatttactttttaaaatatgtttaaccattcatcttatttaaaaaaaaattaagtaattattaattttgtttcctatcatttgattaattgttaaatatacttatatgtatacatatagttttacatatttcataaaaaaatttgaataatatgaacggttaaatatgtgctaaaaagttaacggtgtcgaatatttagaaacggagggggtactaatgataattaatggcagtatcgcttacattgaagttggcctcaaatggaagctgctgtttttctaaccatggccgctgcccgctggcccgcatcgtatgtaacgcggtcgcattgccggttgctagatcaacatagaaacaacagacgaacacatgatcgctttagcttctgcaaaaatactctcataaagtttctttaacctcgatgatcatgcaagatgacgaagcaaagccgcaaaagcgacagcatacatcttaagttcgttgatttactcaagtggcagtactaatcaagcaaagcttttggcaaccaccggcagagcaagaaaatacctgcataccatccttgcggatgcaacattttcctaggaaatttcacttaggaggttaggaacacattatatacagaggtctacttatggcactgatatataacttgtcttcgtactccctccggccccccccccccccctcaaaaaaaaatcacttatagagtttaaattttattccatagaaaactaacttctatcattctgtcaacccttaacacgtaaaatgtgaagttttattcatttaatattctttatctatctatcactcttacttttttttaataattaaagatattttagccattctcatttctcactaattctaccttgaaatatcatgaattattttttagacggagggagtacaagattaatataaagtagttagcatgataaccaactccacttggaattatttactcacatgaattgttccaaagggaatcaatcaaagttcagtaaagtcaaagtgaagtcgatgagttgatggtgaaactgccgcgttgcatcagcagctaccaacctgcacggttgcaggacctggcaggcgggccttggtttgttaattgttagtaaattaattactccaggtcattgtcttagtaaaaccatatatactcatgccactagcgtttgtttggctgtggatggtgacgaccgatgacgtgtcactggtgcacgggcccaccagccagggacgatgccgcctagtaaatcctagaatgttttataaaaaaccaagttagtacgggaatgggacatattggggctgattggttcagctggctgcagagttttgggatgcagctgtccagcccagccaatcggctgcagcctaaaattctacagcaactcttatgttttgaatgtgcacactgctgcagagggcagctgcttgttggttgccgttgtagttgatgcgagctggctgctgcagctctgcagcgctgcaacaacaatcacaagcgatcagccttattatatgtccaaatttatagtaatagaatgtgttatatctaattttagattcttttttataggacatagaaagtatacgccaatggccggccggcctgcctagtatacaatggaacggcgcatttgcgtcgtcttctccgacggcgttggtggacagaattgcaatgcgagagattcagctggaggcagttgcgttatccagcgcgcagtagcggaatacgtgctctgatgaagcaatataatagaagggttcatcagagatgcaacttgcaagatgctctctctatgatcctatccattctagggaccgtacgagataaggttgggattagtttcagtagaggtgtcatgtgccctgctgcatcttctgttcccaaggacgagaggagtaggacggagccgataagataatgaatattactactgcatctccttttcaaccaaacaaaaaaattctaaatctttgcttagggagtaatcaagcaatcatggtatcctcttgctggggaacgatggatggaccggtagcattgccattgtcagctctgatcagcaccggctactttgtccatctgtcttctttcaaaacgaacaacaacaacgaccagtctaaaaaaacgaacaacaacaacagaaaaaaaagcttgggcctttgtcctgtatactgcgaagtttattgggcctacattcttttatggcctgtttggggcaaaatgccaggctggttgggcctgttttggaagagaggatacaagggccttgtggctctctccggaagccagttactagttcaccaaggtccctcaatttaacatcaagatttttttaatattccttaatcacaaaacagaaatatatacacctaaactcacgtatgagcaagtttaatagtatagccaactactagctttaattcatctatagccaatctaatagctcatacatacaatagttacatactacactattaatacctgatcccacctgttatacacactacgtcttatagtccgtgctacagctggctataaatctgtagccagcttatagcctgctattatacctgctctaaaccatataactcatcgatgtcaccgttccagcgagagtgcctgagtctcgaggaaggagctgatggatgacaggactggatttttcacattttgatccttttaaaaaacttatttcgcaaatagacccctgaaaaaacttatcccagaaatggtcctttttggggcgccagagtggctggcgccgtcatccaacgggacggcgcctcctcctgccaccgtggcgcacgcgaaccgacgtggcaggaggagggcgccagcatggctggcgccgccgcctccattcctgtttctctgtatggagttgcaacggtgtcatttttattttattttttcggatgttttttcacactcaggatcacgatacaaccaaccacaaaaaaaatttaaactcgaactaccacttagctaagtctgaaaatatctagcataccacttagtctactttgcaccttcactcaaattagaccataactcctttagtaaaaccctttgatcagcatgttaaacataatgcactctaccactatataaattacttaatctaattcaaaatataaccacatgaaatgacatatataagttaaacagtacaaagagatgcaatttttttatttttatttcatttttttgatatttttttcacacttaggagaacataggaaccaaccgtataaaaaataaactcaaacggacaaaatatgtgacatgtagaattttccaaaactctaccgaaacggacaaaatatgccatctattaaaataggcgtaactttctcatacggactcggaatcaggcaaataatatatgaacggacatctacagaaaaagttacatccgattctcccccgctttgccgggttcggcgatattaaaacctccaaattccgcttgcaagattgtattttcgaggagagaagtttttcggtggagctttggaaaattccacatgccacatatttcgtccgtttgagtttattttttacgtggttggttcctgtgagttcctaagtgtgaaaaaaatataaaaaaaataaaataaaaataaaaaagttgcacatctctctcctctgcactagttcggagagaggagaggagaggagaggaaaaattctacatgtcatatattacgtccatttgaattcaatttttctatggttggtttttgtgtgtccctaagcgtgaaaaaaatatcaaacaaataaaacaaaaataaaaaatttcgaggggggcgccagccactctggcgcactccccctagccacctcagcatcgccccgccaagtcggcggtgggacggcgccaaagaggctggcgccgtcctgttgaacgacggcggcagccactctggcgccccaaaaaggaccatttttgggataagtttttctagggatctacttgcgaaataagtttttcaaaaggatcaaaatgtgaaaaatccaggatgacaggaaggggaagaagggtggtggtcggcgagaggcggctctccggtgaggaccagatcggcgtcggcgacggcggagagggataacgcagttagcgccatcaaccgttgcgatcgtggcccagatggaggagagcaaaagctggacctttctgaccgttcgatcaacgttagcaacggccgcgattaaccaaacggcaaagggaatttcgcaacggagccctgatttaactggagcttatcctcagttgcactaatcccatctggccgctacgctttccttcctcttgctccgcgcctccgccgacgagctccggtgaggagcggcggcgaccggcagccggcagccgagacagacagcagtgaaggattgccatcaacacgaaccaactggacatcgaaatgctcttgcgcggcgaagccggagaccagccgtcggccaaggtcttccgccgcttcgtccatgacgccatcgagaggtgagattctaatcctgaatgccccccaacatcaagtactctctcaccgttgttagtactaacgattttgctcaaatgcgcagaccggacgagttcatattgcatcctgccgctccgctgccaccgtccgtggagattgtccgcgtcatggatgtgatatccaattttgtaccccacttcctcttgaaatttgcagcatctgagtaggtatggagggagtgatgcgttttttgcgattgatgatttggtcaggtttactcactgattcagcagagctgtagaggaacacgcaatcagatatgcaaggctgtgtttagttcagcgcaaagtttagattttggttaaaattaaaaatgatgtgactgaaaagttgtgtgtgtatgacatgttgatgtgatggaaaaggactgaagtttggatccaaactttggatctaaacacagcctaaaatgcatggtgcaatgaatctgccatggtggtaagctgtgaaacctggatgctctggtctctggaacctaaattatatactccctccgtcctatattataagggattttgagtttttgttttcaacgtttgaccactcgtcttgattaaaaaat

SEQ ID NO: 7365 - DNA, 11983 bp, Oryza sativa
  unsure (1)..(11983): unsure at all n locations
aatcccttatattgtgggacggagggagtagtacttatgtactatgtgagtttttggagaattttgagcatcttgaaataacctcgatagtacccaaatcgtttggtttgaaaagaagtgatcgaactgagtgaaacatgaccaggtctgtaccgttaaatttcaatttcctgtaactctctgtctctaaaatcctgtatatacctgatgtttgaatctcctgaaaatgtagatgaagattcagtgtttcacgtaaaacgaggtggtgataacgtgtgattaattaagttttaattattacaaacttaaaaaatagattaatctaatatattagagcaactttcatatgaaaagttttcgcacgaaacgcaccgtttaacagtttaaaaaacgtgccacgagtatacaaaatttcatccaagccttgttggagaaaagaacagggcacgttgagactgaagcaagtaaatcaaattgcatgctgaccttcgaaagatcttcctaaaggtttcccttttttgtgtgtgtgtgtgtgtgtgttaccgaatcccctacttctttttaattggagtgtcactaacaacctaatgttactcctttacagataatgtcgagcatgttaatcagatcaaccttgagattgctagctgggtagaaagtgactatcaaatacagtttttcccgtcgaactattcatcttggttttgcattccttgttccagttgactatctgcagcttactatcagcaagtgatatcattatttggtaccattacttgttggtgagatatatatgttcgacatatatggtgttgagttcacacacaaacctttggtaaattggtaagcttattttttgaaaatatattatcgtttagtgatggtggtgtgcataactaataagtacaaggctaaggtgtatatatgtagtcctctcggtatatatgtatagttgatgatggtttattcaatatacaatttcctcttttttccatgtatagctggaaataagaaacataatattggttctcagtttatttgctccatgtcacgcacaatatgcttgaaagtgtattcataaacgatctgttattcaaatgtcagttctgaattgtcataagaaattcctgtaaattaactgtttagttttttttaaaaggaagacaaaagctttgacttttttatattgataaaggagtttaactgtttagttaccttgtagctttccagttgctgtccatgtccagtatattttcctaatatcttctttttagcgaacgtgaaatattttttttcactaaattgattctctctgttgtaatttaaagccgatcccattgatttgaggctcttaaatatataaatctgcctgtggctattgcgaacttatttgttctttttcctgtgccaggttcaatgaaaatgttgtgaagaaagctgtccacctgcaggttggattcctaggggggttgactgttgaggaataaagcaatccaatggatatttcaaagtaaaatggtctaatgatagttacaggttcaggaaccttatcatcagcaattgagatgggcctcagatgaggaagtatgtccccttcgttccagtcaccaaacattagctaaaaaacgtgtcccctgcactaatctagctgttattttgatcatatgtcataaactgttcaaaaaataagtccactgactgttgtccccagtctatgctgttccatgaaatctgtaatttaatcaaacgttgaagaaccggaacaataactcttatcttaattgcgtccccctggtagtactgttactgtactactaccgaagtacggattgtagttggtagcaagagcaggtcaaagatttcatcgaggaaaaatatttgacacgcctttctctaacacaagcagctactcctattcgtttggtcaaagttgaggtccaatgtgttcatcatctcggcatctcgctcgtgagaacgcaacgacaatgcgctatattctgcgctgacaggtggggcccagaaaggatgaagcgcgtccgtagactccgtacggggaagttgctacgtaccgacgccagctggactttgtactccaacaaacggcagcgatgacgccgaccgacctaccttcccgcatgtggacccgacacgtcagcctctacattcggcctttggacagcgtcctaaagatctcgttattttttatatttattttctaaaagatttaaaatataatatttcatttcaaatattttacatgaacatactccttccngtagaagtatatttttaaaactttgaaatgataatttatttttaaattctttttaaaaaataaatataaaagtttaaacaatccaagatctcgctacttccggcccgggccgacctgccgcttcccttgatatgacgcacacgattttactgctggccccacatgtcacaagcacagccacgaattcggaacgaaccataaaccgcacccgcggacgtgacacagccacgctgactatcgtgccccacaagaaatcctgcacgctgttaactgaaacgcttttgactgacgggtgggaccaaatttacgggcccacaggtcattcaacaaggaaggtatatatagcaatatcgcataaagtattttgcaggccacgcgcctttcgtgatctctggtataaaagtctactcctaccaattaacctcctactactagtacaccagacgacaacacacacacaaaaaaaaaaaagaagagaaaaaccgaacgaaaatcccctcgcgcagacgactactacatccttctcgtctcatcccgtcgacccgccgccgcctcaatctcgaagcctcggcgaggctagggtttctgcgtctccatgggctctaagaagcggtcgcctcagcatccggccgccgcggcgccccctcccgccgtcggcggcggcggcggcggcgaggtctccggcgatggtggcgcctcgacggcgaacgggccggtggtgccgaagccgtcggaggtggcgccgttcctgacgaaggtgtacgacatggtctcggaccccgcgaccgacaacgttatctcgtgggccgagggcggcggcagcttcgtgatctgggactcgcacgccttcgagcgcgacctccacaggcacttcaagcacagcaatttcaccagcttcatacgccagctcaacacctatgtgagattcccttgatccctgtgttcgtttgtttctgatgcgcgaattcggtgccatttccagttggttggacgaaatcggtagtgaaatctgagtttctgttcccaatttgttgtttattatcacggctagacagcaaatcttgcttgcaattataaattgggcagtagcttccgatgcactgcatatgaatttgtttgaatcgtgactgcgtgttatatgatgttactttcttctattttgtgccttttaagttgattgcgtgtattagggattatctgccattttggagttaatcacttattaaattttaactacgttggaagctgttggcgatatagttggatgcctttcttcttctagtcgaaagacacaatagaactagtttctgcggtggctttctattcaacaacaacttctagagttctagtacataaaacacgtcattgggggtggggactaatattgttaattttgagaccagtttctgttctcttaatgttttgtgaatttgatcgtatgaaagctggctgtagaaactatgccaaactcttggctttaaattacaggggaatgatatgtgttgcctatcactacttctaaaagtctatttcccccatatttgtatttagtgaacttcagaactagagaaagcatgatgttataacctaccatcatgctgtataagaagaatatgttccctcttgtttggctgaaagaaatgcatgtttggttgtgctgatattgtactgctattatcttcttctgtgtcatttgcctcaatacattgttttatttgaatttgaacttccttttcacaatcgaatttgtctgatgaaatataagattatgaatttgctcttttattgaactatatggacacttaattttgtgcttttggcaaatccatgtcctcattttgatttctggataaatcactggactcttgcacccaggatttcttctgatgtctaattacttaaatgcgaaaatcacctgacttttgctcactgggttgctttcctgtagttaggagtagttctatttaaccatctattagttgttcttggcttcatatactcagtaaaacttaaaaacaaagcctgaaaagtgaaatctccaatgggatcagtagaaacattactttatctgctttcattgatgttctctattcttttggagcatatgttttatattagctgaagttactcaagtttcctttcataatcagggatttcgtaaagttcaccctgatagatgggagtgggccaatgaaggttttattatgggccaaaaacatcttctgaagaccattaagaggaggaagaagtcttctcaggaatcacctagcgagatacagaaggcgcctgtcaaaactgcacctggtactgaaaatattgagataggaaaatatggtggccttgaaaaggaggttgaaacccttaagagggataaagctcttctcatgcagcagcttgtagatctcaggcactaccagcaaacatctaaccttgaagtgcagaatttaattgaacggcttcaagtaatggaacagaaccagcagcagatgatggcacttctagcaatcgttgtccagaatcctagttttctcaaccagcttgtgcagcaacagcagcagcagcgcagatccaactggtggagtcctgatggaagcaagaaaaggagatttcatgctcttgagcagggccctgtaactgatcaggagacctctggccgtggggcacatattgttgaatatctcccacctgtcccagaaacatcaggtcaagtaaatccagtggaaggagccatttgttcggccaactcacaaccagttccaagtcctgcagttgccacacccatggacatgcaaacgtctaacgttgctgatactctcggttcatctgaggagcctttcgctgataactctactctacatgaatgggatgataacgacatgcagcttctgtttgatgataacctagacccaatacttccaccatttgagaatgatggtcaaatgggccctcctttgagtgttcaagattatgattttccgcagttagagcaggattgtctgatggaagcacaatataactccaacaatcctcaatatggtaatgactaattactgtataccctatgtttttgttcatcattttgtggaaaacaagcgtgatgtcattttagttaactgtggagtttctatgtgcatgtttcatgccaaatgccaaacaatggatgtttacagaccacccttttagtctgttgtgctaggatttggcaaagatgacatggagccttattcaaagttcaatacttgcttctcaaatggctttgatatttccttctgttatttcacgaaagtagtgtttgacaactagagtgatatttttttttatatctggttaattggacaattttgatcacagccaaacctcttgatttagtttcctcaaccaaaacagatctaagctgtgcctgcgtcacattgattattttcccaatcagcctattctttgtttgatcatatcggtttcaattcactctgcagtacttctatacatgcctgacatcttccctttttcatcagctgatgtcattaccgaagcttgattggtggtccaggagcatacttgcagtaacattaggtgggtacagtccatttttaacatgaaaaaggaattattccttaatgtgctttgttaatggaatgcttactttgcgttgcaataccaaagtaccaaactgaaagacataccatccttgtttaattcctctagccgttgtttcttacagaactttaggctagtatttcgtgtcaggctaggactatatggtcaactaaccctgcaaccgcctccaaattgaaattcaatcgaaaaaatattgaacttaatggcttgaactgaatgcttactaaataaacatgattggtcgttaaaaaaatgccatcagccatttcttgtaaataaatacacgaagctatattttttttatttgtatgaccaatgtttgttccagtactgatccagtttcaacatctgcagttcttcggtgaccaacctccgggcgcatctgcaccattggcatcccgaaatggcgtcctcagggtgtaccgatgaattatgctaacacagaagaagatataactctaatctggttgaccatacagaactacctttcttgttcaaggcactttttggggacaggggacgccttttcgcagttctcgtcgtcttacactagcgatggttgctaccatcgaattcatttggtgtatatactgttgttcgtcttataaaacatgagcagttttgtacatttaccttgcgtatcatgatcgcagctgtgtacctctgcattgcattactcttacctttttgcacaccaggctgccggccatcttgcgtgatgccgtttatgtagaagcgcctttccggctttccgtcgtacagagtccaccggttttttttggactgctgaaggatgaaggatgcattcactgccgtttattagcggacgaccaacgattcctggacatccaaatttaaaggggaacaagcttccagcaccaaagaagcgcatctggtgtagtggtatcatagtaccctcccacggtactgaccgggttcgattccccggatgcgcattttttggttatagccctaggttctgtgtcctttaccatgttctgtgtcatctttttgccacgaacaaatgcttgacgatgacgttgcaatgctgcatagcctgaacaaacatccatgttctgaatagccgcacgcgcttcaattctcagtttatcacacatgaaatggaggtcacgactcgtccgacgagtcccgaccatcgcgcaccgcagcagcggccgctaaagcttataataggctaatagaactgagcaatagaacatgccgacctctgtaatcgcactgctagaaaaactatttttcagacgatgacatttttttctctgacgggtatgccacttagagctaaatgaccgtctgtgaaaataacaactgagcgatatcgtcgtccgcttgcaaaaaggttaaacatgttaaaaacatcatctacccaccaaaatgctaagtcagagcacttcgccctcacacctctccctcctctcccctctcacctctcctctccttctctcccgccgcgggatccagtcggagggcggtggtggcggcggctaccggcggtagcaacgcggagggtggaggacgcggcggcttcctcccagatccggtggagaccgcggcgacggcgcaaagggtggtggtggcggcggctccaagcgctggcggttccccttcctccctcctagatctggccggagaagggaggggtgatggtagcggtgcagctggaggtgtatagggcgagggatggggtggtattttttttattctcctaaaatatctccgcaaacgagtggatacgacgcccgtgaaaatcaactattttcatagacttgtgcgcataggcgggccgtcctcccgtctaggaaaatgatttttgaccgcctgaaaaaatgatttcttagcgtcgagctctctcgctgcctgactcatggagagattgctgggacatgacgcaaaggcccaaggaggcggagccacgagcccacggtgaactccgacctgcgatctcacccggtcacgccgctctgtgcttctctattcacatcgtcctacctgtccatctccgtcccggttggcctcacaccactcgtgccggctcgccgccgtgcctcgtcatctctcttatcccgtggtgccccatccgcatcgcccgatggcaaaccgacggccttgatcgcccaaccggatcaaccaccgcccccgtcttaccgttacgttgatccagtcagtcgcgtggggagatctgatgggccaccggccaggccgcccaagtttttgcacctgcgaacccaccgggcgggctcctggtgggcttcgccttcggcgaaacgcccgcggccggtgcccttcttcttccgccgaggcaggaggcagcggcggcttccggcttccttcttgtggctggtcgaaccgtctccgatgataccttccacgcaagcagctagtcgatcgcgccaacgggggaaaagccattcctatcatcctgtggacgcaataatgcgccgtcagttatcaggtactgctgcctccacttgtgctgctgctctccataaatgtccaacttgacaaaacggcgactttgttgtaccctggcccattcgatctgcagtggtacacatatgatacgtacccgcagcgactgttgctcgttttcgtttttgcggccgtgtggccgtgtccaaactgggcgcagagccaaccctctccacgtcggcttgggaatatttttggtggccttgctacttgataaatatcttttgtttaaaatgtgttcataaatacttactccgacttataaaaattaaaattctaactccgaggctttatcccataaaaaagtatttctaatcacgtgaaactcaacaagtaatttaagaatgctaattatgtggattaattatcttaatttttttaatcaattatatatatataatgtatgtatgtatggggttcattatcgtggtcatttgtctatccttctaatatgtcctaaattagctagaattttagtttttaggatagaggaagtaaatagtaatatttaggttatagcttctccatcctgaccattccttatttattttttattaaatcctttatgaatacttatattcgtgaacgaggaaagtattttaggatcatgattctgaagtctgaagaaagtattttaggatcatgattctgaagtctgaagaccattttggtcaggagcctgatgaatttacgtagcaaatttttaccactcaatacaggccaaaataaatcaaaaccaactttattaatattttaaatttaaattatagctttttaagtgtcgtttttttaccttgcttgagaattgagatatggtggggggattttcaggatcctgtggttctatatgaggagagtcccctagtcaatatcatgcgcatatgagatttgacacacaagatgcatatatatatatatatatatatatatatatatatatatatatatatatatgacactctcactacacatgctaatgaaggatccaattggcgatccatcgctgcacatgtacaatgtgttgcctatagcacatttatggacgttttattattttgctcactacctaatggaatgagtacaacactgcagtagttgtgctgtctatctaaaattaaaacatatcgtcctttcgaccggttgttggagctacattttcagctcacagcgacccgggttagtttcctgtacccgtttttgttctttacatcttctgtttatgccgctgcatctctgtcgtatatgttggtatgagtcaccacatgaatccagcaactctaaaagagatttctttttaatcaatccactaatactaaagctagctcaggcttgctgtattcactcagtcacaactttatctcctttacagatcgggaggcacaagtgggggagtttacaaaagcaaaaccattgaagaaaaatggcatgtgtcctggcccattggaaaatagaataatttcttaagagaaggtaccgtgtctgtgtgcgtatgtttttttaggacatgtggttacgcagtacctgttcatttgaagtttttcaaatgaagcaatctgttccatgccgtcaagtttcctccaatgttatagatgtctctaatataagttagctttacagtaagcagcatgtggtgaatttatgaatccaagaaattcgatttgtttttggtaatatcgcttttataataagatctttttttttttcgaaaaagacggcaggaggactgtctcttatcattaatagagaatgagagaatacagattatttacaaaataagaccaaattgttttatgatctgaaggagcacatgttttatgatctgaaggagcacaatatcatggataatttttcttgctgtgctctgggtttcacgtagttgcagaacttgtagcaaacatatcattcagacaattgaactagactctttagtctctcattacgattgcacaaaattgtgtcttgcaatttgtaatttggccaagaacgaacttaaaaaacaaacaaatccttggatggcaagaagtgaaaagagaggaagaaaaaaacacacgggacaaagctgttcgtccacgtggcagagattatgtacacgtcatctctgattggttcctaaatctgcagagttaatttaaccggcggctcgattggctatagatcgccgctctgctccgcctcggcgacgagcgcggcgagcgagcgctgcgcatcggcgggggtcccgctcggcgatgaacgggtgctcgagcagctcgccgaccgacgcgcgccggccgggcttttttttgaggcaccgcgacacgaagttccggaactcctccgacgcggcggccggcatcttccgcgcctcgccgaagcatatggcgcacatgagcgccgcccagtcggggcgctgccccacggggagaagcgggaagtggccgaggtacagctcaaggatcgctaccccgaggctccacacgtcggcggcgtacgggtcgtagtcgccggagtaggcctccgggtcgaacctctccggggacatgtaggccgccgtcccgacgtatgacgcgcaggggtcgagccgccgccgcaggaccttgcccgcgcccaagtcggcgatcttgacctcccgtcggcgccgaggagcaggttcgacggcttgaggtcgcggtgcacgatgcggagcgcgtgaagggcctcgagcccgagtagcgcctgcctcgccacggcggcgatggggcgctcccccatcgggcgcccgagacggcgaagcaacnaagcaagggaaccncngggcatgagctcgagcgcaggcgcgcggggctcctccaccccaccgcgggccgacgggaccaccgcgtggagcctcacgacgtgcggggcatccgccgcgagcntgagtatctcggcctcccgcgccgcggagaggtccccggcggcgaagagcttgagcgcgagcggctgctgcgcggggcaaccccgtcggtggcgcgccttgtacaccgtcccgccgttgccgtggccgaggacggagatcctctcgaagtccgagaggcggacgtcagaggaggtggacggcgcgactgcgggctgctgctgctgctgcggcgccggcggcgggcggagggcgaagtgatcgagcgggagggtgaggtgcggcaggtggcgtcgctggcggacgagagccatcggttggagaggagaggagaggagaagagaagagaggagtcgaggagagatgggagctgacgaggagggggaggggagggggagcgggcgtatatatggagtggagaggagagagcagagagggggggagtgagatggaagtcgatgtgtgggtgcgagtggaggagagtgtagtgcgggtgcaggcaccaccgggtgagtgattgtgtgtgattctcggtaggatctgagttctgttttttccgtttccgtttcgcttctcctgtcatgtcctgcccgtgtgtaactgcttcatctgggctcgcaagagatggccagtgtagcgcccattccgttgtggcgcctagcgggaaaactatctcttaaaaaccctaattgcaaaatttgtttcttcgcttgttgtctagtgtccgtgccatctcagatctcaaatcc

SEQ ID NO: 7366 - DNA, 17579 bp, Oryza sativa
agccagcgcgcgtgcccgagccgtgtcgctcaaaccgccgcgccgcccgttgcttcccgcgcgcgcgtgccgtggtggccgaccgcctggtcgccgccgccgtcagcctctgccgcgcctgcccgcgcctgccgcccgtgtcgtcgcgccgctccaaaccgtcccgccgccatcgccgtcgtcatttcctcggccccgccactccgcgggcaagccgccaagggacggaggcagagccctcctccctatgctgcgacgcccccgctcccctcctccttttcccaaagaagcaaggggcgagccccctttctctccccctttttcctcctttttccctttcgccggcgtcacctcctggcgccgttttggccgccagccggagcgccagctcgcgccttgaccgccctaagtcggttcccaaaccgacattgccatcctttaaacccaagcctccccctttcccttcctctcccattcgcctccgcgccattgccgccgcccccgtgctctgttcgccgtcgccgttcgtcgttgcgcgtgtcggaggagccggcacgagcaaggacgcggaaggggactccgggcgcgccctctccttcctcttccccggcccgaggccggagagattactcccgcgccgtcggcctctcgtcactgcgcccgcccgcacggtagagcatctccccgttctccctcctcgctccatctcctccccttagactcgggtagtagcacaagtagcctcccgtagctagccggcgccgccctggccgttgccgtcgctcaccgtgtgctcgcccgccgttgccgcccgagctcggaagcgccgctcgtcgccggcctcgctcggcatagctccgcccaatccgacgctagcaacggattcccgtagccgcgtagatgctctcgccgcgggaattggcccctcgtgacctcgtcgccgtttcccccttccctcgccgccggttgccgccgccgcaatccgccgccgacgcactccctccggcgaatccgagccgttggctcgtctccccttgtcctgtgcaaccacccggtgtgctcgctctcgcctgtatcgccgtggtttgctccgtcgctcgccgctgtcgtccgccgtccgttccggccggcgtcgtcgtctacctcccgccggcccgcgtggcagccacgtgggcccgccgcatccgcatccaccgcgaaccgtgcgcgtgcaccgcgtccctcccccaccctagcgccgcgccgcgtgctccctccgcacggtgagccgagccggtgacaagcgggtcccacccgggaccacgcgtggtgagcccggcccaccggccctctctctcctcccctcccgcgcgcgcgcttgggccgccttgggccggccggcccatttagctcggccggaccgctccgtttctctcgggccgtgccctagccggccgaggaaaagtctatattcccttcctcttttcttttcttttcttttcttttcttttccaaaaaggattttcctttagaccaaaaatccaataatcttagaaattcaatatctttccaaccgtaaatccgttggctccgttcaacttccaaaattcctcgaatttcgagagctatctaatggcccgcttagaggtcattaatagggctttattcttcgcacgtatattgagttgttccgtttcgcgtgtagtttccgagcccgaagacccgcagtgcgaggatttcgaggatcaagcttcagatctcgacaaggcaagccacccttgaacatcttgagcctatatttgaacttaaattatattgcttgcaaaatatcatgcattgataggattgcacgtaatatgtttgccccgtctgcgaggcagattagtgggcatacctaacttgttgcatttgatccttcctttgttaatcgttacaccatgttcccttgtaaccacccagttgcgcctcggtatccgtgcactctgtgcgagtatcgacggtcgccttcaaacttaaaatatgataaacatcttgggtaaaacttgggttttacaaaagacttggaaaacccgacacctgggtcggtgcttacgaactaaatgaatttccaaaaccgcagaccggggaacgtaccgggtgtacgatttcccgctcttgcacttaaggaccgtttccttggaatttcatccaaacataagtcaagtacgaccacatgggtggaatgggacactcctggctgagtaactagcttatcaggggagccttgatgccgagagacatgtggattcgccggggtggtgtcggggaggacccctgggcttcctggcacagtatggtctgggacctaacctgttgttggtctgggacccctgtcgtcggcatatggtaaacctgtgtcggctttcgaaatgccttgtcacgaaagcttggaggtctcccgacgtggctgatccccacgggctggtgatccgggttagtaatgtcgtgtggataaagtgtaccccctctgcagaggttaacaaactgttcgaacagccgtgcccacggtcatgggcggatgtgaggtgattcctagcgtagttttgtttgactactgcttgtgaaattgctgttgtgaaaagggattcgatgtttgaaaaatctgtagctgatgggatcagctaggcccgggtggccgtttgaaaagttgttggcccaggtggccgtttgaaaagttgttggcccgggtggccattgaaaagctgttggccgggtgccaaccttgtttcaattctaaagactgatgcattgcacatactccgaccggacgagatgcactgtctcatccgtgtcgtttgagaagcactcacttagtcgtttttagaaaagagttcaaataaaatcaattgcaaaaacaacagcctttccttgaagcctgcattaaacacttatttcccatggcttgctgagtactcccgtactcacccttgctctatataaataatcccccccagttgctgaagaagatgaagcggatcctgctgatgaggagttcttccaggagcaagccggctacgatgagttttagggtttcggcctagttcccaagtcgcgcctgtgttgtttggtccaagtcttggcttccgcttcccttctgtaatgcagttgtgagctcgggatctgtccgcagcccaacatgactgtacctctactctataataaagagacctctgttgctgtgataatccgtcttcctgtgataccagcactgtttcctgggactggtatcgattaacaggttaatttggagcgtcacgggctagttccggtcggtactagttcggggcgtgacagccagctggggacatttcattgttttctatgagactgtctaggctcgtttttcttagatgatgaaatagggcattatggtctttgcttaaaagttacagccaattattataatctcacacttaaaataagtgaaattaaaaaaacttaaaaatgaaaccaatcaacaagaagaaacaaactaaagagtaaagattgtcaacctaagataattatacaattattgaattctgtttaaatttggattttatgaaaccaactcattgccccggatgcaacattccaatatgatttatagattgctgtgcattaggaagggtatatacagtggtgtgatttcagctggctgggaaatttggcacgcaaaaatttcaagtgacgtgaagaacataataatatcatctgttcaaacatcttgtagatagttttatagtattatctaaaatactgtaggaactgcctatataatcagttcatttcgtgttaagggtggaacccatgcacccacgtcgtgacgtcgtccatcccattttctccgtcttgccattgctagggggcaaccccatgtggttgcgaggattacattggcgggctctcttcctctctcacaccccatctatattggttgagaaagtttgtattccctctatcccaaatataacaatataaaagaggattaaacagcgtatccagattcattatatctaatcttttttactagattgctatattttaaaagagagggagtatatatctactaataaaaatgacaaaaaattgtgcatatctaacaaataccatcatactatacttgcaagagcaagttcccaacactcccctctcattttccgcgtgcatgcttttcaaactgctaaacagtgcgttttttacaaaaaaaaatttctatacaaaagttgtttaaaaaaatcatattgatccatttttaaaaaaaatagctaatacttaattaatcacgtgttaatagaccgctctgtttttcatgtatgggagatgggttcccaacacccacctccaaacacagccttagagcatctccaaattccactctccaaatacttatatatctaactctttaactgatttgggtaatcaaactaggtgttcactccaacagtctctctatttacatctccaaaataacaaagggacccacatataagcctctattaccttcttcctcttctttctcttctcccacatcgacccatccccgcgcgaggtggacggcgaacggcgacggcgactgcgacagcggcagcggcggcggcggcagctcctcgtgcgggcgaggcggaaggcgacggcagcggcggatccccgcgcgcgaggcgggaggcgatggcggcggcagctccccgcgcgcgcaaggcggacgacgacggcggtggctccttgtgcgcgcaaggcggaaggtgacggcggcgccggcggcggatccccacgcgtgagggcaatggtgttctgggcggagatgatgaagacagtggcgttgagtggcgacctcggcagcggtcgacggtggcgtcggcaacgcacgacgacaaggcagcctcggcagcagagggcaaccggcggcgggcccggcagggggcgacgacggcggagtggtggcgccggcggagctgtatctggggagtggtgaatcggagaaattgcagagagagtgtgggatgggaggggaaaaaggtgtgggatccatgtttggctaggccattttggctggccaaagttggccagcgtgagaagtgctttggccagccggatggcttggctatacggttggctagtctgttagagcatgattttgatctaaaattgccaaaatttggcttagagagtggagtaaggaggctgttggagatgctcaactttcaaaaatgccggtttccattagctcatagactatatgtattgaagaaaagtacatttttttcttatatagtagtttgtgcctacggagtcatgtagatatttacattacctcatgcgttccaaattgctgatcacgtggtatattagcagtttgttagcacacgcgagctaacctcgagagacttgtcattaatcaggttcatagcttatgcctacattctaccgaccgagttaggttaggtaggtgcacgatttgtttcagtctgagatatctaatctgctcaaagtccggagccacaactgacaacaacaaaattcggcaggggcggccgcgcgcggtccttcgattttctccgtttctttccaatcctctagacttccgagtgggattggttcttcgattctccccgtttcctgcctttctctcggtctctcgcgcggggaggtcaagtccatttccgcaaattctcaaaaaaaaaaaaagtccatttccgcagcggagccatcctcgcgcgcggtcccgagaccggtaaccacaccaacttccgcaggccagtgggggcgaaagcaagatctaaccgagaaagtgagggcgaagtgaggccccgcgccgccccgcgcgataaggacaaggatttttctccgtttcgtcctgatacgatatgcgtgacgtgacggcggcagcgagcgaagggcggcaggcaggggcattcgcgaagaggggaagaactttccgacgtcacggcgcgcgcgggcaacttgcgcccaacgggaggcaaccgcatgggggacggggcgcgtgcgtccgtgcgtgactcgtcgcgctcttacgccgtggcgtggtgttccgttttgtgcttgcgcttggcttgttttgttttgttttggggtgctttgcttttgcagctgaggtgccactgcccaccacgtactactgtgcaaattggccgcaagaaagcgatgcttggataggtacttgctccgttgctcgtcgtgtggcctggatcagtggatctcggaggggataagcatgcatgtaccgtgcgtgcacctatagaagtgtaagtagcgagaggtgaactattgggcgaggcaactcgaaaacttgataggtggcacggcagcgaacacaagtacacaacatgtagtagtagatctttattttttcaccagtggtatggctaggaacgatcgtggaagcgtgagtgaatacggtgaattttttgcggtgatgtacaacgggccaaccttttgattttattttttatttttctgtgcgtggggccaggttagtgtcaatttcagcgtcgttttccaatggcataaacaatgctaaatgacgcacgcattgttcgtgataggatatccatcccgtctctctctctctctctctctctctctctctctctctctctctggccccggctatcctctccctttcttcttttttaggcgcaacttgtcagttgaacccatctcgctcggtattagctttgcgttcggttctcgtaaagacggaataaaaaaaccgtaatacctttgtgaagtaaaagtaaccaacccccatcattcaatccaatccaacctgaggtacacgtgatcgaatacgaagcgcgcacgatggcacgagaggcgcggcttcttccgcctcgcgcgattcgcaaccgtccgttcctgcctccttccatttaactgtggatccattcctgcctcacccctgcaaatctctgtgcgccttgcaggttggaagaaaaagacaagagatacgaagtggtctcgtttcatctcgtgcgctagaaatgctgagatgatgcccagtttttttaagaaagtttctcgtggaattatggtggtttgagctcacatcagccgcccctgttggaggaaatctaacgtccgaaccatatattacgaagtggatggattaggtgtgccatgtttagtttttcagataatgatgcgatgattagctagcagaattccagcaactaaacatcgtactacgtagaaattagtaattggcatacgcgcgcatttgtctcattgtggaggagtgagtgcttgaagaatctcacctgctggccgtatttggtacgaagccgctaagccatcgaaataaatcagtggaaaacgaaaaactcattgctagtcatccaagaagatggatcaaccaactatgcttaaacgtgcagacgattgttggaaagattcttcacccccacttactagtgttctgttttgtccgatcctgtgtatagaataaatgccaactattcttactcgtagctaaaaaacagagtacagtggttcaatgtgaagaaccgttcctggagtatatcccatttcgttttctcaccgcaccaaaaaccaagcaaagatttaggcatgtattgcttgccatcgcacgatacctgatagttgatcaatggattcactgttatctaaccatcatgaataagacctaagcagcgacttgatgtacgagtagttatcggagttcctctcgctggcattgaaagaaattgagacaggacgctggcagagagcgattggatcactgaaacctttttggatcagctgaatttcaatttgcaagagatagtaacatcgatacattaacaagttgctccataattcttaagaggttataccacttgaaacataacatatcttatgtttccatatttaggataaatgccatgtaagacacatgcatggctttcgatcacctggtgagttgcttgtgatattaataagtcctaaaagagacaacttccattctcaactcgcaagtaatctacattaccatgttacttggaggtgatctataatattaatagggtagaatggttggatatatattagagcactgagtctacctgtatataaatttataattgcttccaaatgacttataatcttgcccacagttattatgtaagaaattcagctactctctccgtcccaaaatataacaacttctagcattaaaaatttatcccaaaatgtaacagcttatccaccaatattctcttcacaaccaatcacaatccttcaccattcaatttcttcacttacctccacgtctcaaccaatcacaatattctcctattttattatatctactttcttaatagctatatcaaattataaaacttctaatattctgggacggaggcagtagcaaattcggtaaagtcatcatagttcacaaatattataaagattatgagcattttcaaaactcgcctatagctctgtactgttctattatattattgcatataaggtgaaaagttcacaaatttttcaacactcgcctatagctcttagactgtcatattgaacgggatagcaaactttggaccaactcactttgcatttgcctccatgcatctcctcattgccaacccataggaagcgcacctcttgttgccttgtcaatatcttgaatggattgttttggcggcttcaacactgtgaggacgtatgttgggatggcacttaggactgagttcaccataatctagcgtccccctgcatataagaacgatggattccatctcaagagacaacccttaatcttgtgttggacaagctgcagatgtatactttgtgcaaatggccaagggtgagccgtagtccaacaagttggtgggaaggtagccctcaccatagaggagttgcacaaaacgtcatcgagatcaatttcctgacatcgtatgggtgccaacaggccctttccgagattgacatgcaactctgttgcctcgcggaagtccctaagaatgccaataagattttcatagctccacttcattccttgctggagtgaggaaaacagccgcatcacccacatataagattttcggatttaaatgccaaagttgtagtatagtactaatataattatatttataggtagataaaaaaatatcggtattaaaaacaaagaaaacgactaaaagtaaatttacaggagacatggatccacactttgagagagtgggaaggggcaaataagcatttaccatttttcgatgtggcgttaaataatttgtcacttatatgtttatgatttgtaggtttatgtggtaaaatattacatctaaaagtgacaaataattaaatatctctgtcgatgaatggagtaaccacttcaggttcagtagttcagtgccgggactggttgatcgccacctgctcttcacttcagcagcagctgaaagttgttggcacaccacattacccgtcgccggctcgccgctaacgtgccgaccctattcactctagaaccccaaaaggcagacggctcaacgagagcgcgggcgcaagtggggctgaaaggggggtgtacgcgaacgccctcccttctttctgcagacgcccccaacattcggggcacatgcatgaacaacactctgattaggatggctcaacaaatgccacgcacttcatcatagagaaaagaagccacgccctccccacctcgttttcctcatttttatggcgtgcaggaactctcgcgatccgagtttttaaagtggccgaggcatcgggcgcagccggggtccccactaggccactcgagcagcggcacgaagatgaccgcttcgtccacttcaggtagcccacctggatgcagacccttcctgttgcatcctggagatagattggaatagagaagtctagagaataaaactagagattagtagtagatgttttgatgacatgtacctgagcaaacgaggtggtactctggatcttcagctaactgaacatctgtttgcagatccagaagaagatgatactactagtagcattttattcatcccagaatctgaaacctgagcatcagagtatctgagtatgcgtctttcagggtcacagaatcgaacctcgtgcagtgcaataccacccggagaacaaatttcattctggcaccagttgcaatttgtaaacaggatgtttgattagaacaacaaagtctcaacctttggttgcccttaacacaacgaaggctgattttaagacagcttacaacaggaggttagtcgtagtcactgaagccggcagtagtagcaaaatttcgtggttgcgatgctccctataagtctggtgccatcacaaccacgtttagccggcttctttgccctcttttctaccctgctgtcaaactaatgctatgcacgaagaattagctacagtgcacgtgtactatatacacctcctcctaagcgactctgtacgtactacactgtgtttctgggaatgggcagaagattgggtcggcatatcacctgggtttgttcaaatcaggaagcataattggtcaaccattcgagactctgcataaaaggattactgcacgttatatgccatggcacgctaaagatccgggtaatagtcaaattgctgcaaactgtgtacaacacttttcaccagaatcataatttgaggagaaaacaaaccattaggcattcaggcagatcatcattcttcgttctcatgtgagtctgcatttatgtgaagagcaagtggttagacatttgtattctttgcaaggatcagtatgttgtgaattggaataagcatgtgaagacctaggtgattcatggcatttgtcatctggctacgagataaaatgaaagcagcaacatacaaaactgagcaaaagttcagaatctttttccttaaggaagttctgaacgaatagcagactgcagatataagagaaatagcatagccagtgatggaagattaaagtatttacctccataaccaaatggcatgatgactcattgtttgtggcaaggcaagcaagggctaccactgcggctgccacagtggagggccagaaggagagatgtttgtggtccagaagtgagagcaaggccaagtacttcgccaggtcctcgactctgtcatctgcattcgcagccttcagatagaacctgcaaagttgaaccaaacaattgtaagtttcttattcattctgtccagctgacacagaaaatgaagcaaacacacaggcatagtaccagaggaaatgatgggttgttgtgacaaagcactggaagtcaaggacctcctgaaccagccactccatggcgacgacctcacttcggctgtaagtattgatccctactttgaaagctttttgaaggatgctgaaagagatcgtattattaggttcctgtagagtgttctaaagaaaaggtctatattgcacattgcccttgacagaaactaggcgcttgaaacaaatgcgcatccagaggcaaactcataagttcaaaagtgatacttcgtgcaaagtagacaggcaaagaagaatagttcctgggttcacttcacatgcttctgtgcagtaataagtggcacataaaacattcatttactagcaagttctcagggatacaaataaggtctactttcaaaaatgttgaagattcatatgagtttagtctttaaaacttaagggaaaacacagagaatatctcgcccaccagagcgctgatgtaatagctttattgtaacatcaaaaacagagaaataaaactatatcaaggagatctatgcaagtgataatttctcaaaatcgcatctctcccaataattgatagcttagttctttttttcttaaaaaacaatagctcaaggatgccaactggcgcggtaaattattttgagagatgcttgatcatagtcaacacaatcaagaaacttctggtgtgtttggttctcagccaatcaaaaccataccaatattttggtctgcctaaaattttgttagctttctttttgtcaccaaattttggcaacaccaatatttttccttggtagcaaactaaatactaaactaatcaatcttgccaaaaagtttgtcaacaaaccaaacaagtcctttgccaagattttggagtggctaaatcttgccattgccaaaaaattggtatggcccacaatggcttagaaccaaacaagcccttcatttctaaaatacccatcgtgtgaaacctttttgtagaacaatggtccaatggtctgagttctcacatgcagtgctcagtattgaaagtgataaatagctactagatgagatatgagttaccatcggatgttcctgttgttattaagttatttatagaacataattaaactcataaactcatgctaatgtctgttagaattaagttcaactttcagaaaaatcaaactatcaaagaatactaaggaatttgcagcattgcaattgagcactatcccatttaataatacatgctatattcaaatgagacgaactatttaggtgagtaccagacaagcagacaccaacaacttgcagaagtattcatactgaaactggtcatttaagggagccattaccaattatagggttgattctcttcaatgcgggttgccaaggtggtgcaggcgattcccagcaactgcaggttcctagagccctttacatatccacgtgtcaagaagcggtccatcagccctatccccatgaacacggtctctggctgcagcttcatcgcttgtgaatgctagcgatgcatagagaacaagtcattctttgcaagttatgtatgaactctatgtaagaacaaacatattctccacaaatgacagtacattattttcagaaaaatcaaattacaagtataaatgatcatatcacttaagtacttatcgctgagttgcccaaaaaaacttcaaacaaaaaacacacagcgatttcattttcaaaggctacctgaagtttcaatgcaaatataaactgatggaactagagttagaaaagattaaattcagatgatggtggatacacaaaaaaagggaatacactggcaatatgtttttctaacacttattgcatatataggtttagaagtaaaaagtgatgcagacatttctggaggccatatgccaatgcccaatgccatgggatttcagatggcaaatgactacagagcaactttcaggtgcgaaaataaacacctagaaaaatcctatgtatctcttttcttttcatacaagcatgccattacatccaaaaaaaatatgcaagcatgccaaaataagcacctagaaaatctttatcactgctctatagaacttgaatgcgatgacataaaagttaatgactagagttacattgaaatcactaggattaccaccacactgctggcagactaacacggggaatgctgcaaaatgtacaggcagctaactgtgtgataaacgaatcagcaaatgcaatgcgtatattggtatcagatagcttcccctacacaaaatatgcaagatcacaaccggatctgctacctcagcactcccacccagcacagcatttacactgcagagtagcatgttagtgcaaaatgcaagcaactactgttcttgcagaacacatcagtcagacagataagctgatagaatctagatcagtacagcactccgaaagtatacatgtgcattatcagcacaatacccgtgcaacaaacatctgcagctaccacacaacaaattgcgctcgagctagatgaattattggaccaaggcaaagtcatggtcgcagcatacgtgtacaatgcagagcatactgacctccatgatccagttcaccatgacaacgcgctgctccacgacggcgcggccgtagctgccgagcatggaggagtacacctcaatgtagtcgcgggctaccacccctcgccgctcgcgccgccggaaccgctcgtagctcacctcattgtccaagtcctcaaatctcttcccctgatacaataattcccatctgattacatcaaatgtcgcactgattcgggagagagcagccaaactccaacaaatttgagagaagctgtgtggaacctgcttacctctcccgcttgtagagcgacatccgtggcggtgggcgttttgggatgcgtgaaggggacgaactgctccgccaaggcgaggaacagggagaaggtgggggagggcacggcgttgtcgtcgtcggacgacgaggacgactcatgaagggggctaaacgagcaatcggtgcagatgcagggaccactgggcacctcctcttcatcatcgtcttcctcggtctcagacagcgtgaggtcctcgcgggctgagaagtaggcggtcgtctcggcgtcgttgccgagctgctcggggcaggcgaggtaggactcgaggacggaggcgaggcacgacgactcggagacctcgacctcggcggcgcgcggcctcgcgccaccgatgatctcggagcactcggaggcggcgggctgctcctcgtccacatcctggtaccgaggccgcttctccgggcgctgagctgcgtcgagggaggtggggcaggtggtgaaggtggcggagatgacctcgctgtggaagcaggaggaggccgaggtggacgactccgcgggtcgcttggctgccgccgccgccgccgccgcgatctgatcagggagcagaggaggagccgccgccgccgcgcctcgccgccggcggaagggatgggagcgcggcctcgtcggcaccgatgcaagcatggtaggaggcattggcgtgcggcgctgtgtgctttgtgtgtgaattgtgaatttgtgatgctacgggcctacggctatgttcgtttggcttgctagttatatagccgtgacttgaggcgtggagaggaagggggagaggagtgttcagcaaccttcggctgttcgccgcatcgcctgatcggtgaagtgttttttgaacttccaaaaatcctcaagccacgactgtgctgcgacgatgcacatgcgccgctcgcgctccattggatggcctgtgtactccagtccgtgtagattcgccggcgtatccctgtgggtcccagatgcatctggtgcacgagcgatccgccggaataacggccttgcctcccgtgtcccagcctcccaggcaaatcgaggcgtttgcttccagtggggaatgtcgggctggggccagcgcatatgcgggattggcggacggcggccaggttgtcaaaatgctatcctgaccctgattaattccttacccgaacaatctcgatcgaacgatccggttaacccagttgggatcggggaagaattacccaatcccaaccaggttgtctccaattgggtcactgcatactcggatcactacgtttttaaggaagtacagttgaagctcgattgtttgaatctgctggtattccggtggtatttcaagttacacatagctcctttgatttgtaggaaaaatgaaggaattttggaggatttcaatcctatgaaaaaaaaatcctatgaaggcatttgaaacaaaggattgaatcttatccaatcctttaaaattcctatggaatggataatcctatgcacattttggaggaaagttagcaataggtctatcctcttggaacatttcctctgagtctatctctctcatctgattcctgtgtttttcctgtgatccaatcaaatggccattcctgtgttttgcaatcctctattttacaattgtattcctgtcagaatcctgtgtttttcctattcctctgttttttcattcctacgattcaaagggcccttgaaacggcttggataaggtttggagcaaatagctcggtaaagaggaaatgaaagaaaaggaaagtgtatgcatgtagatgggaccctgatggactgattgatagtctgatacacacttctgaagaccgtcatttgccgcagacttcagaaacgtctcctctgaatctgaattctgaacagagtaccgaaaaccttggttcccttgtgcatcaccctggggaaacacaagagttcccgtaaaacaacattcactactaaagtcagtgaactaaaacacttgcatcaaaggatgcaagttggaacattctagctgtaaatcggtaacctgatcttgattagagttggccgctatacaacggaggtcgaagaactactacaagttacagtgtcagcatatgtgttctttaaaaatgtaaaacatttgattgatcaccacttaaacaaacatatctgtttgggagcatactaatgaggaacctgagaattccatcgcaatcatagttcacatgtcctgaagcatcccttggactggaggatctgaacagagttcagaaaaactacaggaaatgggcaagtaaatgaagtaactcatccacattttgctcacacaaatcactctgtgctgcaccctatccccaccaatctatttcagcgtaacaaaccctcaaagccttttcttgctgtaatcatgcagcacggaagcatttttcttgatttgaaatcaaccaagcatgatacttgtaggagggttcggatcacacattggttaatgtgacagcacttcagagcacctcctcagttctgatatttttggtgctagctcctcatcaccatattgctttagcaaatccatcaaacgatcagcacaagaagcctctatgagaatccccctctcagcaaccttcttagccaacgccaaggcctcaccaacatgcccttccacacacagcctaagcaacaaaccattgtagacatcagtgtcacagagcaccccgttctcttccatgactcctatccagtagcaagcatccaatagcctattcctattgcaaagctctctgaccataacactggccgcaagagggctcagccgcacccctttcttcatcatcctctgcacaagcccttcagcttcaccatccatcccaaccctccacaggcaaataagcagcacattgtagcattggtcgctcgacacactcccatcgctgaccacacgctccactacagcataagcgtctgcgaccatctcctctgaacagaatccgccgacgagcgttcgcacgaacacccggttgggcatcacccctcttcctgtcatcctatccagcaagctcagcgcctcccccatcctctttttcccacacaggcatttcaccaaacacgtatacgacaccacgttgggcacgcaccctgcacccaagctccaacccttcatctcttccaccagcctcagcgctgcatccacatccccgaaactgcacatcccgtcgagcaacgcggtgtacacggccacattggtcacgcacccaaactccggcattttctcgatcagctggcgggcaccgacgaagtcccccgcggttgccagcttatgcaccgaggtcacaaccagtgggacgctcggcgagacaccgcacgccgacatgataccgagaacggcacagacatctccgggagagccggccgagcggagggcggagcggaagcaagcagcatcgggggcgaggccgaaggagcgcatgtgccgcatgagagcgagggaggcgg

SEQ ID NO: 7367 - DNA, 23938 bp, Oryza sativa
tttaagtttttaacatgattttttttacaagttaagttaataagtcggtggttttttatgcctcaagtttaatggtgggtcctattaaaagtctcttcttattcatagctccacaatttttcttttccgcgaacgcctagctccacaattttcatggttcatgtattaattctctttatttaagccactctttgcatgcataatgtcacttctctgttagtagaaaaggagaacgaacatgagtgaaccagtttttgataatctttgatcatttcatgggaagtgaaaaaactacatttctattgtaaagccaccatattgcaaggctaattcgcaaacatttgcatggctaactcacgtgagcacccacgctttaatatttctacaaccatatatttccttttttttaaagtctatacaccgagaatttatatataaaaataagtatgttctattcggaatcgaacatttatacaccgaaaaattatatgtccgattccgattcggaatcaaagtttcttatataccgtatgctggagagattctcggttggtgtgtccattgttccagtgaaaaaaatggaaacgtgaatatatatatcgcgatgctctcaaaaatgcatatgaaatggttttcctttttagaatgggtatgaaacggcatctttagaacgtgtatgcatttaccccttgacatatagttggatagatttaatgcgaacgttaaaactctgtgggatccagttgtcatacagagggcaaatgtagagtgaaaaatgtccgctgtttagtttaacgtgttgcgtttctttccttctacagccaagtgccacctttgcctctagcttcataaaaacccagtcctctttggcacagtactatttgctcatgttcgtgaaaatcattgagctctgcaaggtgcaagctttctgctctcagccatcatgtttccctttggctccaaacccatcccgtcaagcaacaaggtaaggaaagagctaggatacgataaattcaatggagtacctccatttctttttgtttgacgttggttagttctttgactaatcaaggctgtaaaaaaaatagagggatcatatgctattttgtttcatagcacctttcttcaaaaaagatttcgtagtatatttgaaaacataatttcttcgtttttgcatatatcaatcttttgggattcttgtaatgttgtaaagcctggttttgaagaccatgaactcaactatagtgttttcagtcgttttttttaatttttgtagaaacggtatgcttaatttctaatatatgaacatgttgtttgaatgattggagattatgttcaatccgtttggattggcacgagaattacagatctctggatatccaagaaaattggatctactgtctttttatttagtcaagccctgaatggatggcaaataaattataaaggggtaatggagggcaaaagccagctgttcacaggaaaccaaaaccgtttgaatttttggcagttctcaaaccttgtctgtcatatatttcttcttttagttccacatatatatcttaggtttaatgataatagcaataacaagatgaaattgcttgcgaagttaagaaaaaataacacttgtttgtgtacttgccggtcgatctgagtgtcttatgtaatttttcagttttctttgtgggggtatggcttgcctattttcctgtcaatgtttaacttttaaaactatccttccaatcttaatgaattttggttagtctaatcctttggctgatccggccaaaataaaaagtatagcctaagctcaattgcctatttattttggtgccaaggaccccatcatttcgcttattgacggaataagcgagaaatgacatatttgtaaacagaaaataatttataaataaaacttttatgtatgtgttcttagtgatctaaaagcaaatactgaaaaataaactacgatgataaaaccccaaaattaacttaaaattttaggttgaaaattcaattttttacctataagcataagcataagccaaaagatattttttatgaaatcaaactatctggcactggcatacctgtcagtgtttcatgtcgagaaaataaaaatgacaacatagttgcagcagagttcatgatcctattatttgacactctatattctacttagtgttaacaaactatttgccgttatcttccccaaaggggggaaaaatccaatctatccaaatacaaactgactaatcaatcagcccatcagtttgtggtgcagcttaagggtaaggagaccagggcggagccggaggtttccagcgtcagcaaggcctcggggggcagcagcgagcacatcaacaagctgccaccgccggtgccggtgcaggaggaggaggaggcgccggaatggctggacgtgctgctgcggacgaaattctgggggcagtgcaagcagcactgggacgcgagccgcgcggaggtttgcatcttctgcctccgctgccgccaggtgctctgcccgcgctgcagccatgacgagcccggccaccggctgctcaaggtccgccgctacatgtaccgctccgtcgttctcgccagggacttgcagggcctcaacgttgacgtgtccagggtacaggtaagtaattaagcgcgtgttggccgtgttttcttcctgtctagtcttcatcaagccaaactccattttaaaacatgtaacattgaaagtactcctaaacatcttatatttaaaaggaaaaaaaaagtacaaattaccccacaaacccgaaatccatatatttttcactctcaactttcgttaccatatgaccccccagcagctttgcaaagcggttttggtctacgtggcagtccaatcagcaaattttttattaaaaaacgatggggcccacctgtcagatctttccagtctatctctttccctctcacacacctctctctctcaaatgtcggcggctgcgacttaagcactgacggcagcggacgacccctccgtcgcctcgacgagctgcgtggcggtggctgcaggcgcttcctccgccgtccgagctccgcccgccgccatcctcggctcgcttccgccgccccctcctcctgccgccccgagctccgtcgccctttcctcccgccaccccttcggccccgagcttcgcccgccatcatcccgagtgcccccttcgccactcctcctcacgccgccatcccgagctccgcccgccgccgtccccttttccgcccactccacccgtcgtcgttccgacctcttcccatcgccgtcccaagcttcgtggccccttcgtcgccccgagctccgcctgccgtcctcgaggtgagggagggagaagagagtggattttggagagagatagagaggtaagggaaaaagagagggtgggagactgacaggaggggcccgctaatttttaaaaaaatgaattcatgtctggactttcacgtagaccaaaaccgtttgcaaagctgctcgggggttttttcatccggtattgatagttgagggttagttgagggtgaaaaacatccttgtttcgtgtttagggggtaattcatactcacccaatattttagggggtaatttgtactttttcatatttaaaacgacgtgactaaacaacgtatagtcgctgtattgtctaaacgcagcccactttttttcctaaatccgtacatatacggatgtgcgtctctttccgaaaacggcactctgctcctttttatgctgggctatctcacaactcaaacgacagatagtcattaccatgtctccaacaattaatgcttaaatatacggctaattcttttagtggtagatgatataccgtcgacagcgaaacgtctatgttacttgataaatcttaagatatattagcctgatctttgaaggtattcataggggatggcatgtatgtattcatggggataaatatgcatcaagttttgaaaaaaaaaaaaaagctcccgtgattgttgaaagcctgaagtactgaaactcaatatgctcacaaattttactcgtgattgcagacatacattgtcaatggccaaaagggcgtgcacctgaggcccatgaggaggtccccgcaattcaagcctcacgtagagacacctcgctgcttatcttgcttctgctggctccgcagtgctcccaacatattttgttctctcagctgcaaggttacattctcttaactattgttctcaattacccccctttctaattgtttgcaaattaaaagcatcgaaattaaaagggtttaaaatctgatttttttttctctttcttaattaccaggttggtgtagatatatctcaggatgatttctcaggacctgaagctgagcgtaggcataagcagactctgggaattgtggtggagtcatctcctcaacagagcatcccacaaccatttgatgcctcacctgtgagaaatgaagatgccaccatggttgaagctgagtgtggtcaagttcagacgaatgcgacggagtcggagtcgtcagcggtaggagatgcagatgaggttatacctaaagttactaagttcaatgttgatatccactctttgaggaggcgagttcgcaagcaggcggcaccacagagggcccccttcttctgaatttttgatatctcgaggaaggttgtgccatggttaagttcgaaagtagtaataaaatctactagctatgacagctaggtgagacatttctgctgcgacatgtttttttcagggtgaacctgctttgctgcacgctgtgatttttttttcattagctactggtttgaatgatgtttttgtagtacccatttggaggtgctaagctctgtaataatactgtaggatcgaatcacaagaactaagccaaccagagaagggtgaatggttggtatacccaaaaaccaaaaacttttagcggaaataaaagttaccctcgaaatcgacggagattggtctgaccgaagttgccttgccggtctgaccgctcagatgccgtcggtctgaccggtatagattaaccggtctgaccgccgaagctgctcgccgcgcctgttgccgccaccggtctgaccaccgtgctcccgccggtctgactgccgtagtgccgccggtctgaccgccggtgagttgccggttagaccgccaaaacccggtgaaacacaaatcgaagaactcttaaagtagatgacgtctttattacttctctctgtgtttacaaagtgcaccaacagcactccttacaaaaatttcgattaaactcgaaaccctaactcaaaactcaactcaattgctctctaaagcgataccgggaagcctcacgctccccctctatttatacatgaggtaggcagcctaaagccacgaaccaaactcatacgaggagtcctaaacaccttaggaaaccctctagtacaagaaagaaactttacataaccaatcgtaccaaatttggactccttccaaatttgactccacatcccatacgcacacaatacctccatcgtatgccatatggaatctccatcaaccacgtgcatcaattctagcctaagtatcccgcatgatctctgaccaccacggacgtcgtcttatccccaagtcgactcccggtccatcaccgcaaatactctcccgaaacatcgagtcacctacacatggaacaaacaaagaaaccatattccgagaccaagctatctccaacttgactcattagcagcaaacaatagtattacatacgtatatagtatccatctggaagttataatcatgaaataaactcggatatccaaataaacaacccgaaaccgaaaccgacacagtgtcggccggtcagaccgcgggctggccggtccgaccgctcgatcaccgccggtctgaccggcaacacctgcccagtctgaccggtccacataaaatgataacctgtagattcacctgtgaaatccaatcatctccaaaaccacttcatgaataaattccaaataacaaaaccaatcatctccgatgcataattgttcatcacagaataataataaaaacacttttgattttacaaatactagcatctcagcgatacctgggactgctttaatttgcactctgctgtagacgtttcttatttctcggtattttctaaaagtttcctatttatcattcttccatttcactaaaatatgaaaattcttctttgtttatcactcctcgtgccactgggatgtgggtctcaataccacgtgtcaatgaggcaatgagcataaaccaggaactggaaacttttacagtgccgaacaaggaaatgctattgctagagtgagatgtgttttgcttttgctaagcgagaggttaggagtcatttttggagctactaactgctacagcttataaaaaaattattttagttacagctgttagaaactctcaaacaatatatatttactctttcatgggtagaatgtactggcggttcttaaacttgtacaggtgtgtcatttaggtccataaactctcaaaatgcatattcaagtctaagaactcatcatagtgtgttatctaggtctcaaatcgccacaaccccttcaggatcctacgtggcgttgatgtaatatgccatacatacatgacgtggcattattttaactgacaaataggacacatttaaatttttttcctttttttcttctcttttttcccctttcttctcctttctctcacccgtgcagaagaaaggaaacaaaagaagaatgagaagaaaacgaaaaagaaaaagaaaagaagaaaaaaaaagaaaatgacatgtcacgtccatatggcattgccacatcagcgccacataggatcgcagaggggatgtgtcaatttgggacctaaatgatacactttgacaagttctgggacctgaatatgtattttgagagtttaggggcttatatgacacaattctataagtttaaggaccgccaatgcactttactctattttgatttagattatgacaatatgtagttgtagcatcgaaaaatgaagtaagttagaagctggaaaatttaatattttcatattagttttatatgaaaactttcgcctgagttagttcaaagtaaaactttgaaaaaaaagcttagcccaaagtatacattactctttgattaatcatacaattcgttgcgttttctgcgccggaatacaacaccttcgaactaagtactaaggccctatttagttccagaggtaaaaagttttgacgtgtcacatcggatataaggacacacatttaaagtattaaatatagactaataacaaaacaaattatagattgcgcctgtaactgcgagacgaacttattaagcctaattattccgtcattagcaaatgtttattgtagcacattatcaaatcatagagcaattaggcttaaaagattcgtctcgcaatatgtgtaattagtactccatacatgtgtccaaacattcgatattacagagccaaaagtttttacgtgggatctaaacatggcctagtacttggaaatgaacatttcaaaacgggaagtcgctccaaatgatattcccgtaatattaaccgccaggaggggccaaagcgcaaaaactgagaactggggagctcaaaacactcctaaaaccctagcctaccggagcgagcgccgacgccgagacgccgagagcccaaggccggctagtcggagagtgcggccgcgtgcgggtggctgctgcgctgcgcgaactcccccgccgccaaagatgttctccccggcgatcaagaagccccacctgctccaccgcagggacaaggaggaggcgtccccctcaccccctcccgctcccgcgcacacgcccgcgcctcgtggatttgccgtccacgaccgccccgccaccggcaccccggcgccgtggacctcctcctccctgctcgccaggttccgtttattccccatttttctttgattttatcagaatcaccgcatttcatcgtattttcgtccccagttgaggcgccggaagcgagcgattcaaatgagctcgtttgccctttttgcagtagtctagtgcgttaactacaggtcattgtgctgcgatagttttataaactttttattttgaaactttttgcaaactagcaggatttcaacatcaacacgaacagacaggacaggggattctggccagatccaaccggtgcatgtatccgaatttccccaaatagttcgaaatgctcaagccaaccttctgcaaaagagtttttccggtaactattcctgtttgatggtcctgtgctagtttttcctggttattagtttgcttgtaccatactgaacagtagatgcttgttaaatacatccttgtaggcaagaacatgcttgctggtggcattgataaagaaacatcccttgcatggatgttatgtggaaatgagctttttatctggagttacctggcttctgttgcaaaagactgtcttgtacttgaggtcccttcttctcttatggggaacaaagaagaaaaatctctatgtggtaatcagtgggcagtttgcatagtgagatggggtagtagtggtgcatcaacacggagcagtggagatatattgcatcgaagaagttcgactggttttatcctgtgcaacaaaagaacacaagctatagcttattggtctgatatctatgctgaaagcagtaagagttcagttcttgatttaattggatatggtgatacatcttcaggtgatggcacatctggaaactgcaggattaattctcttattgcagtggcagttccaggaggtattaatgaatgcattgtgattgcttctcagccaacaggcacattatggatgttctggtgttcaccagctgcagttcgtcgaagagaaattcataagggtacattaggagtttataatgctgatcattctcagaaaaatagtggtggaaggtccttggcttggctaccaagtaaagcatcatctaaggctgctgaacggacgttctttttattgactagtcatgagctgcaatgctggagcatctcattcgggcatgatatcaactgcaaaaaaatagggtctcaggaaattgttggtagtgatggtgatatgggaataaagaaagacatagctggacagaaaaacatatggcttttggacatgcagatagatgatcatgggaaagaaattatcattcttgttgctaccttctgcaaagatcgggtgagtgggtcgaactacactcagtattctcttctgacgatgctgtacagacctaaccaaaagttttcatctgaagataatgtgattaaaactgaaaggtttttggagaaaaaagctccttctcaggtgataatccctaaggctagagtagaggatgaagagttcttgttttctatgaggctaaaaactggtggtaagccttctggttctgtaatcatactgtcaggtgatggaacagcaacaatagccatatactggagaggttcaacccgtctctatcaatttgatctgccttgggatgctggaaaggttctcgatgcttcagttatcccatcttccgaggacagagatgaaggagcttgggttgttcttacagaaaaggcaggagtgtgggcaattcctgagaaagctgtgttagttggtggggttgagccaccagagcggagcttgtcaagaaaaggaagttgcaatgaagcagttgctgaagagaaaagaagaaatcaggcattcaatgctagtgttgtacccagaagagctagttctgaggcttggagtgctggagagaggcaaagaccagcattaactggtatagctcagcaggctgtggttgatgaggagtctgaaatgttattaaaccggttatttcatgattttgttttgtccggtacagttcatgaagcacttcaaaagcttagagcagcaggcgcatttgacaaagagggtgagatgaacatatttgttcgaataagcaaatccatcgtaaacactctatctaagcattggacaacaactagagaagctgaatttcttgcttcaacaattgtttcatccctaactgagaagcagcaaaaacacaagaaattccttcagtttcttgtcttgtctaagtgccatgaggaactctcttcaaagcaaagtatggattttcttttgtgtcattatttatattcattgatttattattttaggcatatatcatcctagctatgatattaatcgaacacattggttctttgttattcaaaatagcataatgaatgctgatgacaattttgatggtattaaaactataggagctgtctggtaaaaaagaagaagaaaatctagatatgctgctgtaaatcatgaaaaatacaaacttcttagctgattttaaagccgtatacagttgtagaactcttcttaccttcatttctgtatacatgattgttgaaactggtgactgagcatgtaactctattggaatctttacctagcgttatatagggatgctaattttggcatgcctgatgggacacggacatatattatgcactcttagaacagcttgcacctttatttctgctaaaagatggtactgttactaacagtacagtatgagctgtaatattgacaaataaccatacaggttagccacaatttttttcaaaaaataactgccagtgcatcattttgcgtgacaacttctgttggaaaagaagtaatttgattgtcttgtaggaactgcgatgctaactgtcatggagcatggagaaaagctctctggaatgatccagctcagagaattacaaaatgctcttagccatcaacgctcaagcatacatttatcacctcagtcaaaaaaccaaacaactggtgcattgtggaaccttattcaattggttggtgagcaatctcgaagaaacactgttctcttaatggaccgtgataatgctgaagtgttctacagcagagtttcagatatagaagatctatttaattgcatatctcatcagcttcaatacattataaccggagaagaaaacccttctgttcagatgcaacgtgcacttgagttatcaaatgcttgcatgaccctagttcaggcagcattgcgctacagagaggagcacaaggactggtatccttctcctgaaggactgataacatggaacagccagcctgttgtacgatctggaatctggcgagtagcatcctttgccatggagcttttgagagaaccaggggctgcggacatgtcaatgaagtcaaacctatggtctcagttggaacgactcacagatatcctactggatgcatatattgggttgttaactgctaaattcgagcgtggggatgagcatggtgtgctaatccaagaatactgtgacagaagagatgaacttcttgggtccctctatgacctcgcaaaacaaattgtagatgcaaaatatcaggtttggtttaaattaaaatcattgtttgctcaatacttttccttactacagtaaggcgctttaccttttgcaatttcacattgtccagctttttacccgttctgtcatatcaatgtagtatcattcattatattgcccatcattccttgagattttgtggttacatagtaaggcatagtttatttcagcaatcatgtgctgttctacccaaattagtggattgctttatgtcagacacatatgcaattatgtatgcaacagtaaccaaggaacccttttttgtcattattttggtagtcacccattcagtaccgaatctgtgttctccaattccatcctctctctctctctctctctttttctttcttttttttttcatttgttgcttggttggttctctttggttgcttccttatagtgacttagttcactgtatggggtatttactacagtctatatggttattgactttagttattctccgatcttagcacaaatattattgggcagctgccataaatgtatgttcgtggcattttagcatttacatacttgaaacaatactgatgttctagctttggttggatggtgtttagccggagttgtggcttagagtgcctgttttatgctgtaaagtaatgttcatcgttgtaacaatagcggttgtacagctcttagcctccatggtagctgtatttgttgttctagtttgaacctcttctcaatcttaataaacttcggccgcgtatcttacgctggcccggcgaaaagtttctgtaagggtgatctcaaaattcaaattataaggtaacattaaaaagttatttttggatgactggcaattttttaattaaggaggcatattttctggattgtccactggtcaagtattctactgttttcagttcttgacatcatatttacatgaaggcatgtagctgtgtagcactgctgttgaatttgatactgttattttttgtactctttatcttaatgtggaacaactaatatttgtattatgcatatattttaggagacgacagaagtcactgacaatctggaactgaaagaatctatattcagagaagtcacttctccaattttggcaacagctaaacggcatgaagggtaccaaacattgtggcagatttgctatgatctcagtgatacaggccttcttcgcagtcttatggtataatcacaataccatatccgcaatttatcccatttaatctttctagggggtacagtgttgactatgttctgcaggcgataacatgccatgtgttattgcaatcaaattgttctttctaccaagttttattaagggacatggttctaatgttgaacttgtgttgcagcatgatagtgtaggacctcacgggggattcagtttctttgttttcaaacaactagtcaacaggcgtcaacatgctaagctattaagattaggtgaagaattcccggaagagctagccaattttctgaaagagcgggatgatcttctgtggcttcatgagatatgcttaaatcggttctcttctgcttcgaagactcttcatactctcgtgagtcctgaggaagatgctaaccttacaagcaacaggaaatcactgtcctttgttgaaagaagacgctttctctatctctccaaaattgcagcagcagcaggttagctgtttcttctcttttacttcatggtatacctgaacctgattaccttacgctgtgcactgccctgaaacaacaatttgttgaggttgcactgtgttaactgttgtggttgataaggaagttgtcattctccatatatcatgctggctctgtgcaaaattggctccaaacaattttttgaaagaaaattctgactatttgatgatggataacttgtatcgaatgctgcgtagcttgattttaaatcagttcatatgagctgtgaacataagctatagttcactttgcagttctttttctgtgcaaaaggacaggcaaacaatgctacttgccatgcttctcgccaagaggctcagtctttttcatggttcaaagaattaattatcctttgaattgctgttggcagtgcatatgtctcaaagtcatgaacattcaatttgatgggggcacctacacctaggtcctgaaatcccgaattccggaacatagttcctgcaccattcttttgcactaattcttgtttactttaacatagttattgtttttttcttatttcttcccttggataaatgcattcctgatatattgcaattttaacaagcaggtaaggatgttgattatgaagtgaaggttgcccatatagatgcagatatccgaattctaaatctgcaggtttgtcatatttcatgttgtacatttatttttctagtcatgatatttgctttcaaacttttagtgtgatgttatgttctttcatatttgccttcacatgtgcatcactttggtagggcaagtgaacccaaatctacgtatcgatgatgaaatctacatttgtgttctctcatgacttcatatgttccataagaccctgttcttttgtacattcatccatcattccattccttgaaaaagacattatcaaaaccagcacactagataggtgtttaactgtccaatgtaacagcctgaccatatttacaacttttacataattgtataattctgtcttatttagctttacgaaagtgttcaagcagtaaaaagaaggaaaataacccatgcaagatttgcatttaaagatgcattgtcttttagtatcaaataagtaggaatgaacagctaaataaactaagttctacctttttctctttcttctctttacaggaagagattgttcagcatgacccagagtatgcaccagataaatatactaccaagccatttcgtccattggaactgatcgagatgtgcctgaagggagatcgagagctctctcttaaagcttttgaagtatttgcttggacgagggcctcgttccggagctccaacaaaggccttctagaggcttgctggatgaatgcagccgaccaggacgactgggttagccttcaagaggaatcttcaggaggttggagcgatgaagtcatccaagaatctcttcagggcactgtcctgttcaatgcctccaggctgtgttatagcccagacgccgtggtgtatgacggttcgtttgaggacgtgctgcctgtgaagaaagaagacgtgcatctgagaggcttggagggcagatgtctctcagtggaggaagtgctgatgcagcacaaggatttccctgatgcgggtaaattgatgatgaccgcggtgataatgggcaaggagctaccttatactgtttccacagctgaacctgttgacatggactcttgatactgtcacattctgtcagggagaaagacctgcaggttgggacctccaaatctgaaatcagagtcaattttcttttctttgcagcacggaatgtgtgcagttccagatgtattcatattgcgggcgaaactatttgtagagactgcaagattttgtcagttcgtgcccttttttagcatgagctgtggcttgaaacgagtttttctcccccgatggaacaaagcaagctgatgctgtatcttaaaattttcttattagtaggaaatgcaaaatgcattcttttcttagtaatcaaggtttttcgtttttggtggaggaaatcaaacttttgatagtgaagagtttaggggacgagaggcccccatcgtctgctccatatagaatcagccgttaccaaaatttaaatttttaaatttgattatttgaaactttaaacttgattttgaagtttttttaatcaaagtttactcagaattggcatttaaatcctaagagcacacatataaaagttttatttataaattattacttttttaatacattgtacggcgtattatcagcgtatggctaaaaacggggaccagagattcgtagtttagtggaggagagtttaggacgagcgaaattgtcggcttgatgatgaaatagtgcacatgcgcatccttgtttgggcttccgtggccttcaattcaagtgcgggccatgtatttttgtgggctttcaagttgggccagccttgcagccaacacagctacacggcacggccagccggcacgcgacccgcgacccactcccctctcaccgagatctcagacgagcaaccactcctggcggagggaggaggaaagggggaggagatcgccgactcgacggcgttgagcgcggtgggcgcggcggcgcggagggcatcaggatggcggcggcgctcgctccgggggtgtcccggaagctgaagaaggtgctggagacgcggacggacaacccggatctgctcgcctcgctgggcgcgctctccaccttctacgtgcagaacaccccgcaggcgcgccgcaacctcaagtcctccgtcgagcagcgcggcctcaccatcaaccgccatttcctcgacgcctccctccctgcccacaaggtttgcgctcgctacgctactggcgcgttgctacccaccgcatcgtgagccagtcgtttttggtttgtgagtgattgtaaatttgtaatttctagtcgttttggtttgtgagtgattgcaatttctgtttcaggcgttggatcgcgtcgagggggaggtgcacgcgctcaacgattcctggaagaagtgagtgtaccatccattccgcgctttcattttgttcctttttcctgtttgcctgtgtggaattgtactataatctcagtccaagactttagattcggctaagctttccccgtaaaaagaagtcaaagcttaattgtatgtagatgtaggaacggttggtgtttggatgtaaaatctggtattagcatcttgttatggatcctaaacaatatttgactcgcatgggtgctgaaatgtatttgcagaaggtttttactttctaccatgagccaagctgttaggttggtttagtttggatgatactattataaccagctgctctactacgtggaatttacattttttgttaacatagtttgacacttgctgcctacttgcctagtactcaaaacaattcaagtgtctagccactaggacatcttcaaaaaagaaactgcaaaatctcttacataattggttatattgttacccaaagttggtcctaaagtagttgtgttttcctcttattatgcgcaatgctcgacatggttactttttctactagtgctgattttattctctttcattgtgttaggattgaggaagcattgggcagttgtagtgcaagtacgggggatatcatcagtacaacggagaggttgcaacaagaacttgaggttatcactcagcgccaggaaattgtgtcatgcttcctgagggattaccaactttcaaatgaagaggtaataccccctaatacaatagaatcaatcaaacaaatgaatcaatgatttggttgccaaactgtgatgtcttattcattttttagtgcatgcaacctcgacttttatgtccatcatatttatctattgttcttctattaatagatacatgcactccgggacgaagaaatagatgagaaattcttcaaggcattgttgcatgtccaagaaatacattcaaactgcaaggttctgctgcgaacacaccaccaggtacaggtgctttatccttgaattttgtaaacttaggtaacagatcataaaaactttgttgtttatcttactatgtacattcctgtaacttaggtaacagatcataacattttagtgcatgttatatcctcagaccttcaacccaagcaggaaagttggattttcagctgccagtaaaaacattcatgagtataccaagattatggaatgtttcccctaaaaaaaagattatggaatgttccacaactattttagttgataggatatttcagttacatttttttttttagcttggaatgttccacaattatggatttatattaacccagtttattgataagaattgagcatgctcaaactatgtgagatcaccctaaactataccaagaaagtagtgtttttttttggctacgattataccaaaaaaataaagccaccatccttatatttcatctctgcccagataaagatgctttggcatgcaacgtgttgcttgtactattaatggctgattttaagcaagagaaagtagtgtttacttcgatatcttgttttctctatatttgttcagcgtgctggtttggaacttatggatatgatgtctgtttaccaagaaggagcttacgaaaggttatgcaggtattggctgtccttctatagtaatcttctctccctctccctccctcccctcgcctctctctctctctctctctctctctctctctctctctcgtgtcatttcttttacttaccttgtatctcagtgttcattccacaatactccctccattcctaaatgatcgtcgcattaccaaaaataaaagaaattcaatttgatcgtcctatttcgttaggaagcagcagaaatcacgggcagacgataacggtgcttcgtattacacagcactgcatgcatgcattggctctgcgagagttaagttgggagctgctgcatgcgtggaattaatgcgttacagctgattggctggttcatgcggcatgcaaaattgatggagcgacatgcatggatacgaagcgtttgtatgttgatcgatgcggatagtaactgctccttggtcttgctgcttaggtgaaatacgacgatcaaattggaacggggggagtagcatttagaatttctattcactagcttttattgccgatgcctctattggctagttcattagtttttgatctattctcttaattatgtaccaaagcatgaatgtctaatttagttttcatgaagttcaaccactccttattttgttactaggtacaactgaggaattaggctgtgttcggatatggggagttgggaactaaactccccgcacggaaaatggagcggtccattatcgcgtgattaattaagtatttgctttttttttttcaaaaatggatcaatatgatttttttaagcaagttttgtatagaaactttttgcaaaaaacacatcgtttagtagtttgaaaaacgtgcgcgcggaaaaagagaggggtgagttgggaactctgggttccgaacacacccttagttatcttgataagaactatagaaccttcagattgactaatctgttatttcattttgctctttataacatgttcgcttgacatttgatgttcaagtggtgtaattcatcttgctttcttttcaggtgggttcaagttgaatgtaaaagattaggtgatactgacaaccctgaagtaagtgaacttctaaagaaggctgttcgatgcctgaaggaaagacctgttttatttaagtactgcgcagaagaggtatgctatattgtaccctttttgaatactaagtttaccttgaagatagtaaagttgccacaatttacatgttatgatgagtgatctgcatcgacaggttgccaatatgagacataatgccttgttcagacggtttataagtgctcttactagaggtggaccgggagggctcccaagaccaatagaagtgcatgctcatgatcctcttcgttatgttggcgatatgctggggtggctacatcaggtattttcttttgtccatccttggtcctagtgtaggaactagtaaaggatgagtgacttcggttctctttttgcccttccaaatcgtgtgcatttacaatacaccttgcatctgtgcctttatgatattgctttggacgtactaaattttcattctctaatttctgaaggcactggcatctgagggctctatagttctattgcttaatccatctgatataactgacatgaatagttatttttctcccaaataacaagcatatacatcatgcatgtgtttctataagacatttctttaccatcccttaattttaaatccttcatttgtgtaggctctggcatctgaaagagagcttatagttgttttgcttgatccggatgcgatgactgacagtggtccaactactcgtcgttattctgtccgagaaggtgatccctccaaaggagagcatgatataacttttgttcttgatagaatttttgaaggggcttgtcgaccatttaaagttcgagttgaacaagttctgcagtcacaaccaagcctgataatttcttacaaacttagcaataccttggaattctatggttacacagtaagtctgacatactattttttgccatttagaatatccatgagctgttctgtttacaaataatgtttttctgttctagatatcagatctgttgggtggagacgctgcactgtgcaatacaatatggtcacttagagatgcaacgcagcagacattctttaatatccttaagagccgaggagaaaagttattgcgatatcctccacttgttgctgttgacctctctccccctccagcagtgagagaaggaatttcattgttgcttgaactcataaatacctacaatagcatgatggttcctgcctctggaaaaaggccaaatttcgatcctgtcatttctgccatactggatcctataattcaggtgagtttttgtgtatttgatttgctttgtagtctgtgtagatatctgaaagttttggttggcatgcgacttagcttgcccacagtgcaaatttgcatagttatcccagctagtatcgatcatctgctaatcacgctgcaatttcttttccaatgaaagggattgcatgctatttttagttttgtgtgtgtagatgtataatattaagtaaatgttaaactaataaacatatatagtatcatgtttgtactcctacacatttggcattgccatatatgatctctcacaattagctccaatgtggtaaactcttgagcttctccaattcttttatgcggttttgtgggacgtgtgttactatgtccaatgattataggagttccatacttgcatcgttaggccattgactaaaaaccgatgtgctcttgtgctattatgtctggtgcaaccagttactagtttactgcagctggtgcaaattttatattttacctagagacagctcttttcttttactttttggatatgttaataattattcttcttgtcttggaatattgggatgttatctacagtatgactttgttgcgatatactgttactgatattcccgacttgctgtacagatgtgtgagcaagctgcagaggcacaaaagtcaaaagggacaattgcacggcgtggtagaactagttctgatcccactggaaataatagagattcaatctcagttgatgctattttatctaagaattcatcaacatcctttctggttagtagcatataattcttttgtttccgctgtatagaatacctggagtatatggaatagtactcacctaattcactggctactgagcacatgttgtaggtaattttaagtttgtaattgtaaaatgtggataatttggaccaagaaaatgtggctcatgtgggactacttaaaaaaggtcaatgtggtttgggattgagatagtaaaactgacaaccttttttctcacctcatttctaatttctaattctgaactaggaacttgctattattgtcgatttctaattcatattttgatgtcattattagatatgggaaacactcatggtttgttattatataaattgctcttacacatgccaaattacatgcaatctgaatttttattatctaacgctggctttatggagggaattgcatgtacataatttaacgattggcatcaccgtctttgagtctcaaccttttgtatttgaaatctgattgatgaaagcatgatttctgatggtggtctaaaacccatttgctttcgaacatttcagctggatagactttgcttctgctgtgccgatcgtttttggacatttgcttatcattttcctcatatatgtcataacatgtgcagagtggtgaatcttcatccaaaatctacctcatcaactgtttgtcagctattcaggaaccattgatgggccaagatgttgctacaagttatattaacaacctgcggtctatgattgaaacacatttgcacaccctagtagataaagaagctgatagcattcttaggaaatgtggactatcaaacaagatgccatacataaaggactatagctctactggcagcaaggatgacgcacgacctttggctgatattgtggagacatcaccgcaaatgttggtggaatgcttgaaggcattctatggtctagtgactggaacagaaggttccttgcctgaatttgagcagctgcaggtaccaaggttgcgttctgatgcatgctatggtttggctagagctctggcggaagcttatgaactgatctataaggcagtggtggatccaaagaattgctaccctgacccaaggtctttagtaaaacactcgcctgagcagataaggactatactagaaatctgaggtctattcacaatctcttcatacatgttaatgagagaacccttttatagagtcaatgtcaatgtggggtatatttgctacgaaaaggtgtgatttcaaattcttttactgaagttgtttacaccttcactgaactcttgtatcatagcgtttctcttgtattaatgttttttctatctttgtaaaagtaaaactgcttgaatcgtagtgtttctcctgtatgtctttgcaccttttgcaagtggatatttagttataaatccaccttttttaatgcatgagtaccctcttaaaaaatggatgcatatgatttgctttttctagaaaactacatccaacgtgccaaccaataaagtcaaactggcagttcggttgctcatatgcagattggtaagtttctgtcttttctcgatccatttgcataaccttctctctttttaagttgcagagcatccaaattaactgtatcctctgtattttcagtactagtgcacacttataattgatcttgtttcagctttccttgtggccccttatagttctatccaagctcctttttgcgctgatttggcgcatggaccagctggagtggttgactgcagcaaggaaagaaaatctgaagtttggcaggttggaaataagtgctgctaatcaggggcaacctgacaagttacacaggtttggttgaatattaggccccgtttagttcgcgaaatgaaaatttttgggtgtcacatcggacgtttgaccggatgtcggaaggggttttcggacacgaatgaaaaaactaatttcataactcgcatggaaaccgcgagacgaatcttttgagcctaattaatccgtcattagcacatgtgggttactatagcatttatggctaatcatggactaattaggctcaagcaattagtttttgtttttatctatatttaatgcttcatgcatatgtttaaagatttgatgtgatgtttttgggaaaaactttttggaaactaaacagggccttactccattcatttttatgacaatcattttggtgtccttaatttccacgagcacgtcttgtttgtcctgttatgacattttctcctttcagaaatcagaactgaaattgggttaggcatgtctcctaattttaactgactggatactttgcggtacatcaacagcaacttcgttgaaaggattcagtaaaccttcaagtttcctctagtacaagttaattccacatcttccctatgaacaaaaacgtattaagtagagacctacaaaaagttggtttgctccattgtcttgatggaatagttaatgtaatgccggtgtcctttactgtgctagcgtactactaactactaatactagtacaactaaattagtttcatctaatctttaaacgttggtctggttgagtccttaattcaccatttcacctattaactccgtatcgacattatatgtgcatggacctcgaacttgaacaaattattctacgccgtatttaccaagaagaaaaccgtccaaccgctccatgttcgtttgtgtcctccgtttggtcagaccgtaggtttgtcgttcagatttggattagttcgagggtttcgtgcgctggcaggcggaccgggcaagtggcgcaacgtgttttaagggtggaactggaacgggtgtgaggcgaggcgagagtcgccggtccacggccacggcggcagggaagaccggaagaacgctgagccgtgacagcgacgggagggaagtgggaacgggtgtccatgagccggcagaagacaacggccccgcattccttgccgtgacgtgacatggccacggccaaagagtaacaggatgaagcgatggataatttagtgatcggtttccatggcagcgttgcacggttg

SEQ ID NO: 7368 - DNA, 10938 bp, Oryza sativa
  unsure (1)..(10938): unsure at all n locations
atgcgctcttcaccgacaactacgcgcccaccgcgcagaacgccctggtcgtgagctcgtgcgacccgcaggccgccgcccgcctcagcaactgcagcatcccacccgaggcctacctcgagaagagctgcaattccatccgctgcgtcttaccttctaccaaagccaacgtcgacgggacaaacgtcacagaccctttcttgaatagaagcgagatgcggcggctcggctcggactgccgcgggctcgtgtcggcgtcgatctattcgaacacggcggggccggcgctgcagctgaccgcgctggagctggattggtgggtgcaggggcggtgcggctgctcgagccacgccatctgcgacgggttcaccccgccgtctacgcagaaggaggcgttccggtgcgagtgccaggaggggttcgagggcgacggctacaccgccggcgccggttgccggagaggtcagtactcagtacattggctggatagtatccactgattagcttcattgctctacttttttcgtccattgatttggtcagtcaaatcctgcgagctaactactctagccactcgaccataaccattaatcgtccggagtagacagtacacagtagagtaagcatatcttgtgcttcgttgactatacacctagctaaccagcagcgcaagaccaaggattggaccaatgaccaatcagcgttaaagatgaacgattaacttgatcatcacttgattgaacagcgaaaggctctgcttaccggcctttcaaaggaaaaaaaaaaagcctctgttactggtaggtgcgagagcgttcgctataacattccttgcacaactgcaagtgctgtcaactgggttctcataccgtcacacatgtaaagcgactggcagttcaagctaattatttttgggtggttcgctgatgtcaaaccgtaatgtactacttgcgcaagtgacataagagtatattcggttatttattagaggatatgtaatcgatttaagtactatcagaacttttgttttctacgacaagttgcttgaaatgtagtgccattgatatattagatattttgaagctctcgaagaaatatttttctgacatgttggctttgatgcttgcctgcctgcctgcctatgtgctgaggaatatttgtttctttcttttgcctgacatcctatatagatggtattgagtcccataattattcataaaaacaagaaccagttgctaagaaaaatacagatcaaccaagtggggtgtagttccacccatagttttttaggtgctgccatgcttaccttctctgtatggcttcatccctggaagaagaattttccaaatcactgcataaattatgttgatttttctcaatgtatgaagtcaactttgatataataaagttcctcgtttgttcccttcttccctttgaatctcacactaatgtttgttttttttcagttccaaagtgtaatccttcaaaatacctatcaggatcatgtggcaagttggttcagatcggccttcttgtggcaggtaattgcttataaatctcgtctgattgtcagagaaaacaatatctacttttggccaaaagaggttggaatttgattttagtaaaaatgcgttgcagtttgctcatcgatcttacaagtagcattcagaaattaaagacagagtatttatgtaggtttgagcttcatccatagagaaacagctcgtcatacgtatggctacatgactgatatttaggaggatatggtgctaatattatttagtattttgttctaagaaaaagtcccctgaattcctacaaaaatctaaaaaccgtcctaaatatctaaaccagacaccattcaagccgaacatttcaagactttcgagaggacccatgtagcaagttcctacaaatatttgtatggaaccaattagtttgaggcagcaatacatgtgtcgaaatagaagaattccaatgtttcaaaatccaaactactctcccatattcagatgataaaatgtattgattttttttctaaaccaaaccttttcaaatttgactaagttcatagaaaaacagagtaacatttctaacacaaaattgtagatttcatttaaactaatttggtgtcatagatgttggtgtgtttttatataaattttattgaacttgaaatagtttgacttgtaacaaagttaaaatgtcttataatttattaaaattgagggagtagcaacgaatgggccttgaactcagacagagttaaggcccagattagagaaagtttaaattgtttgggtagtagagttgaggcgatttcaaattgggctggtatccggactagaaaaatggccttagtcccttatcttttatttagtctagcaggccagatttttggctatttttcacttcctaacgatctcccggcctatttgctcgaagctaagcaaccacaccaaccaaagccactaggctttaaccgcaattgtaattggattgcatgatggattctttgcgctcacacaatgcaggagtcttttttggagccatggtgatgggcatcacctgcttggtgtaccacctgctgcggcgccggtcggcggccctccggagccagaagagcacgaagcggctgctgtcggaggcgtcctgcacggtgcccttctacacgtaccgcgagatcgatcgcgccaccaacggcttcgccgaggaccagcgccttggcacgggcgcgtacggcacggtgtacgcggggcggctgagcaacaaccgcctcgtggccgtgaagcggatcaagcagcgcgacaacgccgggctggaccgcgtgatgaacgaggtgaagctcgtgtcgtcggtgagccaccgcaacctcgtccgcctcctcggctgctgcatcgagcacgggcagcagatcctcgtctacgagttcatgcccaacggcacgctggcgcagcacctgcagcgggagcgcggcccggccgtgccgtggacggtccgcctccgcatcgccgtcgagacggccaaggccatcgcgtacctgcactcggaggtgcacccgcccatctaccaccgcgacatcaagtccagcaacatcctgctcgaccacgagtacaactccaaggtcgccgacttcgggctgtcgcggatgggcatgacgtccgtcgactcgtcgcacatctccaccgcgccgcagggcacgccggggtacgtcgaccctcagtaccaccagaacttccacctctcggacaagagcgacgtgtacagcttcggcgtcgtgctcgtcgagatcatcacggccatgaaggccgtcgacttcagccgggttggcagcgaggtcaacctggcgcagctggccgtcgacaggatcgggaaaggcagcctcgacgacatcgtcgacccctacctagacccgcacagggacgcctggactctcacgtccatccacaaggtggccgagctggcgtttcggtgcctggcgttccacagcgagatgagaccttccatggctgaggtcgccgacgagctggaacagattcaggtcagcgggtgggcgccgtccacggatgacgccacattcatgtcaacgacgtcctcgctttgctcgtcggctccatcacgttgcacggacaagtcttgggggaccgctaagagcaagaggcaggccgcggcaaacgcagtggtaaagcaagagacgacgaagtgtgcagtcgccgactcccccgtgtccgtgcaggagagatggttcagcgataggagctccccttcctcaaatagcctgctgaggaatagctccctgaactaactcaatcaatgtccttgtcatggcattttaggtgtaagtagcattagaacgatctgtaattgatgcaatgatcccttgtgcatcgattgtcgatgtttatatctgcaatattgaatatggggttatacgtcgtggttaaagctacacacagtgacatatatagatggccatatggcctaaggcccgatggcccgacccaagacatggtgatttggcctggccaatgcacggcacgccctgacttgggtcatgcctatgccggaccagcccaacagtcgtgccgtgcctggggtgctacttcggtacgctgcgctggcacgacctggcacgaagttcagagatgcgaaacagacttattgtcaatcacatgtaaggcacgtataaatatagatagccataaggcccgcccggcaaggcccggcccaggcacggcccgatcgacacttcgtgccgggctgagccggcccatgggctgcacctccggcccagacacgacccaccagcagtcgggccgtgccatgctggcccaaaggaacgcgtggcccatcgtgcctttttaaaataagtctattttcctccctcttctttgggctgtgatatatatatatatatatatatatatatatatatatatatatatatatatatatatatatatagctaaaataaatctattttacctccctcctctttggtctgacatatatatatagctaaaataagtctaattttcatccttattctttggacagtggcatataatgtctttttgtactccctattctttatgtgccggcccggcacgaacgtactagtggggaggcccaggcatggcccagcggtcgggccgggctggcacgagcccgactcccgtcgggccgtgctgtgcttgggccgggtcgtcgggcctcgggccttttggccatctatatgcacaaagaataggaaggaaaaatagacgtattatatggcacggcccaaagactaaggacatgaaatagacttattagctatatatatgccagatcccaagaagggaggggaaatatacttattttaaagaaggctcgatgggccacccgtgccttcgagctggcacgacccgactactggtgggccatgcctaggcctgaggtgcagcccgtgggctggcacgacacggcccgaagtgccgaccatgccgtgccggcccgatcgcctcgggccgtgccgagcgggccttatggccatctattgtaaatctctgtaaattttgctaattccttctatactcctgaattttgcttacttccttgtaagcccccaaaatttgattgtgatcccttccatatccctcctgtcatttgaccgtctaatttctgtaaaaatgaccattttaccctttgtatgaacatagaaatttacattattaaaaatgtaaaagtttgtcatatgagactactatagttatgagtttgttgtgtgatgcattattgatgaaaaaaatttatttttagataatggagtaaaaaaatatgtatttattttattttttaaaaaaagtcataaaataaggagcatttatacaaagatagtactaccaatgcacatgatattttttttatgaatgctcctgataaaaaagaatccattgtcctataaaaatttcaaatcaaaattttaatttattacatttgttttattttcaaaatttatgtcaaaaatttctgcgctaattatttagtctcgttagtttcataaaatgcacatattgtgcactcaaacaaaattttcaatcatttttcaaggttatattcaaatctaaatcatcaagggcataaaagacattgcaatagtgaaataaaggaaagtgtaacgacaaggtcatggaagggattaagttgaaatttcaggggtataaatgggatcgagtaaatttaaggagtatgaaaggtattgagtgagttttgaaggatatacagggaatctattctatagatttaggccctcgataagaggatggtcctatttgaccagaggtcggtgtagtattactaagatttgtgccgactagaaaaaaatgtctgtgttgcaacggataaatagtttttctagtgatacaacaactattaagacctaagcaataaattgattcattgaaatcgctatacattgtaattaaaaaagttaatgaaattttttccttggttttggtccgaaagctcattccttttttccttttcagtcccagcctagtctgctaccttgctccactcagcctgcctctcttcgcaccagccaacaagtagactcgtaggcccagctcacacaatgccatcttcaacctccgaaaggtggtcccatacccgtacaatgccggagccgatactccctatcatagttatggatatcacatacctaatagtagttgactaaactcggcagagcccaccacataccaagtcttatacggaatcatatctcgtatatagaaggagttccggataaggaaggacaaatataattctatacggaaacgacaaggactacccggattgtatccatactggtctccctagttctacttgaacaagtggacatctatgggtataaatacaagaccccatagggagagagggaacaacaaaaacaaaaatagatagacacacaatacacaagccaacacacgccaagacaagctgacgaatatcgacatcagagataagcctagacaaacccaatatggtgtctgcggaggccaacaagaggaatctagcgttatcgccgatctcgccgagttcatactcaaggaggaagactaccctgtcgtcaactacgtgttggttatccatactgccaaatagacgacagctagataagttatcccaattattgtacttgtgtgattcagatgaataaagggcaacacctgcttcggtcaacaggagtagggctattacctgtcaaataaggggcttgaacctatataaaaatcattgtctccatctcttttactttaatatcacatataccctgtactaacgatccccatatatactatgcaaaataccgtagtcacgatctcaaacgtcgacactccccatcaaattcggctgaatctttctcgatctctcaaaattggttgagggcttttgatccactcaatctcttctttccattttttccaaaatcggagcgaatcaagctcgtgaactagccatcatcagcgacttttaaatagagattaaattcaatgaattaaagttgaatttttaatgctactcaattcatttcatactacaaattgtattggctttttttagtagtcaaacttctttaggtctgaccaaatttatataaaattttagtaatatttataacacctacttaattccattaaatctaacattgaatatatatatatatatatatatatatatatatatatatatatatatatataggaaaattatatactactaccgggagtagctactccctccctgtccgccaccaattcaattcgtttgcccagataatggtaatgactattaacgggtttattgaatcgaatacttttacccgttttcttttacccgtattttttttccctcggggtcaacaagattgtttctgttctgtagcagattcgaaaattgaatcaagattcctgagtttgttgtagatagaattttgttcggagacagctgaccagatatatttcagggtggttttttcgctcttcagtttgcttatccaaagcgagaaagcaggatgattatcccgtcgagcagaacattatcgatctaaaaccgttctttgcgttttgagagttcttaacccatctaaactcagattagtagcctcgccggcggctgcgttgcagataacgttgaaaggtctagcatggagaactccagttccaaggtttgttgccatattcatctgttattttgcagtgaatgtggtgccggccatggcgacaatgaacagcaccaacccgacattggtacggtatagcagtgtcaggctgcaggctgccggagaggagcgccccaatgtgccgcgtgcacgccgagcgccccaacgccggcgccgtcgaagctcgcggcagccattgatggattttttttcctaatctttgagtctttttttgatcgtatctcttactaatttgttttgtttatgtttttgcatttgcagcacctttgcagtcctgcagcaggtgcgaatgtttcaggtggtggtggctctagttctgttttcactagagcccttcatgctgctcaagcaagaaagatgcatcagcggaagcagctacctggttctgcagtatcaaattccaaaaaaacaagtggcatcaagggtaaaaaggtagtacaagaaaaaatttacaccaggtgcactcctgctattctctcagatctattctcaggttttggtgattagcaaaaagagctagtgaaacagatggagttttatgggttgctttccatgaggctgactaaactgaacaagcaattcggagcatggattctgtgcaagctagacccnnnnnnnnnnnnnnnnnnnnnnngatctagacatgaaatttgtttgacatgtgaggatgtcagcctacttttgggaatcccttgtggacggaaggagattttgcctgcaataaaaaacgaggtaaaagatgttaaggcttatatgtgttaaatctttgagaaagattcctttgatggacttaccattgtaacaattcagaggatattggagaaaaaatttaacaggacgatgactgttcacgaacagattgtattcaagactgcttttataatcttcgttgtaaccaaattcttggctcctcaatctgttaacaatcacatatctataaggtatatgaaggctttggttgatgtagaaaatattcacaagtacaactgggcggaatttgttttgcatgacatcaaagatgcagcagcaacattgcaacacaaaatacgccatcgaaaaagcattggttacatcaatggctgcattatactacctcaggtgagattatcctattattcgttcgaattatttgccttttactttctaatatactcgcaacatcttttcacatgctataatttatactgctcagcttttttatctggacaatctggatttcgggacggacactcccgagcaggaaaacattccaaggattggcgtgtacaatgactccatgatagcagaattcattgagagggatgtaattctcaagaaccggaatcctttccccgcgtatggaaagatgaaggtaaaatcaactctcctgccggtagagtattcttgttgaaatttcccttgtgcagaaacttcaaactactgacattttttttggggttcagctgcgaaacaaacatgatgaaaaatacaatctttgccatcatacgggtgcaatagaggtgcaatctcatgtaggttggcaatctattcaatataaaaagaattcattttttcataagaattgctgatatatctgtacacaggctatccatgtggatcgtacctacgatgccaggtctgacatcgagcccccaagctttaatctaggaataacacaagatatcgaagaagcaaacatggtggcatgtaccccaggtcatgacatctccaatgtggctgaagactctgacaaagaacaagaactcaactttttagcacgtaccccagatcagccaatctcaaagtcagtagatgcctctgacaaatccggagaaggtaatgcaatgcacaaaactccctcttcgcatggaggtaatgatacccacaagcctatatcagtttttcattttcattcataaccaaccacatgcacataatatgtctcactcttactgttctgtctcataataggttaccaacaaactaaacttagtagtttctctccgtactctatgttgaaagagacgagtggggcaaggattttcatgcgtgaggagtacgcatgtacaaagctcccacctaaatccaagaggagaattatcggcggtccttctgatatcctattcgatcggccaaagaggtcgattaaaccaagccattcggtgaaatcaccatttctgagcaagcaacactctttcgtcaggcatgaccagaaggcacttgatgatttatacacatatgcaatttcaatcactgatgcagaagctcttaagtaagccacctatctgaaacacttgatgatttatacacatatacaacttcaatcgctcatgcagaagctctaatgtaagccacctacctgaaatgttcctttctttcaccactaattgtaaagatatcacatttaacaggaaaatctgggttcacatctcccaacctgtccctatgtcattaagcctacatgacatacaacaggctattcggctagacactcaaatgcaagaagaaacattcaatgttgcagttcaagtattagcagcggatgagatacagagatttggaggaactgattttgtaggctggagacatttcttaaatcaagattttgcagtaagtgcttccaattactctagactattttaattcttaaatatggtgtgttttaacacaatatggcgctgtagatgtttgcaacagctggtgatgaccagtggaacccagaggatcatctcccctcattcaaagatgactccctgataccatatgacgtacctagttgccacctggtttgataattaacagcatcttgaaaaattcagtacatcaagtgcaaatgttcaggccactaacttttgcaatgtcaatattaatttgcagatatttattccactacttcaaccactgcactattctctatacgcatttgatatggagaaaaaaaaattatgcattcttgacccactgagagacgcctcgaaaagatcagaggatacagcagaaagacacttaaaaacaaaatttcacatttcatctgctctgaaggagtgcatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 7369 - DNA, 580 bp, Oryza sativa
  unsure (1)..(580): unsure at all n locations
tattgtcttgtgagctagtccacactccctgcagaagagaggatacagatgactggacataaatttcaagaatcaaggagtatgtctctatgatgtacagatgctcatcatcttaacacttcacttaccgtaacatgtcaatcatgaattccgtgttgtcatctgaagaagcctaaaagagataagatcttttaaaatggtagagagaacaataattgagtgaggtgaaggctagagtagacaccacacaccattttggaaaatgataactgatgttccaaacaaagttgcctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 7370 - DNA, 3786 bp, Oryza sativa
  unsure (1)..(3786): unsure at all n locations
atttttcctttttggtggcagtggtggttggggggatgtgaaggttatttatagctatcatataattgtgtcaagcccaggtgacaatggagaagtagactttattaagatttatgaaacaaaggatattacaaatccaatggcaagaacagcagttgtttttctttttggaagggaaacaacagcaaatctatccttgccaacagcaagcgaaaatggattcaatcattgcccaacgccaacactgaaaagcatccaattatggtttctatactgcaagcgcaatcatgtctgtgtaattgtatatgttttggaaaagccaaacactcagatggctgatatagggccatgaaggttacttataaaaaaacatttgaagggatgaagtaaccccttggtatattatccatggaagaaagaataggcccacgatgcactaaatttgcaccaagtcaaaaaataaattagcacacactgttctcactaagttaaaccttcattgattttatttcaagacttggtcacagatcatttgtataacaaataaagcaattaatcagctgctcacagaaagttgtaatgaaaaggtgcagtttcaaaggctttgtaagagagctcaccgcatctgaaggatcagagagtgcatttaggagtggatcgaagatgtcattcaagtatgccaagaactgttacacaagaaaaaaatattaacataaaccatccaataatgaatttgaactgtgtgtaccacatgtccatgttagagggggattcctttgggactttcaagagagagtttaaattgagctaaatcctaagggtctgaagaaaaacctcccacagtccataaaaaattaaatgtgaacaaattatgcaggtacagcttgttaaaatatatgttgtgtagccccaaaaagcatcatagttgagcacctcagcacgatatcgaactaagagagtggaaaaccaatgcaatgactcaatccgggtagcctcgtgttcactattcaattccctgaaattgaaattgaaaaaggctcggtgttatttcacaaatgccatgttacaagtgactgcacatatttttaactcttgatccatgaatatagatacatcggcatgaaaccaaatttcctatgcaagtggtttagtagagaacctctttgcaattgagagaatggctccaatatcaaatccttcagttggatcagcttttatagcacaaagttcctcattagtttcacgcgcaacctagccaacaaaaagtaaataaagattaaagaaatgacttccgacagacaagcaggctacatcttcaagaattgtctgtgtccaaagaagagagggaattaccactctgatcttctcctcttgatcagaaatacagggcaagatggctcccaaaatatctgcatagtaaggaacaagttgttccccaccaagcttgacaaactcgttaatctgcagaatgtgacaaaatattactcaggtgtatcaaagtagactaaatattttagatttcgatatcaaaattaacaaaagaaaacatagaagacaaaagaaatacccatgtgatagacgtcaaccgagtgaattcatcagaagaaccagctctccgaacaagtatttcagccatacgaccataatctacattcttttcatttaaggttgcaaatcagcattggaagcatacccaaaaaatgaaaaatgtaattttgtggtataaatgaagacaaagttattaaagggatattcatcgggcaagatacatatgttgcattgcatctcactgttcagtgactgatacagatagacaagcaatttcaatgaggatggacttactggtgaatttttaatttcctgcagaaactcagaaagtgctgcatctgcttgctgcctaatctcatggctggaatcactcagcatattaaataaacctgcaggggtgacaaataaaaggttgctgaactgtcaacgtaataagtaatatacttgaaaagtaagagaggcattaccatcaagaaaatcaggaaggaaaccaagcatgtcaatatcaggcacactgtctaacactgttatccaccccaccaaaaattgtctcacataaggattcaacacattcatgcgctccctcaagagtggtataaattcttctatgctaaatagcaaaattaagatacaggaactatcagaaatcgatactagattaagttgtgcatgatattgagattgaaaaaggacatcacatatgtagcatacctgaactggtcactctcagttactatatcctggtttataaattacaaacaatgtttatcagggctaatcaaggatgcaatacgtacaggatgtatcagttgcccaaacgatcgtaccttgacaagcctgtcaagaagatgagcagcactctgcacgttagcatcagagtctgcagaaagcttgcataatgcatcaaaaattttgttgaagtagatgatgaaatcccctcttaccacctacaataaagaaaagattaatgcagcaaagcaaacgcataattcatgtaccattacttgacaaaatgtttacctttgctatgttgtatagtgcttcacacgcatagtagcgaactctactgtcttggtccaggaaggaggtaagcacaggaggcacaatttgctggaagaatagagcaaaaaagtttaatgcaaccaaaatgacacttgatagaacacaccattaatgaagacctgaaacgcagtccatcatagccctaacttaacaggatagatgtctcaagtaaatactataacatacaaaagtaaacaatttagacttagattaatccatggacaagattatatggtgtgttgaaaactggtaggttttaccatcaggaaagaaaactacagctattttttgtccagttagcagtacaaccaaacactgcttaaaatttaatactaaatcccaagcactgagttcagcatacacagaatagcaatttgattaaattagagaaatcaacggggatataagaccagtaaagagctaacagacctccaaatgttgagcagcctcactggtgagtccaaccgtgactgctgcaagaccaatcaatccgccctgctaacaaaaaagcgccacagaacttcaacaaatctgatccccaatagcagggaatatgaagatgacggcgatgtaagcaaaccttccgatggttcgcttggggcgacatggtgaaatcgttggtgagcagagcgatcactgctgatatcttgtcatgttctcccgacgtcgccagctgcttcacgatcccctcaatctatacacaaacagcccaccacgaacaaaaacaattccagctcaaatccatcgtcgattgttccaaaaccagaccccctatgacgagccgaaatccctcacctcgagcgcggcgttcttccgcttctcgtagagcttgtcggagaggttgcgcagcacggcgcccgggatgatggagagcgcgtcggcggccatctccgaacaaaccgccaaggagatccccccttccctgccgccgctacaccctcccgatcgcccgcgatcgccgcatcgaccgcnccgccccnngnacncnnannccncaacccccacacggnnacnccaaccctaacccccccacaagccaaangcgtcaccagagaccacnaaggggtgcgccccgcaaaccctagagacctaagcccacctccgctcgctcgcggggcaccctggcgaagcctatctcaatggattggaggttggagacgacggtggtgtgatctg

SEQ ID NO: 7371 - DNA, 6694 bp, Oryza sativa
taacgtttaccgttgcggcggccattaacggcgcgtgtttacccgtgggtgcgggtccaggggcggtgaggctggcgggtggggacgcgccccgtggacggagagtgcggtgcaggaggctcggtctaggcaggtttggcgcggtggactgagcgtcgtgctacagctaatggattgagccaggaggggcacgggtgcgtgagctcggtccaggaggaccgcgctggtgggaggggtgagaaaggacacgggaaaggtggtgcgtggactgggtgcatatgaggcggggtggtccctgtagtcgtgtccaggtttctctttccacggaaaaggagccactgcccggctgctcgtgttatcttccggcctttttgttcctagtttgttcgtcataggctggtagtcctcgttgttaggagtgtgactgtgtgagtgactgtcctgagttctgactgttcgagggtccttcgatgaagggtgatatatgctgagtaattttaagtggtgatactgatatttggtagtttcactgagctaaagtatttttataagtaaactaaattactgacgttattatcactcgatggtcgacataagtagaaatgtgtgtgtatgtatatgtgtgtgtatatatatataggggtaaattaactagtgctacatggagtatgggcttcaagattcaaattaagtatatacctaatttgaatgagtatgaaatttttttaaatgtttagatatgaacattaacttctttactaacaagttcaaacaagtttgaactgagtttgaactttttttttagattttgattctaggtatataacatccaaacatataattcgttaggtatgtaataatgaattgtgaaataaagttgagtttgagttgttttgttgttaggtatttgtatgaatcaaattcatatacctaggtcacaatttgaaaatttttaaaaatttgagagaatttgtgtgttttataccttggagcccgggcaccatggagtcccatatgagtatcctatatagagagagagagagagcgcgcgctagagacactactttaattgttttgttttggatagtttgaaaataccattacaaagatacatgagttacaaaataatttcatatgtgaaaatgatgtgtggagcctagatccacgtgtcaaacaacacgtacgatggtattttccaacaacttgatttttgcgatggtaccgtaacaaattggccattttgttttactcagagagatggcatattagagcgtggtatctcaatcatggggcctatttggtttatcagatttttgagtggattattgtcttgtataatatacttacgtcaatatattttgaaaaatagacttggcatagttccaagtaagtggtctacataatatggtggaagaacgttttctctagaaaatgtattttttaagcatggagtaaataatactttttttctagaaaatgttcttgcacgtattataggacgtcatccttttgagaatgaaaaatgaaggtagtatgtcatgtatactccctccatactcgtaaaggaagtcgtttaggatattgtttaagtcaaaccttgggaatataaatcatgaataactctcacattgttgagtttgaaaatgtaaaaattatatgaatagatttgtcttgaaaaatacttttataaaagtatacatatatcacttttcaataaatatttttatagaaataagaagttaaagttgtgtcgctgtccaaaacgattttctttacgagtacggagagagttctatagaagtatcgtgtaagtttggaaatttataggagtgccatgcaggatttgtaagttacaacgtactccctccgtcccaaggaaaaaacaacttcttgatataaacgtggacatatgttagtcaaaatataacaccataaattaactgtttttaatgagaaatataacaccataaacatatatagatagtcaaagaatttaccacgtcaagctttttttttctcaacacaacatgtacttggaaaagtaaattcatcatttggttagtataacttatcatttcttttatattatacgatatatcactgattagaggattactattgtacatgctcttgatccaaaatagtacggtgtcgggtgggtaccaagtagatactaggctcgatacctgtggcctgtggggtaccaaattcatcaacaccttgttggcacatttcatcgagggctccgtgatcattttgattccactagaggacaacgatggaagtagaggcagtcgacttcggggaggggttagacaggcggttcgcatggacagcgacctcctgctaacaccatggacaacaaaggcaagttccattgtcgccatcaagatgacctacaaagcggatgctaaagacatctagcttcgacctcgcctagactccaagcggaagcagagctgccaccttgcatcggcaatgcccaaccatcaagtaggtgtagcgctccgacgctggccaatcttcgatgtcacctaccaggatgctcaaacttgccacaagaagtagcatcgcgccccttctgccgccgatgatgaccaaccgatgatgacgcaagttgactcgagcgtataactgctcatgagtttcaaaaatgacgtaaagatgaagaccaatgatctagcaccacttcattaggatgacgaggcaatgaagcaccttgcctggtcaccggccaactcgagttacttctccactaagagttgccttaactactcttcgccagggaatgacgccttgtttatgtcgggacaagattccgtccctactgttaaataaaccaggggaaaatatattttactctcttggactatttcattggagcagttaactcttaaactattttttttgtctcactttacccttgaactatttttctttgctctctaacaatatctctctttcatttctctctctatattattcatattttgcactggaaattgggtaggatgatagaggcactgtaacttacgtctcaacattttttttaccatttatagaattgtacaaagtttggaaacaataagacatttaaacatgaataaaaaacttcaagcaaacaatcatgattttttttttggaaaaatggtgccatgtgaggtttaaaaaaagtcagcttacaatgcaacttaaaagagaaaaaaaatattatgagtagagtgaaccatttttaatagtttaggggtaaactaagctaagaatagtttacgaatttttaatagtttaggggtaaactaagctaagaatagtttacggaggattaagtgatccaatgaaatagtttgaaaagtaaattggacttcttcaataaattaagaataatttctggaaaacatcatgtttaatggtcaaaattgcaaaaaaaaaaacaccggtattatgacatgtgacactgacacatgtgtctcaatgtttcataaaatctctactctattgatatcatgataaatttcagcataacataaaaaatattttaaaatagtaagaaagaattaagtatcaaccttaacttaataattaaaaattccatatattctatatgtatatatttttaaataaattcacgcttaaattgaataagagtgaggttttataaaactttaaaatcataatatatggttaaatatcaaatgtttgactttatataaatttgatctgaaaacatgatgtcttttaaattttttactcatccttagttaaactagcaaagtcatgtgtattttagttttcatgcggggagatttttccaccgcggtgctagcggtaatttaaccggcaaagggaaatttccccagcgcgcgccgcagcaaaacctgaaaaaccccaaccgaacctcccatcccgccgttcctcatacttccccccctcaccgcgctctagggttttccatgccgcgcctcctccccccaaaaggcgcattgctccgccgatggcttggacggaggacgaggcgattggccccgatgtggcctccacggggctccacgtctcggagcggatcggccgcgacgccgccgctcagcctgacctggaggaaggccctcgaggcctcacgccacgcggccacgcctcccacccctactcctcatatcccaatgaggtgggcacgccggaaccaatcgcgtgctatatactcgaggctgtgcacggctaagccgttgatctgcagaagcgttcgttgtcggggtgcggcttgtttggcaactcgaggaagtttgcagcggagttgggggcggtgcaccaagcagctgttgttttgggcgatgttctggaattttagttatttagttccttgtttgctgagagaaagaggtaagccgtgaagtggggtgttgatgagaacgagaaccctaaaatgggctgtcatgtttagtttagtagaagctagacttcatagctcttttggagacaggcaaggatgacttctctaattcttgccttaaaaatatttgcggaggaagagatttcttatggcattggactaggccgagagggagatcgggaggtatcctcctgggagtaaacttggaggtgttcaatttgtctagcatagacgaaggagatttttatgtcaagtttcacgtgcgaaacaaggtagatggcttccaatggatccttgtagcagtctatggggctgcccatgaggagtataaggaggctttccttgttgaattggtaaactcttgtagtaaagaatctttgcccatgttgattggggggatttcaatattataagaagccctagtgagaagaataacgataggtacaatgacaaatggcctttcttgtttaatgctgttatagacagcctagacttgagagagctagagctatcaggacgaaaattcacttgggctaactctttgcaagtaccaacttttgaaaaattggatagggtgcttttgagtaccgattgggaagaaaagtacccgctagctacagttagggctctgaatagagacctttcagatcatacacctttgctacttgatacgggagccaaaactcgtgctaccaaacaacctttgttcaggtttgagcttggatggttgttaagggaaggctttcatgagttagtaacggaagtttggagaaaagaaaacaagggttctacgatgatggaaagatggcaaaataagatccgttgattaagacagttcttgagaggttgggcaaaaagcacaagtggaacatatagaaaagagaaggttgaattaagtgcaaaggcagatgagttagataaaaaagcagaggtgcagatattgattaggcatgagttagatctcaagaactacttgaaaaatagactagctcatctgttaagggaggaggaaattaaatggtaccaaaggtcaaaaacaaaacatttaattgaaagggaccggaatacaaaatactatcatatgattgcaaatggcaagcataggaagactaaatttttcagttagaacaagaggagggtgtaattaaaggtgatgaaaatttaaaaaagtacatcactaaatactacaagaatctttttggaccaccggaggaaaataatttttccatggtggaatcacagaaagaggacattgcgcaggtatcagatttagagaatgaaatgctaactaaaatatttaccgaagaggaagtaaaacaagctattatccaaatggaacacaataaagccccgggacctgatggtttccctgcagagttttatcaagtgttctgggaggtaattaaagaagatctcatggctatttttatagaatttcacgaaggaaaattgccgctccacagcttgaattttggtatcattactttgttaccaaaacagaaggaagctagacaaattcagcaatacagacctatatgtctgttgaatgttagcttcaaaatctttacaaaggtaatgactaatcgaatagctctagtagctcagaaagtcattagaccttcacagacggccttcctttcagggagaaatataatggaaggggtagtaattttacatgaaacaatccatgagatgcatagaaaaaagaggagtggagtcattctaaaattggactttgagaaagcatatgataaagtagactggactttttttacaacaaaccttgaggatgaaaggattctcgcaaacatggtgtaactggattgaacaaattgtagaggaggaagtgttgctgttaaggtcaatgatcacattgggaactttttccaaacaaaaaaaggcttgagacaaggagatcccctatcaccaattctatttaatttagtggcagatatgctatctatcttaatacaaagggctaaggatcaggggagatttcaaggagtcatacctcatctagttgacaacggcctctcaattttgcaatatgctgatgacacaattctctttatggaacatgatcttgatgaagtgaaaaatctcaaacttgtacttagtacatttgagaaacttgcaggtttaaagatcaattttcataaaagtgaattgttttgttatggcaagtcaaaatttgcagagaatgagtatgtcatgctttttgggtgtagatctgggacttacccatttagatacctaggaattcctatgccccacaagaagctctctaataaggattggcaaattatcgag

SEQ ID NO: 7372 - DNA, 393 bp, Oryza sativa
cagttcatttctgaaattgattttaacttttaagaaaggtgaatcaattttgagtttcaaaaaaacaactcgaaagtaaattctccctggagtactggattcacccatccacctcgtcgactagtcccgtcgtgcgtgaccgggtgcctttgcctttccgcagaggagcgcgatcccccaccccaaaccggcacgggatgcctcagcggcggtcgtgcctggtgccccttacccgtcgtctcttcacctgccgggacggctacctagacgcctcctttcggtacttcgctcgccgccagcatcctccacgtcgctaccgcgcgcactatccagtgccttcccgtacccatccgactccttccccctcgacaagctcccctccctcctcccgct

SEQ ID NO: 7373 - DNA, 32775 bp, Oryza sativa
  unsure (1)..(32775): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaggtggaacctgtttggcttcagttgatttggctgctgatggtactaaggaaggttccagtcatcatgtgtatgttgaggatgtaaaaggtaactcaggttccccttcaacacaggatgatgtttggttgcattcaagtgcgggcatcgacaatcaacctggcacacctggcaccagtaacaacaataaaaagctgaattataccactaaggtagatagtacctgcgacagtgaaacatctcaaaatggggctttagagacacaatttaaatcgcatgatgcatcaagcattcccatgaaaaaatcagttattttcaagagaaagagaaagccaagtagaaatattttttctcattctacggataaggatgatgaatttcaggctgagttaagtgaaaaaacggcagattctccaaatccaaagactgaagtaaataagtcagatggagatgagcacttgccattggtcaaaagggcaagggttcgaatgggaaggcctcagttggaagactcaccagttgatgggattgatgttactaataacagaccagagcttgctatgcttgcagacctatgtaatatgcataacacagttgcactacctggtgatgattgttcagtcgatcagtcagcagtggtaaatagtgtttccttgacaggaagagttgcaaatactgtttcaaatcaatcatccaagttatacatgcctggcccctcaggtgaaggtcagtctgcttggaagaacaaagaatatcaaccaaaggttttaacattggatgttgaagctgctttgcctccatcaaaacgtcttcatcgtgccttagaagctatgtccgctaatgttgctgaaactaataatctgcctgaagtgacagggtcaaagcaattgattccaaatggttttgtggcttcagaaaacagccactctaataaatctgcagatgcagtagtcacagccactaacggatctgcaatagcagaaagccctaggccatctttgtgcacagaatccatgcatagcccaaagtgcaaaacacactcctcagaatcaattctgcaaaataacagtgttcctgcttctgcttcagttccttcagaagcaaaagatgacagtcatgttacagaaggcaatatttgtgaagaaactcacgttgatagcaaaactactgattgcttgttggtctctagtgaagttggcaatgacgactgcgggaaaggcttggctctttcaatgaagctgaatgagtctgctcttggtggtacacagactgtagctgtacctgatcgtttatcttcatctttggggacagctagtgttagcgaggttgccaaaccaatcaacttcaatgaaggcccaaaaccagttgaccgtcctgcatatgatactgacagaagtgttcaaagatgtgatgagccaatttaccgaccaaagttgctttcttctaacaataatgcgatcagtgattctgtactgcataatgaaactgttgtagctgaaacagtagtcaatgtggctgatacagcaagcacctcttcgctggccactaaatcttccagtatacaatctgatgcagacacccggacatttgaagtgtaagctttcatgccaaattgtatcttccattatgtctgcatgagatatttgtttatcattatatgctccatatcttcttgttcataacctttttgtgacaaatttaggacatgcatgcttcttttccaaatttatgctggcattttctgattgaaacttcagaaagttgtgaagaagaagcatccatgcaatttgatttttcttttcctacgaaattcttttccttgtaatgtcaacctgatgttttcatccatcaaaatgcatttctttggagactcaataatgggtcaatgtatgtcttaaacataggtaacacttcataatctagttgactgaacaaaaaaggtgggcaaattgattcactctggaatctggataaatggcatgaatggttatcttgttttactcatcaacaaggatcttattattctaatgctcctgtcttgtgtagatttgttgctttatgagctggatacttgggttttcaaatattctgattataacgtctttagttatatcatatagattctaaatctttccatgttatgggcttgtggatcctaatatatgttttgtgggatatttcagttccttcacaatcctttattaaggagaattaatcgggactgttttctacctccatacgtccctaatttatttgtctgctctattttggctttaactatagagcctatttttggagcctgacattactagccagtggagactggagagcaatatttaggtcccaatggaaacatcattcttatggttcatgtctgaaatctatacattgagctctacaccttttgaaccttcttagcaggaatgcttattttgcaacgtacagtctgatgaacttatgacctattcatgtagaatgcctggaatagcaacttttttggtttatattgtacctttgaattactcctataacaactctggattagtactttataaatttgatacttgattagttgatttaagatggtcttctgaaaaggcatgacaatacttattgttgtattgcaggcacaccttctcagctttggcattaaaagaactgaaccatagaaacctaaaggataagagcacttctccagattcaatgcctatgaaagaacttattgctgttgcacaagctagaaggttctctcgatcaacttcttttccagataactttctgaatgccaagtatattcctgaaactgtagttgatacacctgctttcaaggaaggatcacagaagcaattgtcacctttgaaccggataatcagatccacatctacaaatgataatattcattctaggagtccttttgatagtcagcaacagaagaacttgagcaaattaacaggacatgatgaggctaatgcagcacgaaaggcttttggatcttttcttggtacactgacaagaacaaaagaaaatatagcgcgtgcaacacgtcttgcaattgagtgtgccaaacatggcgttgctggagaggttagaccatgcgtccatgcatgtcactcctagttttctatttggcacgtgatcctcatttatcatgcatttactgtgtctttcttaagtagtatcatcatttacttgcttatagatgtagcaaacattgttgctttctttgttttgttggtggacggggaagttagattcttgatttgcctaggctaattagtaattacagtgctatgttctctgtgccaagtgccaactaccatcttttttgtgatggatcatcaggcatctggaacttattgttgcttctcaaggatcaatcttatttaccattgaagtgtaccatctcttataatacgtagttgctacatgcttttgatgtgatatgacaacatatctcagcaacttatggacttcgaaataacctgtgataattctggtagatgttgctttgtttaccacttctatgttcttttagattatgaaatctcatctacagacacatgcatggtgcttttagattaccaataaaaagagggtacatacctttctatgcaaccaattgccaaatatcaattttcctgatttttttttcttatttaggcgattgatattatcgttgaacgcttggagaaggagtcgaatttatataagagagtggaccttttctttcttgtggattcaataactcaatactctcgtaaccagaaaggtaacatatagctttcatgatctttttctgtctatttcgcttgcactctatttttttaaattctgtaagaaatttgcaggtggagctggagatgtttacccgtctcttatccaggcagttctacctcgattactttatgctgctgcacctcctggaaattcggcatgggagaatcgaaggcaatgtctaaaggcaggcaccttcagcagtttgatagaactggtgtcatgtgcaattctccttttctcctcttaaaaactttgtgattttatcttcaggttttgaagctttggtttgagaggaaaacactcccagagtacatcattcgccaccatattagagaacttgaggttatcaatgaggcatcttttggaagttctcgccgtccttcaaggacagaaagagctttaaatgacccgttgcgtgacaacgaaggaatgcttgttgatgagtatggcaggtatgcttgtcaaactgatgtatgaaaagtagtgtggcatgcatataatattgtaatgttcataaacgatagctagatgaattgtgcagacaaaatgggatcacgtgtcgaagtgtagagaagcaggcaaagccacggtagatttgatggaacactgcaattttgagtaattttcttagagcatgggtattcttcaggtagtcttgttggtcagttaagcagtgttctatgatatatgaatgatgctaacatccaattagctaatattggataaaactcaccatgaataaataactagaaaaaggagtcattcctgaaatattgggggtgaattttagtgggcgtcctttttcatattatctgtgagacaaagctattttaaataaaacaagatatgcattaatgcatgcagtgcatgaatatgtcctcattacttcatagctccatgttctacatattcaattatatagatgtatctcatccagttctttccctatgtttgtatgttccattgttttccgcagcaatgctggttttcaactaccaaacttaatttccacaaaagtacttgaagatgaggacggaagctcctctgaagatagaagttttgaagctgttacacctgaacatgatgctccttgcactgatgagaaggaagaatcacaaatgcccgcagaaaagcatcatcgcatccttgaagaagttgatggcgagcttgagatggaggatgtagctccaccatctgaagttgaagctagcaccagatgtcggccagaacaaattgataccaaatgcagaacatctgatcgacatactttaggtcctcccctccctgatgataggcctccatcgcccccgccattgccatcatctcctccacctgttccgccaccaccacctgctccaattactcagactggacagttgcagcgaacattaccaatggcatctgatccagttggtccgcatcctacaagagctaccaatgtatgctcatatttgctttctgtgcaagaaggaatttatgcatttttattttagaaactaatgattcattttctttgcagaatattcagacgcaacagccaaattctgttgtggaacgcccaggcagtatgaatccttctgtagcgcaattgcagcctccaccattctgtaattcaggatatggggggccatccaaatcagatgccaccgccgcccccaattgcaccacttaatctcgctggaccccatggcaattttcctgcacctcctgcaccatatcatgggaataactatcatcaacccccaatggcatcggtacctaacgaaggatatcatatgcaccaccaccccctccacctcctataaaccaatgcccctatcgaccaccagaacctcagcaaagaccacggccttggagtaataatagttcatcctatcctgagagatatcggtatgatggacatgatcgagatcatcacaggcatgatagaagacatcatgggcatgatagacgacatcactttgatgatagaggataccactatgatgatagaggatatcactatgatgatagaggacattattttgatgatagaggacaccattttgatgacagaggacgttcctttgatgagagagctattaggggaccaatgcaccacgaagttgctgacaggggcagatttccttttcctccaggtacttttttcgtgaatcattgtcgcttttttcctggcacagttttcatcctgtaaggtcaccctagaaacaccagccatgaattgttattgtacaactagatgggtactccacgcgttgctgcgggagaattgtgtgataatatagtagatatgagttctaaaattttcattcttactccctccgtcccaaaaaaagacaaaccctgggtttctgtatccaacgtttgaccgtctgtcttatttgaaaaaaatatgaaaaaaattaaaaagacaagtcacgcataaagtattaatcatgttttatcatctaacaacaacgaaaagactaattataaaaaaaattcatataagacggacagtcaaacgttggacacggaaaccctaggtttgtctttttttggacagagggagtacctactatacgattttttttatatgtttatgtattttttacctttatcaattatccataggttataaatgattgggttgtatagtgtgccttttggggggaagagatgcaatttaaacccttgatgaatcatccaaaagctaaaaacaattgaggtgatgtggcttcatgagagaagagagaattagcattaattacacttagtggggatgaactttatagatatatgattacccaattaagttaatctatcccatgctgtaggaccctcaaaaacagcagactaaatgttctttgttcttgattattgtccagggcctcctggtccagaccattttgaagcatcgtcagcagcaccagtgcactacggacgaccatcagatcctccaccaggtccttgctctgggtggtctatgcctcctcggtcatcgaattattctccctccagacattctatggagcctccagttccacatgtaggaggtatgttacatgctctttcgtcctgcttcataatgtaacttgcattgatttgcctcttaccactagatattggtttgtccaaagaatccagtttcataagcatttgtcctgtaaggagcatttatatggtagaaacttttcaaccttaactgtagaactagagtgtaaactgtaaagtcatgaggggaagcttgaaagagaggaataacattgttaatgttgtgaccaaagtcttgggaccattttgtttcctttctaatattacctacactagtcctaatcaatatttcgtccaagttcatgacatattttggttgtactgtacgaaatgcttggcataatacgtgtaagaataacacaagctgttccaaagaaagtaacttcaggtcgcatcagattacaggatactaattcatcatcttttatcgcagcacatggtagctggagaccaagataacatttttgctatccgtgaatggtacgccatttgttccgttcctcttgttaccaccatatgccacaattatcttcttctctgattcatctgacatgctgcttttcagggtcgatgcttttgtcagctgggcacttcgagatgctttcgttgatgctttctgattcatcggtttggttccttcacatgaagacccaccaaaaaggagggagataagtacctgccttcctccttgtaaatatgtatcttagcatagtaggattgcagaagcggaaggcagatcaatgtattgtaggaatagaggctgtcaatgcatcaatctttagccataggttgtattgttagcctaacaatgttgtatttctcttcggagaatctcattgttcatgtccattcatgaaaccctcctacccctctgacaacaactaccccaaatgatttactgaaactgtttggtctcatcgtacataaacaaataaatacaaatcattttgccgcagttcttttgttgtgtaaatatcacctggcatagctgcagaacaaggcatgcttgtgttcctggagcacatcattagcttttttcagcgcctgcgtttgtgtaaatatttagaagctaatggtttgcgagataaattttaccatatttgcactagaaattgtgctgtaatgtactttgtcaaaaaggttaggctattcacatattgtctcacatcagccatggattatttgttgcgaatttagtttgaaatgagtcgccagccccattggttacactaaaaagctaaagcaaagccaaattttaaaatttaaaacctaattttgaagttgatttttaagatatttttaacatagcattttacattgatttctaagttgttaagaacacatatagaagttttagataaattattttctaattgctaataaaacagttacggtttataaccagttttggacattatgaatgcaaaagcttggctgatgaatttacagtgtttccaacatagatgtgcactgaatgactgaattggcctgtttggtttagtgtcaaccttagccaaacttgtggcaaaaaagtttgatcaactaagactagtcctcttgtcattgaatgattttttttaccacaattgtggctaacacattcataaccatacaatatgtggcatgccacactttatcaattatattgtggcaaaatatactcccttgatactatcgtgccaccgtgttaagtagttgcacatgagctcggtatttaggtgattatgatgctgttgctgattactacctccgccctggtttcataattcttggtgttttggatattattgttgtcaaacttttataacttcaactatcaataactttaaaaatatttagtttaaagccattagaataacaaatatagatttattttacaaagttctctattctagttttcatagggggcggatccataattggagccggccttgatcatcattcatcaagggcggacccaaaattgggccacgacctgggccagcccattatagcttgagctatgaatatcaatggaaaaagtccactttgactcccttaaatgtacaacgaatctaattcgtacccctcaaccagaaaaccggttagaacgactcccccaattactaaaaccggtacaaattcactccctcaatggttttgaagggcggttttgctgacgtggcgctgatgtggcagtgttaacttggtcttcgtcccacgtgacgctgatgtaagattataattaaaaatatatatgtgggacccatttattattcacaaaaattataataggatccactaatatgtggagtccacatgtcattctcttcccaacctttcttcctccccctctctctcccttatctctctctttctcttcccgtcggcgagcagcgcggagagcttgccgaggcaacggatggcggagcggagagtggcaagggagtgtgcgaagccgtgggcggcggtgggtggagaaggccggcatgaaggtagggcggagcagcgctgcggcggcatcgagagctgccagtcgccgcggtcgctgctgtcgcgtatcctgtagcgaggagacggcggcggtgggaaggttcgggtgtcgggtgcggctgccgcggcggtaaagctccacctccgccgccggcgttggagttgccggagaaaaggagatgatgtcaaacgcgttcaggctcgaccgccgccgcgagctcccgcccagcccgaatctcccttccagcaacgacggcgccgccatcgccccggtgcactccgccgccgacatcgccgtcgccgacaccctctggaaggccaccaccacggtcgggactccccttgcgcgagttgctcacgctcgtcaccagcgacgacgacgctgacatggacacgtgctgctgccacgccgccatggcggcatggcgccatccactcaccgaagtagtaattagctagctagctagctagctaggcaacatgacgacgacactagcttaattagcttgtgtttagttggttaatttagtggtaatttagtgttcttggttgctcggtgacgtcattagctaagctagcgatgtagtagtagcagctagtgggagtattaattatcactcaaggcgaggaaatcgacgcccagaagaggggccgcggccatgctgcccagatccatcgccactccacccggccgccgctgccgccgatgcgtcccaagggggaagagggggaagagaaaaggggagagaaaagagagagaaggagggagcgaggaggaagaagggaaggagaaaggatgatatgtggccccatatgtcggtgggtcccatgatatattttatgtgtgaatgatagatgggttccacggatatattttaattctagtgccatgtaggcgccacgcggaatgaagaccgggttagtatcgccacgtcagcgccacgtagaatgaagaccgggttggtatcgccacgtcagcgccacgtccgcaaaaccgcccttcaaaaccactgaaggagtcaaattgcactggttccaataattcgaggagtcatcctatctggttttccagttaagggtcacgaattaaattcggtgaacaattaagggagtctaaatggactttttccaatatcaattacatggtggaaaacggaataagttcactttgaccctttaaaagtgacccgaatctaatccataaccctaaaccgcaaaaccggataactcgaccccgaactattgaaaccggtgcaatttaactctctaggcggttttggagggcggttttgctgatgtggcacttacgtggcggtattgaccgggtcttctttacacgtggcgttgacgtgatgcttaagtggcattagaattaaaaaatatgcataggattcattagtcactcaaaaagagaaatgtgggcccaccgacatgtggtgcccacatggcagtcctccctgtgtccttcatttttcctcctctctctctcccttctttctctttctctcccaatgggaggaggcagcggcgcgagggcggaggcggagcacacggccgacctgcggatccggatcgcctacagtactgcagggaagcactgtccatgtgaggggaacagcgatctaaggacataaacagtggctatttactatagctacaggatatccttccattctcgattggacggtctacagtacccctaatgtgcggtactgttcatcctctgcattagtacctctaatgcaaaggatccgaattgccggcctgcacgccatggcgacggcggtggcagcggccgttgatccagctgtaggagggcggcggcggcggcggacgttgtcggggagatccccgacctcgccctttccatggcggccaccgccggatgccgccgtcttcactccccgccatgcccgcatctcccccgctcgccgccgtctccgcttgcccgccgctgcccttctgcggtctcccgcaacgacggcaaggtcagcctactaggatcttcatccattggcaagatcggcaagcatgcagctcgttggcaaggacgagtcggtcaataggcttaaggccgtcgtccagaaactgaaggacatccgcgcgagctccgggcggctgatgcaggcggcggggctgaccaagccagggtccggcgagtcgagcagcaccctcctaacctcggatggtccggtgatcaccggctcgattctggaggatgctgaggtgtttgggcgtgacaaggggcatgagcaataattggtgtcttggctagtcggtagcacgaccgaaggcgaggatcggagcgccgcttctgacaccatccccgtcgcggctatcatttttttgagaatgtctcgtcgcgccggttcttgctgattcttgagaatgtctggaataaagatgagaatgagaattcgtacagggatatgtggactgatgtgttagctcccctcagatttggtcgagctgggagtaagatcgtggttaccaccaggaagaggattgtggcagacttgctgaatgagggaagggagagagagagggaggagagaggatgacatgtgagccccacatgtcagtgggttccgcatgccatcctttgtgtgaatgataaatgaattatttttttaattctaatgccacttaagcgccatgtcaatgtcacgtgtaaaaaagacccggtcaataccgccacgtaggcgccacgtcagcaaaaccgttaagggagtcaaattgtaccagtttcaaaagttcgggggtcgagatatccggttttgcggtttagggtcatggattagattagggtcactttttagatagtcaaagttaacttattccatgtagatagtcaaagttgacttattccgtggaaaaacaaacttcatagtgggattgcatcataggcctcaggccatggcccgagctgcccgaggcctagttccgcccctattgatcatcatataagatttttaaggtcttcctaaatgaccatcctctaacaaagtgtcttttcgtttatttgtgcaaatagtaaatgagcattattgaatgtgctacatgcaatcaaccaatattaatttatactagttggcatcccacatctttgccgcgggttttgtagtttatcatcaaacaaaatcatagttttaaatagttaaggtacaactctatatacatacaaactatatgataatgtggatttatatatgccttatgttattacaatataattcatgctttatttttccatgcgtcattgtgcattgttataatatatgaatttcatgcgtaatatatgggtatcgttgtagttagacaatttgcatctctctacttcactcaagttttttttttctaaaaatagattcaggtaacgatacctaataattatatgctatcttgtcatgcataataaaacaaaacacacatattaaacaataatttgaattgtattaggaaaacatggtgttatgcataaaatatgtaacagtgctatgtgtgactatgaagtagagcaaaatgaggtgaatggataaataataaatgattgaattggaagaataagtagcttcttgatccaacggttgttatctttatactaatatgatgtgatggcttaaaattgttgatgatgtggcttcttgcatgtcttactttataggagtaaatgccctttaatgggtaccaactatatagaagataggattggtgaaactccattcaatatataaaacgtgatgcaatctatgagacacgaaacaacatagcaccttgactgatgatgattaatttcataatagtgaagtttttgttgtccttggtctctgtgtgtttgcttaggtgatattcaaattgggatagagggagtgctataataaaagtaaatatatatttatttattgtatatattataatagaaaaaatacagtcaaatatatattctggagactgttattgtccaaaatatcaagaattataaaatcggaaagagtaagcaatcttaacaatacaaatgatagtcaaaatcacttccgtcttaaaatataagcaaatttatcaacacaaatgcatagtaaaaatttcttatattttgaggaggtagtataaactgtctttttgaggaggtagtataaactgtctatttgccatgataacattgccatgataacagcatcaatatacttatatacatgcatcttatagaaagcaatatacatgtagacaaagacctttttttttaataaagtgcacgagcggtctctaaatttgtgcagatgtgtcacctagatccctgaactctcaaaatgcatttttgggccccttaacttgtttagggtgtcatataggtctaaatgggctccaactcacaccgtgtgctgatgtggcatgccatggtggcacatgtgtcagtagaacctatatgtcaatcatatatagaaaaaattaagaacaattttttcctctcttttttcatttattttttcaaaattaaaaacatccttttctcatctctctctcctttctttttaaattttatttttttatgcgaatgacatgtggatcccattaacacgtgtcaccgtggcatgccacgtcatctcacggagcgggttggagtccgtttagacctacatgacactcataacaagttcggggactcaaaaatgtattttgagtgtctagatacctagatgacacatctgtgcaagtttaaacaccgtccatgcacttcactcaatttttttctttgcacataaccattaaccaaaatgtcactaacccttcaccaagagtgcatctgtgcatgtcaacaggatggccatgggcatggctgaacaaagccttgtatcccattgcatgccactggtatgaagcacctaattttaaccatgcttctcttctcaaccccccccccccccccctctatcttggttaagttacgttacccaactacttgaaaacaattaagtctttatatatatataagtagtggcacttagccagagagtgaggccacggctatctatacactatagcttagctagctagccggccatggcggcgtcggcgcttcaagcggcggcgatcgccgccgtcctcttcctcctcccttccctcttcgcggccgtcgcggcgcagtccaaggccaaggccttctgcatcagccagttcgccatcgccagccaggcgtgctccatcctcccgcctagtccccccgacgagcacgacgacgacgacgacgacgacgacgacgacgatgatgacgacgacgacgacgacgacgatgatgaccacgacgatgacgacgaccacggtggtggtggtgacgacgacgaccacggcggcggggatcaccaccgtgtgcgccaccggcaccggcaccaccgggaaccggggcgccgtggccacgccgccgtggtcgacctctcggcgctcgtggcgggcaacggcagtggcagcacgcagatcgcacccgccgtagccgggaacgacaccgagggccaccgcggcaaccgcaccgcccgtggcggccgcggcggaggccgcggacggcgccgcggccatggcaggcgcggccgtcttcgcggtgacgacgacgacgaaggcggcggcggcgacgacgatgaccaccatgacgacgacgacgaccacgagcacgaccacgacgagcaccacgacgaggagctgagggcgtaccgcgactgctgccggtggctgcaggaggtgtccaaggactgcgtgtgcgacgcgctgatgcggctgccgccattcctggtgaagccgcagcacacgtacgtggtgagggtcggaaggacgtgcaagatcacctaccgctgcggcggtgtctagccggcggcgacgtcgccgccggcgaggcgaatgcaagctactcgatcgtggttgattaccgagctgagtttgggttggcgtcacgtcgttgctcgcgtcgtcgtcgtcgtcgtccctctgttttaactgtctgtttttccattatggttattcatgtttgggcatttatttgttctcctaattagattattattatcaggtagatatatatgaaatatgatgaggtccttgactatcagctagattttaaaaatctgaacttcgggatttatgtttcaattttgggtttcatgattaaaaaatcaatttaattctaagaattttaatgattcaggcattaaaacctcagattcttatcataggattcataaattaaatttgaaatttaaattcacttgacgaacttcaatttaaacttgttcttttttctaaacttgaaaaaaaaagatgtactagtaattgtggcttgcgattagatcaaactacgagctctaacggactgcgaaccgagagtaggagacgagatacagaggaagatattctcatatcagtttgcagtggtctaatagccccaattaacttgatggaaatagcagcaacaataaaatagaggaagggtaagagaaacaaatcctctaacttactattatctgattttgagttactgatatgtgaacccactactggtggccaacatatcagtaactcatgtgagaggataatgcgtcaaaaggagtttcttcctagctatttgtagatggttttctgctgtatcgatcgcccgatccatacagcagaaactaaccgagccaaatcaagcagcagcagatcgagcaggcgccaccactcttgcatgattcaacaagccggcccgagcgcgcaccggccggcagctagcagttgcatgatccatcgggtcggcgcgcggcgcgggcgtgcggagagcgcgcgcgcgcgcacgcgcgctgaggcggcttcatcttggcaacttacccggccgcgcgcgtacgtgcgtgcgagctcgtcgtctcgtctccgtggaagcgcagcggcgcgtaccacgccggccggtgcggcgcgggcgtccaacggggaggagacgggggaggcgcgccggcgcgctcgccctcacggcgcctctgcatctggagcagccacgcaccggccgtacgtacgttggtgagctcgaatgattaatcagcggatatatacgcaaacagcttgaatgatggcatggatatattggtaccgatcgaggacgagcgcgccggaacgctccttgatctcctcgccggtggacgccgccgcgcacctgcaggggtggtacacgccgctgcgtgcccacgagacgtactgcggtgtaccaacgcgcggacacggagcgcgcggacgacgaagccccatatatatagcggtgcacggagtctcggtgatatatcaaagtcacaacaaaataaataccaattaaatatttttaaaaacaaaacgaattatcgatatctaaaaagtcaataataccatatattaaaatataaagatagtagtactgggtagaaactggtcctctcacgtaaaatcagaaggacgtgggttagtgacgcataaagttcgcttgatattcgcattttcgtatgaatgtaataattaaaattttagaagcacaaaaactgctgcctcgtaacaatctaattaatattgggttattctattctgtttgtcaatacgagccatacccaaatattaataacattatgctttttacatttatctaatatatattgtggcaaaataaccgtgcttactctgctagtaccagaaaagtgctcaatagtcgccaaggttgcgtaggctactattacttgggttacttcatttgtttccaaacatttctccacattgactttgatgttttaacttcgaaaagaaataacttttaaatggttagattatgagacggaagtttcttggttgtatttgtgtatgatgaaacaaactgtacactcattgtccggtgggtacgtagtttatccgtcatgatcaaaatttaaattttcaaaaattaatcttagaattgattttgggattctattattgtagtctattttccaagtccagcttttaaatcgctataataatataaatataaaaatttacctacaaattatttttaattactttatttatttttctatggcttatcagcctcatccagccgaacagttaagcatttataaatttattgctaaaagaacatgccaaattttaaatttgaacaatatctggtcataatattctaagattaatggagataataattaacgaagaagcagccatatatacgtaagccatatataccaagaaggcttgaccacaagcattaccaaatcttggtagcgaaacgaaatggtcggcaaattctgttggcaatgccaaattaaatttcagtaacacttattttggtaataaccctattttagaacctttttgcttggatgtggacacctcgtaggatcacgcaagacctgttctattcagtgattcgtatacctcataaatggttaggggtgggcgttcgttttcgactttctaccggccgagccatatggaaatggtaatcgaccgaaacaaaaatgaaaatggtaaaaaatatggaaatgaaaacagaaatggttttgctgttataccgatcgtttccgtatttaccgtattcttgtggaaattaccgtttcttataatatggtaattaccatattctaaatatgtcgatatttatagagcatgtctatacttgacccgcagcttacatattgactgactcttcaatcaaatctctaacttttgtacatggctaaaatgaagttaatttataatttatatagtataagcttgaatttatgtatacatataacatacttatgtaaagttaaatatatgtttttatagtttaatgtatccgtatttgttacctgtttccgatctgtaccgacatgtttccgtccgtattgttccgttttcggttttccgatatttccgatatcgttttcgtttccgaatttaccatttccgatttcatttccgagaaaaatatggttacggaaatggttgaggctgttttccgatcgtttccgaccgttttcatccctataaatggtaacctgagtactcgaccttttctccttaaatttggatgcgtggtagttaagatgttgtgcactcgtgttctgctaactaatatcggacacaagatgactagatgagtcgtgcagtacactacggcttcttgagatagccaaaactcgaaggatgaagggtacgtgtgcaagaatccacagattaacaaggaaaaaagacgctccctgacctcgattgatccttgtgacgtcttcttttaaaaatatagataacaggtacgtatcatatgagttatctccagtgaagtccatagagtatgtactccttttcttttactttatttagaggtgatttgtaggcggagctatatggagagttatgccttgtgctgtggattgatttgcctaggatgtcaaataatcaaggcctaatttctaatttctaaagcgtcgaaatattacaaatctgtctggtagaagtggatgtggttaggatgcatactccgaggaccggcgagggtcaacacacacgggtgctcgacaggagggattggttgtcatgacagtttctagatccgatggagggatgggttgttggtgtggggatgagatggccaagcagtgagataggggccagaggcagtgactaaaggaggcgcgctcagtaggaggcggcgatgttggagctggatcggagcacatgactaacataggttgcagtggcacttgattaaggagggggagagatggatggtgggctaggtaggatgatagagaaccttcgacttctttacgagacggtactaggaatcaagacgagatgatataggtctaaagaacccaaaacccaaaaccactactggacatatgagattggtcaacaggtctggttggaagctccagagttgggagactcttgccacctcgcataggtaaagggaatccatggctgaacgctagatggaaattagactaaggctgaattgggcactcacctttttcaacttatacttcctcttttttcctgtgtgcacgctttctaaatttctaaacaatattttttaaaagaaatctaatccattttcaaattatttttttgctaatgtttaattaattatatacgaatggatcgctctattctatgtgcggggtggtggagttcgtaaccttcgcctcaaaacacagcctaatggcgccgtaaggagcaagtgacattgggtgacgaggctgaagcaatagttgatgctagaggtggatgacggggctggagtggcagctgtcatgaagtgtggccagccaatggatccaggaataaatagcaagggatctgaatgaactagacagagctacaactttcccttcttatttatgtatgacaaaataaattagtgggagctttgtgggggtttctatagttcttgctttagtagaaggcttgaacccttgctgtccccctggtagatatacccccttggccggtggggttggccatggaaggagggggctctcatgcaatagtttcatgagctatcttttatagtttaacggtggagcaaatttgatgcagtcatagcaatgccacttcaatcaactacaagaaaattaaatggatggagcggttcgagcctatggatgcttatgctagattacctgtcgtcttagtattacggatttatacaatggacggggtaatattatttcgtattatctaattaccacaagtactgtagcgtagctatacaaattaaagtcggtcccttgaccccctatcttaacacttgtacagttaagatagcaaatcgaattgaagaaaccgagcgaaaaaatagcaaatggagtagtacataattacgctttttccatcaccttggctgctacgtaagcaccgagtaggaaagcggcgaaggatctgtaaaacataacctcctcctctaacttgcgtatccttgctgcattattctgcgacgccgccattaccgtttctgttacttgccgctgccgcgatgccgtcgtcgccatcgcccttgccgcctgtttgttggctgaaccactggcactaccagcagcagctgcgtgcgacgccgagacgttgttgtaaccgcgaactgctcccgcgaggccactgccgctgccgctcctggcatgctgggtgaccacgcgtgctgccgcttgacgcgccaaccgctgcatcatcatcacggatccactcatcttgatcgatcgatctctcgctcgctatagtgccgatcgatattgatcaattgactctacgtgcgtacgggggtaaaccaaaatatatagtagtactggtatacgtatgtaggcgatcgattcagctacaggttgtccgattcgaggctggtccggagaagccaatccgagtctgactctggtccggagaatccgattcagggagtgtctgatcccggttgctagctgctgcccagcagcacagcttgtcggcgaatcagacggcggcggcggttagctgcagccgtcaacaactcgccgctcgtcgtcgatcaactctcccgctaagtttgcttcctctcttggagtctaaagatctacttcattgtttagactcgttgttctaggtggagtcgcatcactacgtagatcgactcttttttatgaagggagtagacaaaagattttacttgttaattacatatattctccttttcatattatattatatatacgatgttttgattttttttatgaaactatttaaagagtgaattgcatcttgggctagtgtttattacatattgacggagctcgtggctcctcaccgggagaccgcgcaggcccccctttgccggttcggccgggggcttagggtgcgatctcaagctctctctgtatgtggaaagatgctcgccggcaagacacacgagacacggccgatgtatacaggttcgggccgctgccaagcgtaataccctactcctgtgtttttgtggatttgtgtatgaatgagctacaaagtgagagcccacttctcccccgctctaggctctaaatctggcaagaatcaaccaaccctttctctatgggcaaggtcctccttttatacttcaaggggataccacatgcacccttccctttccaaactggactgttcttcttctctttaatgggcggagattggtatggttgtcgtccaaatgacacttcgatgggacagctcacacctacctccactcccggcggagacgggcgcaacgtgagatcgtggctgcccgttgctgatgcgaccagtgtcagaccggtcattcttgtccaccacgcgtcagtttaacaacgtgcatgtttgcccttcttcgtgtaacaccttgcctgtaatgattaggatgaagcctggtataaatctaaccagggctaacgtgccatctctaagagataacacgctagctccggcttgagacgagttgccttgaggctttcgtcttgacgggatggggcgaggcgtgcgtcagaccgccagtcgccacctaacccttgatctgaccggtctgtgactggtcacagaccggataaaagagcgtgctgtactgcgttgcacgcagcgtgacacgcttgaccagactgcaataaatgctgttaggtgagcacagctgtgctcacttatcccatatatgtggcgcagacttctttaaggggtcgggggtgccccggccctcggggccggagcaagcgcaacccgacccccccctcaggggaaatcacgaggagggcggacacctcaccctcgggcccaacgtccccgaaggtgccaggccacgtgggcgattgcgtctgcctcaagcctctggtcatgatactcccggtcccatatcaccgacagtagcccccggcgttatgccagagcaatttcctttcccaagggaagcggtcaagtgtgacgccacccctaaagcctggtgacaggtgggaccggtctccgtagttgggcaaaatgcccaacggtctcaatccatgcacattggtattgataactttggttgtccataatgggcggtctattcaagactgccacaccacttgagcagcgcgcgaatctgggtgagcagatttgtctcgcctggagatacggtaacgccgcttcggacggcgagcgtaattaacgcgcgcacgatacaatccatttcgattgccacaaccgcatatccacttcatgcgccgtaagcgggcgaatgggattagtggaagcgtgggcacgggaaacgagggagcgagatagcgagatacgagggagcgaagtagtgggcgcgagaaacgaggagccaggcccagcgattgcaagggtataaaagcatcgagaaaaggatttgctcccttcctttcgccattgttcctcttgccttcgccgcctgagctctaactctttctctgctacgccctactttcgccacacacgctcgttcccaatcatctcttcctccaccgccatggcacggggctctgctctgctcgacggcagtgtactgccgccttcccgcatcgtgaacgagaggcacgccggactgccgcgccgcttcatgccggagtccgccaccggtcgggagatagtgatgctgggcgaggggcgcccggcaccagactacccggggcggtccatcttcttcctccccttcgcaatggctgggctggtcccgccattttctcatttcttcatggatgtcctggagttctacgatctccagatggcgcacctcacccccaatgcggtgatgacattggccatcttcgcacacctgtgcgagatgttcattggggtgcgcccctctcttcagctgttccggtggttcttcaccgtgcagtcggtgtcaccgccgtcggtggttggcggctgctacttccagccgcgggggccggtgttgaaccgctacatcccctgcgtcctccgcaagaagtgggacgactggaagagcgactggttctacacccccctcgccgacgaagcgcgcctccgacttccaagccagcccccggcgcaggtctccagctggcgggcgccggtagatctgggggaggagtacgacgccgtcctcgaccgcctggcgggcctgcgatcccaggggctcaccggggccatggtgttcggcgattacctccgtcgtcggattgcgccgctccaacggcgcgcccggagcgcctgggagtacactgggcctgaagactacatgcggacccaccagggagccagatgggattgggctcctgaggacttcaagatcgtagtccaaagggtgctgaatcttagctccgcggaggcgtctcgccttcctcaggagatcctccccctctgcatagatcccgaccgcgtctccattctaaccattatgttgggggtcggggcctcagaggagagagcccctaagggccacgacggcgcgggcgagcgacgccggagggaacaacctgccccaggagggggtcgtgcttctgggccccgcgtcgggggctcggggagcagccgccctgccgacgcccaggggaagaggaagctgggaggtacacctcccccatctcctccccgagggggcagggcggcgcgtgccagcagtcggcgcccggagggggccgcgccgacgtcgcagcccgagggggtgcgcaagaagaagcggctccgcaagacgggggagacggaaccgtgccggggaaacctgatttcccctccaaggtggtcattcaaccgaccccctcgcaggttcgtctcactctcattgcaaccatctttctccaaaaagaagtttttttcttgctcactttgttcgtcttctggctttttttttctgcttcagcgatgtcccgtcgcattcctcccgccaccccaagtccggccagtccgaggccgaagatccagcggccgcagaggagcggaggcgagagtctgaccggcgtgaagccgcagcccgccttcgggaagctgaagaggccgcccgggaggccgcccgggttcgccaagcggaggaagctgctcgggaggaggccgcccgggctcgccaagccgaagaagctgcccgggaggaggccgcccgggctcgccaggctgaggcgtcagccgctgctggcgcgtcacttgggcccactccctcgggcggccctcaggcgacatcctccgaggcggctcgcgacgaggccgcgggcgcatcgcctgggcctacctcaccgggcgacgcccaggatcaaacgggcccgggggacatccccgagcccagcgcatcctccggggggccaagccgcgtcgccttttctccaaggcggctcttctcctcatcttctgtcgccccgctgagcgccgagccccttctgcaggccctggccgccgcaaacaccgcagtgctggatgggttcaacacccaagtggaggccctgcgcgcagaacgagcggagctcgaggccgcatgggcgcgtgttgaggaggggcggcgctcggtggacgccatggtggaggtgggccgtaaggcccaccgccgccacatctcggagcttgaagcccgcaaggcggcgctggcggagatcgcccgagaggtggaggaggagcgagaggccgcccttgtcgccaccaccgcgatgattgaggcgcaggactccctcccgcttcaacacgggagctgggaggcggagctgaagaacaagctcgacgccgcccaaggggttcttgactccgctgctgcccgagagcggcgggcaacggaagccgaagcggcgtcccggcggcgcgaggaggcccttgaggcccgtgccatggcgctggaagaacacgccggcaccgtggagaagggcttcacggaccgcgaggccgccactgctctccgggagacgacgctggcggcgcacgaggccgcctgcgccgaggaggagtccgcgctccgccttcgcgaggatgtactcgctgagcgggagcgagctctcgaggaggccgaggccacgacgcaacggctggcgaacagcctctccctccgcgaggcggcgcaagaggagcaggcgcgccgcaaccttgaatgcgtccgtgccgagagagccgcgctggagcagcgggctgccaacctcgaggcacgggagaaagagctggccgcgagggcgcgcatcggtggggcggctgcgggcgaaagcgacttagccgctcgcctcgcggctgccgaacacaccgtcgctgacatgcagcgcgcgctggattcttccatcggggaggccgaggccctccgcttggcgggcgagatggggcccgacatgctttgggactcggtctcccgcatggatcgcgccggtcggcaagcgggcctctggaaaggccagacgaggacgcgcccttgcaacctggaaggcctcgctccgcacctcaacaggatggcctgggtcctcgaacgactccccgaggagctcgagaagaccatcaagtcatcctcgagggacctcgcccggggggcggtcgaactcgtgctagcgagttaccaggcccgggaccccgatttctctccctggatggcgctggaggagttccctcccgggaccgaggacgacgcgcgcgcgcgggtcggggatgctgccgaccacatcgtcaacggcttcgaggggtcggcccctcggctcgcgttcgtctccagctccgacgaggagggcgacgccagcggtgaggatgacggtggcgacgaggccggctacccgggcgcatcggaatgagcccccgagcccccgccaatctttactttttttctttttctttcttctaaggccttcatgcctcttttttgtataaattaactcaatctgcaatcagaaacgaaatgatgaaaaaatttttgtgttagttttattttgctatacatatgcgatgaggatgatctgtgccatggtccttttgcgccttagcttgaaataagggctcgtgcccaagtcccagtcctcgaatggctcgggtcggggccagtgcctggggagatccacatgtcgagactggccaggccgggaacgtggtgaccgaggggtatgggtgacccgattgtgggtttttgccgattcccccccggagttcaccacgccccggggcacggctcggttctgggccccgtttggcgattttagctgaccgaaccgagcccccgagggtggggttgagcacgaatgacattatttcaagtcaagattcctcaaaaggaaaaaacggctcagacacaacctttagaaaattgaaactgcttctattgaaatgctgaaataaaggaaaaaggaatatatgtgcatgtgtggtagcccccggctaacccggcacacccgaggggggtgtggggttagcccgagccaaaacctgacacccgaccccccccttcaggggtagaagcgacgaaggtgttcaatgttccacgggtttggcagctccgtgccgtcgcccgtggccagccgtaccgagcccggccgggggacaccgatcactcgatacggaccctcccacattggtgagagtttgctcaatccagcacgcgtttggacgcggcgtaggacgaggtcgtcgacgcagagtgatcgggcccggacgtggcgctgatggtagcgccgcaagctctgctggtagcgcgcagctcggagggccgcgcgccgccttcgctcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggttcgcccagagcaccgctggcaactcctcgatccatgaatcgccgtgcttcttgagaatgttgaaggtcttggttttgaggcctttaaggatttctgcattggcgcgctccacttggccattgcttctggggtgggcaggtgaggcgaagcagagcttgatgcccatgttttcgcagtagtcgccgaagagttcactagtgaattgggtgccattatccgtaataatacggttaggcactccaaaacgggccgtgatgcccttaataaatttaagagcagagtgcttatcgatcttgacaaccggataagcctcgggccacttagtgaacttgtcgatcgcaacatacatatactcaaacccgcccggggcccgtttgaacggtcccaggatatcaagcccccagacagcaaatggccatgacagtggtatgatctgcagggcctgggccggctgatgaatttgcttggcgtggaactgacacgctctgcatcgccggaccagatcgactgcgtcattgagagctgtcggccaataaaatccttgacgaaaggccttgccaaccagggtacgcgaggcggaatgggctccgcactcgccctcatggatgtctgcaagaagctcaacgccttgttcctgaggaatgcacttcaggaggattccgttagccgcgcgccgatagagggtcccttctaccagcacatagcgtttggaaatgcgttgtacgcgttcactcccttcgcggtcctcaggtagagtcttatctgtgaggtatgtttggatctcagagatccaagcaatcaatctaagggagcttggagcgctcccttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcggcaatcacattatcccgtctgggcacatgccgaagctctatcccgtcaaaatggcgctccatacgccgtacttggcgcacgtaggcgtccatctgcgggtcggagcaccggtactccttacagacttggttacaaccagctgagagtcgcctaacaccaggaggcggcggatccccagcccggctgccaccctgagcccggcaaggagtccctcgtactctgccatattattagtcgctcgaaagtcgagacggaccaagtatctgaggacgtctccgtttggagaggtcaacgtgacccctgcaccggcgccctgaagagacagagaaccgtcgaattgcatcacccagtgggcggcatgaggcagctgtgaggggttcgcactggcctcgggcattgagacggtctctggagccggggtccactctgccacaaaatcggcgagggcctggctcttgatagcgtggcgtggttcaaagtgcagatcgaactcagaaagctcgattgcccattttaccactcgccctgtaccctctcgattatgcaagatttgaccgagggggtaagacgtaaccacagtgacccgatgcgcctggaaataatggcgcagtttcctcgaggccatcagaatagcataaagcatcttctgggcctgtgggtatcgggtcttggcgtcccggagggcctcactaacaaagtagacaggccgctgcacccttcggtggggccgatcctctttgctaggggccgtacccccggggcgttcttcgtccaagtggccccttggggcgcactcgtcttctgtgccgatgacctcggggtcggaggacgacaggagcggccttcccacagtggcctcggggccgtcctgggggtcgggggctcctggcatcgtcggacaagcgggcaaagggccaactccggtcgtcaggggcctctggcctccgttcggctcgggggcctcttctccctgctctttcccgggtcggctcagcacagggttagcctcggggtcaaagggcgttaagtgcggccttcccgcagtggcctcggggccttcctgagggtcggggacacccagcaccgtttgacaagcgggcagagggccgtctccggtcgtcaggggccttaggccaccgtttgactcgggggcctctcctccctgcctgctcctgggccaagtcggcacagagtgggggtgcgcagaatgaggattgtcctcatcgcgctccacaaccaacgctgcactaactacttggggggtcgctgctaagtaaagtagcagggactcatttggctccggggcgactagaaccggaggagagctgagatacgccttcaactgggcgagggcattttcagcttcctccgtccaagtgaacggccccgagcgcttgaggagcttaaacaagggtagcgccttctctcccagccttgatatgaaacgacttagggcggccatgcaaccggtgacgcattgcacatccctaagtttgctaggggggcgcatccgctcgatagctcgaatcttctcggggttggcctcaatgcctcgggcagagaccaagaacccgagaagcttgcccgcaggtacaccaaacacacacttatcggggttcagctttatgcgggcggagcggaggttctcaaaagtttccgctagatctgaaagtaaagtttcttggttgcgcgtttttacaaccaagtcatcgacatacgcctcaacattacgtcctatttggctacccaaagaaattcgagtagtacgctgaaaagtaggacctgcattctttaacccgaagggcattgatgtataacaataggttcctacgggggtaatgaacgcagttttttcctcatcctccctagccatgcgaatctgatgataaccagagtatgcatctagaaaacacaaaaggtcgcaccccgcagtggagtcgacgatctgatctatgcgagacagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagcctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggcgatccgctgcctcggggcggtgggggcagaggtgccaagcctctcgtcaccaccctcgggcttggtcgcggcagcgaggtggtccgcgcgctgctccatgcaagcaagcgcgactttaaggtcgccacggacagagatggggccaccagggcccggcatcttcatctggaggtaggcataatggaccgccgccatgaacttcaccaacgcgggcctccgagggaccgcgttgtagggcagactgaggtccgccacatcgaagcttacccgctccgtgcggaagttggcgggtccaccgaaggtgaccggtaggtcgatgtgacctaatggccacgtgtgccccggcgtcacaccgatgatcggttgagacggctggagcaccatccccggggccttgatagcatcaaaggccgcgggggaaagaatgttgagagccgctcctccatctatgaggacacgtcccaacttcacgttgcagatggtgggggaaaccaccatcgcaacctgccctccccgggcaatgcacggtgggtggtcggtctggtcgaaagtgagagcgacctccgaccaccgcgcccgacgcatcgcctcatgagtaggggccatggtcagaagctctcgcttcatagccttgaagctccggcgagagacgtgagcacacgctcctccatcgacggtggcaatggtggccccaggttcttggaaacctaggtcatcatcaccatcatcgatgtcaacagcgggggccttctgcttggcctcacttcgccgtttgccggaaggaaccgccggggacttgccctcacggcgttcctgcctcctgtcctcctcccacttcctcgttcgctcagccaaaattttgactgcgcgacagtccgcgagatcgtggagggaggtgttgtggacggagcaccacctgccggcgggacgctccctgctgggagtaccagcctctttctttttgtcgctcgcaggcctcccctttcgggtggcccgcggagtgccctcgacggcgaggacatgaccctcgtcgccggaacggtccgacctcttcttcctcctcctgtcacgccgccctgtctgagcggtggatccgggggcggccgaagctgccactccggaaccggaggagttccatgtccacgcttcctccttacgagccactcggtccgcgagctgaaaaagttccgcggtagtctggggctctttggaggcaatcttttcgagcatgcggttgtgccgcacaccccccctgaacgcgtaaatcaccgcgtgtgcagggatgcatggtatagtattgcggacttggcaaaaccgctgaatgtacgagcgaagcgactcattatcgcctcgctgtactgcatgcaagtccgcttcttcgcctgggcgcggatatgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcgatcccggtcgtatagacctggagaaactcggtggggttgacgctcccatcgtacttctcggtgatggcgggccggaaccttgggggccaacggacattccgaagactcgccacaaaggctctacagccaacaccaccagccggaggcacggagggctggtcctcacgtccatgtcgaggtgacactctggacgaggaggcaccctcgtgacggggggtacgccggctattacgccggcgctcgatgttgaggcgggcatccggctccccatgctgatcctcccgagtcgaaggcgtcgacgagggagtagcagccgaatgacgtgcagncgccgtcgttcgtcgngcccttcgctttgacgacacggagccggtggtaggcgcgcccgaggtcttggtggtggcggacggtcaaccagcacacaagcgctggtgagccgtcatgacc

SEQ ID NO: 7374 - DNA, 1177 bp, Oryza sativa
ctcccgagtcgaaggcgtcgacgagggagtagcagccgaatgacgtgcagccggcgccgttcgccgcgccctccggcttgacgacacggagccggtggtagcggcgccggaagtcttggtggtggcggaccgtacaccagcacccaagcgctgtgagccgtcatgaccaagttggccacgtcttccagccatcgttgggctggagactccgggtcatggacgacaggcgggtgtcgtaggagcgcgccagcagcctgaagcgcgccctgaggcgtgctgccgtcgccgtagacgagaaggcgacgctccccatctcgccgttctcctgcatcacctgcggctggtgacgccgcggatttgtcgaccctctcaagcgcctccccctgcttaggactttggcgcggaggaggtggaggagtacgagctcgacggcgtggattcggctccccgtcgtcgccgctcacactcggcgagatgtcgtgcgtttttccttgctcggccattaggctgaacaagaaaaacttggggcacacggaagagtctgagagctcagaaagcacacgctgagacccctacctggcgcgccagatgacggagctcgtggctcctcaccgggagaccgcgcaggcccccctttgccggttcggccgggggcttagggtgcgatctcaagctctctctgtatgtggaaagatgctcgccggcaagacacacgagacacggccgatgtatacaggttcgggccgctgccaagcgtaataccctactcctgtgtttttgtggatttgtgtatgaatgagctacaaagtgagagcccacttctcccccgctctaggctctaaatctggcaagaatcaaccaaccctttctctatgggcaaggtcctccttttatacttcaaggggataccacatgcacccttccctttccaaactggactgttcttcttctctttaatgggcggagattggtatggttgtcgtccaaatgacacttcgatgggacagctcacacctacctccactcccggcggagacgggcgcaacgtgagatcgtggctgcccgttgctgatgcgaccagtgtcagaccggtcattcttgtccaccacgcgtcagtttaacaacgtgcatgtttggccttcttcgtgtacaccttgcttgtatgataggatgaagc

SEQ ID NO: 7375 - DNA, 79000 bp, Oryza sativa
  unsure (1)..(79000): unsure at all n locations
cccccccctcaggggaaatcacgaggagggcggacacctcaccctcgggcccaacgtccccgaaggtgccaggccacgtgggcgattgcgtctgcctcaagcctctggtcatgatactcccggtcccatatcaccgacacatatgttgcatattggactagctagtagcaagttttttcactttagaccatgttttattacctaatattgcgttttggactattttagtgagcatgtcagtcaccaaaagcatcttcttccacctttcatccctaaagacaattccagagcatatgctgctaaatttggtgaggagaagtgaatgtttttttttttgaggtgaacgacggcaggagctctgccggaatttcattagaggagagaaaaatagttcagagaatacaggggaagacatcgaaggagaagaagggagaaacctgaaaatacaaagggaatccgaaaaagaaaagacaattaggggggttggaaagcagtgtgtctgagatcaagttcttcctttactattctcgcaacgcgatcctctgtgtaagagatgttttgaaaaattcttctgtttctttccaaccaaatgttccaccaagtggcgagaagagatcctttaaccctgaatttgaaaggtttggggtgtagttgattgagatcagcccaccaagctgtgttgtcatctgcaggctatgcccccgggatgttttgctattggcacaccataagccaaacttttctgaagaaggggcagacattaaagagatggttagtgtcttcaaacgcctctccacacaggctacaaatccaattgcaaggccagtgccggtgcaaaagattttgggccgtgagagttttttagtgaaggattagccatccaaagaagcgcatctttggttcagctgggcacctccaaatggaatgaaaatcaatcggagagaaggacccttggaactgaaataaataagcactgtttgcaaagtaggatcccgattcattcaggttccaagtgatgtcgtcattggtttgcggtagaagctgaacattttgcagcattcccccaagctggacaagatcgctaatttcttcaattgtagttatttgccgaaaggaaaggagccaagaattgtttgtcaattccgttttaaccgatctctgtttgcgcttagctaggttgaaacacaagggtgcaatgtcttttggacatgtattttgcagccatttatcatgccaaaatttgttttttctccattacccacagttatcgtagtggcagcctaaaagagtcttttgtcgcagtcatcacaaggtaaatccattccaacccaaggcttgttgtcctctttccatttgaaccagagccaccgtagtcttagagcgcgagaaaatttctcaaggtctggaattccaaggcctcctaaaaatttaggtctacagactgtaccccaattaaccaagctacttcccggatttgttttgtctgggtcttctcccttccataagaaggatctgcggtaacgatctattctgctgattacccatttgggagcttgaagggcagttagatgaaaggtcggcaatgcacttaacactgattgcacaagaattcttctcccttctgacgtaaagtagcgtcctttccagctagggagacgcgatccaatcttttcaattagaggcaagaaatccactttcctaagctttcgaaaatgtaaaggtaagcctaggtagcggcaggggaaggatttcaaagttccagggaaagaagtaatgacatgtgtcaagtcggtggtgtcgcaacagataggagaagtgaatgtgaaggtagctcaactggcacaggaccaaaggcaacaatgacaagcatgagcagtgtggtgcttgagctcagggcagcgaagaagttggagccttcagaaagcataagcgtggagaccatctgctcattttcctagtcattaaggagccaacgaacagaactatgtgggcactgggcaggggcggcttgatctcgttgtgccctgctcatggctacttgctcagatctgcgtggctcttgaagaatgttgtggcaggggtcaccaccattcctccatattcggcccaaaacactactaaggaggagattgagtctttattctaagtatccgggtggcaaagagtcattcgaacaggaaaacggtaaaataccattcgagttggaaaacactattcgagcaagttcttgctactaagccaaatcatatgttttgagtgttttctaagttaatgacaggtcaattgccaggtaagccgaaaagggtggtcgagatggaaaagacaacttgccgtagaaaagacccatggagaagacccttggtggtggaaaaggctctcggtcatgaagaaggcaatttgagcaataaagatgccaagagaatattctcggggaccacttgaacactctatctagcttgcgccaaaagactataatgacccctgaaatataccaaaataatcttgggattgctgatgtggcggggggcaattgtaatctcacatgggcccaatgaggggcacaattgtaatctcacatgtacagctatgaactatataaagtagataaaaagcctgtagcagacaggacatattggaatactaaaaatctcatcggtcaaagcgtgtgtacattttgtattcgggctcattcctcatgataggcgggaaaatggtgttttctcgtctatcccccaatcttgtccgtaaccttgggtcacaacaaagaagaagaagaaagagaggagagagatggggcagctggaggagaagacaggtacaatgtaaaacattttgcaaagaaacctggtctaaagtgaaaagtgtattgtaaccttagtccaaagtataacatgggtaaaaatacatggtccaatgtgcaattctctcttaaaaaacgtagtaatatttctaacacaaacaaatatattgtcaaaatatatcatgtgttagctttagtacgtgaaactaatttgttattgtatagataccactacatttttctataaattttaaatttaaaaagtttgacttaaaagttcaaaaaaaattataatgcaaaacagagggaagcaacaagaacaaaataaaataaaataaacagtcccacttgtcaggaataagagggtatgggtgagctacactgccctgacgcatcaatgggttgaataggacacatgcacaatgctccctcctcccattttaagtatagccatgatttttcatgcccaattttgatcgtccgtcttatttaaaaaaattttaaaaaaattttaaaaacataaatcacaagtaaagtactatacatgttttatcatctcataacaataaaaatactaattataaaaaaatttcaaataagacggacgatcaaagttgagcgcgaaaacttatggttgtacttaaaatgagacacagagggagtaagaaaaagaaggaagtgaatcagtagcgtgcgaggagaagggaagagaagggagatgggacgacttttggctcaaagcaagaagatggatttttaaagcctttcaattaaaacaactaggtgaaactccgcgcattgctgcgggaatttagtatgataacaaaaaaaaaataacgtgtaagatagctatataacatcagattaagtaaattaatgtggtttatgataatttaaatttaaatagtatgtagaatggtgattcaaacgtaaaaagtgaggtggtatgactttatggaagaaaaaagtagggagatagtttggaccatagattaatcatctaaaagctaaaaacaatttatgtgatatgacttaattagaggaaaaaaaggaaaaagataatttggaccatagattaatcatttaagcactaactaagtgaggatgaactaaataagtatataggatatcataaaacataataaagatattcattgaaacattatgtgaattatgttggatgataatttaacatgtttgtatttgaaaagctcttaaattataaaaagaataaagatatagcatgtttgcatgatgtttaatgtgatgattgttagtggatgatgatgtggcatcttgttaattagtggatgatgatgtggtatctttgcatgttaagtttaaggagttagtgggggataactttatagtaagataggaatacagaaatgctctccccttcattaaggccttgtttagttggaaaaaattttgggtttgattgtcacatcggatattcggacacatatttgaagtattaaacgtagtctaataacaaaacaaattacagattccgttaggaaactgcgagacgaatttattaagcctaattaatctattattagcaaatgtttgctgtagcaccacattgtcaaatcatgacgcaattaggcttaaaagattcgtctcacaatttacactcgaactctgtaattaggtttttttccacgtttaatactccatgtatgtgtccaaacattcgatgtgatgggtgaaaagtttttgttttcggaactaaactaggcctaaaaatgcatcctatgaaagaaaaattgcttgaaaatctaaaaaaaaaatatgagctacaccacaaatattataccgccaggcagtagtactccaatgagtatctccacggtatctaggcaggtgagatccatacacacatagtaaccacctaccctcacacggtcatgaccatgtatgttttaatgtcttcccatataatactttcagtgtcggacaatgaacaaagaaaatatttgatgagatagataactcagtagtctgctaatgaagcatatgttgcttatcatgcatactttgttggtgagctgaagatataccacggagttcaacattccatggtttaaataatttatttacctttaaatctatatatgttgtgagggtaattagaaaaagatcataatagttgacttcgtgaatctcaagatacacctaacaatgagaactccaatttatatatgttgtgagggtaattaaaatttattcttttagcgataaacgacttacatgtcactattgatgcgcttgtggtgacttgtgaatatcatgccgatttagttttagagtacttataagatagggtgtgcaagtgtgctcacttatataggcgcatgtgtctgtaccctgtttcaaaaaaaatcacaaccgttgagaagaaaaggtaacaagttcaaaatagaacaaaagaatgtgctttttttaaataaaacaaaatcaccctcacataaatattaatattttttaaggtaataaaatttcatgcaccattaaaattaagaggatgcttgtgataagaggcgaagccaagatttatagataggcggtgtcgagattttcagagactcggtaagacggccaaaactttcgggtttttggattggccatcaaaggagcacaacacgtcgacatgtcatgactatagatggccaaaaggcccgaggcccgacggcctggcccacggcatgacattttggcccagcccaagcacggcacggcccgaccaccgggccgtgcctaggccccccactggcacgttgggctggcccaaaatgaccgggacggcacggcacgatgggccgacaggccaggcccgacacacaaagaatagggactaaaaatagacttattttagctatatatatatatatatatatatatatatatatataggacactcatatggggcaccatggtgcccgggcaccatggtatctaatgcacaaaatcactcaaaattttcaaaatttttaaattgtgagtatatacctagttataataattcgattcatacctatacttatcaacaaaacaactcaaatttaactttatttcacaatcagtgattacgtacctaagtaattatatgtatggatgctatatacctagaatcaaaatctaacaaaaacaagttcaaattcagtacaaacatgctttgaactagttagtaaagtagttaatgttaatacctaagtaattgaaaaagtttcatactcatttgaattgggtatatatatatatatatatatatatatatatatatatatatatatatatatatatatatatataatatgtcagcccaaagaggagggaggaaaaatggacttattttagctatatatatacatatgtcacagcccaacgaggagggagagaaaatagacttatttaaaaaaaggcacgatagaccacccgtgtcttcggaccgacacgacacggggccgtggcagggctggaggtgtagcccatgggccagcacggcccggcacgaagtgccgaccgggccatgctggtccgatagctggtgggccgtgtctagccgtgcctaggccgggcgggccttatggccatctatagtcatgacccactcaccaaccgatgaagcctcaagtatgtcatgaagaagctgagcagccgaacagttgagactcggatgcaagttttattggctcatgcattttgcatctctcttttttagtattgctaatagttcttatactgagaaactatatttaacaacaaaccacctcattactatagaatacctaatgggtgccatttgagaatcccacatagatactagacttcgtaaccgacactgatgtggagaatcatagatgttggtgcacctttgaggttctagaaatgaaaaaataatgtggctcgacgcatcggcttcggctcgaattgagcacatgttttgagccaaggacttaatcccaatccaattacaaatccaacgcaaaaatttaatcctaatccatcacaaattagaataatcaccgaatgatatatagaatatcaacattcaacacaaaaggttaactacaaaaaccgaatcatagtccaccgaggctatcgcggccattagttgctcaccgaaggccaagcctatcaccatcgccactcttcgccagtcctcctcctcgccgtcgtggtggtgccgagctcgggggctgccggatctagcccccgcgcatccttctccacctcacgggacatgagagtagaggagaggagagggaggcacgagtggagaaccttttgtgttggtggaatcggatggccgctgcataggggagaggaagacgacggaggaagacgcagtcgctgttgcaccggggagagcgaaaaaaaccatcaccgtgcctatggtggttgtgcctagcagaggcgtccggccgccactcaccaaccaagctcgggtggggagacgagagagagggagcaaggacaaaatgatgagagcgaacgagagagaagaattggatattgatgacgatagcgttgggaggatagggatgagacttaaaaagatgtttttttttctcttctcccatgctcacgctcagctcggcttggctccaatgaagcgttagtttttttctttttactaaaccaacacttttattccacatataagtgttaaactttgcactaggatcacctaggttagatctagtcgggtggttctatttgggtttgatgaacgacattgtagatgaaagggagagggtttagataccgaccggttgaggagatcgtggaggaagaggcgccggacatcgtcgttgtcgtcgcggcttgacgtggatgcggcggtggcgtttcccgtcactggctgcgccccctctcgatcggattagggttttgtggggtggagttggcggcggcggtgaatctcgtaccatgtgccgtgccggcctccacccctcttttatatggcgcagtgtgacgggggcccaccagccattgggctgggcgcccccgatcagggcgcggtcaaggcccccttgagccgttgggctcaaggggagagagatctatctaacattctcccccttgatctcactttttcttttagctttttctattccatcacagatttgtaaatagagcatgtttcatcgtcacggtcaatcgccgatggattcgacagccactatacacatctctattcagaaacagatactttacttttgggccctgtagtccaggattcataaggcttcccttaaacccatgccggctacatgttccttgaacacgttgggtggtaggcctttcgtgagcggatccgcgagcatcctttctgttttaatgtgctcgagactgattgtttgatcccggactttgtccttcacaacatagtactttatgtcaatgtgtttggcagcaccacttgactgattgttgtgagtgtacattactgcgggttcgttgtcgcagtataactttagtggtttctcaatactgtcaaccacctttaaaccgggtatgaacttctttagccagttcacctgccccgttgcctcatagcatgctataaactcggcatacatagtagaccctgcagtgatagtctgttttgagcttttccatgaaatagctcctcctgccagggtaaacacgtatcccgatgttgactttgtattatcttttgcaaagtcagaatctgagtaccccactatctggagtgattctgatcttctgtaagacagcatgaggccttttgttccttgcaaataacgcaagactttctttaccaatttccagtgctctaggcctggattactctgaaatctgccaagtaacccggtaacaaatgccaagtcaggtcgtgtgcacacttgcgcgtactgtaggcttcctacagctgacgcatatggctttgttttcatttcattgagctcatactgatttctgggacattgcgatgccccatacttttcgcctttcattataggagcaggtgtagcactgcatctgtacatgttgaatttcttcaacaccttttctatatatgtcttttgagaaagtcccaatgcatactttgttctatctcggtgaatctctatgcccaaaacatatgaagcctcaccgaggtctttcatgtcaaagtttgaggacaagaatttctttgtttcctgcagtagactgacatcactactagccagtagaatgtcatccacatacagaattaggaaaataaatctcccattcttaaactttgaataaatacagttgtcctcgacattctcttgaaacccaaatttctttattgtcccatcaaacttcaagtaccactgtctcgaagcttgctttaatccataaatggatctctttagacgacatcccatattttcgtttcctttcatgacaaaacctttcggttgcgccatgtatactttttcctccaaatctccatttagaaatgccgtttttacatccatctgatgtaattccaaatcataatgtgccactagtgccattataatcctgaaggaatctttacaagagactggagaaaatgtctcattgtaatcaatcccttctcgttgcgtgaagccttttgccacaagtcgcgctttaaacttttctatattccctctggagtcatatttggttttgtagacccatttacagcctactgttttggctcctttaggaatttcttctaaatcccaaacatcgtttagtttcattgatttcatttcatctttcatggcttccaaccattcagatgagcgagcgcttctcatggcctcttcatatgaggtgggatcatcctccatatgcgactcttctatattataaactttatagtcatcacggatagccgatcttctgactctttcagaccttctaggggcctgcacatttggcacatcctgtacctgaggctcttgatgagtctcctgtactggcacattatctatttgaggctgttgtagctcctcctctggcgtggcaaccatttctgttgaatcctgtataacaggttcctcactctcattcattgttgccacaggaggggtaacaacaggtgctggtacctcaatgacaggcattgcaggcacaacatcagcaggtagagagaagaaaggttcctgagtcgacggagcgggtacagacacccgcctctcctcaagatcaatttctcgaactaccgagctccccctaatcatttcgtcttccaagaagacgtcgtgtctcgtttctacaaactttgtataactgtttggacagtagaaacgatagccttttgatctttcaggatagccaataaaatggcaactgactgttttggggtccaacttcccaatatttgggttaaatactttggcctctgcaggactcccccacacacggaggtgagttagcgagggtactctccctgtccatagctcatacggtgttttgggcaccgatttgcttggaactctgttgagaatatgaatggcggtttttaacgcctccatccataaaccgagtggtagtgtggagtagctcatcatgctgcgcaccatatccataagcgtacggttgcgcctttcagctaccccattctgttgaggttcgcccggtgttgaatactgggctactattccattctctagcaagaaccttgcaaaaggtccagggacttgcccataaggcgtatgtcgaccatagtactcccccccacggtcagatcttactactttaatctttatatcatgctgattttcaacttcagctttgaatatcttaaatttatccagtgcttctgatcgctctttaattggataaatataaccatagcgggagtaatcatctgtgaatgttatgaacgagtcatagccatccacacttttcacaggaaatggaccacaaatatctgtatgaatgatctctaaaattcctgcgcttcgttttgcaccctttttgatgctctttacaaattttcctttaatgcattctatgcattccaatggaggaagaatttcattcttaactagtctctcaattctccccctcgaaatatggcccaaacgacagtgccataatttcgatgagacatcgggagttcgctttcttttcttgttttcttttgtcaacgaggacacaacattcacattctcagaaagagataacaaataaagctcgtctcgcaacacagcaagaccaatacatgcattattatgccatagttcacatttgccacttccaaagcggcaatcatatccatcaaaatccaactttgatacacttattaagttcctttgcaaagaaggaacataaaagacatctcgaagtaaaagtatgaagccattcgcgagctctagaggaagatctccaacagcttcaactttttcttcaactccattggcaactctaatggtgctttctcttctttgcgtagtcctcgtcgaacggaatgcctttaaacaattacaagcatgaatagttgctccagaatcaatccaccatgtggatctagagtaaccaacataatgagattcatttacaaatgtaataatgttctcacctttctttgccatgatcattttcaaaaagtcaggacaatctttcttgtagtgtcctgtcttcttgcagtggagacattgatctttctcaacagcgaactgttgttgctgaggcagatgctgagactgtttaccttttgaggtgggagacttgtggttctttttcttatctttaacatagtttattgaaccaccatttgattctttgattctctcctcctcttgcacacaattagcaatgagcttctcaaagttccatttctctggacttatgttgtagttgacaataaaattgtcaaactgctttggcaatgaggccataaccagatggaccagaaagtcatctgttatgcccaaatccattggcttcaacttggaagccatgttgctcattctaagtatgtggtctctaacaccacctccattgtacctttctgtcacaagctgcttgatcagctgtgtagcataagtctttgaagagccagtaaactgactctttattctttcaaggtactctgagacagcgtcacactctgggatcgagcccaatatggtaggctcaatcgtattctttaccacagccaaacatttcttgttggctaaggaccatttcttttgttcaatgtcatacgacatgacgagaggagcattgtccctctgtctcttttgccagtcagcatctgactcattttcacctctgacaaggtcagcaggttctataggacatggggtagtcaatacccagtccacctctcccaagataaaagcaaggtcgagttttcttttccattctgcgtagttatctccttttagggtcggaatatctttaatgcaacccatcaaggagtagccacctgaaataatcatgtgcggtgagaacaaaattaacattaaaatattatgcattaagcctacatcaccgttgggcagaattagacataacacatataaccataactataatattgcaattaacaacgttggtcagaaaattacaacatcatagcacataattaatgttcctaaaattaaattctcccgttggttcgaaatttaattttagaaacactaattttcatcaatttcatctatttgcagcggaagactatataaaatcatatgaacagtagcaaaatctctgtaattctctctctgtgaaaattctcccgttggttcaaatttaaacagaggtaaaacatgcaaaaatctattcaaaattctattgaaatttgcatgaaaaatcgacaaaataaaatggaaaaattgctactgttctcttttattcattttcggccccgagggacctaaattgaacttttccggcctttgccggtcggcctatggccactttgcgcgcgggcgagcgccccctcccctcccccaggccgcaacctgggcctgggccgggaaagccgccgccgcgcgctccccacttgggccgatttcggtccggccgccgccggccgtccgatcagctagggtttcgatcggacggccgggcgccgagatcggaggatcaaaaacccccctctcccggccggccgccgaaaaccctagcttctcttctcttctctctctcacgcgaccgcgtggacggcgtcgccatcgccggcgaccttcgcgccgccgcgccatggccggcgctcctttcttttctcttctccgctccccccaccgtctctaacccccaccgtgtgagagagagatggcgacgacggagatggcggcgccgccgcgggccccctcgccggcacgcgcgtgcaggtgcgcgcgcggccgtcgagtggctcctaggcggcgcctctttgcccctccccccctccgttgccggcgtcaacgacggccggcgacgaggtaagaattagggttagggtttttggttcttttgatccgtgcggatcttgtgcttttctttctttggatttctttccccgaaacgatctaaacactagggttgctctgataccattgttaaactttgcactaggatcacctaggttagatctagtcgggtggttctatttgggtttgatgaacgacattgtagatgaaagggagagggtttagataccgaccggttgaggagatcgtggaggaagaggcgccggacatcgtcgttgtcgtcgcggcttgacgtggatgcggcggtggcgtttcccgtcactggctgcgccccctctcgatcggattagggttttgtggggtggagttggcgccggcggtgaatctcgtaccatgtgccgtgccggcctccacccctcttttatatggcgcagtgtgacgggggcccaccagccattgggctgggcgcccccgatcagggcgcggtcaaggcccccttgagccgttgggctcaaggggagagagatctatctaacaataagtgcaggtatattaaaacctgacacttttgttattattgccgaatttttaataaatcagcacatataaagtgttataggtgccctttttaatttcaatcccgcttaaggtgtcagtaggatgtaaaaagcctcacatatatatgtgtgtgtgtgtgtgtggattttaaattaacttggcacgtataaggggcatgcctgattcagctatcgattggatgcatgcatcactagaacacctggcatattcatttatttcgtcaccgccgcttgcattcttctatttctgcagcttaattaattatgcattacggcacacaacaatcacacacacacagaggttagctacatatggattctatagatcgattattgcccttttcttgcgctgatgctggaaaattaagagacaaataattctactagctacgtacgtagaaatctgcggcgacgagtgaccacctaattatcgagccatcaccctggcggcggcgacaccagcaaagtaaacggagcaacctctccaaaaggaagcctcgtagagtagccaacgaagcctcctcgccgcgtcctcctgcgacgtcgacgatggccgcggccctgcacctgctgcttcctctatcgtcactaccacgtccggatgtcgccgcgccgccgccgccgccggcgtcacgttcttaccaccagctgcagcgacgccggcgtggtggtaaccgcgagccgtagccgccgtctgattcctggcacgctgggtgaccgcgtgtgccgcttgacgcgccaaccgctgcatcatcatcacggatccactcatctctcgaccgatcaatctctctcgctcgctgtattgtagtgccgatcgatcaatcgattctatgtgtacgggataaactaacccaaaatatatatacaggcgatcgatcgattaaactactggttgtccaatccgaatcagattctgagaccgtctcgatgatctcggttgcttagctgctgcccagcagcccagcttgtcgcagcgaatcagacggcggcgccggcggttagttgcacggttgcagtcggcattggatctcgccactcgccatcgatcaaccctgccgtccgctacctttgcttcctctcttggaactaaagatcatcgagttccagacacgagattccacgtgcaacaacgaactacaataccttaattatatacttcctttgttttatattatacaatgtttgaattttttttcaatcaaattgttttaaattcaaacaaatttataaaaataaaggcatgtagtaacatttctatagatgtcggatttagtaaaattaatttggcgttatattagatgttgctacgctttcctataaaatcaattaaattttaaaagtttaaaaaaatcaaaacatcttataatataaaatgcaagaaaaccatcattaccatgaaatatacaaatatatataactatgaacatacattaattagtattggtttaatttgttttgtttacaaatttgaacatggaggctgtgaagtgatatattttgtattaattatattatcattttttctatatatatataggtggtataaaaaaacgagggaatgcatgtcctctccaattatgaaaatccatctccctatatttatatactagaactatttgtaaaatagcactccactgtgaataaataaggaaaaccttcttcctaatcatctctttaatttccccgcaaaaaaaatcatctctttaattaaactgatgacatatgggtcccacttatagtgactggatgatgttacttccatcacaaaacgtactttcgacgacatataattgtcactctaatcaaacgcgatctgcttgcactatatatattaattatagtagtagcactaacgctagccaacgccaagccactccattctaattagtattgcagctgcaccagctgcgccctcaggcgacacgccgccgtcatcggtgccaacgccgccggcgaaccggcggcggcattgtcatcgtcatccacggcggcggacgcctcgaggaagcggccgaccatctcctcgcacggcttccacaccaccgcctcccacgtctccctgtgcggggccccctccggcatgcgcgccaccaccaccgtcgcgttcacgcgccggacgtcccacccgttcagcgcgctcagccgccggatcttcgccacctgcgtcgcggcgaggcggtaggtgttggccttgatctcgcgcacggcgccgtcgagcatggcggcgagctcgccgtcgtcggccggctcgccgcccgagcgctcggccaggaggtacccgtgcatctccgggatcccgatggcgcggcgcacgccgcgggtgtagtagtccgcggcgccggcgccgtcgacgaacccggggcgcgcctcgccaccaggccgcgccgcacatgttggttcacgcgcgccgcggtgtaccaccgcagcaggcccggcgcgacgtctgtccacaggaagaggcagtcgtgcgccgcgcggaacgcgccgccgccgccctccaccagcgcctcgacgtaggtgttcgacccgccggccacgacggggaggcggcccgccgcgaggacgcgggcgacggcggcggccgcctcgcgccggaagtcctcggcggtgaagtcggcgtccgggtggaggacgccgaggaggtggtgggggacgccggcgcgctcctcctcggtgaccttgttcgtgatgatggggaacccgtcgtgcacctggatcttgtcggagttgatcacctcgccgccgaaccgctcggcgatggagatggcgagcttggacttgccggtggcggtggcgccgagcacgaagacgaccttgggcttgggtgactgtccgatgacaccgccgacgtggtactccattgatgaaggtgagctgctcaccggagaagaggtatataagccatcgttaattactttttgcaaagatagtaaatttacgacctaaaatgtacgtgcactcgatcattcttactcccccgtcccaaaatataatatacgagattttagatggatgtgatataagtttgttcagattaataatattaggatagctaagagcttgtgctttgtaacggacaacaaattgagtttctaatttattaaatcaattaacaaacacttatttagtccaagtactgagagccaacggtgaaacgggggaggactcgttaaaagataatgtaatggtatagattgtggggctcacacggtagtagtagagatggtgtgggaatggacaccaccagaactactaacattttaaggactatagattacatctacccaaaatcatttacattttgagatggaaggggaacatatactatatttaaatggttataatacattttctaaataaggattaccagaagacactataccattccagaatggaatactttatttctggcatcaccataacgccagcatggcacaaatttggtacttatatgatactagcattagacatgataaacataggaaccatatctaatatcggggtatcatacatgatactcataggtaacagtatttggtacctagatcccatgctgatgtcatgatgatgttagtaaaataaaccaccgttgtaacgatatagcatttttttttattttttttgttttcaaaaacagtaatgctgattgtaaatgatcagtttgatgctaaattacctatatatcatgataattaattgtctctagttaatttgttgtgaacgagaatttaacataaaactagcaatgcaagttcatggaacaatgtgggtgcacttccaaattatcatgcatgaaaaatacatctctgcacaatttgttaatcttacagtcgaaaacattaaatatcatgaaaagcattgacaagtaattaatcccccatatagattattcgcattgaacttccttattttactttttttaagagaagttcacggttcatgaatgaataataaactcatctgtggtcaattttccatcaacttcataaaaccaatctataccaaaggagaaaaggatgacagtacgtataaataaaaaggatgataacatctgctgttgtatgcatattctagctagcaaaattaacaaaatcaatcattaatattactacttcttgagggtaaacttcaataatttctttatgttcatcgtcgctagttattattcagtgaaactttaactttgttttatgttcaccaccttctaactttgacatatagcgcaaaacattatctcatatgtatccgcaaactattcattcctattgaacctatgtctggtgttcacatcatacaaggggtaaagacaaagcctagggcaattaggactccctaatcccttttaggtcctattgaaaagtaatgaaaagtcaaaggtaaaaacaagatgcattagttcggtcttaagtttatatatgacatggaaaaattataataacattgagatctatgtgaatgaaaaatattagcccttaaaaaaagcctcaacttagatatctaatatatcttacataaaaataaaatatctatcgctcaacataaggattacaaagaaaaaaaaatctttttagatcaaacaaaaaccacccatatatatggatctatcacggagacggggtttgagcgcccgctactaatatatggattattagagacccttgagcctccaaaattttccgacatagatacagaaaggccaaaaataagttggagctttgtctagttttttttagcccctgcttttttcccccctagatccacccctacacccacatattttttttgataaaagaaaaagaaaaatggatattaacaagaaaaaagaaaaagaaactagcattgcgacacaaaaccttgcaagcaaaaagcatctatactcatcttatcagttcaagctggattacgaaaaatggacggtgattaaccaagagggtaacacctaccgcgaggagatcgaccacagagctagctgctagccggccgccggaacggaatcgatagctgccggagtttatcaagtaccaacttggtcgccggaatcggtggccggagttgtacaggggtgaggtttattccgacgaggtaactgtatatagcctctcttgtgtatttatacagtccctgcaggacctatctggctgatgcagatatgcacagtagtataccgtgtcttaatgccttccataatcagataatcagaagaaaacatgtatctgcatatgtcgacctgtatgacagaattaattggtatcgaattttgagccagccaagaaaagcatggataacaatgcaataaatagaatcttggtcgaacagtcacacgaaaatagtacgggcattgtacagtgctatctcttggctgcagtgtatatccgtcagtaagagtgttgtaattatgtactgtattaattagtactagctatttgtgagaatatgtgagattatggtaaccgacgattgactttcctgttattcttgtatatatccagatatacacatccaccaattttctagccgttaatgttattcctatcctagctatcacccgtttcgagaaatctgaaatggtatttttctttaataaccttaattatcactccccggttgcatatatacacactttgaagtttttctctcccttttttttttagttttggaaacaattgataaatcgagaaggggttaaaaaagtactacattcatccatatatctttttagttatgaacttgaataggtcggctgagagaactcatatctagtttcatatctaaatatatatatatatatatatatatatatatatatatatatatataaggatggatagtgaagtttattgctctcaccttagaatctagtagcaaacattgcaaatagttactagataaatacaacgaaaacatgcacaacacgttcatacatcatactcattcacacaccacttgacctccacagcacattttttagttttggaaacaattgacaaatcaagaaagggttaaaaaggtactacattcatccatatatctttttagttatgaacttggataggttggctgggagaattcatgtctagattcatatctaaaaatatactttttttaaggatagatgtagtaaacaattttacagtgaagtttattgctctcacattagaagctagtatcaaacattgcaaatagttgctagctagataaatacaacgaaaacatgcacaacatgttcacacatcacactcactcacacaccgcttgacctccgcagcacgggaaatgtgctaccctgtgtaccctagctagccatctgtcctatttaccaatttcatcccacaaaatctagattgtttgagctacggttaataagaaataaaacaaataaataaaataatcaaaatagattgaatatacttttatacttctatttatattactagcacgtagtccaaaaaacaaggttgaaaaatagagaacaatttaaagccctaaaatcaactctaaaattaaattgtaaaaattcaaattttgattgtggcttgtaaaccagcgagaaaatttatcatgaggcggtagtaagtccaatggtaatatgttactagcctagttgttagcacaatccaataatcgtgcactatgaattgatatatgctcaactggttagattttttatgatgaaacctatctactcaggtttaaatctctgatgtagtatatgtgcccacattttacgatatttttgttgtttctaggtaactgatttacaaatcaacagcgaggcatctacggtaatttcgtcaatgtcacaatgtggtatctttcgagtatgtgatgtttatagggccaggtaggagtgtgtttgggtgttcatatcgatgagtataataatatcaatgtaggtaacgtgttttgaaaagaaattcaatcgtacaactctggatatctttttaagatacttagtactccacttaattgaataccaagtagaagtgaaagctcaattagttatgcaggctcccttatcctaaaacttgcatacttagatggaactcgtttacttgacatgcatggatatggatacttgtattttcgtagagtacttgggtgtaaagacgttgacggccaatctcttcatagacgtacgtatgctggtgccaggacgcatctgcatggatgtatatacgcgtgaatacggtgtgcgcatcagtggcggatccagggccccgacacgatttttttattttttatttttaattttaaaaataaacccatccaaattttattttcaagatatgaatcttttgtccacgcgagaacaatactgttacgccgctccgctggcgtgacagcgttatttggccacatcaacgttgcccgcgtgacagcattatttggccacggcgctctcgctggcgtggcaagataaaactgtcacgcccgctgcaagtgacatgctattattgttttgtcacgtcagacgggctggcgaggctaagaggttcagattttataaataaattttgaaatgatttagttttaaaattaaaaattaaaaagttcaaaaaaattaaaaaaaaaatcccccgacaccagcattggattagatgcttaaataacagtgcttagtcattagcccggctacacatgtactattagattagcactaattgtcatgtttagtcattagccagcagcttaactttgcttccgtatatgataaaatgctctatgtagttttaagaatttgtgtctacttgttaatttgttattatcgtcgttcggtttgtccagttcaagaaaacgtctaattaatccggtcaactgctgtgcatgggttgtgtccgacttagtaaaagaagactatatttatagtatcatattattttataaaaaatagtctatttttttactctacaattacaacaaattttaaaaattacaccgtaatcacagctgtactgtaatttttttctggtacagataacactatatataagaaattaggataaaaacaattgattgttttacttcaaagtttggaagggacagataggagacatataagcattagaaaaggtgactgcaatcaagtaaaatatatatacatcaacaacagtaaaactgtaaaataaaaaataagaaaaccacgatactccctccgtctcgaaatataagggattttggatagatacgacacattctatgtccagatttatggtattaggatgcatcacatccattcaaaatccataatattttgagatggatggagtagatttcaatacatcaactaacaaacatcggccagcctgacacattattcgtaccagaaattaagcctctagctagacctgatcttggtacaccacgggaagcccacagatgcagcgcttgcttgctttcaaccgatgcgcttagccggcgtagccgtagaccacgcaaggccggccggctggcctatcgatccattccagttgcagagacgttaattgcaatgcaatctctgccgtttttagtactgccgcctttcccccctatccactatccattatccaatccatctgatgaacttccttggtgaggtgaggcgcccaatcttcttcctcaatctgtaattttttaatcttcttcctcaatctgtaattttttttttgaaagattaacggcaggagctctggcggatatattagggtaaaaagagtcagacaaaacgaaaaacattaaggttcaaagaaaagaggggacatccagaaaggaaaataaactcataaagcctattacagaggagaagagaaacgactcagctgagacctagcctttaggcttatctcgaaagctcaattaaatcaatattttctttgatcgtgcaagctacttgtgattcgctttagcatttatgatggaagattcgacgattgcgctcgagccagacctgccaccatgttgtgagtagagcgccaatcttcttctttgctgaatctccttttgcaagaaaaatctaggaatcccaccaattcgaaatgggtgtgtcttgccaagattgtgggggagagattgtaaccaagccagctgcatactaaattccacacatttcttatgaagctgcattctttggccaagtgatttgcatcttcgaaagtgtttgtacacagacttcatatccagttacattgccagtgacgtctcagcaaattttccgccgttagggttctctaatgcaaaatgagccagccgaaaaaacgatgttttggttccgcctgggccttccataggggagagaagtttatgttagtgatcatacattagaattgtgcttcataagcgctctttgctgagtattctccattgggagtcgatttccaacgaatgtcatcgggggtgtttttaaggagcatgacttcttacaatcggctacccagccggaccagttcatcaatttcacttatcgtggtaatggggtttaggatcgccagccagtggttgttttgaaggctgaggtgcacattgtttcattttctcctggacaggttgaagatccctagagctaaatctttaggtaagcaaccctgaagccagttatcagaacaaaaggagcatttctttccatttcccagggtaatgactgttccagctcaaaaaagcactctgtccaattcatcacatggcacttcaatgttatgccaaggtctattatcttccttccagccaaaccagagccagtgcagccttaaagctcgcgagaatttttccaaattgagaataccgaggccccccaaattcctaggtttgcaaatgttctgccaattaatgagactactacccaaactgacattatctggatcatctcccttccatagaaaagcacgccgaaatcaatcaatccttttatatagccacttattcttattcctcaatctgtaatctttccactcttttgttctttctttcttcctgtttcgtgttgttcatggatcatctctacgactctacactcatagtattacgtttggggatgatggctctggttgattggtagtaattggtagtattctctagtttcaagctgtagaatttccgtgtgagattattggtcggtgaacattttgcacaaccctgcagtttccactttctagttacagatctgtgtgggggttgatatgtaattggagtgttatgggcgcttcatgggtatggattgttttagttcattttgggcactcctctgtacgtagagagaaggggtcgatcaaaaacggaagttaattgagaaatgaagcgactctagcctctaggactgtttttccgttcagtcgatattgtggtttcgattgatcattgcgcaacaacacaggttatagctaggagcaatgccaccaggaagcttctatatattctacctagtctgaaatataaatttcagttttgaagtttgaaaagttaaatcttttgtcataatatttaatatttatagccatcaccagccactattatatttccttttgagataatagtgtggaactaagagaaatgtaccatatgttataaacttacaatttctatactctctgtgtgcatttttttccttcaaagctactcaatacatcaaagaagtgaattgggtatctgcattgacacgggaaggaggaaactacggcgaaggccttagccctcggaccaacaacggcgacgcctacgggcgccgcattcttgttggggtgttgttgcgtttctcctatccaatggtttctttaggtgaaaaccacgtcctggttctctaggacggatgacggcagcgctcttagcgtcattcagaagaaccattcctctggggtgttgtgtgcttggtttatttttagtagcaagatcagacgtaaatgcgtgttgtgactatctttttcttttttttcctgactatagtcttccaggactatagacttgtatttttcctactatatcaatagaaatatcatactatcttgtgcgggttgtttaaataaaatgggtatctgcatttgtacaattgatataaaatatgaaattacaagatctatcaatacatatcacttgccatgctaagcttacaaactaattatcatcccttttttctcttctgctccaggtgtctaccaatacatatcacttgcctatccattccacttctatgactcggctacttgcttttctacgacacgtcaagccgagtcatgacgtgaaaatccgtggattaccctttatttaacatataagtaagttcgcgggtctgtccgtttgcatccataagcggtgaacctggcgagctggcaccctctgggagggcagcgacactggccgacgaacgccagcttcgttgtccggttcggctccgtcctcccggccaaggaggcggccttgctggctgctaccgtgccaggtcgctgagtatgtcctgctcataaagttccatgttgtgacggctatggcgggggagacgccgccattggcgctcactctgaccgagctgagcatgcggatcgaggagatgggcggtggtcggttcgacgggcggcgcagcctggtggtgctgaaggaggcactgggatgctgtcatcggagcggaaacctggaggaggtgatggagtcgtgtcatgccactcatacctgagggcgcaaagcaagctgagggaggagaagatctgcagcgagtgccggttcgacgctctgtacgtcgtcggtggcattgcagtgtttgttgccctgtgtaccatgtggtacagaaaaaacgctcgagagcttgtgaagctggagcagatgtatgatgaattgatgtattggccatattcttttctccaataaaaactggataaacttttgaataaaagtggcacgcttttcaaactgctaaacggtgtgtttcgtgcgaaaagtttttatatgaaagttgttttaaaatatgagattaatctatttttcaagtttgtaataattaaaactcaattaatcacacgttattaccacctcattttacataaaacacttaaactttatcttcatcttcaggagattcaaacaccaccattaaggcgtaatggatgatagggatttcagaaatgtttgttaaggaccacaggagtaactgtggactgggtagtttaaaatctagacggtaggtagcttctgagagcggtttcccaacttgtagcttttagttcattttctgaattatacaagttatcaaaataattctcaaaatctaaaaaagctatactattaggaaaagtttctatttggatagaaactttcagccccatgtttggttgtttggtagaataagccaaacggtatatttataaataaaaaataatttttgaataaaaatgttatatacatgatctaaacgatttaaaagcaaaggctgaaaaataaactacgatgaaaaagctctacaatcaactctaaatttaaggttgaaattcaaattttatcaataagcataagcgaaaagaagagaccgtttccaaacaaaccatatgtttaatcccaggcgatgtttgtgacatcgtaaccctgcatgttctgttattttggtaatgtggttagaataatacgaggtataatgaaactagaataatcagatttatccatgcaaaaaaagggaaaaagaaaagagggacaatcagaattgcaataagaatagaaccatgcataatcaccactcaacaataagaagatttatacagtatgacagtaccaggaatctcaatacaagagaaacaaaaaagtggaagtctgaacatcaatgtgcataatacattccaaaacctcgctagaaataaccgcttgtgccaaattgagggtaaaaataatatacacatggatggacaagaaccagaacaaagctcggaacaatgtagtgacgcccttggtgctgcatagagcagaccatgtacaaataaagaataccctgtaaaacttgggataacggcagagtaagccaccggccaatcgtcttcgaaacatgaccaagattgctggcaaacatggcctctcacgtaccatgtcaccaatcaagcaaaactagtaaacatgcagcctttgtagtgggaaagagattcatgcttcagaaaagatcatgcttccttttctgtagttcttgtttccaccctggctgctggtagaactcttccttcgttataccaaatacagtctggaattcgctgtccgacaaatatgtctgcagaagccgcacaaaagttagccattgaaactcatgcaggccaccattcacattatcaaggtgttcatatgaagcattagcagacagtaaaggctgtgattacagatggttgctagtaatggaccaattgtgagtttgccactgttttgttttaaactaagaatatctgttgcaattcctttttgaaggactagagcaaaaccacaaaaacaatactatcgatgtatcaatccttccgttgaagtttgaaaaaacaggaaaaaattgaagggtctggcagatagatgattggcaataatcccaaaaagggtctggctgaagccaaacatgtacatgcaaacagcaacaatgggggataccaaagaagaacatggtatcatttaattgaggggaaaaaaaggcaaccaaacctcccaccaattgagctaggctcaattcctataatctaaatttctttgagggcactatctagttggcttgctctacctttgagtggcttgcttgcatgttgcaagtcatgcacgaaataacaccaggttatatccacttggaatactgaaaccttgttgaactcactgcaacttctgttatgtactcgagttactaaacaacatatgcattgttactgtggttttactattacaaagttcctccaaagttttattactaaaagtcatttctcctgctattttatatggctgtgctcatatcattttttatgttgcacaggtaattaactcacatatttatgggtaaggtaagtgcttatccatttcacaaggtagcagaaacaacacataacacctactttgcttccaaggttgcaaggaaaataacaaacctctctgcgtttgtaatctatcccacgaacagggttggtagattttgatatcagccgatcatagctgaaggttgtttcacctccattttcattagcagtctgttccactgatacgtcaggctcagttcgccctccctcagataatgccccatctcctggggcatctttatcagcggaaaattctgatgctccttcagacagaggggatgcagcagacggagttagttcagctgtatctgcatcacctgaaattggcaagatccaacatcaacaaaaagaaatatttgttaactctaaattttgcaagcatcgtcttcatctactgttcttgcagttagtcaatgagtacagtatcgcccatccaaaatttacaaaacaatcaatgcacaacaatgcatcaaaagtctcacattataagcttacagaggacaataagcagagacctagggtagtgtttgcatctcctgaagataaagattaagtgtttcacgcaaaacgcgccatttagcagttcgaaaagcgtgccacgaatatccaaaactttatccactctttgtagtggaaacgaacaggactattcatgaaatatgtctagcaaaaagaaacgatgcagtgcctagaatatctattattggttagtagcaccacatgaaggaaattgatattgttacccttaaaatatatgcaggggaaggaaatagtaggccacaagtcatacctgccattggggaagacctacctatgcgtgggctttgagatgaaccctcagcagtcaaaacattagacagcgcagcaacagcagctgctcgctgagaaccttgacctgcacgttgtggtgggcttttgggttttgctgatggattgaacgctgatgttaaggcagccattgctgaagcgcgctgagtgggtccaccatcagagcttttaggcctatcattaccctaaaaagaacacaacattgcttatagtttgtaagatcaacaaattttatattttttctgctgtgcattgggagtgttaacaataccttattcttttgggaagatgggttgaatgcagatgaaagagcagccaatgctgatgccctctgagttggtccaccatcacctgaactcttagatccactctgcaaacagttaatgagatgggttactaacaagtgaatccatacacattacgtctccaaatatctgcttttcacattaagtgaggataattcatagaatttcaaactttaagagcaaaaaaaaattaacgtacctctgagcgcattccgaaaagaagtgaaagcttcttctgaaatgaatttccatgaatctgtttcaagggtgaaaagtattatatcctgtgctaaaacaagtgtgagcaaagaaatggtacgaccaaataccacagtataggcaagtacaaccaaactgaaaaataagcttgcagaattgatgaataaataattgaagaaagcatgatagcttccatgtgccagcctcatagcaactgtgcacattcattcattcatatgggcaaggatgtccttgttctccagtcctttagattaatttaaattattttaaaatcaactggatcctttcttgcctccccaggtcccttttacttctattgaggactaccaacctaaattagcataacgaaaagaaattttccttgtttcttatgacacccttaagtcggattcgacaccatatgtttaacatggcaacaatctaagcatacacaccacaaaactaccccaaacataatagctgatctaatgagacatatatgtggtaggcatttattagtttagctaagaaacagggaatgaaacatatagcaaaacactgaaggagctccgtgtagctacatgcatatgtactgaagtactgatggacatttagagctgctcagaaggaaatatgaactacgaacataggatagatctcttatacgaaaaattgcttccaaggtgaaatctcttaaatacaaagttccaattgatagaactgagaaaaaaagatatagtggtaaatatccaatagcataccacagatcttgtgttatcccaggagaagtaagttctgaagaagcatggttcattcccttcaacgactttgtacagaggcacatcaggagaaagagattcgaaggccgccgcatgttctgcatatttctgagaataaagcagttattgctgagttgagcaaagatgatgatatttaagtcagcaagagtaaatcttcatatcatacctggccaatttcaaatgccttctgcttctctttagcatccacacactgacccatccaaacaaagacttccccatgtgtatcaagaaccatcatgtcttcagtcagcaaatcatcttgtgaaaagttgaaaatttcagtgacctgcaaataaaaaggtttttgagaaactaataatcccaaattgttgaagcatgacaataagagtaagacaacatacctccagtttccctggtaaatggtgatcatgtcagtgcaaacgaaaccaaaaaaaaaaaagagagagagaaacattagggctctgatagaatataagaaacacattgaaacaacaacaggacaaattcagaatcaagttttggctggaactaaccattcctcaatgagaatgtatacaagtgaggctctctaacaacatcatgtgtggcatttctgcttgtgtaattctgctttccaccaagagcaaaccaaaaggcagagctctcagttccctccttgcaatgtttgacagcaacaccaggctgcaagtttggaaacatcagataatcgtattgagtgagaaatagctaggaattcaagaaaatatcaaatgctttcggtttattcagaacaaaacattctggagcaacaaccaagttagttctatcacagcggaaacagatttccagtagttagtaacctcacagggatggtatatttgtgctagtccctttcattcatattggtcaatcacataaaatgataactgtactttagaatccaatcaacaaatgtgtgcccctctgaaaaaggtatgccttacatatatagtttcaaaaacacatttggataatatagtcagaatgttgtaacattgctaatctggactaacagtagatcaactggttgtgacaataggactggtacttattgcctacatgatcaacttcagtcttaataaccatgctgttggaagctttcttccaaatcaagacacaaccaccatattttccttcctaaaggttcattttgaatttctataaaagttcccaagaacagaagacattgttgttttcaagcccttaaactttctactttctagtggacattttggaatttggatatgatcataattagcaaaataaaaaaaagaagaagaagaaaagaaaaataacaggaacaaaatttgaaaatatatttttgacctgcaatataatattcaagtgcccgcataaagaaattctttccaataatgtccacagcatttttttcccgacaataaccacatgaagtggaatattaaatggggtttcctcatttcataccttcaagaattcagcaacttttgcagcccattgttgctgttcatacgaactggcattgccaatccatgtaaacattgaatttccagattgcaggacaaaacaatccgtgggactcaagtttgatgacacctatagaaaaatgttacttataagcagatgggcgcagtaaattaaaatttacagataatggatgcctgtgaatttcaaatgagtctagtaagaagaaaaaggtcattgcaaaggacaagaacaatgtggctaaaatgaaatttctgcatcagcagcacactcagaagaaaatcaatcgatgtatttatgccacactcttctgtgtttccataaaaagaaaaatacagacaaaaataatgcaaggtagattctctagctgcaccctaaggaaatcactaatcaacattatttgagccctcattgtttatctgtttgcagttgttatactctacaatctcactaaggccatcaattatcaattatgctattaaatggtctacttaggcctgccactaggaagggtatgggtgacccatatccatacccaattttacccatatcaatttcataattagctgggcctcacatatacaaatggctcaaaacttgcacaaagttgcttctctgcaataaatcatttctacaaaattcaaccgaatttgacaagtttttatagtgcggatgcaagttttaaaattttgggtccaagctttacacacataaaatgggtatgggtggtaatgatgggtattaccctcccctaatcaaaattgaaatgggtaattcctccctacccatacccttcccaaatagtgtgggtaagggtatgggtgtgggcattggatacccagtggcagccctaggtctactctgtcatgtctctatatatgagcacatagaattttagaatagtttgctattataaagtaccattttgaaaacatacaaaaccaccaacaatattatcatgttgaatcttcataggcacagccattgcaggagaggtaaatattaccgcatcaacttgaagcactttattgttgtgaattgatgttccagaaattcgaaaaagagcaatgccatcgccagaatatgtttcatccttcaagcccttttcttctacaaatttctggtatccagagctgattccaccctgcacaatatgccaaatacacttaactgatattgtttgaattgagattggacattacagttcagctatatagacagtgcgcacctagttccttagagaacacccactattaccaactgcttctatttaacatgaatatggtaaggatcaagtaccatacctttagaatgaccatgggctggaaaagggcaataaattgtggtggttctttcccttgataaatacgaccctacaacaccagatataatgtatcaaactcctttccagaaaatctgtccacattgtcatagtaggaatacagtaccagaataggccttcctttcagtgaattccaaattgaattagctgtttggaaagccatctcttgatcttcctgtatgaaatcaaccaaagagtaagttcacagatcacacaacagtggtatgaggcgacaaaaatgttgagtatatggtacttagagtcataataggataggattgatttgtatggactccttccttatctctaaatccttccttatctcctctacatgtagtcctatatataccgccccccaaggctcaatacaatctgtccaatatttgcagtatttctctccctatactattcaacatggtataagagataattttgtcacccataagatgatactccctccgttttataatagatgacgttgtcaacttttggacatacatttgactattcatctttttcaaaaaaaaaaggtgcaaatatgcaaaaatataagtcatgcttaaagtacttttaatgataaacaagttacaacaaaataaatgataattatgtaattttttaataagacaatggtcaaattaatgtccaaaagtcaacggcgtcttctgtaaataaataaacagagggaatatttattttcacctgagatgactagtaatatttaattgcacatgagaactggtgattatttgacataaaagtcaagctcttgatgagaacacacataacatggcattgacaggactttgtgttgatcacagacaaagtaagaagaaagcactatagtatagaagttcaagaataagattgccaactactccctccgtttcacaatgtaagtcattctagcatttcccacattcatattaatgttaatgaatctagacatatatatctatattcattaacatcaatacgaatgtgggaaatgctagaatgacttatattgtgaaacggaggatgtacattctaaagcttgggagcactggaaggtacattaccggtatgctgtccttgccaatccaataagtcaaataaaattcttctctcttgtcaccagaatgatatgtatagagaacaatatagcaatctccgctgtaaaactttccaagctcctcctttggaagagcagtcttagcactgccattgacacaataaacctgaaatatccacatgtttcttatggttacattcctattattgcattttcccagtcttcctttatagttgctgaaagcttataaaatatacctcaagttttccatcgccttctagcaaaggaggaacttcctcgtctactggagcgctgctttttgaggctcccttgatatcaactccttgttgcttcaacagagctataggaaaagcaaatattatcaagaatgatctaagggtcaattattttatctcagagaacatgaacaatatacacaacctgcaactttccctcggccttcctccgcgccagcacttcctgcactatttactggccatgattcaaacttagacttgaatgtatgattctcgtacccttgaatcactcgggttactcttgttgtctttggcctattttgagtagcaatgaattcctacaaaggcaaatttagatcctaacaaatttgaataggcaagaaaaaaaaaagaagaaaacaatggcttgagacttacctcaactgctgcacttgcagcttttctctcctccacttgtgttagtcgaccaacccatataaataaatcagacccacagtcgaccaaaaagcacttattgttctcaagaattgattttgtcagaactgtgtcttctaactttaattgaccattattgatgctgcaagcagttgatggcatggaaaaaaatcaggatacaaaaataaagttaagccactgggaaaaaaagtaagataaacatagcgatatatatatatatagtctcagacctaaggatatagtaagcgtagcaaaccaactaaaactgtgatacccatttagtctatgctacaatacaacactaccaaaaacctgagaaaacctatataaaacatgggaaaactattaaacttatgagaagcctttgaaaaggtatgaaacccttcatcaaccagaaaaggacaaatcaatttattggtaaaaatgtatctacctaaacaggaagctatttacagtaacattaagctgcaaatacatacagctaaaatggttgtatctgcatactgaacattcgttgaaattatgtcagaagttgcttaatgtactgtcagaaatccaaaagtaataaagttgaagtaagaagtcctaaaaatggatgtatgtaattagcatcgatacttttcaaatagcatcatcttaatacataaatatacacatgccttgcacacaactgatggataaatttttggagttttatatgaagtttagcagcctgtgtatgatcagggaggaagttagtccatgccatatcatgtgttagaacaatgcttttcggcacagaaattcttcaatgagcgcaccctaaaataacttcactgtgaagtgcgtaccatacatagggaaggcaagaatatgaagttgtttggagcatctgattactaaaagacaagggtcctatctggattcacaattctgtaagcgcaatttaaaaaaaaaatcatacctgtaaagcttgggggctgtggtttcaagaacaacatcatcgtcacatatagctttcttccctattggtgcaaaacctccaaaaagaacccagaattcaccagaatctgattctgcttgcaattttccatcatctatcacaaaaattttgtatgaaaatgtgtagatttgtgccagaaagttacatgaattgagatttggttgtcgagcataccaacaatcgcaacatcacacactccattgtggtatgtctcctttaaatgttgaatcgcttccaaagctttcgctctctcttgaatattggagtttgcaccattgaattgatatattttcttttccgtatccaagataaatacatcatcatgattcaatgacgagcgagcaaatggaacctgaatataggacatttagtgtatataacatgaggagataaagtagtctaagaaacagggaggtgaaatagtagtcacctctttaactctgatagctctcttccctttgcaaatatatagccttgtttcaaacttatcctcttcaggtgttttaaacccagaggcgaaacctccctccaagggtataatgcatggtttaaagtacgataggaacttatcagattcatagccttgaagttctctgtgctgcactgcacgacctccgagcatggtgtcaagttcaactgtcttaattgctgcagtcccagcttcatcctgaatgagaacacatcaaatcaagaagtgggctggaaatgccatttatcagtacatgaaacttgagatgttagagaaaatgtacttgactagaatctttcccaatccaaaagtggatgtcaaaaagataggcgccaccacctttgctgcaagtcgtctacaaaacaaaatgaacagatcattgaaactttccatagtggagataacagaaagattcttctaaaatgtaaatataaaaaaaatcacctggagaactatatatgaatctccattgtaaaatttaccgtaatctgcttttggcaaaggaactggcttaaaatcttgaatcctccatatttctgtgccactatattttaattaaggggctaacagcataaaaggatagaaactcttgtacgtagatttctaaaagaagacaactaaaacaaaccataaaggcatttaaagaaggatacggtttttggccaactccttgaaatgcaggatcaagcactggttttgcacttgacattgagcagcaactttacaaaggtttaattgaaaacagggtagtggaagatggctccaccacagaataataggaacttgcacactgaaaaggggaagaaaaaattatatgtcaacaagattagaaagaaaaaatagccaagctaatttggacttctatacatggatcgaaagaccagatgttaaaagagcaatgatattcaaacaaacaatcaactcgaatcaagacaacaaatagagtagttagctgttgggaaatatgaatgaatggaacacacaagtgaatgatcaaaacgaacatatcctgaatgaaaccatcgtaaaaggggtatatcatgaaggaaagcatcatcaattgcatgcagcccagtaatgactcaccagaatcgcacaatttcactcttataaacgaatcagtaagtcagatcaaaacaggtaaaccggaataaaccatacacgacgtgctgattacatctacctgagcccccatctacatttgaaagacactgtaacgtagagtacccattatatttgctaatggagatgtacccatcagaggactgagacccaaatgcgcccatctattctgattgatctcatcacgaagccagtggctgcacagcgccaccggactcatgcccacaaagcaatcgcccccgtattctcgtcaaccacatgggctgcattacgagatcaatcaaaccaaacacatcatatgcagatctcatcacccagctccctcacaccaatttggaagatgtgtgctcgtgttaatcatcttctatccatcagattggctgcacgagcacgtgccgacggcagccaccaaccagagattgggaaagctgattcggcgccacccaaccccactggggtcactgatcagctgccagtcaccaccgcccccaaagcggaagggagcggattgagagctaatccacggatcaacccccgcacatttcgcctccgatctcaccgatcggttaggcaacccacccacctagacaccccccggatcgccggagacgaacaccattcctgacccaccccgcgcccctctctcccccacacaatggccggcaccaccaaccggaacaaacaacgccgcgcaagagcggatcgtcgagcgagaaaccaaacccaatccgcttcattcccgaagaaccaacgagcaattgcgcgcgcggggagacgcacgacggcgagtcttcgatcgaggagtcgagagggggtacgtacctggagaaggggaggaggacgacgacgacgggatccgatcggaggctgacgggaggggaaggggaagagggggcggcgatcgaggtggccggcggaaaagcggagagaggggtgacgcggcctaataaaggaagcggggcgctatgattgctcccttccgctctgcctctctgtctctctctctctctctggcctgtccgtgcccttgggctgggatgggaggggggaggagatgcgaatgaatggaacggggtagatctggcaaagcgcgctccctgtttttagagcgagcgtggcgagagcggcgtcgagcctgggccggtggccgccctggggtccctggacggtgggggaaagaagtggcactaggctgtagcggagaaaatggggaggcgttttcctcgatggaaatttgaacggctctccctcttggctaacaaatgatgtcatacgtcggtgtcaaagtaagcgtattattaatacggtcaatttgatcctttcattttatatactacctccgtttcttttttttttcattttatatactacctctgtttctcaatatatgcgtattattaatacggccaatttgatcctttcattttatatactacctctgtttcttttttttttcattttatatactacctctgtttctcaatatatgatttttttttatcgacatctgatcattcgtcttattaaaaacttttgtgcagatataaaaaagtttaagtcatatttaaagaatatttgataataaattaagtcacaataaaaataaatggtaattacatgtttttttgaacaaaacaaatagttaaaacatatttttaaaaaatcaacgtcgtcatatattaaaaaaaacagagtgagcattttattttcggttaacctaagttttatttggagggagagacgttttactcctagtttgttgttcgatagtagagatgataatcatgagtcaagtgagaattgaattgtacgcaatgatatacggctttagatttatctagtcgtacctagaagagaattatgtcccaattatatacccctgctcaggcattaaaaaggtgggagttcgctcttaaacttttaacgcccaccaaccgtcctcatttttaaactcatattctctactaacaatttccccccaacttaataagccattagtctctagcgtttcattttgttcgaatcggtccttgagcttttgagctttgctcttttgttccatacgatccataacgcccacctaatgaatcgggtgatcaaggcaactcaatgaagatcaatcttgttgatgaatgtgacgccctgcacttttaacattgaagataaaagtgccagactatagattattatttaacaaactattattcccgcacttttaacattgaagataaaagtaccaggctgtagattattatttaacaaactattattcccgcacttttaacattgaagataaaagtgccaaacggtagattattgccaaataataatatagcacttttatcttcaatgttagaagtgcgaactgccaaataataatctacaatctggcacttttatcttcaatgttagaagtgcagggcgtcacaatgaaccatatagctaaaagactaattcaccattatattttaaattccaacataaaataacaatgataaaataagctatagaatccttcttaagtagtcatgggaccaaccgatgtttattcttagacttgtttcattgttcggactataggatagatataggatagtgaagcaatggaaataggaaaggaatcccaacgtaaactagggggttaaaaaagagtttgagatatgtcatcagtatctcaatgacatgtaggacccacatgagtcaatgacatataggatccacatgggtcaggatggcatatctcaaattttataaaattataatggcatggttacaattttcccttaaaaatatatgtcagttctatcttcctccatccttctttttctttcttgcccatgtgcagttgaggctaacggagatttttatgtgcagttgaggctaacggagattcttatggaaaacgcgacggagtggcaggttccaattccctaaattcccatgacacatatacaatctaaaataacatatttgtattggcatggatcgaattaacccatcgtttttaatgtgttttttcccgtggaatcgatggtgtaggaaaatttcttgtgatttttttgtgtttggcttttgcgatccgaatggtatgaaaaggaataaaaacctatgaatagtattcctccaaaaatcccatggctatcctgtaatccgaacgaggcctcaaatatatacacaaggatgtaacaatcatttcgctgttgatatcaacacaatagatacacaaggctaaacttttcttgagttatgttcgtattgtagcatattaggttcatccaattaccacgttgacccaaaatgcaagctttaagcactgaactgtacaaaataaagcgttacttactccatttcatattataagactttctatcattgtccatattcatataaatgttaatgaatctagatatatatgtgcctagattcattaacatttatataaatatggataatgctagaaagtcttataaccaactgtcaaaatagcccttaagtgaaacttagagggacaaaattgactattctctcttgtcactaccacaactcattctgttcaaagtgaattctcgttagtttgccaatcatcgatcataccatggatcaggctacaatgcccagaggtgttacacagtagtatgttggtgacgacaaaagctgacaatacctactaagacaatgcataaatgtcaaggatgagcaccgaagcaaggacaactaagaaaatgtcgcaacagaaattgtactattggggtgtttagattcaggggtataaagttttctcgtgtcacatcggatattatatagggtgccgtatggggtgttcggacacaaataaaaaaactaattacataatccattagtaaacagcgagacgaatttattaagcctaattaatccatcattagcaaatgtttactgtagcatcacattgtcaaatgatggaccaattaggcttaaaagattcgtcttacaaattagtcgcaatatgtgcaattaattattttttagcctatatttaatacttcatgcaggtgttcaaacattcgatatgatagggtaaaaaattttgggtgtgatctaaacagggcctgtcatgtgacatattttttcatagacatatttttttagtattttctcttttccaatgtacaataactacatagtatatgcatgagagtttttcaccgattcctttttttccggtgcaacttaggccttatttagttggggaaaatttttgggtttggttgtcacatcagatatacggacacacatctgaagtattaaatgtaagtattaaacgtagtttaataataaaacaaattacatattccgtcaggaaactgcgtgacgaatttattaagcctaattaatctgtcattagcaaatgtttactgtagcaccacattgtcaagtcatgacataattaggcttaaaagattcgtctcgcaatttacacacaatatgtgtaatttttttacctacatttaatactccatacatgtgtccaaacattaaatgtgacaacatggaaataattggaaataatgtgccagatctaagatggtctacccaacgtcattcgccacaaaattccaatttccaaacctgttgtagtataaaggtggtactgtcctaagcaccgagagggttagtacgaacaaagctactctcgttagcgtcgttgccagatgtatagataaggtgtcacatcttgggtggaagaggtggatgccaaatagctggtttatggagaaaatttgtctgatgaatgtgggggtgcaagctaggttccgtcgctaacatcacgatcaaaaggatacagtgtagaagcggcagcgacttgagatggcaatggcgccgtttcctgtttcccgtttcctacagggaattctcttattagggagcagtgatggttagaattggttcttcgtggggatcaaatgggaggattgatattcccgccgggtttcacgggagcggggatggtcctccattccatgttcccgaccgccacggagagcggcatagggatacaagtttaatgctttttttaagttatcttatgtgactaaattacttgtaatctttaataaacgttaatcttattttttttatcatgtgacttagtagatatatgttaatatattaatataaaatatgaatatatgtgttacattgcatatataatttgatatgtatatattgttttaagcggggacatagaccccgcgagggttaattccccatgccaggtggggaaaattttgttattaggagggggatggggatgcattaccccgtggggaattcccaatttccatttctagcggtgatcggccagcaagtggaagagctcaacatctcgcaacacggttagcggaggatggtagctaggcataggcattcgatagttcacaggtggaggagacccggggcagaacttgacaatgaccagagaacgggctacggatgggcaagcggaggatttgggcggtgaacgataggtaagcggacgagtaacgctatccgattggaagtgaacaggtggatgaaaggtgaccggcagacatgcgaacaagcggcgataccgggaagtagataactcagggggtaactcgacgacgaccggtggacaggcggacgagtggtgacgattggcgagcgggcaagcgaagtaacagcacggctcacactgtgcgcccgtctaagtgggtcaagatggtccgctcatttttaccgaacggtttggacccggaactaaggagaatattcctctaaggtgataacccatcccacccatctccaaaccaaacacaatagtaaaaaatagagtcaacccatcccatccttccaaccaaatagtacaaccttaggttcttcatcttcttggatccagcgctagcaggaggtggccgtagtagccatagacgctagcaacaacaaaatgtgggtcgaggtgcttaactatggcgctttgggcagcacatgaccatgacaccgggatatgtgtgacacgtatgggctcctcgcgccaaaccgttgtcgatttacctcgtccaagctatacctttttctcaagctcacccaacgtcgatctctaccttccatatgagctcgcccaccgaagcttcaagccctctcggttacctcctcctcatcatctctttctctccttccaaactagtacgggaagacatgttgatgactagctagctaggtcaggtgatgatagagcttctggagaaggtgttaaagggtgtagtggcccgccatgccttgtcaaattccgtgccatgatgttgcctgcaccgtcgcttgccgtagtttctcgctgccactccttccttgcgccctcgtctacatcacggcaagctgccgcttctcccttctattgctgtcaccgctcgctgcaactcctccgtggctttgctaccttgcaatatactccatccgcctcattttaagtgcagccataagttttcgcacccaacttcgatcgtccgttttatttaaaattttttgagtaaatttcactttggaccatatttgttgaccaaaatttcacattgggctagggctaggcttatgttttcacttaacaccatgtataattaccattgtttgtactttggacctgattttacagttaccatcacacgagttgttgtctaggtgcttagcattttacaagaaacaatgatatggaaatttttgccatgcaaatatgattagcgcaagaacaatgattgtaacatgttataggatatcctatcagattaatgggacttcattactactacatatgaacattcacaacccttatactagagacaaaattggagaaatattgagtttaagaactatttttctagaaaagtacacgttttacaatacccaactgtagtgttagttcaaattattgaattctaagttttctaaaaaaaaaagaaataagatcagatctacaatcattatactatgtgtaatttgtgaaacccggtccaaagtataaattatgataactatatatggtgttaagtgaaaatataagtctaactctagtccaatgtgaaaatttggtaaataaaggttgaccaaagtgaaatttacttaaatttttttataactagtatttttattattatgagatgataaaacatgaatagtactttatgtttttaaattttttcaaaaaaattctaaataagatggacagtcaaagttttgcacagaaaatcatggttgcacttaaaatgagacgatgggagtatgttggaaacaactagtctgtcagaaatacaatatctatcaggagaacaacaaaattatcggtacccatatactggtaaataagaaatatgtcagtgcatacttttctcgactgcttgacccctgacagaccctagtggcaatctaagtgacagcaaaagtctttaccacattgtgccatcaatagctgtttttttttcccgaccgatcgagcgtttgagaaacaacacgctgaacagctcaagaaatcgagcttatctctgtatatatatatcggtgattcagtgtacacgagcgcgggcaagcttaatcatctctgtttctttagaagacaaacgcagctgcttttttagaaacatctcaggcaaggcaggcagagagacgatcgatcagacttgtgatcgcaggtgggccgggcccacgcccagccttaaccacgccagcgcgtgtggcccctccggcccggcacggcagaccacagcagcttcaatttcttagaggcacacgtgggccccacatgccagccagcgtgccaagacaatgcatttggcatcctcctcccgaagatgacgcacacgccccctgtgtgatccgtccctcccctccaactccaccgtctttttcctcctctttttgtagagtggacacgagttaagccacgacatcgatagcaagatggtgccgatacgtacgtactgtactagtgtgctgtagttgactcgatcagagtaatggtcaggctttcgtgatcggaaagtggtttgggctgagttgtttttttcactttgctaacttatttctcccatttgccatgcacatatttttttaaaattactaaatggtatgtaatttttgcaaaaataaattatacgttaatgggtaacactattttctatacgaggctaccgaacacagtcgttgagtggacacctccgcgcggcgttggatcagagataggtgatctctctctgtagcacaagcgcgcgtcgtgtcgttggattcgtggaggcgaagcatttgtgcaaggcgagtacgacgcgtacttcagttgatcaatggatgaacaaaagaaggaacgcatgaagcaacggcgtgcacttccgttgatcgatcgttggatcggtggaggtgaagcgtctgtgcaaggcgagcacatcgtgtttggaaggccgcctgcggcaatggcaacagcagcaacaaccgcatgttactcttatgcttgtggcactgttgtcgttggctgcaccacaactacaaccacggctgtcgaatagacccttagcagaacagacgaaagcaatagaaaagaataaccaaatggctggacagggattcagattatttcagctccactacagtctccatttctaagttagatttaagagttagagaggtactaaacatgttcttaaatttggaccacatacgcatacgtaatgtacaggtatgtgcatatatatttcggatcaataatggcataataacgtgcagtagcataccatgtgtataaaatctaagttcagttcttgtattttacaggcatctaagaatgattattcggtggaccacggttatccaatattgttacagtaaggcacttaccacaataacatatgttaactgctaaaaaccacgtgaatttcatctcaaaatgttgaattcaaaatttcaaaaattgtagtaaggtttacgataacaacacaataagatgctataaccgtgttctttgacttgaaagagatcatatggaaaaaggatactacaacatcacatttgactaatgtcgaatatactagatatatattactactaatcatgtattatttgtagggattttttttaaagaaaaactgaattcgaacaaatttaaccaaactctatcatcaataacccttgccatacttttagcatactttcaggataaacacgttacccgcaaaattaccggcaatgtgaaaaacctaggaggaacccatcttagattcttatatctataatcgcatacggatctaaaataagattaaaggggaacccatctctttcttcctcgtcgcaccccctctcttcctcctctcccttccctctttctatcaatagtgatgcagtgagatagggggacttgatcaagtcttcctcctctcccttccctctatcaatagtgatgcagtgagatagggggacttgatcaagtctccctaaccccacgctagatccatcccattcgataatgaattcatctacaaaacacatgtaaacgtgaaccacattactctgcaaaagaacctacgacgtcgatgacccgcaccacggtgagcttccacactgatatgttcatgccaaatactcccttcgtattttaatgtatgacgccgttgactttttaaccaatgtttgaccattcgttttatttaaaattttcgtacaaatataaaagtatttatattatgcttaaagaacatttaatgatgaatcgagtcacaataaaataaatgataattgtataatttttttaaataaggtgaatgatcaaatgtttggataaaaagtcaacggctacgtatgaaatactgtagcagctgagctagctacccacacaaacagtagcactgcacgctggcgagccccctacctagctcccagggggatcgtggcgaagacgatgcgttcgcacatgcttagcttttaacgcgaggatccttttgcggggcgggcacctcccatctccccagctcgcatatattgcacgcaccgctgtcgaggggtgggcccctgccaaggtccatgtgtgctcgggtaagctgcattgattaatcatgcatgtactctcgctagctacacacatgtcgatcgatccgtcagtttacacattgtggctgatcagcgagtgtgtgtgtggctgtgtgctgctgctcgctagtcgctttacagcaaacatgctggcaagctgcgcagtgtattatatgccagatgcataatcatgcatgcatgcaggaagggttgattaattaactaattaatatcactagattggtataaagggaactggccagttgattaaaccatagtcgatcggcgcattcgtactatcatgtggacaaatctatatattcaagcatgctagcgcagtagcgcgtgagtgaagatacataatatactcactcactcagggagcttcagttgtttgatatactcagggagcactaaccttgaatggttaaaaattgaacatcacataagctagcttagcgcaaggctaatagtataactcgctactagctccaattcatttatagtcaatctaatagccaattcatataataattgcttactatactattaatatatggtcccacatgtcatacacacattacatattggagtccgcgctgcagctggctacagatctgtagcccgctgttcttctctctcatagcaagtttaatagtatagcccactactagcttcaatttatctatacccaatctaatagccaattcatacaatagttacttactatagtattaatatatggtcccacctgtcatacacacatcttgtattggagtccgcgctgcagctagctacagatatgtagcccgctgctcttctctctcatcctttatctcattaaaatatgtttacaactagttaatagcttgctattgtacttgctctcatcttttatctcattaaaatatgtttacagctagttaatagtctgctatagtacctgctcttactggcacatcggccttggccttgaaatacgtgtcttacgtacgtgttcttgcagtattgtcctgcaatgcttctagaatggctgcgccaaatctgggtaactacgctagattgcttaagctgatcatatggatgatctgttgatctcttcgatccggcggacggcggtatatgagtgtatctgtcatcaataaaccgagttccattttcatcgcatgcaataatttccaacaaggtagccaacggtcaagcgcatgcagcttcattatggccttgtttggataacatatacaatccgccccagtgaatttagttcaaaatcccggtcaatttcatgggctcacggccttccaaacaaggcctcaagggcatgagcaatatgttggaggaataagttcatctgacatccctcaattgtacgcagagtctgtttaaggtcccctaacctcaataccagaaatgtatacccctaaactatgcaaaactgtctaaaaaaggtcccaaggtagtatagatgcctggtttcgctgacgtgatatcctagtcagcaaaaaataaaaaataaaaatatatggggcccacatgtaagtgaaaggaaaaatatggggtccacgtgtcagcattatcttcttcctttctcttttcttctcttctcttctgacgttgacggtagatggggagagacggccgccgatgaccccgcgccgctcgaccttgtcgatggcggcggcgaccaaccccggctcccctgagcccaatgcactgcttggcctcagtgctccgaaccacccaacccaggcatggatgagagggagatggcggcgaggagagcgccaagcctagctcgttgtgccatgggtggtgtgcggcgttgcgggggatgggatttgaggacgacgacgacgtggatgatgcggtcggcaaagtcgtggacgatggcgatggactcgcaaggccgccgctcggaccccatgttaagcgccatcttcaccctcgagaaccccaaaatggcgtaccagaaccgccccgtggaacacgtcgacaaacctgccgctggcagtggagccaacatcgacctctgcacgagtgccgtcgtcactgccgtccccatgtcctcgggagcagtggaggtggagacgaagaaggcgggcgagagcggagccacctctttttgccctatcccgtcggcctcatctcccccttctttggccgacttcctctctcccctcactgtctggcctcatctcccttctctccggccatcaccagctgctgtcgccgccatcgccgccgcctctcaccctctactaccagcgggtgaagaagagaagaaaagacaaaaaaaaaagaaaagaaaagaaagaggagaaaaaaaaagagatgttgactaggatgtgggccccacataatattttttaaattttttctgactaggatacagcatcagtaaaactgggcaactatactgccttgggaccttttttttttacggttttaaataatttaggggtacacatttctggtattgtggttaggtgaccttaaacaaactcagtgtacaattaagggacgccaggtaaacttattcctatgctggaggagggaaggcctagtttgatttagattactcaacggatttttgccgcggatatactcaactataatgacttaggctgtgttcggcagcccctcttcccaacccatcttcctcattttccgcatgcacgcttttcaaactgctaaacggtgttttttttgttgcaaaaagtttctatacgaaagttgcttaaaaaaatcaaattaatctatttttgaaaaaaaattagcaaatacttaattaatcacctgctaatcgctgctccgttttccgtgcgggcacttagtgttaggaaccggtggttccgaacacacccttaatggatgcagtgacttaataatgaataaaaatttgttttcattccatgccttttttctactcccccgtttcatattataagttgttgattttttcttagtaaaacttttttaaatttgactaagtttacagacaaatataatattattttcaatacaaaacaaacctattataaaaaatatattcaatttaaatttaataaaatagtattatagatgctgctattttttttataaatttgatcatatcttaaaaaaaaaactttgatagaaaaagttaaacaatttataatagtacttgattattgtgttaggtggcggcataccccgtgctctgtgtgcctcgtacgtgtacgtcttttgtgatttttttcttgggttactgacagtggaaaaatagtccaacggcattcggcaaacagtccaaatcgtccaactcgaccgcattatccaaaatctccacacaatcgtccaccatctgaagcaatcatcgttgcctatcatctcatcatttggagaattcgagggagagagagagatagaatagtagactagagagccactcgggcagttgcattagacgtgaccacctgcggcggcggaagcggcagtctcgccgccggccggagtcgagccgggtcgcggcgatgaggccgccgacgcctctccccttcctgctgctcctcctcctcctcctggtgctcctcctcccgtcgccgtctgcggcggccgcgggcggcgccgacgggtgggaggcgatcggcgcggcggcggcggggggaggcccccgcagggtcgcgtcgccgggagagcaggaggcggccgccgccgggttgctccgcaggctcctcccctcccacgcccgcagcttccgcttccagatcgtctccaaggtcggtgcgcgcgacgatttctgactcgggggaggcgaaacggtcgcggcgaaaattacggtcgctgctcgattggatcaggatggcgtcgtcgctgacgggtttgactttgattctctcatccagggtggcgtctgcggcgggtcaagctgcttcaggattagtaatgcggatggctcgcgcagaaatggagcagaaattctgtacgcttctaccgctctcctctgtgtgtgtgtgtgtgtgtttacttcccagttttttttatttggaacagaattctatcctgcttccacggtttaaatttagaatagttaaaattatggagttatggtctcaaaattggctttgtttaaataggagtggttttgtaggaccttcaactaagtctgatgctatagcacagtagcacttatctatctgatgctaataaaactgtaaaatatactaatgggttgacataatgaaaaaacgccagtgcgaagtatctattttggcaactgttccttctcatgccggctgtctcttttagtaacttttgcattttgtttttcaaaactcaaaacattgccttcagctgagcatagataggggaatgaatggagaacaatttgttgatatacggctaccaaaactgaaaatttgctatggttacattgcaaaagtgaatgcaattacttatcattgtgttcaggatccagggtaccacagcggtcgagctcgcctctggtctccactggtatctcaagtactggtgtggtgcacacatttcttgggacaagactggtggcgcacagctggcctcggttcctttgcccgggtctctaccgcaagtaaaagggacaggagtgaagattgagcgacctgttccgtggaattactatcagaatgttgtcacctctagctgtgagtttcacaattttccttttttcataatgtttgttctgctccatagaccatatctgctcagtcttcaacctccagctccaaatcctttattatacccaaaccacttttgtcaaattggtgataatattatattgcactctgaaaaaatgatctcttttcctttttatcgagttatggaattggtcatctaggtctgttgcaaaacaaatgcttgttggatttctaaaacgccatcatgattatatgtttgtactgatgcaatataaatctattattgccactgtgcgtgtcaaattgaagttcttttatttggtctaagcatttcagtcctgcaattctgccaaaagttttttttttaatttctgtattctacctgtttcaaagatctaccttttgttcttttcaagatcaaaccacacatttttagtttgtaagaaatatctcccaatctggctacttttactcttctttacttggtttccaactgtttatctctgacaaagttcatgtagcatctctatagactcatttgtctggtgggattggaaaagatgggagaaagaaattgactggatggcacttcaaggaattaatttgcctttagcatttaccgggcaggaagctatctggcaaaaggtttttaaggtagtatgacagacacaatttaaactctgaagcacattttcaaattctttttggagtctaaattgttaacatacagcaaccagtgatgttgcttatgatgggccatgcatataaattagcagaagctgcgtctgtttccttacccaataggttacttgggctggctcagtccaataggatgcgtgatcttctctctctctctctctcgcttatctaagggaactttacattctagaaagctcgaatcaaatactctaatttatctccgtgtctgtcactatttggaatattatctttgctgagtgccagtcttttgtgctgccttctataattttatcgaccattttcccaaacgatagtcgataaaaaatttgcattaactgcatactaatctgtaccattgctgttttgtgatcaatctggcatctttaaacattacagatccagaagttatcttcagtttgacatttatattgccactgtttttgttttccatatatgccactgtggaatcataatgcaatttttgctgtgttcaatcccttgctgatgactgagttctatttcagagttttaatgttacagacagagacctagatgatttttttggtggaccagctttccttgcttgggctagaatgggtaacctgcatgggtaagcttagcataaatttattataaagtatttgatctgaaaataattatgagataaatagtacaataattaaaaaagaaataagggtatgttgtctatgcccttttggttttagttcacagaggatagtggattgctttatgtctaacaaaagtgaaccttaacaaaattatcacccttctaaaatacatatcctgttgaggtgttcgcagtttgaaattttttgcctgaggaaaatctttactgaagctaaattaggttagacatactacagaggttttcctctcagctcaaatcatttctttcagatgacagacaatactttgtacttcttaaaaggttaaccatggcttgcattatcagggacccacatagccagtacatagcactgcccaaaacattgaattgatatttttgtagttacacatagtatgctaattatgactatttggtcataggatccttcagttagcagcatatatttgttagtatgatgtgaaaaaaacagtgcagtttgatatatatgtttattttaaaacaaatcttagatggggtggaccactatcacaaaattggctggatcaacaattgacactgcagaagaaaatattgtcccgtatgattgagcttggaatggtcccaggtaataatttgttttacattgtagaatttcagctctttacttctttagcaattgtttgtctatttatgtgagacaaactttggacatatgctattgtctattgtttgtctattgcatctttcctcgtttcatgctatgtttaaagctttgtcacatttgctcttatcctatctttggagtcaggaaatatggagagtcagttaacatatcaatgttaccttcgatgtactattagtatagtgcactaaatatttgattctggttatatacttcactgacattaattgcaatttttcagttctaccatcgttctcaggaaatgtaccgtctgtgtttaaaaaattatttccatctgccaacataaccaaacttggtgactggtaatgcactcttctgtgtcatttccattagttggctgacatttcatgctagttcaggtgtgaccaaaatttcaaaatcttgtctgtgttttatagtcgcagttcacatcaagatacctattttataactactgttagtttgggggctggacctcaaatttggtgttgatgtattcatgctttctctttgctaaataatttccagagtttataagtaaccgtggaataaacagataaataagtttcaggctatcagtcttctgttcttccttggcattatgtgggttgtaggtacagggtaaccatgcacacaggatagtttgaagtcattgtttatatgatcgaacatactttgaaggtctagtattctgtttcagcccatgaatactgtatttacagattcctttgcttcaggaacactgttgatggtgatcctaggtggtgctgtacttatcttcttgatccttctgatgcattgtttattgatgtggggcaggcgtttatcaggcaacaaatgaaaggtcagagtctttccatgaaaagataccagatttcatttattccaaacttccaataccttttgactgttctttcgccaatagcttcacgaaattgctgcatggattactaacagtgcaattttaatgtatgtttttataacctgcatagggcgtgtttaccattctaattgtttttgtattttgcagaatatggcgatatcaccaacatctataattggtaagctctgactgatctgcttctctgttttttttttcagtagaatttgcatgaataatttgtttcttgcaaagtacctggactgtacaatacactatagtttagcatttttagcgcaaatgattggctctccttgtaattcatggagatgaaccactgattgttaattttttttttaaaaaaaactataatgaaccttgatgcaagaaatgttgagtgcaaaaatatttgaacatataaggtacttaataccaaaacagttttgtggcaaggtttaaaaaaaaatctggtttttgaaaatgacaagagtcctttcctttctcctcacttgattcttgctatcaggttagaagattttgttcctgataccattcagaattctacatgatatccagataattccattgatatactggttgttgataaaaaaatgtaatattattggtgtattggtttgctttgttcattgatttagtacttatttatgttccttgtccacaatgtctttcatacattatgatcaatatttattgtttgttttcagtgacaccttcaacgagaatacaccacccacaaatgaaccggcatatatttcatcacttggttctgctatttatgaagcaatgtcaagaggtaacaaggatgctgtgtggctgatgcaggtgtgcttgctctcctttttgacctttgaagtgtaaaatattatgtattcaatagcatcgccacattttccaatggaaaaaaaaacatatggagtacccattcatacttgctttgtcccagtttgtagagaaaaaaaatgatgtcttaccatgctgtagttttgccagtaaaaaatcatttgccctaagccacagtggcatatagtgtttaattagcatagttttcatgagcacatgttacactcatggcaatttttgaacattagtataatcttggaaccttcttttcttgattcagggttggctgttctactcagatgcagctttctggaaggagcctcaaatgaaagtaagtttcttcgttttattctgatttctgaacactcatagaaactatagttgagcctggactgatggatatctgtttcatcattctgaaattcgataatagcgaaagaatgtgatgatccaatgttcccttgtatcttgtttcttgcactcaacttgaatagagaaaatagcatctagagctatagatctttaagtgtgctcaatctaagttgccatctatttagaacctatgtagtgtagtggaaataactttagtacttatgcactcaacagtctaagagaaaccttgaatcattactggtgagatttatggaaaaaattaatgtagtgcttctcagtgtttatgctactgtgtttgtgggtccatctggatagggacaatgggacatggacttaattgagattgctaaagaaagctcaactgagaaatggctctggacaatctatttctttccaaatccaatcattccctcctttgtgcctttgtatttctagcttctcaaaccatgcctgttgagaactgtcttaccttttctatattctagcactactggtttgtcctagtcttctagaagcatgtaaggaaaaggctggctcatgggatgcagggcaagagagggccttctgcactaatgtcttttagtttatgcatacaataagccgtaactattatgaatgccgattcatggatatggtaaagatccaaagactggggaatacgacactcgcactaaattaacgccagtaaggctactccctgtcaaaaccaagggagtctgaggcttattggactaactttagagattcaattgtcgattgatagcggggtacacatggtgttcttttttagggagggatccctgctacatttccatgggtagaatctctacttttctaaaaaaaacatatctctaatttcctagtagtaattaactaacaactttcattaactgacagacaggataccaattgactaacccctatcctactaggaaactagttcattattaaggaaatagaattctaatcctgatgccacagtattatggtactgttcacacatggccacacagtggtgctaccatagcagtaacagaagcaaaatattatgtgtattcatatgaacgcatattactatattagcaaataggtagcaaaagcatctacctgtcttttccccatatgtaagtttctgctcattcttatagatggagataaccattgcctgttttgtctttcaggcattacttcattctgttccaactggtaagatgatagtccttgatttatttgctgatgtgaagcccatatggcaaatgtcctctcaattttatggtgtgccatatatatggtatgttttgactccaccctaaagcttcaaatcttcttatttcttaaatatcacttttatactctattagttgtaaaagtatgcatggtggttctcattgaaactaggtgcatgttacacaactttggtggcaatattgaaatgtatggcatacttgactcaattgcatctggccccattgatgcacgtacaagccacaactcaacaatggtacattttactctcttctattaatatagtgtagagcttatatgagctgagattgtccatcatttgttgcaccaaacttgaggtgaatctatcaatgagttccttaccactcctctaaaaaaaaagagttctttaccactgatctggcactgcagattatatatcatggcatgattcctattaatatgatacttacatttgtgccttacctcctttaggttggcgttggcatgtgcatggagggaatagagcataatccagttgtttatgagcttatgtctgaaatggcattccgtagtcaaaaagttgaagttgaggtatgtacaacaaacatgcatatgcctcgcttgttatgaaccactgtgactgtctcatctccttttcttttgtgaccagctcacctgtcttttctccataatactgcctgacatttttcatttgctgaagttgttgcatgtttccaatttgtcaattgccatctaatctgtattatctcccaggattggttaaaaatatactcctacaggcgatatggtcaatcaaatgttgaggtggagaaagcttgggggattttgtatcatacaatatacaattgcacagatggaattgcggtttgacatcatacatatgctcctctacaaattatgctcctgcattacaactgtgctatgattattgacaaatccactgatcatatcttctttcatatgtatattgcaggatcataataacgattacatagttgaatttccagacatcagtccaaattcatttagctctgatgtttcgaaacgaaaggctatttcagaggtgaagaaacataggaggtttgtcttaagcgaggtgtctgcaagcctaccacattcacatctatggtattccacaaaggaggctatcaaagcccttgaattatttcttaatgctggaaacgatctttcaaaaagtttgacatataggtatgttttataatcgccattggtccttcaaacattctgatgccatgcattcttctttaactaggtatcagttaatgctgacctgtttgtttctagaggacttgtttcgaaaaatgaaatgctgtggcagtttcaacatctttatgctgatacatgaaattcatttctccaattcccagaaaaagaaaacaaaattatctgctttatctcatgcctgtttgatctgctatgcctttctagagcatagatgcatctacttagtttgtttaccaatcatgtcagaataatggcattcacagaatcaacccacattttccaggcttggagtagggaaaagtctgaaatgtggggacactaatggtgaaatgctcatgtgcgattgtaattatgtatgtgagagtactcacaattattaaaatagtccaaaaatgtacagcagagccaattgaagctttgacaagaatacaacaaaaatgaaacaaagccatgagcccatgaatatactcttgaacacaaatcttagccatatgttagaactttcactgccagctgctaattaatcaaacaagctgttctgcatacatgatatttttttttaaaaaagaaaactgtgaattaacgataattgttgtcacaggtatgaccttgttgacctgacaaggcaatcactgtcgaaattagcaaatgaagtgtaccttgatgccatgaatgcttaccgaaagaaagattcaaatggtctaaacttttacacgaagaaattccttgagctcattgtggatattgatacactactagcttctgatgataattttctgctggggccttggcttgaagatgcaaaaagccttgctaggactgaaaatgaacgaaagcaggtaaatttctcacccttcatccagtattagtcacagatattattttttttcttattattgactgactcaatttcttttttttttcttattgttgactggctcaatttcttttctatcagtatgagtggaatgctagaacacaggtaacaatgtggtatgacaatacaaagaccgagcagagtaaactacacgactatggtaatatatatagttgtttcctccataattttgaagtacatgccagatatatgtatgctagttatacttctaggttattaaccttcctgcctttcttgacaccatattaccagccaataaattttggagtggactgctgaagagctactatctaccaagggcatcgaaatacttcagtcgattaacaaaaggcctacaagagaaccagagttttcagctggaggaatggacgaaagattggattgcctactcgaatgaatggcagtccgggaaggagctctatgctgtgaaggctacgggtgatgctttggcaatttccagctcactattcaaaaagtacttcagttagctgcaattgtccacttcgaattattagatgattgaaaatatcacatttccagcccctgcactaggtgcacacgccctaactgttggaataaagccaactgtctactttgttgatgtggtaaataattcatacatcagaaacacactgtttagaagcttgagaatcgtgcaaatgaaggtcgaaaatataaaatgagaaaaagagcaggacctcagctctctaaagtcagtaaaatcacttagcttgaaaaacaactctaaaattctggatccaaataaaaccacaacaaggtaatacccatgctaaaataagttcattttgcacacataccgatacaaagttaaaaggactagggtgtctttactttagcaaatctcaatacaaccatttctcaattcatttacttctaatacattattctctatttctacaaactcagatataatgattactctaaaaataaatttattttgagacaaatgaaagaagctgaaagtaaacttattacgggacaatggaagtattttggtttgatgctttgatcctctttcagacttcgagcatgagtattgtacgtgtcttctctgtattctctccaccataaaaaaaattaatttagtattgaatttaacacatgctatacatatttatagtactagcatgttttaatccgatactaggttaagcttttatgaaacggagcgaggacatgtcttttggacacgcatacttcctccgtctcaaaaaaaaatcaacctatgagggatgtgatctgtgctaggacaatgtgtttgaacgtagggatgtctctatgtctagatacattgttcatatcctctcctcctagttgtttttttttttggatggggggagtaccagctagtcgtaggctgcgacagtgcgaggcgtagaggagacaaccaagtggatcccacatggccacttcacagcatcgatgatcggtcgcttgtgtgttacgagtagttctagatagggctgtcaacgagccgagctcgagcgagtttggctatataggcttgagtttgacatgaactcgagctgagcctgcataccgatcgagcttgggactaagctcgagttcgagctcgagcgagcttcgagcctactcgagcttgacagcttgacttggtgaaactccaaagaacttactcttgtataagagatattaatacaaattatcggtagtcaaaattaatgggtgctacttgtcttgaatgaagcctctgcagcttttctcatgaattcatggctttgaaacattacaattaacaaaagctagctactacatctaataggaatagtagtactaattctaaaaaagaaaaggaatagtagtactattactagcagccagttaattactttattgagaagcattgatgagatcttgagacttgagcaggtcaagcacgatgataagtatacattgacccatcaagaatatcttcctacgtgcaatgcatcttatgctaattaagccctaccgagctattcgagctcgaacttgctaggattgcgagcctcagcctaggcttaagcttggcttgtctagtatttgagccgagctcaaatcaagcctgtaacgaatcaagctcgagcagcttgcaagctccgagcttttttgacagtcatagttctagatcagctgcaatagtaagatagactgcaacttaagttattgtagctgctaagttggatctaactctaacggcaaggattagtttggtcactgtagtaaaatatattgtatcataaaacagtgctcagggtactgtagggtgaacactgttgcaattaatttggaccattatcatataaatgaaatgactaaaaaatatatgcagtcctatggtgcggccgcagttaagactacacccaatttcaatccttaattagtggctagacggtcctatcttttcgcttatgtatataattttccaagctactcattactaacttaaaaaaaattataagtaatttttttgcatacgtgtttttaattatttaaaagcaaaaagtatgataagaaataaaattaatttaaaaattatctcgtaagcataagaaaaagaaggtgttgtcaatctcttcagtattgaccaccaccaacgcacgcacagtcgcacagtcccccatcggcccatcccatgcgtacgtggtttgcctgccttgctctggttggagagccggaggcactttggtgtaccacgcggctctctctctctctctctcacagagaaattcagatcccagtttaacctgtttcaaaaaaaaaaaaacctagtgtatgtaagacagtaagagcaaggtcaatagtatagccagctgatggctccactcgtatccatgtcattctatagttgattttaaagctaacttgtacaacagagtggctattgtgttggctgtatctcatccatcaaaaaatgtattttacacgcatatattgatatacatgatcgaaagtgaactcaatccctgtggtcgttgttgtgcaatactcaggagtgctctatacataaaagaaaaataaaagtcacagacagcaaatagatgagaagaacaaaagaattaggaagagattagatgacaataactcaaattagaaagctattttctgctccatcaacgatgagatccgtttgttctgtttgtagatgcatcggccccttcttgacgcgatggccagcagcagcgccagcccgcggttgtcgtcggcgcccgttgctgccaccacgttcgcgatctgctgcgccgcgagcgctgcgttcgtcgatgccagcggccgagtcgccgagaggaacgcccttgtcatcgccgccaccacgggcgccgacgacatcaacagacccttcttggtcaggcttttgagcgagattgggctaggcgtcggggtggaagacaattgcaaacggcggtcggcgaagacacgccaggaagactgggcggggaatcgacgcggaagacaactgcgaggcggtggccggcagagatcgatctgcgacactcccgtgaggagagaaacaagatgggctgcggagggggagggaatacgctgcatgtcacacgggatcggatggctcgtcgtgagacccacaaagcacacacgaacccgtgctattgcccggctatagattagtcgctcgctttcttctctctcctgttcctctctcttccacataggaatttaatgagctggatatttttagagcctgctcagtcaacttattgtacctgcttacgtacaatcacagcgtggtccagactccagacgtaatcacataccctgtacacctagcacacattagtgatcagtcaatggaaatggttaagtggattttagtttgacgagacgcagtccctcacgaacgagctagagacaatttttgaaaagaaacggtgcgtgcagcgctgcttacgtacgtgctccgatccacccggcccctgatccggccggctaacttttgcttttacttttgtggcgctgatggggatgcacagtctccggaatgcaagaacacgggtgcgccagctgctgcgtgcgttgcatgcaaatgcgtccaagcaaagcggtcgtcccagcagcttgactgaaacttgaagacttgaggtgctgatttgaaattttcattaggctcaattggccagaaaaagaaacctaaaacgattgatcaaaacaaaaagaaaggtggtttagccttgatctaatcagctaaggtcgatgaattaatccctagttagctgctcatctcttcagttcaaactagtagtatagctatagcccagcttgtgttgatattcagatactgtgtgcaaatgcgtgcaacgcgggcaggcgaccagatgatcctgaagctgggctgtacagtgcctggtgcagaggagatgatagccaagtggacccggccctctacatggcgcagggcaggggtacgtggagtgcccagatttgttgtcactcgatcgatcgtgtgatctgcgacgccatcacgtgagacagacatgcatatgcactcgccgtgttcctgtgtgttggccctggactagtactacagtaaatgtaccgcaggaagtggattttatgggtacatccccttgttttatgtatggtgtttaaaaaattataaaaaaatttgaaaaaaattatcaagatagattcatacatgatatatcttttcgcaaacatgtaagttaaaattcgatttatacaattcgaaacaaaaataacaacattaaccgtgaattacgcgttctattcatagtcaaatttgttatttttggttctacatgtataagttgaatttgaatatgcatgtttatgaagtgacatatcacatattgatctatcgtactaaattttttaaaattttttgatgattttttaagtgacataaaaaatgagagaatatccccttaagggatgaatacagttttccatataccgcgttgcatgttttatttaccacacacggacatacacctggtactccagttcaaacctgagttagttttgcaaactacggttaataatactcgtacttaccacgcatgcacggttaataataagctcttgcaaaccctgtgctagctagctagctaggagtaacatacatcaaccttttttttcaaaaaaagaaaaaaaaaagctttcttgatactttctctcgcggagggcaagctgggccaggcggaaacggccgccacggctacgcgaccgagcagcgtcgttgcggtagagtcgtagagaccgagccattgaagagctcttcccccccttgaccaccaccaccaacgcacccatgcgtacacgtggtttgtcaccgatcgagcgctcacagagagagagagggggagatactccctccgtccaaaaaaaaaaaaaaagacaaaccctaggttttcgtgtccaattttaactgtcagtcttatatgaaatttgtttataattcgtattttcattgttgttagatgataaaacatgactaatattttatgcgtgacttatctttttaatttttttaataattttttcaaataagacgaacggttaaatattggacacggaaaccagagtttgtttttttttggacggagggagtatgtgtgtgtgtgtgaggtgggcgcgccatgtcccgatgcgcgggcgtgtcgggggttgggcccgatggggatttctgttgttggttggaggcagaggcacgcagatcgcgcgtgggtgggttggggacgtactggggtaaccggtggtaacctgaccaacccacgcagctcaattcccgtgctggcggaagacaagggcatgcatgtaaggcggctgtgttgggatggaggagatgggaatcaatctcctgtgcacggaaaacggagtgatctattagtatgtgaataattaagtattagctaattttttttataaatggataaatatgatttttttaaacaactttcgtatagaaactttttacaaaacacacaccatttagtagtttgaaaaacgtgcgcgcggaacacaggggagaggagttgggaacctcttatgccgaacacaccaagcctgtaaaaggtgttgatcactttatcagaaattcagatcccatgttaaccaaactcaagagagcctactccttccgttatataatgatcattatatatatttatacacaaagaaaaagaataatttaaactgtattaatcaagacacactatacacatacttctacaatacatgtatcgattaaaacaccatatcatttatactatagcatgcacatattctcccatcttgcattaattgtatttcgatagaatccgtatccatgtgattatatgatgatcaatttgagaaatatttgatttcattatatgatgattagtttctgaaggagaaagtaataacataatacccacacctaccacatactatgtcatttatcactcaaaagaaaattaccttttgcttttactttcgggggcgctgatcgatcggatgcatgcgtgatcaagctggccgccggacactccctgtacgtttcacctcgcgatctgcagagttcaaacttcaaagtgcaagaataagtcctacgttacccggtcgagcggggacgcataccatggccaacgctaagatgtgacacgtacctctagcctctcccacgcggacgcgatgccaaaaagcagcaaaaagcacgtgcctgcgaggaggcgcgaacctcatgcacccctgcgcgaggcgtcgggtctaaggccagggttcgagccgtggctcgcgctgagcagcttgaggcctcttgggcgtgtagctttacgcaactttacgataaataaggtctcacttgtgggtattacctctattaattggagaaataagctctcctgtgtagccttgcccacctaacaaacggggctacggtttgcgtcggtcatggcctaagcaggcagtgtagtgtatagtagtagcctcgattgttggtgcatacgtacccaggcagcaccgtgcatattcttatcggattaggatcctctgcagtcgactgcaccgcgtcttttatcattgacatgtgagtctgaagatcatcagacccatatgtaataaatgcatctggcagtgaccgcagaggatctcaatccattctcgtcgggttctctttccctcctgcaaagcccggccggccgctgccattcaccgagcggcagctagccagcagcctacagcctgcctctcgctggctctgagtagccaagagtccaagacgtaccatctcttttctgaggccagagaacgtaggtactagtgcaaaccaagataaaaagttaccggagataccaccaaatatctaattattgaataatctgtattccctggcgtttttacattataagatgtttcagtatttttcaatttaaacttctttaattttaactaaattaatataaaaacaaagttaacaaatatattcaacgttaaattttataaaataactttatcctagatggccttttgccgattgccattgaactttgaacaatactacagtgctacgcctgaatatgagtccacgttcacagctcggctctacaagatcttaaacgaaaattaaattgacaaaacaacctcagattaattatccccaatttgaacctaatcacagcaattacttgcattctccaaaaccagactaaatattgattcttgagtagcaagtttgattagcctaaccacaccccccgtacacacgcgcgcatacagtcaccgcgaggtaaggtcacctcccccccttttcccttgcagtgggtctctcgccggtcgatctcccccacgcctccgaagaatataaaagcccccttcaccctctgttgccttgtagcctcaacacctcaccagtgcaccaccccaccaaccacctctcgttttgcatttctctgcgctcgctgtcgctgccatggattacggaggcggaggcggaggagatggtggtgtgcgcggcggccccggccgcggggaggcggcggtgggggagcacagccgtaccggcccaccggcgtcgtgtggccgccgccgccgccgggtagcacccctgtcaccgtccggaggcctccaccgtcgacctcgccggctccgcaggcggcggcttcgtcgtcgtcgacgtcgacaccggacaagctggtgaggcagaaggcgatggagatcgcgctggcgccacccgccgcggcctctccagatggtgaggcgctggcctcggacaatctcgcgcaggtatggaagaaggaactcgtccactcttctcgaggctatggtgtattggtgtacgtcactcgcaaccacgttcccatcaacaaactgagctcatcttaccctctccccttcccacccctctagatctctgcacaaccgtttactactcttctgctgttgtttctatatcgatatagtagcggtagcggcctagatccggttctaggcatgggtttcgagtgctaattctgaatgttttgattctaggcatgggtttcgagtgctaattctgaatgtttttgttgctgatcacgatgaacgttttcgtgtgtgcactgtgttcgtttacgaatctcatgctgcctaatctgttttgagacggcgagattgttgatatatgattccaagtatcgaggcttccgatctcatcctttgttcgtttacgaattttagtgctgcttaatttgttcttgagacggcgagatgttatgtgatatgatccaaagtatcgaggcttccgatctcatccttgtgatgtttggcagaaaacgaaaaccaaagcatatttgaacgtttcttagatgtctttttatttcttattttgtattacatctttattgcatccctgtagagtacattacagtttaatgtatcctcctgacatcttttctgggtgagaaaagatgtattgcattttgaatgcataagtgtcaatactgtacaatttgaatgtattttgagatagcatcttcttgtgttacatttttattgtatctcgctaaagtactgtgctgttgaaatttattccgagagcaattttggtgacaccatgtattacattttacaagaatacatttaagaacacatcttgtaaaatgtgtggtaagatttaagagcacactttgattgcatctgtagataatgccgtgcagctaaatttattccgcgagcatttttctcttgtcaacaaatgagtactgattctaaactctaatgtttcaaaatcttcagataaaaacagcattaggtggggtttgcattgaaacaaatcatcaggatgataaaatcagaaggtacaaggggattacccctattcctttgagccagctgttgtacttatctttcatctgctgtttctgtaactttaactccctttctgtttatgttctctaagttaagggaaatcaatgtagattgttgaccttctgaaatacttgttgaggtgttcacagtttgaatttttagtccgaggaaattcacttcattattctacattagactagacatactacagaggttttcctttcagctaaaatcttctcttttcagaataagtattcccaaatgacagagatactttgtcctccttacaaggttaatcatggtttgcattgtcagcccaaaacattgaattactgtttttctagtaacacatttgtatgtaaattttattatttggatcctaagatccctttgttagcatgctgttaaaaacaacaggtctattaacacattatatgttaagatcatgtattgattgctgtaatgataaattgtttggcttcaacccgtgaatgccgttagttacatagtcccctgcttgaggaatgttaaggaatatagagtcctttacattgtggaaagcttttaaatctgatttttaaaaatgtcaaatagtcctttattttcaatgtagattgttgatggaatatttgaatggtctttgttaaggattttgggcatattagcatatcaattatatctggatgtgggatgaaatattttttccctttaaaatggttatgacttagatatctttcaatcttataaacgatccgtgaatattcaactgaaatgatgtgtaaatgaagtattacacgatttccctgacctgggggagtatagcatgtgctatcatctttttgttagacctgcatttttatttatgtacattggtgtttttttttccaaactgatgcccagtatttaatgttatcagattttctgttgacaagaatgggacaagatgctgcctagactctagcagtgagtctggaccatggtactccaagaagcttaataacaagaagggagtgactggaatccttagtcaatggcacaagcagacggaacagaaagctcatgaggtataatgcgacttatatgcagatccaaaccttttatgccttttgaattttagctccattttgaatatgaccttttatagattttcttagaatgatttgtgtgtagaacatgagactttttgaatatgaccttttgtagattttcttatgatgatttgtctgtagaacataagattgtatttctcttgacgatgtaatttagtcatgaatcatgtatttgtcttgatttccatctcattttttgtcaggttgttatctacaaacgttgtactgcttctggatctgcagttactctttttcttattatgatgagcttggtttgtacggtgagaggaagcaaccatggaactgattgcgacatcggcgagtactcaacgagcattgctcaagtttgtcagtatggtgctcctcccgcagtgtgttgcgaccttttacaatccgctgtccacacttgtggcaatgctagtgttttgtgtgaaattggcagatctgtgccaattacttctagaggtttcaatgttcatgatgttatggattggcaccgagagtgcacgggtcaaccagaatcatccagtgtagatgcatcgtccatttgttatgtatcaggtatatttccctttgcttgtgtgatctgttagcctgctttatctgtttactgaacaacattgtcttatctgatctgttagcctagctagtttaactgtttactgaacacattctctatattaggtgaaaggcacaaagagggcacaaaagaagagggccatcaagtaaatattttgattgagaccggtaacaaggagtgcaacgcaaggaagtcaacttctactaatccgatgtttatcggtttaggaattgggtttggatcggccatgctctttgctttcgcgctggtggtgatttggctgttcgtgagaaggcgatcacaaggtatgagtttttctttaaactagtataattctgtttgcttgtaaatacggccaattgaactcattttcattttgcatatggtcaattgaactaaataagaattcttattcctgcaggaggtcctctggtgccgcagattagcttgctcgcaatcgcgcctcacttctcccaagggcttcctgcgctgcccttccaagagcatcctgcgctgacgcttccctgcgggcctgtccctgtcccgacacctcaagaagttacaacagtgcagccagccaccagtgcatatggtcagccagcgccagtgcagccagccaccactgcatatggtcagccagtgcaaccagccaccaatccaatggcgtacttggcatcagtcgtttcctatgcgattgtagacagacttactagccgccgtcgtcgctagtacttgtgtttgtctctcctcatacttttttacaactttcttctcatacttgagacaactattgagtttgatgatttagaatacttgagatgaccactgaacaattccggttactgtaaaatttgagacagctagtgagtgctgatgatttctgttaatttggttctttaaaatacctggacgactattgattgagggctgatgtttttttcttttgttaatttggttgtttggggtatccagaattcataatttcagtggactccggacttcggaacggttcgaaaacacaaaccacttgtttttaagtttttttaaaaaaataccaagtatatcttaagacaaaaggcacgagggcatagcttttaatagaaagcagataaaattcaaattgaacttaaagtttttggaccaaatttattcggactttattgattttagtcggtttatcaacggattacatgaagagatgtgcttccaatgatatcattcagtagattttgatctaatattaggattgtgagatcctgtttagatgggactaaaacttttaagtccctatcacatcggatgtttgtatattaattataaatattaaacgtagactattaataaaacccattcataatcttggactaattcgcgagacgaatctattgagcctaactaatccatgattagtctatgtgatgttacagtaaacattctctaattatggattaattaggcttaaaaaatttgtctcgtgaattagctttcatttatgtaattagttttgtaagtagtctatatttaatactctaaattagtgtctaaagacagggactaaagttaagtccctggatctaaacaccacctgaatctgctggtgtgtttgattagagataagaaaatatctgtttatttacgttttaagggcctggtgtagataagggcctgaatgaggaacttctcctccatatatttatgatgtttccctagggtccaaatgaaatacgttttctacggctccatatattgtgcggcaatggcggaagctaagtcgaggtttttttttaatggtggaatcaaatgtactacacctatactaatataaaaaggatcaattcaaactttttgctatggccacccaactgaaatgtacaccgaaaggtctcatccattccgtagccgtttgatcgtctcatccaacgcctcaaaacgcatctaccacatgatgtgtgtgtcaatttcagggagtaggaaattggggataaacttgttgcattgacttagctctatgggcaatatattgtgtacaagagggatgggaaataaccaaaatatccaatacacactattacacttaacacccccactcaaatgcaatgtgtatgcaataacgttgcatttgaaaactacaactaaacactaaactaaatcaaaagtccatgcttgatgatgacgtcgaagtgtgcagttcttgaaatgatgaagaagaaatgattcatctcatcttcaatgaagcggaccttggagccttcacggatcgttcttcagcctttaataccttaagccttcacaaattgtttttcagctcttcattgattcagagatggtgacaatgatattgaaggaccttcacaaactgttcttcggtccttcatgattgatgatgatgtcagctccaacggggagcatgatggaccaactccggcagggagttggtgatgatgacaggacaataatgaagaccaactccgatggagagttggggaagttggagatgacctgctccgatgtggagctggtgatgaactgatgatgacggctagctccgatgtggaactagtgatgatggagatagattggcaagacttcgacaaattgaagaataggcaatgacttcaatggactcaatgggaactagtaaatgacatgacgatgctagtatatactccctccgtattttaatgtatgatgccgttgactttttaaccaacgtttgaccactcgtcttattcaaaaattttatgcaaatataaaaatacttatgtcatgcttgaagaacatttgatgataaatcaagtcacaataaaataaattataattacataaattttttgaataagacgaaaggacaaacgtctgttaaaaaagtaagcggttcatacattaaaatacggagggagtatgcagcaggacttgaatagatagactagataggaaacaaagaaaatttgatttgtagaggacaataattgatggatataacaaaagtcaatattgatagatgtgcagcaagcagtaatgtacatctatctattatctattatatactaaaagtccattaaatttcctacaaacgctctcaagccgccacgtggcgctcctacaagcgctcctagatcgccatgtggcattctacaatcccaccatcgattttcatttaaattggtggacctgttattttacaccgttttaggtacgttactttggatggaaaaaaaaccaaaaatataaagccaaaaaaaaaacctgttcaccagggaaaaaaggaaggatgcgtaccatataagcacgattaaagcctaaaggaaaatacatgtacaatgttataaccatcaaaggccttttgaaaatatgatcttctatactataaaaataaagtttattactctacaaatatgattttttgtgcttctacaagcgctcttagaccagtacgtgacactacataatttcaccatcgattttcatttaaattaatggacccgttattttatatcattacattagcccgctttctcttaatctcctatgtatacgagataaactatttaccggatattcgattaaaaaaacccaaagaaacatacatacataccattaaaaaaagctataaagcccaaaaaataaatatgtatgttggtacaacatcgaaaaaatatagacaatccttaaaataggattttctatactatgaaacaaaatttattactccagaaatatgcaagttaaactagatcattataagtatcaaatcaaaggtatttaaacacccacttttaaattataatccgttgtattcaaatgctgatgacttatcatagttatattatgatataaatacattacaacacatggatctgacatataataattaatattataataattttcaaatgatttaggcgacatataataattaatttcatcataatctttgaaataacttcacatcatattttgtggtgtcaaatataacttgacaaatatataacactaactgaaatcgacatgcttgaaaacgaaacaacattatgctttgtcagttatatatgatttaattttaatttatggagactaagattctcaaatgttttttttcatatttttcaaaactatttcattggtattcctaggcaataatcttgctataatacggccccttaatccatacgtttttcccgccagattagtttgttaacaaatgtgcattaaattactcatgatatattttgtttatagtcgaggaattctaatttgtcgggtataaatgatagttgatagttgatgaatgtatgctataagtgcactccaataaattagttatttttaataatttttgaaagtaaataaaatttaaaattagtaaatgtgtctcatgcaattatgaaccaattatgaacaacaggtgacgaaaacaaaccatacgctaaaatattgatctttgtcaaaatataaacaatgatataatggtatgatactctgaagatggttatggtcatatatctgtttagcgatacatttcttaatgatcaacctcactcatttcaaagcagaatattgtatttatacataaaaaattaggtagtactgctcaatactagaaaaaattatgtctacacaaaacgtaaaaacaattattttttatgggaagaattattttcattacatcaatcttttcttgctttctctaaaggctattgaacatcttttacaagtatagttgaggtggccccagtggaaaccaacgttgacaatagtgctcaactttttacttactcatgcaatcatctttaagaatgctgatagtgaattaggacttaaaattgtactgcacactgtccttgagaggcatgagtatgtcgatatggaacccatgtttaaaggcaaccgagaaataaagacttggtatctccacctgttagaggggatattcatgtctaattttcaacactaatatcacatttaccaatagatgcagtattttaagtatatttatttatagatttagaactatgtgttgacataaacacttaggtatatagtggagataaatgttttatgtatttatgatgtattaggcttattttggtgctacagatgcagttccgtttattaaaaaggcatctagcgacaatggtaagaagtaatggtgacaataggcaagtttacataatcaggacaaaagtgatttttttaatataagaaacattcctatcgtttatattaaaacctacaatatatttcacgacatagatttttgttattatgaggtaaaatatataatttcttatacgcatatgatgtgatatgacttaattctcataacgttatttttataatcataatgaataagttccccgcgtatctgcgcgggctttctttctagttactagcaaaagacccaaagaatgctagtgaacgtgttgacagtagcaagcaatgagctaatgatctaactaccactccaagccatcatgataatttggagatgtaaaatgggattatgataagcagctaacaataataaaatacggtgataattgatgagtgattatcggatggcagcgaccagcaagcacaaaaattaactgcatatgtgtgatggagtacaagctcaaagacatgaaaaacaaatcgacgattttgacagattttgcaactgaaattaggagcaaccaacaattttgacagatgatgatgaacaatgaagcattgatgcatatcctttgttctccccaaaataaaactgaagcagcacaagctacatcagtacatgcaaagtaatggagagagaatgtgcagaggagagctggagcttgcgttgacttagccataggcgtcttagcagtgacggctaaagatgaaattgtggaagaggaagagaagatgtggaatatttgcttgctggttggagatgaaatagactacgacggggctcgctgctgctgcatcaggcaggacccctgctgctgctgcttgactccgcgagaccgttcagtctcgctctcccattccgcggtaccacgcggtctcgcactttcgccgcgcgataccatccacgacgtcattcccacgtcgttctcgtgcaacatttgtgcgagaccgacgatatatttacgcaaaaaaatttacatcccgaatatttataagaaaaaattgaattaacagtatattttcaaatttaatttctaccttagctgccaggaactagagaaagctccaggcatcagtcgtttagtaattttgatgttcatattctcgtgagttgccttgccgcattatcatgtacagttttgtgaatcaaaatgaaaaccgaaggattataggttctggaagttccatgctcaaaacaaacaattgttgccatgttagaatctgaagcatgatcaatttagcagtttcttttcgtagctgtgtcttactactttcagttatatgcattagctgcttcaactatgacctgaaacccaaattctactcaattttaagttggaacgaaactagataaaacatgctgggtaggcccacatggtgcttgtgtctatcgagcaatagctagacttatacttggtgggtacaagtccaaatttcccaacaacatcacaattgtttatatgatctgccatatccctgtttttcgtttggatatgttgctaagccgagtaaatattcttaaaaaaagcagagttagaactcaagctgtggcagagttgctctgaaatctgaaaataccaagttcagaacaagcagcacatggtacaatttagctgtattcaaacacatctagtattactgtttttaggatgtacgattttatctatttttagtccaaaagaaaggaaagcaccatatacttcatcctagcaacaataggtgcaagttatataccgtacccttcatttgatttccttgtctttgattcaccaagaactagttctacctgaataccaacattggtactgtatgatagatatgtatgttttatggttctagattttttgagaacccatgttcaagtcttttgtgccaatgataaatttggccgcaactcatggccaatatgaacataactgaaattcccggtttgaacttcattggaaactatttcagttttaattgggactagcacatataggccttgtacttcagaaatatttcaattttactgatgtaaatcggttgtactgcactggtttgcaacctgaaactccatttaaaaatttaaacctagatcataagatattcagagataatggcaagaagtagccgggccactgaagctcatggtggcattagtgctatattataatttctcttgcacttgagtgggtccttaaacaagtattataccatttcagttctgcttcagcactagtgttcatctttttcctggagttgcacatctggcgtttgcagcatttctgtaaattggcatagtataatagtgttgtcactatctcttttaaggacattctgtaaagcacgcatggatggctttctggtctggacatgcaggagaggagcacttatgttatttttttagcacttctattcagggtgaagacatcctttggagcaagcattagtgtcggatcttatgtgattgaatatttgcctgatacttttacctttcgactgagacattttactgcttatgtgattgaataagtagatgtgtagggacagttcttatcagatctgtcaaaccttgtgaattgtgatgatgctattgatgttcagatgggcaagcgattaattctgtgtatatgtgtgctagtgagtatgattaattatgcgtatgggtgctaatgtctatgattaactagatgggtaccccgcgcgttgctgtggaagaattatgtaataatatagacttaatatcggttgagcagtaagaaggagaatcggttatggaatatattcagagatttcgtaatgtccgcagccgatgttatagtttgagtctaagtgatgagcaactagcatatcttgcattccaagggctatcaacacctatcaaggataaattattttgccacgagttcgacagcttagctcatctaatgcagacagtaagtaagatcaattttggagttattaagactagactgaagataatattgaagcatgagctctcgtactccaattttttttttttggagggggggcctgtgttaacaatgaaatttggtaagccttgaagacgtcatcagcctaaaatcaatatcggcttcagagttttggaatcggccgatgagaattatcaagtcgccaatagtcggattcttgctatattcggttaagaaaactaatctattaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 7376 - DNA, 908 bp, Oryza sativa
agctctcttccctttgcaaatatatagccttgtttcaaacttatcctcttcaggtgttttaaacccagaggcgaaacctccctccaagggtataatgcatggtttaaagtacgataggaacttatcagattcatagccttgaagttctctgtgctgcactgcacgacctccgagcatggtgtcaagttcaactgtcttaattgctgcagtcccagcttcatcctgaatgagaacacatcaaatcaagaagtgggctggaaatgccatttatcagtacatgaaacttgagatgttagagaaaatgtacttgactagaatctttcccaatccaaaagtggatgtcaaaaagataggcgccaccacctttgctgcaagtcgtctacaaaacaaaatgaacagatcattgaaactttccatagtggagataacagaaagattcttctaaaatgtaaatataaaaaaaatcacctggagaactatatatgaatctccattgtaaaatttaccgtaatctgcttttggcaaaggaactggcttaaaatcttgaatcctccatatttctgtgccactatattttaattaaggggctaacagcataaaaggatagaaactcttgtacgtagatttctaaaagaagacaactaaaacaaaccataaaggcatttaaagaaggatacggtttttggccaactccttgaaatgcaggatcaagcactggttttgcacttgacattgagcagcaactttacaaaggtttaattgaaaacagggtagtggaagatggctccaccacagaataataggaacttgcacactgaaaagggggagaaaaaaatatatgtcacaagaatagaaagaaaaaatagcccagctaatttggcctttatacatggatcgaagaccagatg

SEQ ID NO: 7377 - DNA, 684 bp, Oryza sativa
  unsure (1)..(684): unsure at all n locations
gtcattaggtacaagcacctgttgttacccctctgtggcacnnaatgaatgagagtgaggaacctgttatacaggattcaacagaaaatggttgccccgccagagaagaagctacaacagcctcaaatagataatgtgccagtacaggagactcatcaagagcctcaggtacaggatgtgccaaatgtgcaggcccctagaaggtctgaaagagtcaaaagatcggctatccgtgatgactataaagtttataatatagaagagtcgcatatggaggatgatcccacctcatatgaagaggccatgagaagcgctcgctcatctgaatggttggaagccatgaaagatgaaatgaaatcaatgaaactaaacgatgtttgggatttagaagaaattcctaaaggagccaaaacagtaggctgtaaatgggtctacaaaaccaaatatgactccagagggaatatagaaaagtttaaagcgcgacttgtggcaaaaggcttcacgcaacgagaagggattgattacaatgagacattttctccagtctcttgtaaagattccttcaggattataatggcactagtggcacattatgatttggaattacatcagatggatgtaaaaacggcatttctaaatggagatttggaggaaaaagtatacatggcgcaaccgaaaggtttt

SEQ ID NO: 7378 - DNA, 1011 bp, Oryza sativa
agcacctcgggttctgcattacgtaacattttctctaggtcgattttgtcctcaacagaaccatcgtcatgcaccatgtcttcaacttgtgtcggaactacattttcaggctcgtccacttgttcttcgccatgacgtgtccatatttcgtacttgtccataaatccgtgagttaccaagtgctccttcactttaaaagcatcgtcaaagtcccaggctatttcattcttacagtcagcacacggacaaattatcttcctcatattgttcttctcagcgtgaaccttggcaataccaataaatttagccacttcgtttctatatggagacaaaaacctcggccaatgatacatccattcccgactttctatatctctaaaaaatacacgtaaaatatttgcacaattaataccaaatttgtagggtttattgaaaaaacttatagctattcaaaactaattaactaaaggttaagttgtaaagtaataaaaaatcatagtttatttcaattttttttacacagacatgccaaattagcacattaggaaaatctaacaaaatcaattcatcggcatattacaaaatactataactattttttgattgcactgaataaatagacatttaaaatttttttctctctctatacatgacaagagctagatctagatctagaactaggtggtggatatgatagcaaaaaattaaaaaacaagaatttatgttaccacattaaaccactacaacaagaggcatcaagtattacacatacatctaacataaacaaatgacaagaaataaaattaaaaaacatggagctcttccttcaaaattttggatgcataaatccatcacaaattaaggtctaaaagcttaaaaaaaatgcatacctagtgtggaaatgagtagatctaagtaccgtagaaaaatcccccgaagatttgaagttcaaaacctcccccctatatttaagtcactttaggagagagaaacgtcggggagaatgaacag

SEQ ID NO: 7379 - DNA, 5700 bp, Oryza sativa
ggcccgcctgcaaagatcaatcttcgcaggcggaccgccccctccaccccaggtaccatttttgccggcggggttttggctccgaattacgtgcacgcctgcgaaaatttatcccctacgacgccgaaaatgagatttctagtagtgttgcaccagcccttcccttattttataagtaaagagtaaaggagattaaaaaaatgtcttaagcggggtaggtttgttcattcctgaaggaaaaacgaggccggatttgttagcttggagagcgagttaatttaatgtctttcagaaatgcatttactttgaaatgttggttttaccatatatatccatttacgatcttaactattgcaaaataaactataaactatttgtgatttttttaacttgtcagacaaagtctccaatccatataggtttgttgccattcatgtttataataatatattcataaaaaatatttaaataaaacaacacaagtatatttattgtaaatctatgaatgcaattattcgcatagattatattatatcgcatagattgtatagacctgtgactaccatatgttttttgacacgtcatgaaaccaatcctactgtttgtcagttgcttatcgggtgacacatttgatgaaaacaagcgtaggaataataacaaaactaaaagaagagaggaacatcgtttctactcctttcaattcagattataagtcgttttgacttgggtcaaagttaaattgcttcaagtttgacaagtttatagaaaaaaagtagttacactttcatcacaagacaaatatattatggaaatatatttaatatatatatatatatatatatatattaattgaaactaaattactgttgtaaatattactatatttgtatacaaacttagtcaaatttaaactagtttgattttgaccaaaactaaaacgacttataatcagaaacaaagggagtactcttatttcttactagtaaaatggccgtgctttgctatggataaaagaaaatatattataatatgtaatagatattaaaaattatcgaatatattaatgccacttgcttacttgtttgaatatacagtatttacttgtttgaaccatatatttggactattccataatataaaaaaacaggagcctatttggaaaacagtgggggtggcagattcactaccaccacatctagggacttttatgtacaaccttcgttttgaatataaggatgtgtctatgttgtttatcaggtgtttgtcgaatacttatatcaaaagattcatttttagtcacttcagttgtcaatttttgaattttgaattatttagatatcatttacaagaatctgattacctatgcaatcactgaaatgatgggaatcaaagtaatcagtgcatgaatacttatagtgtggtaccaaagaatggagggagtgaataagaaatgcaacattcaaatattatagatgttactattaattgtcagatcacaaaaaaatacggcagcttattatagagggcacctttaggctgcgattcggccgacatgggcgctctcctcaacaagaaattccctttttccatcatgaaattaaagaacaacgaaggctagctagcaaaccagcaagatatattcagaagaacattgaagttcatcatttattcaccacatatatataaatagatgcttcctgacaaaagaaagcactaattatttagcaaccccacatagtcacacacacacagctaactatagtagcctagtgaccggttcttggggtcctaggatacccaagccagtagcagacaccaccaggcccattggggatgtccacgttgcagaacgccgggaggctcgccgccgcgcgctccaagtcccctctccggcagccggggaacacctcggccatggggtgcccggcctcggtggcgccgagctccctgtagatgcctgacagcatgtgatcgagcgccccgcacctgcaccagccgtcgtcgacggcggcgagctgccggcagcagtcttgccagacttgctcgtccgcggcgctggccgcgccacggccaacgcattggcgcctcaccaatgttcgacattgcgggagtgagtatgtcggatagcttattcctggccgacattgctcaccggggctgtagacttggtggtggtccgccatggtcgccatcgccgccgcgagcacggagagaacgacgaggagcaataccgagaacactaccttgttggaagccatattttgcttagtttgtgaaaaatcttaattaactgtgatagctaggctcttcgtctctgggtggttttatatatagctataaagaccaaagtgattcaagaacagatagaaattttttggctgttcatgagctatttatggatttgcttgtggttctgtatgaaacatctattgtgattcacacgcctaatctggggcatcatatggacaacagatggttaaagtggattgatatgtactacactctttaattatttgaatttgtttgatccttacgtggaagaaaataaatgctatatgtggctatagaaagactaattaaagtgattcaactttgaagaacggccacaaaattgttttagctgttcatgcgtggttagtatgctcttggggttttgcatgactggcatgagcaatttgcttgtggttttgcatgaaatattttttgttattcacggctaatctgagcattatatattttgacaaaaagttggtttaaagtggattgatatggaccacactctttaattatttgaactcattttcattcttccgtgtaagaaaagaaatgcacacaccgtcaacagacatatagtactatgggtaacaaaatcttttgatatttatatttatccaatttgtttaatgacgaaaaggatagttcaaagcaaattatgtttatagctacccgtggcatgattttgttgttatgtcatatcggaagtggtcttgaagtaataacaccttgatgtaatttgtaagatcaacaaagtttcctttgtcttcaaagaatgtttgctaatttgcaaaaggaaaaaagagtattgttagcttggggattgagcttaatgtttttccataaatgtatttattcttaatgtcggtttatcatatcgatgatgttagttatttcaaagtaaacaatactcattgggaaagactctgagggaaaaaattatgcgggatctttgatgaggacatcccagctacacttgacgtgaacaaggctgatggttacgttatacatcacatggagaaatttgaagatgacgtaaaccaagttgatggcttacgtcttagtaagaacgatcaaacatatcatggtccaattatgcacagccatgctaagaaaatacaactagaggtgaactcactctttgctcaacttaacccaaattttaatgagaattttatactacctaaatattctacctttgtcttgctaaggtttacatcggaagacatcattactacgccaagaaggatgggttatgttgaggatgacaagagttacaccgagcaggaattagcccatgcactaccagcagctgtctacgccaacaaaaagttggtttacgctacaaaggctcaacatccaaggcttgtacgacccagccagtcaagttacgggttgcatggcatacatggttggaaagaggggcatgtctagcttccaatgcttcaaaccccatctcaatatcactttccaataaaaagttagagcatttttactgaggactgcgcaggagctgaagggctgtgcgtgaacccgagaaaactttttgcattctcatttatgttagccttgatcaccagaacgtggcttcttatgttcacacctacgctaggaggaatgttcctagtataaatacacttctaattcatccattagacaacttttgttcaattgaaaacctcatgtatgagagattattgaagtctgcataagtcttaccctttttgttctcgtgagttcttttgggcttgtgagaaggatcctcttgtgtcccctagttcgtgattttggccctcgggcctcttgtgtggattagttctggattgtggttctgtaattgctcgttttgacgggtcagagtccaggaaacttcggatcattctcacactcaccacttggtcgcatccaaccttggcaggtataaagctagttatcctctagctacgagtagctagttaccctcttgtgtacaatttatgccggtgctcttttgcttcaaacctactaccgtgaagatcgggtcacctctcgcgattgcgttcgcaacaaccttggttattcgctcttctagaaatacttctatttactgtcggcacgaatcttcacgaaagcaatagcttacatagacatctttaatactatagaggcattgcaaaaatatcgcacaagtgccttttgaataatctctataaatggggaaacattttatagaatgtctccattcacaatgtgatttttctagaagcatttttatgtgtataagagagtggtaaattttaaagtgccaaaaagattgattctcaaacaaagtaaatttgtctctaaaataaaaaaagttccaagcaattattaaagtgcttctaaaatgtgtctctaggctatagaactcctaagtttagagatgatttcaaaatcagctatagaaaagtgcccacgtacttaaagtttttcatgtgcttggagcagtcatcacctcctacctcagctcatgtccccaaattctcaccttctctcttgtctcaactccccacctcccttccttctccttggccggaggcccaatctccgtccagagtgcaatccatgtgcaggggcagcgagctaccccaacttttcctactctctcccactacctaactctccttccatctaagctgaagtcccaatgtttggccagatgcgtagtgacggtgccaacgtcaactcatccaaccatggggacggccgtcaaatttgttaaggtttattttggttacaatctgaaaaaccgtgaagtattttgggattggtgaaaaaccgaggtcatgcataatttcttccacatactttaggaaaatatatcgtaataagaatttctaaaagcattacataaaaaaaaacttccaagaacaaaactaaagaagagaggaacatccattccacttttttatttcttattagtactatcacatacataagaggagaaaattatagatgctacaattaattgtgggcgatctcacccccaaattaaaatagtgcagattattaaagagggcacttttaggctgcgttcgagcgcaggagaaagagagaaatattgtttcgtttttcgcgcgcacgcttcccgaactactaaacggtatgtttttttcaaaaaatttctataggaaagttgctttaaaaaattatattaatccatttttgaagtttaaaatagttaatactttattaattatgtgctaatggctcacctcgttttgcgtatcttcccaatctcctcaatcccctccttctcaaacacacccttagtttgcaaaatccgcactccgtcagcatggatgccatgcctgccatcctctggccgacgcagcccagcagcggtgctattcggtcgacatgagcaccatgaaattcttttttttcacaaaatgaaattagggctgc

SEQ ID NO: 7380 - DNA, 3948 bp, Oryza sativa
gccggggaacacctcggccatggggtgcccaacatcggtggcgccgagctccctgtagatgcctccaaccatgtggttgagcgccgagcacctgcaccagctgtcgtcgaccgcggcgagctgccggcagcagtcctgccggagttgctcgtccacggcgccgccgggtgcgccgtggcccacgcactggcgcttcaccaccgcccggcagcgtggcagcgagtacatcgggtagcccattcctggctgacaacgctcgccgaggctgtacaccacctggtctttgtggtggtccgccatggtcgccgtcgcggcgagcacggagacgatgatgaggagcaacgccgagaacactaccttgttggaagccatggctttttgtttgcagaaaatctttagtctgaatttgtatgagagggataggtttaaggtcttcatctattggtggttttatatatagctataaagactaaagtgatttaagaagggacataaaagttttagctgttcatgagctaatagattaacttgtggttttgtatacatataaaatattaattgtgatccacgcctaatgtgggcatcatatggactaaagttggtaaaagtggattgatatgcaccacactctttattaatttgaaccttccgtggaagaaaattaaagaaatgcacataatgtcaacagacatatatagttttgcatgcaaggtaacaaaatcagttcatctttatttccatggcttgtatagtgatccaaattgtggaacaataaaaagaatagttctgaacaaatactttaaaaagaatgctctggaagctgcagtaacgaaagctgcatcactagatttcagaaaattaagaaattaacgtgcctgatgaagcatataagtattggagttttctgaaacacaaatatcatatatatagatagctttacgcgcacgttggataacagggttatattaacaaggcacggcattatatatggccaggagaagtacgcacgcataatcactttgtttaaaaattaatgatacaaattaaatgttaggaatattttgtgctataactttgtcgacttgtaataaagtaaaaaatacgtgaggttaaaatataggtattatgtgaggtggaaggaagaggttttttatttcgtgacaaaggaaaaagaaacaagctagagggttgttagcatggggtgtgagtttaatgtccttcaaaatctatatttatttggaattgttggtttgaccatatgaatgaccttagtttttgcaaaatatactatactccttgtgttcctttttatttgtacaatcacgacatagtctctctcgccaattcattaatttttatcattcctattgataatcatatattcataataaacagttcaatataactacagttatagtcttttttttatgataaatcaatgagtgccatctttgaatattaaatcatattatatttttgcatctataagtgattaaaaaaataatcaagatttcattgcctcctatacatccaaaacagcatctatttgtgaacggaagcaacactttaatggcttaacaagtgatcttatttgtgcagtcagcgatatactctatctgtactctatctcaacaaaggagtatatgagaacccttttgttgtgtatgacatgtaggggtgaaaacagtacggaatttttccggattccggtcatgttttcggaaacggaatcggccggtcggaattttttcggaatttctcggaatcggaatcgaaaacggaaatattttctcggaaacggaatcgaatatgataatagcagtttccgtcggaacccggaaacgatcggaaacattccggaaaaattgtcggaatttccgaagttaaaaataccatagattcaatagtccataattcatccctagcttcccagcccaacccaaatcgcggcggcatctaccctaaccggctaaccctataggagagagaccgtcagactcagaactcagacgcgactcgcgagttggaggcggagcggcggctgcggcatccagatcgcggcatcgcggcgccggcgtgccctcacgcccaccgcccgtggcgccggcgccccaccgcccactgctggtcgcctggccggctggcccccgccgtcctcgctcccaccatctcgcgccgcccttgctcttcgtcgtttcgccgccggccgccgccaccatctcgcacctccgccggcctgctcggtccccgccatctcaaggcgccgtcccaccgcgtctcgccgtttcaccgtcgccaccaccgccgccgacgacggaacaaccaccacaccgacgaggcgacgacgacaccaccactgcagtctcttcctcaccgccaccaacgccgacggctcctcgcctcgcagcagccagcagcccagcggcagcatctgagcaaccagcagcagcaggtgtatatagtgattgactttgcacttttactaatgctctatcattttttttgaaggctaatggaacggaacaagagacagagacagtagaagcggaatgttctaatgaggatggcattgcgccaatggatgtttgaagaaaatgttggtcaatttaattttcaagttacatctaatttcaagtttccatttcaaattagtgtactcctgctgcacaagtggatgagatatgtttgaaccatgtactgatgtgttttgtgattgaactatgttttgtgatgaactatgtatttatagggtgatgtgttttgtgattgaactaagtactgaaacactgatggactgatgtgcgttgctgttctgtgatgattgatgaactattgctgttctgtgatgattgatgttgtgaccttaggtcacgaacaagatcggggataggccggaaagaagtgttttcccgcctatccttagaaacgagctcgaacagcaaacacaacttttgaggattacttttgtattcaagatgttttgtcctgctacaggtttttgactggcttttataaccagtggtcgtacacgtgagattacatttttacccctgtgggtctttgtaagtttactctaatgcccctgccacatcagcgtctgtgggggcattctagtacatctccaggggtcttttagtcttttaggtgctagctggcgagagtggttgaaggtggtccccacggaatcttcccttggcatcttctcttgttcgagtagtgctcttcctcgaactcttgggaaaaatgccttttccgtcctggaccgtcttcttcctcccgggaattcgaattcccctttgccttctctttcatccttggaaaacacctgtgaaattgtaacttgtccaaaatatgtgtagttgtattagcgattatggaatgtccctaaaaaggtgttcttcacccgaagaggtattttctattcgaatgagtgttcttcctctgggaaggtattttccctttgggaaggtgttcttcctcttggaaaggtagtttccactcaaaatgagtgttttcccttctggatacttaggtcttgcaaaacctcgtagtgttttgaccgaattggaggaaaaggtgtttgcaccctgctacaacaagcccctcacgggtaagggcgatgtgtgttttcggcggaaaccgtgcctgagtttatggaaaaagggggaaaaccgccgtcctcctattcggtcgaaacacactattcaaatatgcatatacgccacgtttactattcatttatttttattcttattatttttcatttttattaatttattcaatgtgtttttttttgaatgccacgtgccggtatttcattggtgcgctcaaggggtcgcgtcgcttcgggtttcgtgtccgctcgtaaacccgcgacccttaccaccctgcgctatataaggccaggaggggtcgctatcacgtgacccacgccaccactcgtttgct

SEQ ID NO: 7381 - DNA, 8951 bp, Oryza sativa
tcgtttgctctgccatcaactcgaaatcacaaaatactcgaactaaatctctttcttccttcttccattcgagttttggtgctttgcttgatttcttcctttctcactacacaacatggggaaaaacaagaaaactgcggaaaagtcgaagtccaagaaatcaaaaagccacgaagatacttcttgtggtattggtgcctcttcgattaaggaaaaaaacttaaacgatcttgttgatgttggttggatatctggtcgaaacgttgtaattcgaccagtgggagaatcaaggccttctcccaagctgggatacactcttgtgtttgaggatttcttctacgccgggtttaaattcccatgcagcacttttttggttgaggtcctgaaattgttcagacttgagtttcctcaattgactccaaatgctttagttcgaattgggcttttcgaatggatgattcgaagctgcggtgggacccctcgagctgaagactttgcatacttccattgtactcggcactacaccaaacagaactcgaagtttgggtgtgtaaactttgctcctcatcccaagcgcggaagtccatggccagctgtgtctgctattcgagcaaaatgggggaacaagtggcaatcgaagtggttttatcatcaaatccctctcagcctgctgaatgataaggattgtcctttttcgttctctgggaagaaaccgaaaactgtctccgagccatcagtctctttgtcgccggagttcactgccatacaacctcgaatcgaagaacttgtttcgaaatttagctgccgagacctggtggaagagtttgttcttctcaaaattagacctctttcgagcggctgggatatcactctcggagaaatccccgaaaattgcccttccagtcttcctccatttgtggtttcgtctgatcgtaagtttccttttcgaactgcaaaccttgtttgtcttgaaaaagtgatttagttaagaagatttattttctccctttgttatcttcttccttgtagttgtgattccagaggatatggtccgcccagttcgaaaatttcttggcccttataccaaggatgagcatttgaaatttttgacacttcaaaatgagaaaaggcaaaatcgggtcttcgcctctctaggctccgatatccctgtccgcgttcatcctgaaattgtccccaaactaaagaaaaagaaatctgtgaagccctcttcctctgatgatgatgatgatgttgaagtggaagatattgacgaagaaattggggaagaaaatgctgaagaagaagaaggcgaggaaggagctgatgaagaagagaacgactcgggtgatgatagcgactcgagtagcagttcgagcgacaactcgagcgacttgtctgaatctggtgatagcaaaacagttcctcctcctactgttttagctgatttgaaaaggaagaaaactgccagcagtcctcctcctgaaccgagttctaaacgagtgcaacttgttattgacagtgatgaagagttggatgaagatgatatccgtattgatctttctgctatccatgtcaccccaattcgagctgatgctagttttgccctttcggcaaaagaagtagcttcactgtatgttgttgccccaaccaccacggttgtcgagaaagattgctcgacccaagtgggtgatactgttgagacaacaaaccctcttcgagctgatcgagacttggttgcaaaaaaggcaaaaacgcccgtcagtgcagccgaaaagtccgaagcagggaagagtgctgctgatggaggtgttcgaactacaggtagttcgaacccaactccacctccgtcaccgccgttcatcgcaaccccttccccagagctgatacaaaacgttcttggtggttttagcgaacgatgcgcaaaagatggacattggcttatgggtcttcctaatttcaacgaactcggggaaagtagccatcatggcccaaacctgtgtttgaatgacctaaagtatcgccaccccctgagttcgattggtgatgaactcgagaaagttctgattactcctgatcttgaaaaggagtttttggaagaaaatgatcttatgtcctcttggacagcacttgatgtatctgctgcacaggtatttttatttatctatttatttatttatttatttatttattattattttctttttaacttaaaacctattttctgatgcgcagactgcgagccttgctcgtcttcaacgtggtgttgctcggaaagctcttcgagctctttgcacgcaacggaagaaatcacttgatcgcatcgctaaactcgaaaaggatcgggattatcttcgctgcaaacttgatcgaatggccgacgagaagaaaatcaccaccgatctcgtgcgcaagttaagcggcgaaaagaaagagctttccgaagaaaagaagttgcttactgaggaaaagaagaaattactcgctcatgtaaaagcattcgagcgaaaaatcatcgagtatcaagacgtcgcacgacaacgcgctgaatcagaagacaagatgaaggagcaagttgaggtcttggagaagaagaataaagaactcgaactcgcctgcaaaaatcaaagcgagaagatatctgctttagagctcgagagcgaaagttgccgccaacttcttctgaaaagttgcgagaccgttcgaatcacgttgcgaagtctaggggctgacatcagcttgctatcggaagaaaataccttagcagctgtgggaaaatggttcgaggaattttccattgggctaaaagatagcgttactccctttgcatctcgctgctcgaagactgctgtggagagcctttcggcctgtctgctttcaaatgggtgtgaacactttaccacccttaaaactgatatacaaggtatacttaatgatgaggccaaatttgcacagcttcgagatgcagctcaacccgtcgtaaaggctttccaagtgctttactggaagaagaaaggatatgaagataccctgaggtctctccgagcatctcttgcctcgagatcaaagtcacaaccggccagttcgagccaacaagataaagacagtagtactccgagctcgagcgcacaggtgtgacgttcgtgaaaagaatagttaaggatgcttcgtatgttcgaaaacaatgctattttgctgcttcaaaaccgttatggttgagagcctttattgtaaaaattcatctcttattgcatgcttttcacggaaattccctttctttgggggggctgcatgttaactcgaatcgaaaacttgtgattcgacgcaacaacactttgcctactcgaaatgtgaagcacttagcatttcgagaccctgcaaagctttcttctaccaggaccgccgtctccgatgacgaactcgaagcctgttatgataatacttgtatatttgcttttaagtttttccgatggcaacgaagccatcgacatgacagtttacgtgactttgtacttgagtttagggaacggcgttcgaacaatactcttgctagtaaagccttttggcaaaacttccaaccatccgaacgccaacgtagaatatggaaaaggcgttattcaatagttccatatacagtaatgccttctcctctcaacattgtttatcccgactcttttctttcttctttgtagagtttgtatgtaacttgttataccttcttaacatcaaataaacccttcctttcttcttttctttataaatgctctttatttcaattgttcaagcacccttaggtaaactacgtcctccttatctttggaagaagttacgaaatcgaaacgtactttatctcgtcacgtgcattttccgccttttgagctcgagcgaggggaaaatagagttcgagcattctttagttggttttttggactaaggcaaaatagttcgaaaaccgccgtcctcctcacctttcgaaggagtgacgaggtcgaaacgtattttatctcgtcacgcggattttccgctttttgagctcgaacgagaatagagttcgagcattcctgagctggtttttaggactaaggcaaaatagttcgaaaaccgccgtcctcctcacctttcgaaggagtgacgaggtcgaaacgtattttacctcgtcacgcggattttctgctttttgagctcgaacgagaatagagttcgagcattcctgagctggtttttaggactaaggcaaaatagttcgaaaaccgccgtcctcctcacctttcgaaggagtgacgaggtcgaaacgtattttatctcgtcacgcggattttccgctttttgagctcgaacgagaatagagttcgagcattcctgagctggtttttaggactaaggcaaaatagttcgaaaaccgccgtcctcctcacctttcgaaggagtgacgaggtcgaaatttgctagtcgaaagtattcgactcctagcgtgaggagttatattttgtcgactttgctagtcgagagtatttgactccgagcgtgcggagttctattttgtcgactttgttagtcgaatgtatttgactccgagcgtgcggagttctattagactttgttagtcgagagtatttgactccgagcgtgcggagttctattttgtcgactttgttagtcgagagtatttgactccgagcgtgcggagttctattttgtcgactttgttagtcgagagtatttgactccgagcgtgaggagttctattgcaatcatacacagaggcatgttttttatacaggttcgggcctccattatggataaaaaccctacgtcctgtttatatacattaacttggatatcattcgtatttacatctgagtgagtatactacaaactcgagctcccgtgttctcctttttctctttctctctctctctcctttttttttaggcataaaatttctttaaagaaatagcattccaagtatgctttaactcatcaccatcaagatatgctaacttgaatgctcccgtttctgtcttctttttgactatgaatggtccttcccactttgactcgagttttccaacagctacctcattgagcactttcttcaagactaaatctccttcttcaatcggccttgtctttactttttggttgtaatagctctttgttccttctgtgtatgatgccatcttctccaaagcttcaacccttatttcatctagcatttcaagagttatgtctcttccttcttcatctttttggtcaaatatcattcttggagaatgtgcccctacttcgcttgaagtcattgcttcatcgccataaaccaatctgaaaggggtcatgccagtcgaccttactaccgtagttcttagtgcccaaagcactgatagcaaatcctccggccattttccttttgctgatccttctaacctcttcttgatagcttccatgattttaccatttgccctttccacagctccatttgtctgaggatggcctatagaggcaaagttgatttgcaaattaaggcctttacacatgtcttgaaattttccagattcgaattgctttccattgtcacatactatttcccttgggattccaaatcgacatattatgttcttccaaacaaacttttgtagtgctgcagaagttattcttgccactgcttctgcctcaatccatcttgaaaagtattcaattgcaacaatgataaagcgcaaatctcccttcgctcttggaagaggacctactatatctattccccatctgtaaaaaggccagactggcggaattggttgcagttctttgggtggtgcttttgtcattgggccgaacttctgacatgctttgcacgtcttgatgtatttctctgtatctttcataattgttggccaatagattccttgtcttatgacttttgaagccactgaccgtggtgcttgatgagctccacacaagccttcatgtatttctaccaccatcttcatgccttcttcccttgttacacactttaacaaaggagcagtaactccacttttatacaactgtccctctaccaccttgtattttttggatgttagttgtattctctttgcttcttcttccttttctggaagttgtgcactggcaaggtatttcaagatcggttctctccaatctccttctctctgtatgcatgctacttctttcttttcgtaacttggctgggtgattatatcgaaaaatgaattttccaatggttgacctgttgcggctgccttagctagctcatcagcttctccattttcttcccttgttatggcttttaccgttattcccaagaaatgtttctcattcagccttgcttcttccagatatttagccatagtttcctcctttgcttcaaaggatttggaaaagtgacctgctaccaactttgagtcagttttgactattaaccgccgagcccctagcgctcttgcctttctcatagccaataaaacgccttcatactctgctgtgttgtttgttgaaggaaaagctaattgaacagaatacttcaacgtttgcttcattggtgttttcacaactgcagcggctcctgctccggcggcattgcatgctccatcagagaatactatccatggtttttcgacttcttcctgttgttctacctcattgggagtccattctgccacaaaatctgctagtacttgtgactttatggctgttcttgatatgtatttcaggtcaaaaggtaagagttccattgcccattttgctattctccccgcgacttccttgtttgttaacacttctcctatcgggtatgccgatggtattgttatgtcatgcgacagaaaataatgcctcaactttcttgaagccatcacaattgcataaatcaacttttctacttctgagtatcgtgttgttggtccttgtaatgcttctgagacaaagtataccggcacttgcctattttcttcttcttgtaccaaaactgcgctaactgtcgctggagttgctgccacatacattaacagaggttgaccttttggcggacttgctaatgttggcatttcatgcaagtatttcttcaagtcctcgaaagcttgttggcattcagcagtccactcgaaggtgtttgcccccctcaaagtcttgaagaagggtaatcccttttctgctgatttagataaaaatctactcaaagatgccattcggcctgtcaatctctgcacttctcttgtgttttttggcggctccatttgatggattgctgcgattttgtcaggatttgcctctattcctcttttggacaccaagaaaccaagtaactttcctgctctaacgccaaaaacacacttttctggattaagcttaactgagcattttctcaggttttcaaatgtttcttgcaaatctttgccatgggtaaatgcttgtttactctttaccacaatgtcatctacgtatgcctcgacattccgtcctaactgcttagccaagacttttcctatcagcctggcaaaagtcgctcctgcattcttcaaaccaaatggcattctgataaaacaataagttccaaatggtgttataaatgatgtcttttcctcatcctccttcaccataaaaacttggtgatagccagagtatgcgtctaagaaactcattagttcgcatccagctgtggcatctaccaactgatctatccgtggcaaaggaaaatcatcttttgggcatgccttgttgaggtctgtaaagtcaatgcacattctccacttgccatttgctttctttactaacactggatttgacagccattctgggtgcatcacttctcttatgactttcgccttcaacaacttttcaagttcaatttttgcagcttgttgtctgtctatagacattcttctcaatttatgttttttgggcgtgtatcgtgacttaatcgctaggttgtgctcaattagacttctatcaactccctgcaactcatctggtgaccatgcaaatacagccatgttttctttcactacctttaagatttcttcctcaacatgtttttccaagttttctcctatcagaatgaactttccagggtcatgttcatccaactgtactttctttgttttcccttcaggaattggcttttgtatttttatgtattctccctgtttttggtcaaccacatgtactcctttcacacttggtgttccttaaagctcatactttcttcctgcaagctgttctcctcggaccgttattactccccttggtcctgggagcttcatacatatgtagttgtggtgtattatggcctcaaaaatattgattgttgaccttccaagaattgcattgtactgatatggcatatcgaccacatcaaatactatctcttcttttctcacattagtgccttttccaaagaccacttgtaaagatatttttccaattgcatgtacttgttgtccaccaaaaccttgtaaaggtactcatgcatttgttaacctatcttctggtatttgcattttcttgaaagcatcataaaacaacacatccgctgaacttcctccatcgattaacactctttgcacttcgcattgtgctatttccactgagaccactaaaggatcttgatgagggaaaagtattccttctgcatcttcaggcccaaaggaaattaccgtttttgagtatactggtggatttgactgatagcttgtcccgacatgatttacctgtctgacatatgcttttctttgcctttttgactcaattcctaacgaagagcccccagttatggcatttatcactctctttggcacttcttcaattgcctctatcttcataacttgcggtgcttctatggcgttttgtcctcgttgatcacgagctccttcatacttgttctcatatcgatttacgtgtttttccaacaagtgagtcatttgcctgcattcttctgtggaatg

SEQ ID NO: 7382 - DNA, 737 bp, Oryza sativa
ctattttgtcgactttgttagtcgaatgtatttgactccgagcgtgcggagttctattttgtcgactttgttagtcgagagtatttgactccgagcgtgcggagttctattttgtcgactttgttagtcgagagtatttgactccgagcgtgcggagttctattttgtcgactttgttagtcgaatgtatttgactccgagcgtgcggagttctattttgtcgactttggtagtcgaatgtatttgactccgagcgtgcggagttctattttgtcgactttgctagtcgagagtattcgactccgagcgtgcggagttctattttgtcgactttgttagtcgaatgtatttgactccgagcgtgcggagttctattttgtcgactttgttagtcgagagtatttgactccgagcgtgcggagttctattgcaatcatacacagaggcatgttttttatacaggttcgggcctccattatggataaaaaccctacgtcctgtttatatacattaacttggatatcattcgtatttacatctgagtgagtatactacaaactcgagctcccgtgttctcctttttctctttctctctctctctcctttttttttaggcataaaatttctttaaagaaatagcattccaagtatgctttaactcatcaccatcaagatatgctaacttgaatgctcccgtttctgtcttctttttgactatgaatggtccttcccacttt

SEQ ID NO: 7383 - DNA, 445 bp, Oryza sativa
ataacttattaaaaatacaacttttgttttggtcatttttctatatgactttgattcaacaatttgaatttgaaaatgccacaaatttctcgttttgacttcgccagctcccagaagggggccgaatgcacgattttcggcggaccccctggtagacagtgcagaaaaggcaaaacacatcttgaatggtaagagtaggcgaaagaaggggaaggtatggcataatgcgaaacgagtgaaataaaaatatgccaaagacttcgatcatcaaaaggtaattaagattatgtcatacattccaaatataccaaaaagccttttttaaggtttagcggcagtttgccgaatatacaacggttcgccacatctagcgaacaccaaaagaaaactatgaaaatctaagagaagggtggagggcctcacacctctgggtggtcctgggcat

SEQ ID NO: 7384 - DNA, 932 bp, Oryza sativa
gcagccctttctccttctttgttctccccctgggcatctccttttgcctgatctgattgcttttccctagcccctggtattgcacactgatcacttgatcctcctgctcctactgtctgattgtgtagggtttgcaatctttgtaactctttttgcaattcctcatattgtcctttactcaccatgacagccccttgcgcttggaccaattcagccagctctacatcactcatgggtgttttccctgtttcttccaccaccgcaccagcaattctttcttcttgagttgtttcattacctcctgctgctgtggatgtcttggccatctctgcccactgcttatcaagtgtttccgttgctcttgccaagtcactttcttccactgccttttcccactctctctcgagtgcagctgtcgcgcttgcaaaagctcctgtatagcgtactggcacagtcttctgtcgttgagaacgtcgcatttactgtttgagcccaattcaatggagactttccgtccccacggacggcgccactgttgtgaccttaggtcacgaacaagatcggggataggccggaaagaagtgttttcccgcctatccttagaaacgagctcgaacagcaaacacaacttttgaggattacttttgtattcaagatgtcttgtcctgctacaggtttttgactggcttttataaccagtggtcgtacacgtgagattacatttttacccctgtgggtctttgtaagtttactctaatgcccctgcacatcagcgtctgtgggggcattctagtacatcttcaggggtcttttagtcttttaagtgctagcctgcgagagtggttgaaggtggtccccacggaatcttcccttgccatcttctcttgtcgagtagtgctctttctcgaactcttgggaaaaatgccttttcc

SEQ ID NO: 7385 - DNA, 3218 bp, Oryza sativa
ctcttggaaaggtagtttccactcaaaatgagtgttttcccttctggatacttaggtcttgcaaaacctcgtagtgttttgaccgaattggaggaaaaggtgtttgcaccctgctacaacaattgatgaactaagtgttgatggactgatgttcttttgttgttctcaaacccatttcctggagtgataggctgatagcagtatagcacctgaattgtgtataccttataggcttataccattctgttttgctgtattcttttagaatatttgttatgcaaattatatgaagttatagaagaatatattttgctgtgagactcagtttgaggggtttatgtattccgataaattttcgttaccgtatccgcgccggttcgttttcgctccgttttcggttttgataatattcgtttccgttttcgttttcggggtttccgatttcgattccgattccgaaaaaaaatatgaaaacgaaaacgataaaggttgtttccgtccgtttccgtaccgttttcacccctaatgacatgcacgcattatcatacatccatgtctactaaatttttttttcaagtttagtttgcacctataaaaattaaaatctggaaattcatttgcacgggcgagtacttaagagaacgcaatgttgaaattgatctccacggctgtcggtatatatttacaaatctcgcgaatttcaacgttacaggccatatagtcagcctcgaaaatgcccatgtaaacgaactagctatcggcggtctacacaaacatttttttatagtgtcatggtgacactcattttttctcaccttgaaaattataaaacaatgaagcgtagcaaggaaatcttcatagagatataaacagaagaacatctgagttcatcatttattcatcatacatgcttccagataaaaggaaacacaaattatttagtaaccaaatcacacacatgaacagccaataactagctacatacagaaggctagtagccagttcccggtagccagtagcagacaccgcctacgccattggggatgtccacgttgcagaacgccgggaggctcgccgccgcgcgctcgatgtcccctctccggcagccgcggaacacctcggccatggggtgcccagcgtcggcggcgccgctctccctgtagatgatcctcagcatgtggttgagcgcatcgcacctgcaccagctgctgtcgatggcggcgagctgccggcagcagcctcgccggacctgctcgtccaccgtgccgggggcgacgcactggcgcttcacgaacgcccggcatcgcggcagcgggtacgtcgggtagccgattcctggctgacatagctggccgggagtgtagaccacctgttcttggtggtggtccgccattgtcgtcgttgctgcgagcacggagacgacgacgacgagcaacgccgagatcactaccttgttggaagccatttttttttgtttgcagaaattcttgattgttaatttgtatgagagggatagaagctctcccatctatgggtggttttatatatagctataaagactaaagtggttcaggaaatggagacaattttttttggctgttcatgagggattagcttgtggttttgaatgaaaattttgttgttattcgtacgcctaatctggcatcacacggataaaagttggttaaaggggattgatatgcaccacactctttaattatcaacttattttgatcttccgtgcaagaaattgaattaatgcacacattgtcaacagacgcgacgcatagttatgcatggtaacaaaatctgttgatctttagttccatggcttatatggtgatccaaattgttgaacaagaaaaacaatagttccaaacaaatattttaaaagtaatgcctctggaagctgcaacagtagacgtgcctgatcaagcatatatatattggagttatctgaaacacaaatttcatatatagatagctttaatgcgcacattggataacaggttatattaacaaggcacggcattatatatggctagaagaagcacgtacgcaaaatcactttgtgaaaaaatgatacaaattaaaggctacaaataatttgtgctataatcctgtcgagttgcagtttgtgccagccctttttttaaagaaagtataagggatatcaaaatataggtcttaagtgaggggcaagaaagagtttgttattttgtgagaaaggaaacaaaataaaacaagagggttgttagcttgggtgtgagtttaatgtccttcaaagtgtatttgttttatctgatcgatgatcttaattattgcaaaataaacaactcattgtattccttttttactcgtcatacgtaccatctcgacacattaattctcaccagttcataggtttttgtcattcgtattgataattatattaataaaagacagttaaatataacaataataaatattcatattttatttttgtgtatattagtgagttaaaaagaaatcaagattttgttgcctcctatccaaaacagcatttttccatgaacgggaagtaacatatatatcaatagctttacttatattttgttcacgctttcacaattgacatatttgtgtagtcatcgcagccattttttctatatgtatacttcgttgtaatttatttttttgctggcatgcagtatatgacaaagttattgtgtatggcttttacagacgtcatgaaaaagaacagaatgtccaagaagcagttggaccagagaaaggccaaggcgaacttgataagatctgaaatggactgtgctgctacaagggtggcaaaggggatgctttttgacaggtcatgaaactagtccccgctttcacaattaacaagccacgtaatagaaattactaagaacattacaaaaaaaggggaatttcaagaacaaaataatagaagagaggaacatcgtccattccactttttattacttattattgtcatcagatatatggagacgcagcaatcgtggatgtgaaaattaattagtcggctggctagtgctagctagtaacaagctactcccttcgttacaaaataagattatagaggggaccttcaggttttgcaatacactaatacacaaacgatttttctatactagacttcatgaatttttgcaaacagaccataagtgatggcgtatgcaaaaatcgaccttcatttt

SEQ ID NO: 7386 - DNA, 28897 bp, Oryza sativa
  unsure (1)..(28897): unsure at all n locations
cccccccccccccccgggatctttagtcccggttggtaacaagtatctttagtcccggttggtgttaccaaccgggactaaagatcacggggatctttagccccagttcataacactaaccgggactaaagtctcacccttagatattcgtcttcttcctcctctagctgcccgagcaagcttcaaaatttcttcaaaaaagaggggaggtcatgccaaaatttctagtgaatttattttggtgattatatacaaatcggaggtgcctaaaaggttagcaacttcattctccaatgttttctttgtcatattatatttggagctatgttttgcacacttttttgtctccaaaatttagttgtaagttgatgagagagaaaatttgtgtggggaagaaagaatatatagaaatttagtttatttgctaaagaaggttttataaaatagttgagaaggaaaatatagtgaaagttaatcttaaataatagaaaacaaactaaaatgaaaattaaaagaagtacaacacattaatattagtttaaaactttagaaatagtaaataagaattatttggtgtaatattttataatttttgtatgaataatgatatgtcattattgtatgactgttgaaagagtttgtaattattttataattattgtatgactgtcattattgtaagaataattatttgtgtacaatttttgttcatctcatgtagatggatcggcaatggatgtacgctgaccggtggtccaaagaggttattgacggcgtgcgttattttttgagaatggccgaagctaacaggcataagggttttatttgttgtccatgcaataagtgtaagaatcagaaggagtattctgcatccaggactattcatttccacttgtttgagtcggggttcatgccaagctataactgctggacatcccacggagagcaaggggttgaaatggaagaagatgaagtggaagacgacaatattccggactttggtcaatacgctggatttgaaggaaatcaaacggacgaggaggaaagggatgttgatggtaacgacattgcggatgatcttggttagatgttgcaagacgccaaggaggactgcaaaagtgaaaagggggcccataaattggacaagatgttagaggaccacagaacgttgttgtacccaggttgcgagcaggggcacaaaaagttaggataccactctgaagttcttgcaatggaaggccaaaaatggttttagtgacaaggcatttggcgatttattgaaactcatcaaggacattattccggagggaaacaaattgcccgagacaacgtacgaggctaagaagatagtctgccctctatgactggaagttcagaagattcacgcatgtccgaatgattgtatcctatatcgcggtgaggagtacgagaacttagaagcatgccctgtttacaaagcactacgatacaagattagacgagacgatccaggagaagttgacgggcagctaacaaagaagagaattcctgctaaggtaatgtggtatttccctataatataacggctaaggcgtttgttcaggaacaaggggaatactagaatgatgcgatggcacgctgaagagcgtcaacaggacgggatgctgagacaccccgccgatgtttcgcaatggcggaacatcgaaataaattttaaagactttggaaaggacgcacgaaacatacggtttggtttaagtacggatggcatgaattcttttggagagatgagcagcggccatagcacttggcccgttacgatgtgtatctacaacctcccccctggctatgcatgaagaggaagtacataatgatgctgattattattcaaggccccaagcaacctggtaacgacattgatgtatacctaagaccaatggtcgaagatcttaaactgttgtggaaaaaggaaggtgtcccgtgtgggacgaggacaaacaggaggagtttaacctacgagcgctgctgttcgtaaccatcaacgattggtctgcacttagcaacctttccggtcagtccaacaaggggtacaaggcttgcactcactgtatggatgaaacagaaagtacgtatcttaagcactgtaggaaggttgtgtacatgggtaatcgtcgattccttgctgcaaaccacccggtacggaagaaaggcaatcactttgaacataaggcggaccaccgtgcgaagcctaaacatcgcagcagtaaaacaatgtttgctatggttaaagaacttaaagtagtgttcggaaaggggcatagaagccagcctatagagagcgaagatggtcacgcggcgatgtgaaaaaagaactctatattttgggagttaccctattgggaattcttggacgtccgccacgcaatcgacgtgatgcacctcactaagaacctttgcgtaaaccttcttggcttcctaggtgtatatggaaagtcgaaagatacactagaagcacgtaatgatctaaaccatatggaacaacgcggcgaccttcacccagaaccaaaggagaaaggaagccattacttgagtccagccagctacactattagcaaggcagagaaggaaagtatgtttgaatgcttggagcacataaaggtaccgtctggatactccacgaatatcaagcgaataataagcacgaaggagaagaagttcacaaacctaaagtctcatgactgtcacctgttgatgacacaactgctaccagttgtaataaggggtatccttccagactatgtgcattcatgaacacaatttcgcagaaggtcatcaatccggatagattagaagcccttcagaatgatgtggtgcattgtcttgtcagttttgagtcgatatttccaccttcatttttcaatataatgacgcatctgctttgtcaccttgtcaaagagatcagtattctcgggcctgtgtacctacacaacatgtttcctttcgagaggtacatgggcattctaaagaagtatgttcgtaaccgtgctcgtccagatgaaagcatcgccaaggggtatggaacagaggaggtcatcgaattttgcataaaatttattgaagacctttgcccaatcgaggtacctgaatcacgacatgaagggagactatggggagagggatctctcagaaggaaagcaataatggcggtagacaacaatttattccgtaaagcccatttcacggttctgcaacaatcttcattggtagctccttacatcgaggagcacttggctctagttcgcgtcataaacatcggtaagtccgatgcatggattacacggcatcacattgatactttccccgcgtggctacgacaacatctcatgggtaacgagacgatcaaccaacaacttgtgacatcccggcctagggcttaataggattaatagaatactcatatcaacaagttgcaacttcttttccggaagccggtctcgaaagaactcttaggttaagcgtgcttggcctggagcaatttcgggacaaagtgtgcagaaaacactcactagtagtgtgcacgagtgaggacaaagtgtgcagaaaacactagcgttggtctgtgagggtagtctatgtcctagggaagctgctagatgtagagagggcccggtctcggagagtgtggggcgtcacacaactggccttcctggcggggcccggtctcggagagtgtggggcgtcacacaactggccttcctggcggggggaccatctgggtcgatcacgacattccaaggatggattaggttgactggtggaggtgtaatgattgatgacagtgggatgacaacggttgaccttaacaaggttggatactcggacaaacattttgtccttgccaatgatgtaacgcaagtcttttacgtgaaggacatgtctagcaaaggaaagaagggcagaggacctgacgagccgaagcgtcacgtggttctcccaggcaaaagaaaaattgtcggagttgaggacaaaactgacgaggattacgatcagttggatgggcaaccccctttcacggtgacgattgaccctagcatccttctatcaaatgaagacaccccttactcacgtagcgatcacaaggagggaacaataatgaggagaaagtacgtgcggtcaaccgtcaccttcgatgtattgccgtaattattgtgtacacgatgtaatctattttggatgtattgattatccatataaatcaattgttgtatggcatatgttaattacgtacgatgattagaggtttgaacaatattaaatcatgtaattgctagttatatgcgataattagaatttttaaaagttttaaatcatgcatgtggcatttacatatgttactgagagtttttaacaattttaaatcatgcatatgctagttatatgcgataattggaatttttaaaagttttaaatcatgcatgtgacatttacatatgatacttagagtttttaacaattttaaatcatgcatatgctagttatatgcgataattagaacttttaaaagttttaagtcatgcatgtggcatttacatatgttacttagagtttttaacaattttaaatcatgcatatgctagttatatgcgataattaggatttttaaaagttttaaatcatgcatgtggcatttacatatgttaattagagtttttaacaattaatttaatatcattcatatgctaattatatatgattatttgaatttttattaattttaaatcatgcatgtcgtatgtatttacatatattaattacagtttttaacaattaatttaatatcattcatatgctcattttatatgattattagaatttttattaattttaaatcatgcatgtcgtacgtatatacatatgttaattagagtttttaacaattaatttaatatcattcatatgctaagtatatatgattattagaatttttattaattttaaatcatataggagtatttgcttactacgttttatccacttaatgtactacagacaacaataatttttcgaagtaattgtcattaatttgaacacattattttctattttagaaacacatatgtaatggaaattaatattcagtgcgcttatcagtagtcccggttcttaactctaactgggtttaaaaagaaattggaaatagcgggaaaatatctttactcccggttattctcatcaaccaggactaaagatctagaggtatatatattcccgatgcgcgccttcgtcttctccaccaacacttagaagttttttccccaatcaatttctctctcggcttctccttcgccgccactacctagagcatccccgcgccgacgccgccgtcgtatctcgcggtcgtctcgcgcgcgttgtcgttgccgcctccgccgccgtcgcatctttggggtgagagccgccgccacctccctctctctctccgacctcgatctctctctctccccaaacagccgccggccgcctcgttgccgacgccgccgccgacgtcgtcgcggccgaacacgactccgccgcgccgatgatgactaacttgtcacgcccggaaattcactagtaatttccgaacttatttgtgcataaaatcctcgtccaggaatcagccgaggtacacaaactgacaatttaatatacagattcatcaaattagctaaaacgataaatacttacttaagaggcacttagtcctcaccatgaagaaaactgcagcggaaaataaaatctagcgaagctccggctccactcccacaggcagctcaactggggtataagccaaacgtcttctccttctggatcattttcttcaactgaggttgattgattattgaaagaattagcatatgacatactcaacaagccacacagcaaatatgcaagtgcacaaggataccaaaggatggcataatataggctcatttgcaaaaacagcatttagcaaaacatttaagagaagtaaaacagtggagtaattaatcagaaattttaatcaacactgaacaacatacccatgctgcacaggcccaaccatcctgaacaaccatacccggctgtacagatctaactccaaaccaggagctaagcaaattattaccaggtataacatccataattattgtgagaggtgtgagactaatcacgaaaaacattgctcaacccgcccataaccgcgggcacggctattcgaatagttttactctggccagaggtgtaccactgtacccacaagacacagccccacgacatgtcacaatgtgcctcagtaccaccacggtacctcggaaaggagctgtgacattaccccttgcataacacaacccaccacagtgcaccgttcctggatcataatcaccccctcaaaaaccagaggcatggactccccagcgacccccgtgggcttatctccgccacttctcagtctggtgctctgcaatgaaccatgctatacgaaaggtaaagccgttgcccacgctggcttgtggttggcacggttaatgtttcacaacagtagctcgcgaaccggtccttaattgccatgagcacgactctcaaaaccatgtgctcacaacccaccattatcaagatttagttggcaagtaattaattaaccaatcacgattgaccatcgtgaactatcattaagccatcattaaataatagtgagtcataagttatcccaatagtgtgctaatgtttctaagcatggctaagcaatcataactaatatctagctgaaccaatatataaagcccaactagtcaagttataataacccaaggtatcaaggaataaagtaatcaatgcaaacaggccataacaaaggaataggttcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcacgaacctccgcaacgacggaaacgacaagctaacacgcaaaacgaagaaaaaggctaataaaaaccaaataaacagtacatataaagtaaacaaacatgtagatcatgattttagatgaatttagcaacttgaaccactcaaaaccgagttacgatgatttagttatgaatttccgaagattaaatctattagaaaaacaggaaaaagaaaacgatngatgacgtcatgatgacctcatcaatagccggaccaagatggcgagctcgccggagattggatggtcggctgcgactttggaggacatgtacacgtagaggacgacgagacgaacccaacggtactcaccctcgaaccaaacgacgaacgacgacggccgacgacgaggtctagcggcggcgcggcttcggtcgacggcggcgacggggctccggtgatcggcaacagcggggagagagcggccgggcttctccacacctcggcgtaccttacggcggtgacggcggccggcggcgacgacggaggcggcggcacgacgcggatggagctcggccggcgacgacggcggggtggagcacgtggcggcggcgctacgaggcacgggagaccacgggagagggggcacacgaaagaggaggactagggggtcctatttatagccttggattgaagagatcggactcctcccgcaagaaatcgatccgggaaatcaaaaactcggttttggagataaactcgaaaacgagttcgattcggataagatactcaacgattagctccgatttttgggggtaaagatagaggaggataagaggaatatttcccctcaactaattttagaaaaaggagcaacgagaggcgagattttggaaggggatcggcggcaacaggcacggcacggctctgctctggctctgtccagagctggaagatgaacagtagcgcagggaggaaaagtagacttcttgccgggcttttcttttctcagcctgtttagaagagggagcaataccagactttggctaagagaagaaaagagaggatgcaggctcgggttgggccggtggaagagagaggaaggaaaggaaggaatgggccgaaaatggcccaagctgaggaggaggattttattacttttccaattaaaataatcacttaaatgatctttgaattgttaaaaatacttccaatgctcaaataatttcaagaaaaatcctgaaaatacttggacactcaaagtacataaaaaattacaattagaccatttaatgattaatttaatatgtgggtaattacttaaatgctctttgtatgattaaaaattacgaattgagctccgaaaaatccgagaatattccagagagtataattaaccatggagaatttaataaaaattaaatccatccatgctttatatttaggaaattttatttcccacatttaacttcacttgtaaattaatgaacatttaatataaattctaataataatttattaaataatttataaatcctgaagcaaaaatcaggatgtgacaccaaccctgacgtcgatgctgccgccaccggtgacgacgtcgcgccgacagtcccgattaagctgcgcgcaccacaacgccgggctgcgccacgcttccacggtggcacgacgccgagacaccatgacgccgccgcggcacgccctcgccgcgcggccacgccgccaccgcgcaacgccgccgatgcgccacgtcgatgccgcgccgccacgctgccgccgcgccaagccgcagccgcgccgccacgccgccgctccgctgccgccacgtgaacgaacgaacgatcgtgaacgagaacgaatgaacgaacatgaacgagaacgtgaacgaacgaacgaacgtgaacgaacatgaagattttggaatacaagaatttattaatgacaccgggctaactacggatcaattgctacgaggtgcaccaatcaaaaaggcggaagtgaaatacatgtacgaactcggtaaaccgcttgtcaagcctgagcagctgcagtccctacccacacaaatgtacaagttccatcaactgtacatggagatgagcgccaccggtacagaaatgatcggagcgaggatcagggacacggacttcttgcaaggagatgacattctctggatcaatttcaagggtatctacgaactataccagctggatgccctcgacgtctctattatgagttgctggattttgtaagtatcgttcagttagatttcttattatgtttcctttaattagttaggtccttgtatataagtagactacatataatatatacttccttttattgttgtagaatggagattcaaagggcccggcggcggggggttttcgatactggattcatcgaccctcggaaagtaaacgtcgcaatgctcgaccagtatccgcaagccacagaggacaatctcgtccatctcttgaaggcgcagcattacaagacgttcatactattaccgtacaacacagagttagtttaattttactgtcttcctataccaaatttcattccgtacgaacatgctaagtgtttcatatgtaatgcatcccacgcacattgcagattccactgggtctttttactcttcaacctggaggcctgcaccgtcaacgtatatgactcaatggataaaaaagagtctatgtttgacaaggttttcgaacttatagacaggtactgtcataagttcctatgttaattaagaatcttgttataattaattgctactacgaatcatagctttaaactccatgtagggcttggtatcgattccgtcatttggtccgcagtaaatggagagaaagacttaggcggaagttcaattttcctgtgagtacacatgctttacatttatattgaatctccaattcaaatacatacaagtgtatattaattagatctctcaccgtttatcatttatttatagtgcacaaagcaaaagcagggaactaacttgtgcagctgctacgtgtgcgagtattgccactgccttgtagaccaaatcatcaccgcaagagagctcgatgtacgtacaaataaattctaaatttcattgcgtacgtatcgatttgttgtttaattactaattaatttcatacattaatatagtttattcgcatgagggataacctgatcacacacaaggaatttatcgcggtggttcaagaacaactcatgggatttatcaatgaacaaatccttgatcccaagggtgaattctactacgacagaaatacaattcataggtccttagcttctgagataacgactactactacgtcgaaatcgtagctagctaggacatcataatagattgtaattaatacatgtctatttttctatatgcatgtacacattttctttaatgtaaatatatattttagtcatatatatatgcacataaaatgttaagtgctttcatatatatatatatatatatatatatatatatatatatatatatatatatatatatatacctatgcatttgcataacatatatatgtataaatacatatatattatgcatgtatatgtactgaaacatatataaatataatatatatatatatattatatgcatatatatatgtattaaaacatatatatgcatggtttttatatatatatatatatatatatatatatatatatatatatatataaaccatgcagcaacagggccatgaaaaaaaaaaggtcagctcgactttagtcccggattggtagtcccggtttgaaaaccgggactaaaggggggttacgaaccgggactacaaacgctttctccaccagtgcacatttgaagtattaaacgtaatctaataacaaaataaattacagattccgtcagaaaactacgagataaatttattaagcctaattaatccgtcattagtaaatgtttattgtagcaccacattgtcaaatcatggcgcaattatgcttaaaagattcgcctcgtaatttacacgcaatctgtgtaattgggatttttgcctatatttaatactccatgcatatgtccaaacaatcgatatgacactgtaaaaatttttgttttgggaactaaaccagctctatggatgagggttcttattgttgtctttaggctggttgagtactggtagtgtaagtggtagttttgttgtttctattcgagttgtgattttataattttgtaaccatattcgacctataatcgctgtgtaataattgattgtagtttcttttgaaaccaagaccaaaaatagacgaccgcttattagtatttgtgaagaagaaaatacgtacaccattaatggtttggtatgaactccacggcctgaaagaacgaacacaagacaaataaggctgagacatttttttggctgcgatcttgcttgctgcgccgttttctggtgtttatcattctccacttattaatgggcaaacaaggggccaattacatgcatatatatgacataacgtgtactttaaagccgcccgagagttcacaagaaatcgtgccatcccaggatcgatcacgcgtacggccgctaggtcacaacagttacaaacactgaaacacacactgatgtagaaattgaagcctgatcgacgtgaacaggaacgatgacacgaaacaattaaaataattaaacaaagtagtgtagtaaagtttacgccagaagttgtaccattaagtagtattactgcataataagaggggcggcggcggtgatggggacgctgtggagaacgatagtctcgacggtgaggccaggaccgaagccgaagaggacgccccagtccatgccctcgccggtggtggcgtggccgtcgtcggcagagagcttgcgcatctcgtcgaggacgaagaggacggtggcgctggccatgttgccgtactcggagaggacgttgcgggaggcgcgcatgcgggccttgtggagggcgaccttctcctcaacctggtcgaggatggccggaccgcccgggtgcaccacccagaagatggagttccagtcgtggacgccgagcggcatgaaggcgtcggtgagcgcgccctcgacactgtcggatatgaactccgggacgtccttgggcaggtggaaggtgagacccacctcgcggaggtgccccacgatggcgtcctccgtgcccggcaggatggtctggctcgccgacacaatctggaacagcggccgctcatcggctgcctcgtcggggtcagagccgacgatcaccgccgctgcgccgtcgccgaagagcgcgtgcccgacgagggagtcgaggtgcgactcggacggcccccggaaggccatcgccatgatctccgagcacaccaccagcacccgcgcgccgcggttgttctcggccaggtccttggccacgcgcagcaccgtgccaccggcgaagcacccctgctggtacatcatcagccgcttcaccgacgtgggtaggcccagcatcttggccacctggtagtcggctccgggcatgtccactccgttggtcgtgcagaacacgaggtgggtgatccgcgacatcggctgcccccactctttgatcgcctcctcggctgccgccttccccagcttgggcacctccgccaccaccatgtcctgcctcgcgtccagcgacggcgccgtgaacacgcacatgctagggttctcctgtaggatctcctcagtaagatgcgtgtacctcttccgtatctgcgagctttcacctgcatatatcatggatgcgcgatattaatttgcacctgcgctattttaatcttaattattattaattattattgtatacggtttagatagggtgaaatttactctggaaattcgcttaaatttttttagaaaatcacgagctgcaattaggagtccgactatcgtctcaagttaatgtgcgagtttttttaagaaatatttcttatacgactccttttgtatttcaaaaaatgaacaaacaataaaattgactcaaacacgaatctatatttccaaaagcgaacgaaattacaaaccgactcaaataaaaatgacataccaaaataccgacaaaaacatgatcagtttttataatagaagtgatggcgcagtactttaatttctataaagggattcacctttcacttatttagactagatacagtatgtgtactagtataatatagatgcaaattaactgattactcattagtgcttacacatcctctggaacctctccttcaggttggttaggtgctcgctgttggtgaccctgaagtagtagtccgggtagtcggtctggtacacgcagttagccggcgttgccgtcccgatcgctagcaccgccgccatcccctccgctctttgcatcctcctaacctcctccaacttcactgttgatgtcaccatctccccactcaccggcggctaatcgtacctagctaggaatgtagtgtatatcttggtataactgagggtactagcagctagcttgttcgccacaacgaaaatgcatgtgcgctagctagctgctgcctctcagcccggctgattcgaacaaatggtcgcagctaagttatttataggggtgagctgcacgtttgtctgccagaacgttgtacccttttccaattttcctaacaataatatatctccgttgaatttgtgtgacgatactatttttttttctgaaaacgtgtttaattaagattcattgaagtttgaacaaaagtttcaattcgatctcataagatatattcttttcagctgcaaaaaccagtactttaatatatatacgaatatattggtgtaattcttgaactaaatatatttgtaatctaactaaacaggaaggaagcatgcgcacacaaacgtggacatcttatttaaagtttcttaaaattttgctagcctaacatatgcatttttgtgcgtggatgaccttttttggaaaaaaaacatattatttcattctatatattatgaacctgctatcttattaacgagttatgatttttttaagaaaaacagtacaaatgcacacgctcataatatgcgcacaatgacccctacgagcacacacgcacactaccctacctctacgagcacctttgaaagactgagacgacatatgttgggatttacaaattgaccacaagtgcctcgatgtagacaggtacgttggctactactacaacaatagttagccgtaatcacaaacacccgcgtatcaaagtctaggacataaaaccgggtgggttggttctaccaaaaaaacctaacaagttgagctatactcacttcgcgattttcttctaattatcctcacagaacatatataaaatctaaagcataattatattgaaccatggaatcttaaattgatgagaaaattattgtgtcggagttgatcctatgaaattatcatttctatgataagtgtttcttttttaattgaatatatttagcacactctttttatagtatatatactttgagcaactccggtttacatacacacacataggacatatatgggcacccgggcaccataatatgaaatacacaaattcgtctaaatttttcaaaattttctatatatctagttataagtattcgattcatacctatacctagcaacaaaacaactcaaatttaactttatatatatatatatatatatatatatattaaaattaactggggcttcatggggcccggccaacatgattaaaaattgagtatgtacctaatgctaatgagtctgatttttttaaaaaaatgtttagttatgaacattaacttatttactagctagttcaaacaagtttgaactaaatttgaatatctttttgttaaattttgattgtaggtatataggatctaaacttatatataattacttaggtatgtaataatggattgtaaaataaagtttaatttaagttgatttattgctttggtatgaatcaaattcttatgactaaatatacactcacaatttaaaaaattatatttttcagtgtttgtgcgcgcgcgctagtaataactaaccattcaaattaagaacctaaccacctaaccatcgtacgtgagattcaaacttaggtgatatgtgtgcataagatatatagcaaaacaatgtaaccaccacacaacttgtcaacttgtggatgtacatgacgtacccactcttctttttggagtatacgaggtcagcgccaagcgttatggtggtcaatccattgcatcttctcgcgcatcaccgtgaggccttattcggttaatccttatgagagaggaattggaggggatttatttcacacctattatagtctggaattattcccccttaatcctctccaatcgccctctaagctgaataacgcctgacggggttagcggcatcgatcagggacgatgctgagctattggacctcaatgccatacggcccctgagctcatgttatttttgctgaagatttttacacggtttatttcaaaataatttttctaaaagattaataattagtcaaaatttcgatggacttataggcggaaaaatatgtgtacatgcggatgagccacctgcgcctctaccaaattgccataaccacatgtaaaaatcaatttttgcaggtggttaggttaagccgagcaacttgggaggtgattttcggtgaaaacaaataatatagctcaaaaatatccagatgcagtgccatttcctgctcgtcccatttctacggatccacaccactgcaaatcaatatcagacacaccgcaaatccaaagtcgagagtaaacttccacatcaccataacaatgctcaacacatatataacgcaattccataacaaattcacatttatctcatagcgaaataaaagcgaagtgaacataggtcaaggctgcagcaaagcttgccgttatcgagctcagcattggcccctttctcccactgccttgatcatcagcctccatctcagcgctcctgccatgtaccttgatctggatctagctagaggtggtagtggtgtggtggatgcgaaggaagaaaggggataaggcagggtgaggcaacctccggtggaccggttgcttatgagcctttaggagaccacaattgtcgtcatcgtttaacaaaccctatcggcagcagatctgccactcccaagtccactggaggttgaagttgtcagcgggtgcctagagcccaccaacaggcggtgaatccaccgctcctgagtacgcaggaggccgtagcaatcggcagcgcctgccgagccttgtcagcatcggtgatcatgtcgttggctatgattgacgatggccttgcgaagcctgccagctgagaggcgcatcggtgatgggagagggcgtagaggaattagagggagcagatctcgactcaatcgtcctatcacacaaataaatatacatggtagtcgtgttactgcacattgaccgtaacgttactacgccgttccagcgtgatgagaactaaaaaaaagtaaatctcaatctttagagagcaatatctctcacattatatagtatttttctaattcgtctgcaccatgatttctgtaaaaaagtgcttaacaaaactatttttcgatgttgttgctgcgagaaagttgtcctgttactacacgataaccgttatgttactgcgggattcctgcgagacgtgaacagcaaagtggtgggtgggagagggagtcaatgggcgggtttaactcgggtttgaccggcgggaggaggctttgactagcctttgactgaggtgggaggggagatttgggccatatgaatggtgggggagatgggattggcccatgggaggggggtgtagaatagttattctaggggaggggtgtagaatagatttgctatatataataatctaggatgggatgaaacccatccacattttggaacggagttagtagaagttataaaagttgcacctcaactttccggagggagtgtaagccaactatagcttatgccaagacgagataaaaaaaatgagaagtgctagctcttatgcaaaatctagctctacgcatgctccaaagcaaatgcattagttacataggcgagggaaaaagaggaaaccaaaaatagggcaccattacaactaaaatatatatatggtaggtttaatatggacttattgtttgaattaatagatcggtcttagcccattcgaagtttaattctttggaaaatcataaaagcccacctcatgggatagcatgcatggggagtttagtaccgccttgcctattcaatgagaggaagacctccttttaagagaggatgctcttctagccacttgaggcatgtgaggcggagagaacagggggaacacgtgctcctgacatgtcagtttaactcgggtttaatatggacttattgtttgaattaatagatcggtcttagcccattctaggagaggatgctctcctagccacttgaggcatgtgcgggaaattcatatttgttttttttggaaacactcggaataatctgatgagtgaaacggtgtggagtccgttttgctgcggaaaattcagatttttttttttggaaacactccgaataatccgatgtgtgaaacggtgtggagttcggataagttacgcgtgacttatctggttcggttcggttatgcagagtggagatcgtgtaggcgccctgatcaagtgtcctgatatctctatataatttgagccgccacctcctcgcaacatacgtggaatcaatcttgggttggcctcctcctccgtactacgttgttgtttgtagtctactccatcccactcgccggtgctcaatggcaatcgggagagcagctctccgaaacctgcgccttctacgttttgcactagaagaaggtagcaataagatttttgggtttttgggaagcgctccacgcgactgctccctattcgttcatacggctcgtcttcctcttcgctcgcgtgctgtgcgctaccgttaagggacggtaccgtgaattcttcctgccgagcaaccggatttccaaaaccatcggtatcaacatgtttcgcatcttcgatctgttcatcctttactgtcttgtttacatgtatagatcctatgatgtgattatactagtttacatcgacaatgtcatgatttatttatgtatttatggaacaaattaaatcattacgtgcttatatattcaacacttatatctactagtattaaacttgctcaaatactctgaagtacagtaaatgagagtggttgaagaaatgccaaaaaattatagccaatgcatatgtacttcctctgtctcattttaagtgcaaccatcatttttcgtgcccaactttaatatagtttgtcttagttgattttttaaaaaacttttaaaaaaactcatgcataaagtactattcatggtttatcatctcataacaataaaaatactaattataaaaaaaataaagaggacgaatgatcaaagttggacacgaaaactgatggctgcacttaaaatgggacggaggaagtaggtaaccggaagctatatgatataattgagtggaggtagctcaattaattgtcaattgacttgacatggaatacctgcagatagctatgtttgtgaaacaaatggaatcttgatcgacctagacatctacccaaaactgacaagttgttcctattttacaaagttcgagctgccatactatcattgatattctcaaattggctaataaactaccttgaatatgagcagttcaagaaatgcataaaaaatatatataggcagtgcacatctgggtaacgggaagctatttgatccaatcgggcggagttagctcaactatttgtaaatcgtcctagcaaagaattcgtgcatacaaccctgtttgttaaacaatggaatcttgagctacgtcccactactacataaatcatttttacatgcagccagcacaatcgcatgcgccaaaagatctacaaaaaatcggattttcgcatgcgaccagcgcaaccgcgtgcgaaaatggtattttcgtatgtggtcacctatatcggctgcatgcgaaaataatatcagcgaaaaaaataaaaaaaccgaatcggccgaaccctagctcgccgctgtcatcagtcggacccacgcagggcggcgccactgctgctgccagagcccaccgtcctccgcgccggatccaccgtgcgcctctcgtcgtcgccgtcagatccgccgcccccgccgcccatcgtcgtcaccggcactggatccgcgtggggatgggtcgccaccgccagatccacgctaggcggcattactcctggccacctccttgtcatcaacggcggcgccgcctgctcccaaccccaccgcctgctcccgcacactcggtgaggagaggaagacaagagagtatcagaggagaggagaggaacagacataaggagaggaagagtgagaggagaggagacgaaaagttttaagtggtgagagcgaaaagagagagcacgggaaaaaaaatctgtgaagaagagggtattttcgcgtgcggacaacttaagagacacgcatacgaaaatttatttggtatgtggccccttaagatgaccgtattggtaaatagacttatttttacatgcgatcccttgcaaattgctaccactatagaacatgacgtcgtgaacgggacatccatgataggggcttgcatcccatcatatagacctcccatttgacgggacataataaacctcgacacaaaagcaccattacaggcactcaccacaggcctctagtctggacctgttactaatgacactcatcctcgacacagatgagttttgacatcactgaccaataatctgtaactgggctccttgccgacatagaagggacccacccaacatggatgacctattccataggtgtgctgtggagtcttgaactacacatcgtctatcaaaaacattgacaaggtcttcctattttacaagctacaaggtaccattctatcattgatattgttgtcaaaacgacaactgcatacgtcgaaagacgtggttactcaacagtggatgggaaaatgaagtgtactaaattttgaattttccttggggatcccccattacatggccctaggggactatttatagccccattacaggttcttactactagggtttaggttgtacagggaaatttacatgattacccttaccaaaggggcatttacaggggtacataatgttataggggctcatgggcctctgatgggccgtctggcgatcgccggcctgttgggccggaaaggcttcctcggccctcacgggggcgaacttgtcaaggcgaagtcatcctccttcggcagatagtcttcgccctgcacccttcgcctgagacgcctctggcctggcgcttgtacgactcttcgccttgcgccgttcttgttccatagccttcgccatgggtttcggcaggtttggttgaaggacctcatgccatccgccaacaagcccctcacgggcaagggtgagattggagcttcggccgagaccgtgcaaaccatgtggtatggtatgcggcgccccctttcgaccgatgctcctgccgaaacctacattattcctgcgaatgaagtttgttatttgtgcggctggtattattttgccgcgcttcgcctcctgcgattgatttttatatatattcttttttcctgggccgaacggaagccttcctatcgtgggcttttcactgtgccgctcggtcgatgggaatttaccatttcacctacccttgcgacacgtggcgctttattactagtggttaggcgaacggtcgcctgggtgggctatatattcccgcttctctttccttttcaccgccccactttccattttaccgcgagcgctctcttcctccgtctcttcctttcacagcatctttcgacccctcaggcgtttcgccgaatctcgtttttcgccaccgcaaacgcaccgttcgccatggccccacgtaagccaaaccctacttcggcgaaagggccagatcccggcctagtcgatgacaacagcaccgcctttctgggggtctctcttgtagacgacgtcgagctggcgaagatggtcagctccggagcgttggttgaggggcaggctttcgccccagggaaaaccgtggtgccgaaacctgtcgacaatcggacagtggtgttcgccgtattttttgaggcaaggctacggtttccttgcaacgtgttgttgccggaaatccttcgcctcttccaggtggaacttccgcagctgagcccgtcggcgcttgttcagatcgctatctttgactgggcgtgctggacttccgggtttgagcctaacaccgagctctttggcgccatatttttcgccaccgtgaactcgaagacggtgattaccccggctggaatgaaaaaaacagtgttcgggagcgtgaacttcaacgttagccccgagcggtccgatctctagccggtgaacgctgccatgtcgaagtgggaccgccattggatggcgaggtggttctaccacaccatccccttcgaggctatttctgaatcagcgaaagccttccggtgccggcgcaaggcgattgcgccgaaccggaggcccaagattgctgtgaacggcaccatggaggcatggttcgttctactacggaaggtttgctcccgccttagctgccgtgacttggtggaggaattttgtatgcttcgaatttttcccctctcccagtcatggcaagtcgcggttgaacaaggcgaagaggtcgacggtttgccgaacctgatacttcctgagggggcgaacagtaagactgttgttttgctatttactgctgtgctttgttatttcgccttatttgacttttgacatagcttcacactctacttttacagtgttgaccctcgaccaggccgaagccaaagcctgcaggatgatcggcgatgtttcggccgtcgagtatagtcagctgttaacgcatcaagcggctgggcgggcgaaccgggtttacaatggcgaactgcctccccgggcgaatccccaaaaggtcgacgacgaggcagggccttcgcgaaagcggacgcgcggacaagtgaagcttgcccccaggaagcgaagggttcctacttcgtctgactccgacgctgacgacgaggatgatgccgaagaacgtgacggcgaggaggaaggagatgaagaggaggaggtggaggctgtggctgataaggccgcgagcgaggcggtcgaagactgcgtcgacacccccggctacactcctaccccaagtcccggtcacaacgagaccggggtggagtcgaacagctccccccttcatcggaaggatttggaaggggcgaaggccctagttgcgttctcttcaggtgcagcggcgaagggaggtcctggcaaaaaggtggctaagaagaaaggactcgtcgatgtcgctcgcgtttttagcgacgacgagtccttcgacgggactctgacttcgcccgctggtcgcagcctggatctttcggccgcccccattcctccattcgacgccgcgggagtggacggtagtaccgccgctggggcttcagcttctgcggaaaggattgtgacggccgcggcgaaagtattcggcaatcctccgcctcagccggttgcatcgccgctgattgaggtgaagggaaagagagctgtcgctgagacgtccgcttcggaatattcgatctcggtaccccgcttcgcccctggcgatttcgagacgcgagcggacctccttccttttttggagggggtaagcaatcttgtactgcccgccagtgccccgagcttgttcacggaactgaatgagttcgacgaagggtgttctgctataaaaagcctggctgttcgggtacgttccccccccctttttttatctttacccttcctttatcttgtttttacaattgacacttgttctcttcgccgctcgtattctgcgcccagatcctcgcggctcactgctcaacggagcgaaccgtgcgagcccgacttgatgagttcaaaagccgtcttcgggccaaggatgacaaactaggccgtaaaaatttggagatggaggcccttgccaacactcttaaggaggcgaaggctgaaaacaagcggctccaatcggaactggagaaagggaaagaagtcagggccgaagtcgatcgcttaaaggccgaactggagaaagagaaggcccattcggcggtgctcatcgactactacaaccttactgagccgaagatagtctcttcgccagaaggctagcagggctgaagcgagcgccgcggaggagtcgcagcggttttcgcgggagatggcgaagaccgccgaatctgcgagaacggcttgccaaaccctccgcctcgcccttaccgacatgggcgcgaaggggcggggggtccctaccgaggatgcctcagccttcgacttctccgagtggacccagcaggccggcggatcggtttcggactgcgccaccgcgtacggcaactgctgtgcgcgcgtgtcagcggcctttaccatgggcctcctgcagcagttcggctgcgagcacatcgccgagttccccaagtacgcgaagggggattgggaaatcagtgcacaagacatttcacctgcacttcgtgcgtggcgaaaacaattttggcagaaggacggccgctccgccgctaaggcgcgccttttggagcagctggcgaaagcagaggcggcggacctttgtgaagaggaaggcgcggcggccggagggggtggaggcgatgcccaggaccacccagaggtgtgaggccctccacccttctcttagattttcatagttttcttttggtgttcgctagatgtggcgaaccgttgtatattcggcaaactgccgctaaaccttaaaaaaggctttttggtatatttggaatgtatgacataatcttaattaccttttgatgatcgaagtctttggcatatttttatttcactcgtttcgcattatgccataccttccccttctttcgcctactcttaccattcaagatgtgttttgccttttctgcactgtctaccagggggtccgccgaaaatcgtgcattcggcccccttctgggagctggcgaagtcaaaacgagaaatttgtggcattgaaggggctgccgaagacgcaatgtccatttcggcatgtttatcgcgaaatggagataaacggtcgtagctataagattatcaaggttgccaactggctacgtgtgcaccccgggcgaaccttagaagattacgatcttgttcattcaagacgtttggaagatatggctcgcttttggcgaaaccattagaagactaaacgtcaggaatcgatctttcagcgtcgttacagtttagtctgtgtttcgccccctactcctcttaaggttgtgtatgatattagtagtgatgacgaacctagttcgtccgaccattccttagggagggataatgatcactggggcgaagatgtaatttacttgtaaaatgaattgtatcgggttgtaaaccttgtattctttgattatttttttttcgaagctaataaagaacgtgctttatttccttttcgctatttttcgcatcgtcacattttgtgcttttgttaggtcggaacatgccggcccctttgcatatattagcgaaataggtgtattgacttttcagcttttcgtcgttcgtttttaatctgtagcgttctgtgtcgagagaaacgcttttgcttttatactgatcggtcgtaacgtcgttcggctatttattttccgagacaagctgttgcggtttcaatgttcggcgagcaatgcttcggccgattcgtttcgcccccttggcctttttcgctgatcaggcgtttgccttggggtttttccacaaattatcaatcacacgaaaagtaagaagaaggcggaggacacagagattttatactggttcgggcctccatggtggataatagccctacatccagttttttttctttttctctctttcttctttttctttttttttctttgccgaaaggcttacatagtgccgaagggcttacatgatagtatgtacatttttacaagttggcgatttgggtgccacccattctagacatagaagcgcttgagggaggcggcgttccaggaatggtcgaactcctcgccttcgagtgtcgctaggcgaaaagatcccgtcctggacttgcgcttgatgaggtatggtccttcccactttgattcaagcttgccaactgctactgggttcgccttcttccttaggacgagatgaccaggcatgagctccgtgggtcgaacttttttgttgtaagttgccgaagtgcttgcggcgtacttgtgcatgtgctcgagcgcttcgactcttactgcttccaagagttcgagcgatacttcgcgtccttcgcccccgaaaaacatcacccttggtgagttagcccctagctctgctggggttattgcctcatcgccataaagaagcataaacgggctaaacttggttggtcttgtgggggtcgtctgaagggcccagagaaccgatagcaattcctctggccatttgcctttcgccgccccctcaagtcttttcttcagtgcttctaggatcttgccatttgtgcgttcggccgccccatttgactgcgggtgtgcgaccgacgcgagcttgatttccaggtcaaactgcttgccgttgtcagtaatgaactcttttggcactccgaaacggcaaacaatgtttttccatacaaacttctgtactgctgccaaagtgattgccccaagcggttcggcttcaatccatcgagagaaatattccacagctacaattgcgaatttatacccgtttcgtgccactgggaacggcccaatgatgtctagtccccatctggcgaagggccatactggcgcaatgggctgcagatcatactggggcgcggcttggcttcggccatgacgctggcaactttcgcacttcttgatttgctcaacacagactttcaacacagtgggccaataaactccttgtctaaatactttggaggccactgttcttgcagcctagtgcgcgccgcatagcccctggtgtatctcctttgccatttcttcgccttcggcaaatgagatgcaacgaagtaagggttgaagtacccctgtgcggtaaagctgacccgaaaccatcttatacttcgtggctctgagctgcaaatgcttcgcttctgcttcgtctaccagaagccagccagttttaaggtgtttcacaaatggggttcgccagtcatgtgggtcttcaccccatttctccttgtcgattgccatgacttcggagcagtccatgggcacacttggagcatgcaggacttcgaaaaagatgcccagcgaatatgggccgccttaagcagcggatttcgccaaggcatctgcctccctgttctggtctctaggcaagtgttcgaccattatgccggtgaagcatttttccatggaccgaacagcctccagatacctcttcattccctcttcttttgcctcgaaggatttgtcaacatggcctgctaccaacttggagtcagttcgaattagcaggcaccggactcccaatgctttcgcctttctcaggcccaggagaacggcttcgtattctgctgtattgttggttgtgtcgaactgcaatcttgctgcgtaccgaatcggcacaccattcggcgaaaagaggactgccgcaacgcctgcccccttgtgcgaccacgaaccgtcagagcacatcacccagaactgctcggtgggctcagggtcgggggcaaatactggtgtccattcagctacgaagtcagctagcacttgagacttgatagcagagcgtgcaacaaaatgcaagtcgaacggggatagctctaccgcccacttgctgagccggccagtgacttccttgcctcggagtatttcgcccaaggggtactgtgatggcactatgactttgtgggcctggaagtagtgcttaagcttgcgcgaagccatcactagagcgtaagcgagcttttccatttcaatgtaccttgtctttgctccttgcagtgcttcgaagacgaagtagaccggtttctgtccggactctgtttcttggaacagtatttgctcttcgcgcctgttttctcccgagccgaaggctatcagcaaaagtgcttggccaagaacttgcactgcctctccgccgaacccccggagcgacgttggtgccggtgtaagagcttgggttggcaagcccatcttagcatatgcttcggcgaagatcacgtcggcctaactccctccatcgaccaggattcgtcggacttcaaaaccggctatctcagctgagattaccagtggatcttgatgcgggaacaggactccttcagcgtcttctggctcgaaagagatcagctggttcacgtactgtggcgccccctcacccgccgaagtgatgctgtggaccatgcggatctacatcttcttctgccatttcgacaactggcttggcgggtcagctcttgtaatcacttcgattacccttcgctgtgcatcttggcgttgttcggctgggggtgtttgctcctgaactgcttcacgaggtgcttcgacagttgttccctgctgtggccttaggtcttgcgcgttgccatgttgcctaatgtttcagcattgctccgtggtgtgcgaagagcatccgtgaaaggcgcagtagaggtcttttcggaccttcttgcgggctggctgctgatggttgcttgcttgctgggcgtcgaactctttgcggagggcttgcacttcttcgacagccatcacagccttgcccgcccgatctgttctgaactttctccaagtcatgggggcttggccttgccttggcggctgtccctggatcgccggctgagactggcgaacagagaggggaggtggttcggcaacttgaacttgtgcttgagcttgagcagcggcgacgtatagcttgtcgtcgtttagaatcctcctcactccttgtgaacccgtcaatgatgcgaagtaggtgctcgagcatctgcggctccttgttggcgatttttcttgttagttcgccctcaagcagactggcccaactggtggtacttgctgagccgccacggatgggtcaaaaattggctgcaaccacatcatggcagcatggattggtgcttggtttgttccgaagcctagagttggaacttgctgccgaacagttggcacctgagcagtgttgacgaagtcgaactgcggtccttgattccacggcgaagcttccaagcctggctgaattggtggcaatcaattgggcgcaccatgacttgtattccccaccgggtgagccgatggggttgtgcttgaaatgtagtggggttggttgagttgctgaaggaaagcttggagttgcgcctgcagagccgaagccccttccgccactgattgtggcgcttggccaggtggttgatgctgcccggcgaagttcaccggcgcctgtgtggctagtggcggagagggctgggtcaccacttgcggccggacttgaggtggggcatagcctgccgaatactgaaggattagagccgacgtggccttggtccgccttgccgcctcgtatgcttgttgttgttcttgcatttggcgaagcatgtcttggagccgtgtcatgttctgccgcatggcttccatgtcggcttcagcttgcgcttcggggtccaggctgatttgggcctgtataacggtgagcgcagttgggcccgc

SEQ ID NO: 7387 - DNA, 7852 bp, Oryza sativa
  unsure (1)..(7852): unsure at all n locations
ttcgctctcagtggtttcgctcgaagtccccacggtcggcaccagctgttgtcaaaacgacaactgcatacgtcgaaagacgtggttactcaacaatggttggaaaaatgaagtgtactaaattttgaatttcccttggggatcccccattacatggccctaggggactatttatagccccattacaggttcttattactagggtttaggttgtacaggggaatttacatgattacccttaccaaagaggcatttacaggggtacataatgttataggggctcatgggcccctgatgggccgtctggcgatcgccggcctgatgggccaaaaaggcttcctcggccctcgcaggggcgaacttgtcaagacgaagtcatcctccttcggcagatagtcttcgccttgcacccttcgtctgagacgcctctggcctggcgcttgtacgactcttcgccttgcgccgttcttgctctatagccttcgccatgggtttcggcaggtttggttgaagagcctcatgccatccgccaacagatattacatcaaattgcctcataaactcccttaaataagagtggttgaagaaacacgtaaaaagatatagccaacgcacatgttgataaccggaagctatatgatccaatcgagtgggagtaacaagattagttgtaagttgtcctaggaaagtattcctccagataactatatttgttaaacaaatggtatcttgagctacacatctacccagaacattaacaagatcttcacattttgcatcgtttgatattccaagttgcctaagagcaattttaatagttggcaactccctccggttaattatgacgttttgaataatgatatggtcttcaaaatatatcattgactatacatagtcaaacatatattttaaagagcatgtcattgtttaaatacaataggataatgtgtgtgtgtctatatatatatatatatatatataatagaaaaaaagtaccgtactaaaagtaaaaaaatatttatttattttatatattataatagaaaaaaacaatgtacttctcccccgtctagtaacttagaatgagataagacctatccacattttgagacggaggtagtaaaagttataaaagttgcacgtcaactttccagtgagagtataagccaactatagcttaggtagaaaggagatatatataaaaaaaaagagagaagtgcaagttttcatgcaaaatatagctctacacatggtccaaagcccatgcattagttacactagccgctaacccgtacgatgcacgggtattatagagtatagagatatattttaaattttaatcatagcttaaatatgtaggttttatattttttttattatactgactctagctaaaagaagcgcacacgttagttacaacttcacatttgtggtttcaaaatttcaaattaaattagttatttcaaattaaaaatggaaagtccgtaatttcagaattgtgtattatcaatttcgtaaaaactaataaagaatccgattcgtatttgtgaaacaaattgaatcttgttcgacctagacatctacccaaaactctgacaagttgttcccattttacaaagttcgagctgccatactatcactgatattatctcaaattggctaataaactaccttgaatatgagcagttgaagaaatgcgtaataaatatatataggcattgcgcatctgggtaacgtgcaaaggattcttgcatatataaccctgttttttaagcaatggaatcttgagagctacgtacgttcacatctatccagaactttgagattcctagaattccgtaataaacaacgacgaagagaggtttgaaaacatgcgttaaaatcatgtggcggtagctcatcaattaattgtcatttgtccttgcaagtagtgatacccggagacaatggcatcttcagcgagtacacacctacccagaactttgacaagttcttcacatcttacaaagttcgacgtaccatactataattgatattccaccaaattagctaataaactggcttgaataagagcagttggggaaatgcgggaaaaatataggcaaaatgcacatgtagataacggggacctatttgattcatctggtggaggtagctcacattgtaaattttccttgcaaattaaggccttgtttagttccaaattttttcttcaaattttcaatttttttcatcacatcaaaacttttctacacatataaacctccaacttttccgtcacttcgttccaatttcaaccaaacttttaatttttgacctgaaaacacactctaagaattcttgccgacaactatgtttgtcattgaatcgtgagctacacatgtatccagaactttgatattccataatccctaatagactacaataaataagagtggttaaagaaagcgtaaaacttataaccaatccacacactagagaaatgatctttaataccgattctaaactctttttaatctcggttatagtaaccgagacttaagatctaaagatgcatactaaataaaaaatatataggatgtgggattcgaacttaagatctcgcatctcaaccattatctgtgttaccatcttacctactccacacgtttaacttggataaaggtattttcattttgaactaactctagaggcatttttagtactggttggtaacaaccaacttgtattaaaaatatctttagtcccgattgatattatcaaccagtgctaaaaatatctttagtatcggataacagtaaccaagactaaagatccacaaaaattagtaccggttggtgctgcaaaccggttctaaagatgtatttttaatatcagttggtaacaccaactggggctaaagatatatatttctaggtacctaggcttttagaaccgattataaatagctttagtaccggttcttaatgcatcggccggtatatttgtgatttggggtattggataaaagttgatgatggtgaaagtctgacgagagtggtgatgctatcgccaaaggggccacaacaacagtttcatgtagatgcagtgccaagtaagcatgagcagcgataccacgcactataagaggtgtgtggatttttaacattttattatgtcataatatatgaaatcagttgacgtaattccaaacgtcaaaaagccacgtcataaatttagtatgtgacgtttgtacatttattgtcacaagcatttgacaatgctttattgtcataaaatcctggggcttgccacgtggcagctgacataacagttgacatggttaaaaaaaaagtcacaaaataagattcggcctgctaaagcccatgtagctcatgggccacaaatatattttttctggggttgttgctagctggcccagtatattttttgcttgtttgtttatgaatgcagcctgtacaaattttcaacccacaccaattcggcccatatgatttttccaacccgcacaattcagcccatatgatttttccacccccacaatttagcccatatatttttccagcccaaataattttttcagcccacaaagctcaactgatattttttcagcccatacaattcagcccagatactatatttcagcacatacaaaatcagattcaaatgaattaacattccacaaatgattgcaatgtcacatgcatttcacattccagaagtcttgaaatgcaatatcattacatccatccaccaattcagtacatatccaaactctcaaatttcatattcctgctactgcgagagcaacagcagcacatctgcaatagcatcacagcagcagtagcgcaatggccaaaagcacagcagcaacagcacaacggccagaagcacagcagcacctaaataacatcccacaagcacaatggtcgcaagttcagtgtcaccaaaatatcatctggaacctaattgagtaggagtgcttactattcagcatctgatgatgcaaaattgctgccaaacaattgagtagtttcttattgtacttgaattacatgtaccccagtggcataatgtatctatgaatcctataatacatgagtaagcaaaatttagtagactcaagtaaacccccgcggggcattgcatttacgttagaaaacattggccgcagtttcattgatagaaacagacagagttgtccgaagtccagtgcaaaaaagaacaagtaccttacggcatctgacttgaatcccatcaggttttatagtgctaaactgatcctcaaattgggtcattgtgcatttaatggtagaatcctcacatgtattgtatgagcagcaactataaaataaagataataaatttcaggacaacaacaaaattatcatgtctggactaaagcctacgattatagcaaataccttatgttcatacgtattgctgctccagcccgtttatctgccgcatgacaacgcacaggtggacaacgtgcatgacggcagcatccgtaaggattcatccttaatcaaaagtattatttagccttagccttagtccacatattgcacacaaaaatgaagagttattccatacaaaatcgaatccagattcatccttaatcatacaaaagcatctcttgctctaagattaaaaggaatgtgacatcaagctatgaacgagcagaaccgttcagctttctttaatacaagaaataaacaagctcaccttgtgcccattgtggccttggtgttgcttgtccgttcagagatcttgggcttcatgccaagattcggcacagaagtctcggccatatcaaccaccggcgcttgatgcatcacagccacaccagtggcggaggacggaaaaaattttaggtgtggcctacgaattaccacagaagttagcacataacgaaaaatctcaatgcatgttattatacgatgcaatattatcacaacaagtctacattaagcacggtaaacaagaactaattataagttgatgattcatcatctatttgtaaactagatagaagagtaggtactcaaaaaatacctcaacttcctaagattcatgctttcaacaatacatcacaaataggaagtacagtactgagtatagatagatatagtaccaaagattgattaatgttcacatatgtaggcacctgttgatggagtgatggatgcttggcttgttggcttgtcgcttgcttgctgtcgtcgctgggtgctgcacgcctgcactgctgttgtgccattcatcccaccctgcctctgtctctgctcttcctgcgctgcgcgcctgcccatttgggccatggcggctggtcgtgctgccgccttgccggagcagatgccacagccgcagctctggaagcctggtggccgcgccctcctcacctcaccctgccctcccgcgcggcgcgcaccacagcagcccccgtccgccgatggggattggggatggggattggcggaggttggaggagatggtcagatgactcagatggggaaatttgggtctcatttacactaaacaagcctaatgggcctactagctatcagcgtgaggaccagcactggcatttgcggacgcgtccacgccgtgtcggcactctctctgacccggctgctgctatgcgcggaggagcacgaggaagggggggtggtcagcgggcggcgcgaggatgctgtggccaacgtggtttggaatcggctagcggttgggcccgtcgatgccaccgcacgccgtcctcgagccgcccggggattgccgccgctcgatctagccgccctaggcccgggatctagcagatccaccgctcccgagcgtggtggcggcggagatagaggcggcgtggtaagcggcgaaggaggacgccgccgcacgctgtcatcgccgatacccaccgccggagaggagaggagaggaaaggagaggagaatggatgggagtgtggcggctgagggtggagagagagagagagaggaggggtggagaggagggttttatatagggctagggttagggacggcgatcagaaccattagatcgaagatggacggtcagaaatagttgggccatttgggccgaaacaggaatgatcatatgttttttttttaatttcaatttatgaaaacattaaatgtaattttaggtcgattttttttgtttcaaatgaaaaaatcataaataataaaattatagaactaatcgagatctacaactattgtattagtcctttttacaaataagttcatttgaacaatacaaattttgaattttcaaaaattgataatttcgaataaaaattggggttaataaatgatttcaaatggaaaagtcaccaaaactaaagttgtataaatcatcgagacggaaattttttatttttgtcatttctccatctgactctatttgaacaatttgaatttgaaattcaaagtttgagaacttcaaatagaatttttttattagtgaacgacttcaactgaaaaattcatcaacaacaaagttgtataatccatctgaatctacaatttttattttggtcatttgttcattcgacgaagcgatagtaagattgttcacaaaattttaatatggttttataaactataagagagatttgtaaattttgtgaacaatgttaatatcactttgccagatgaagatatgaccaaaataaaagttatagatatttatgagttatacaactttgttattgatgactttttcagttgaaatcatttagtatttgaaaatattgtttgaagtagtcataatttgaaattcaaattcaaattattgaaacaaagtcatatagcaaaatgaccaaaacaaaagttgtagatcttgataagttatacaaattttttgttgacaattttttcatttgaaatcatttactacacaaaaaaatatatatttgaatttcttatattttaaaattcaaattttatatagatcaatcaaactcagatggagaaataactaaaataaaattggtagatttcgataagtcatataactttgtttttgacaattttttcacgcaactcccaacaatttttagcttgcgggttcgactcctaactcctaacattttttagccattttgctgagttaggcgcggctgctcggcctagcgcacgggttggcccatttcgggtaagcggctgttgggctagcaccaggttggcccatctgaaaatgagaaaagaaaatctgatgtggcaataaggcttgcctacatggacaaaaatatttaaaataatacaataaataatttgtgacacataaataggtcttatgacatagtaaatattgtcactggatgacactagactagctatatgacacttattgtgacacacaactttttattgtcattaagttaaaatgcttcaaataaaatgtcataaattagatgatatagtgacattataacctgtgtcatataagccacacataacttgtagtggcggtccgaaggggacgacgcatgcagctagcggcaacccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctgc

SEQ ID NO: 7388 - DNA, 6236 bp, Oryza sativa
  unsure (1)..(6236): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattctcaaatgaatatatcaaatctggttactcacactataaggaatttgattttttatgactgcaaaacatatttatgagtagacagtcatacatcattaaagagtggctaatctactgcgttcatcaaccaaattaaatcttgtatcaaattgatatgtaatttgtgttcatcaaccaaattaaatcttgtgtcaaattgatatataatttagcacatgttttacatgttattatttctcaatcgaatcattctttgtcttcctatctttaaccatcatctctagttttccttctcaaatcaacaggctcaaataaaaaatttgtgcctcattcaatatatatagtatacattcatctataacattgatttctctgtcttcctatctttaaccatcatctctagttttccttctcaaataaacaggctcaaataaaaaatttgtgcctcattcaatatatagtatacattcatctataacattgatttgtaagccacatgactattgataagaaacagatttaacagtttagtaagcaaccctcttgtttttctccaatattttatcacatttaataatgatcttttgcggtataactaacccatattatttcaatcatgcctaaaactagcactcctatatatcactggtacgacataaacacatcatgtgtgcaaagttagctgtatgatgccactatatactatcactgtcatttaattgctatggcatcatgtttatgttccttgcccacttatttgcttcataaatcacatacgcatgaacgctagctactcccgcatgaatcattagctagcttactttattgaaatgcagaacgatcatgcatgtaacatgtttcaatttttatgttttttttagcgcgccaattgatctctacccttctctgccctttttgttttttctaaaggtatcccaccctcgtactatctttggttgattggatggaccgacgagatgaatggagaactatccagttcatgctttcttgacatcctactgtttggatgcataaacgggattatatgtgtttggagacagcaagatattacctccgttatcacatagatgacattatagaatgcgtctagtcaaaccttgatatattaaattaagcatacataagtattagaatttaatacacaaaaatggtattgatagatttatcatgaaaaaaatattcacatggttatatgttcgttatttttataaatatactgttataaaaaaataatggcaaaacacatgcatttgagacggtgtcaatgtccaaaatgctcaattaaaaagaacagatgcatatatgtttcactaatattctcataactccaaagatgtgtatagttccgttccatataaataatatggttttggagcgtggttctttggcaagtaacaatatatgctggagacgcaatatatgtgaagatatattatttaattgacaaaacaaaacaatgaatgagatgcacctacacaaggttggcccaatccggtagaaatggaaacaaaaccaatagaaacaaataaaaacaagataataaaaaagagaaaataaaatatgaacaagaagataaggacatgcaatgaaatattatcgaggaagattatgatttacttacgtaccaacatctctatgaaaattagaaataacataaattttacccaaccattctgggtcatcttttacaatattatcaaccaaataaattgatcaatcgaaccgtagatttgatcaaacaatcaataagtgtagttattctatcctaacccccatccaacacattgtcctattccattcaacaacatccctccaacaaaacatagaatataatacatcaaatgaaatacaccttagtcataacaaatgagataaacatagaatataatccatcaaatgaaatacaccttagtcataacaaatgagatgtgtttttttacacatatcatagtatacgtgtatactcaattacattgtccattaaattttattcaatcagaacccaaccaatattgaggataaatagaattggacataatatgctcacaatttgtaggttatgcggacaatgaagataatatttgtttgagtatatcatcctccgatgaaattacaattatgagacataaaaagttacaacttatagtactatttaatatttaaaacctaaagcccactacttaaaacactaaaaatgatataattgggtcggtttaaataataaaaaaatcacaccaatcatttaaatactatatataattttcctccctgtacagagagatttcttcttaatgaaaaatgtagatatattatttctcccccatacagagcgattgcttcttaatgaaaatatggagtgatcgaatgtttttttataaaactgtcatatgaaccatatcagaaaattctatcataactatcccactcgcaggtttgttaaaccataacaaaattgacatgaatatctgttcaatctatcttcacatattttcttcaaaatctggtgggtaagaaacccctcttgctttcctccaatattccatcatgaattaatgtttctttttcagtggataaatatgtattctcatcaatactatctaatacgagccaaagctaataacctagccaaagcatgtattcatcactgatatttatatatggcaatgtattcatcactcgctggaagaaaatccaatagatcatgcgtgcagtgtttgcatgcaactgtatgttcttcatgtcacttaattacttgctgtacatgacacactattcatgtttctttactgttaatctcttccatgtagtttaagaaggttttgcatgcaactagtcgcacgttcgcgcgactataaccttcctatctattagctgctattacaattaacaataaattttccaccattcagctaaatcaataattaatgtatagactcagggtttatattcatcttattcgtgttgtttcctgctttacttgatttaatattcgaaaaaagtatttggtcggaagtgcatgttcaatacaaatactatgttgttttgatatgtaataaatacatattgtaatgaaaataaacaatttactataattacgctaaacttgtgatattattgtaagaatcaaaattaaatttcactactacctcggattccaaatatcctgggtctacatttaagtaaaattgcacatcataattgtaactatgttataagatttgtttgagatgttaactttttttttctatatctttgttttgattgttgctgactgatttaaagtgttatatgtagaataatttttccctcttatgaaattatttaattggttatctagtctaaggaccgtttgggttgattggccaggctaagccagccctaggcctatttgggaggccaacatgagataaccaataagaggtaatgagtggctcaaactcttccttctctctatattttactacttctagaagattcctcatttcaatggctaggattcttccttgctattttgtcattttgtgaatccaactgctattttttgacaaatcatgtggctaattctggttgctttttgagttttacttttcaattaggtagatgtctatgcattgcaatgcaatggaatttagagtagggataagtctatttaacacccttcaactttttgctttgttaaaaacacaccctcgaactataaaattggtttctaacacactcaaactatcaaaaccagacatttacatcctttagaggttttaggatggttttggtatagctggacatcactttggatgccacattttaaaaagatccacatcagcaaagggaagtgtcccattagtcagttccattccacccctcttcttcttccttcccctctaactcgctctcccctctcttcgtggagcagttaaagttgacagcgagctccatccgtggagagacccccaccctctcggcttggagctccacgctatttcgccgccgttggcagtaacactgctcaacaagctcgagttggaggtgaagatggcgcgggcgacgacaaactcttggtggtggaggccctgcggcatcgactcctccgtcgagttcatcttgggatcaaggccgtgctgccggcacccgtctctttaacctcggcaaggagggggagggggtgggggtgctgggtctagggtggtagtggcgcttggataggaagccatctacgagctccctgagcttgacgaggagagtgccgacggcggtagtggtggagcttgggtaggaggggacggcaaaggcttcatggaggagagaattgaagaaccacaccttggtctcgtactctcgtcgacatcggggaggagagatacctccaaatttcaactagccgtagccagatcaagatacagttgggtcgatccgcatccatcaaccctcaccagagcttgccaataaccccgtcttctatgtgcttggcgaaccctcttcttcgagcttgctaacagccccttcaccaatcacggccaagggagcaggctccgcgtcaagcttgtcaccaacctccctcttcccttgagcatggccaagggggtgggcaccgcatcaatctcactgtcaacctcgtcatggccaccgccaacctccctcttctctcgagcatggcgagatctctatggccgactcaagctcggtgagggagggagtcaaaagagtgagccatggcggcctcaagctcggtgaggggtgagcgagtcgaaagagagagggaggaggaagaaaccactctaactagtagggccagctgatatggcaataccaaaaatgccacataaaatcacaactttcacggagaaaggagaacaactgtattttaaagtagtagagaagtgcatatctcaaagaccaaatatgccacataataatacagctttcgcaatacacatttgctttattaaccactaatgcatgaaagccaacttgagcatgaatcgtttagcttagtttgctggagcctggagacgcaaaatatgatcatgcaaacgttcagaattttatatactgtttgaaggtatgcagttcgtctccacccttgccttctccccttgataatcaaaattccccatttcccctatgaagcacatcttgaccttctccccttgaatcatcaaaatgagatgcagtttccgggctacttttcagagtttacttaattatatgctcaattacattgtgttcatatgtgatgaattagtcgttctgtagagacaaatgggaaggcggggtgagctgcaaaagagcggatgagaaacgctttgcatttttctttcatattccatttgtcatccacactgtctatgtaccctcaaagagaatatatatgcactgtattagctacctacaagctatatcatccacaagtgtcaacctcattcttgaagcaccaaaacaacgcttcagtagatcttaacaaagtacaaactcattatctacctggaggctggagggaatctcccttgtgccactgggaatatgcccttgaattttgtttctcccatttatggtactatttccaaatcttatgccaaaacatgctgtggacattggccatgctgtactgaggaacgcaatgatgatttatgcccccatcctgtattagacaaacttaacgacatactctgttcttcactcatgatggtggtagctcatctgaaatcattagagacaagaagtcaagaacataaaaagaacaatttatgctatgggccaaacggagacatgagacacaagtactgtgtatttagaaaaagggtaattaccatattataaaaagggtaatttcctcgaaaatacgataaccaaggaaacggttggtaaaacaacaaaatcatttccatttctgtttctatttttagagtaaagtccatcaccggtccctaaactt

SEQ ID NO: 7389 - DNA, 7264 bp, Oryza sativa
aaaattgtagccctcgacgtgacctacaactttttagttgaaaagtttttgaattaaaaccatttagggtctcaaaatattgttgcatgtttatagattttgaaattttaatttcacaattacattttgggacaaaaaatgacttaaaataaaaaaaaatcaactacaaagttgtagatcacgtcgagggctacaagtttgatataaagtttgtcttcattagaattcacatgaaaaatttatgaattatttttaaatataaagtctttagaccgtcctatttgatccagatgatattcaaatccaagtttagggaccggggtgacacaactgaacaagttggagaacctaaatgagtgatctgcaagtttaggaaccgagatgacacagtcgaacaagtttgaggatttgaacggtcgatttgcgagtttaaggaccgggatgacacagcggtacaagtttagggaccggtgatggattttactctttttttttaccatttccatttttgtgtctgtcagtaaccatttccatttctatcagtaacaaatcatgaacgattaccgttcggtcggtaacaaatcatgaactatagccagtcggtcaggaattaccaggggcactgtttttcacaacttcacccgtaactgaccacggagtggaaacagcgccaggacaccttgtgcatgctcactcctgttatgcactcgtgacagcaatgaggaggcaccaagcccatagtataggcttgtggaccagaactgcaacagccacactgggatgtacgcagtggaggtgaggctgcacaggcattacccaacctacatggaggtggcaagaaatgcaaagttttcccagaatgatgcatatcaattatcaaagcagtggctcgaccaccccagatgagcatatcagaggtgcggttacgcactcgttgcccatcctatgttgaggtggcaagaaatgcaaacttttgccagattgatggatatcaaaccttaaccagcgacacgatcacccagatgagcattagaggtggagagatgcaatcctcatactgccctgttctaggtgcttccctttggatgtgtgaatgccaccttgccatcctttataagaaatgggatgtgtcaattacggatgtagagtttccttctttctttgggtttatgtgtaatcagatggagagtagaggtgccacttggaataaaaatgacaagtagtacgtttgggccaaactgtgttaccgcccgatgcatattccggcataggttcacaaaggagtgccatatatgggagaagcaaaaatctggtggcatccttttcctttgggttctagttcgggaaccgccagttttctcaaaacatggatttggtttcaggatctggaaatttctagtgacacgtaaggaattttccaacaatttcagttatgggcctaatggacttcaaaccagggattcccagtttcattttggaaatagattctgggcgataaccagaaatttcagaaaaaataacacctagaattgtttgaactttgatttaagaatagaaaagcgaaaaagaaagaaaaagaagaaggcaaagagagaaaaacagaacagttctcataccataaatttctttttgtcagcacatatgtgttaccactgaaggaggcaggcgtttctgtgttggaagacctgtgtttaaagccgaggtatttcctgcttaacatcagagagatgtaaacatcgagagctcacgtttgcttgtctctcaatgaacctggtgtgattaagctcaaatgagtcatccataacaatgattcatgtaggtcccatcggttgcccatattccctaataagccaaaacggcttattagagaataaaaactaacttataggtaaaacttttatatatgtgttcttaacaacttaaaagccaatactaaaaaagaactacgttgaaaatattttaaaatcaacttcaaaattaagtttgaaaattcaaattttggctttggcttattagggcaaccgatggggctcgtaatatatgcaagctcatcaaaacagaaacaaaataagagataccaaaatattccctccatttcatattataagtcgtttgactttttttcttaatcaaagttccttaagtttgatcaagtttatagaaaaatatcctaacattttcaatacaaaacaaacatattatcaaaatatattcaatgttaaatttaatgaaactaatttggtgttataaatgttgctaatcttttctataaacttggtcaaacttaagaaactttgactaaggaaaaagtcaaacgacttataatatgaaacggagggattatattattgcatgataaattcatagtcttcttgaaatgataattagagtaggacgtatcatacttattttttcttgcatagtagcagcaaaatccatgccattttctctccagatatagggaaggacattttgaaacatatatagtgttggatgaactccagagtcctccatccactgcaaaacctacaggcacaaaaaataaagctcaaataaatatcaggttttgacctattactcttgaatctagcttgttgcaagcggtattctgagatgatcagatgatgtaaaaatgagaaggggccttgttacctcaatatactttctccatttcccaacaactaggagatttctaagaacaaccgcataagtagaaagacccacagtagaacatgaagtcaccatcttgtaaaacagctgcataagagaatcaaataattaatgtagggaacagaactgtaaatgcagatcattatttctcttacaagtgtagtggcatgtttgtgattccatggcttcctcaagtatcaatgtgtattgatgtgagaaggtgatgaactgatgatttaaaactagtcaagataaaattgttcttattgctaaatccatttttattttggacaaggagcagcaggaaaatataggtggtacatgaaagtatggaattcttggtagtacattgatacttgaaccttcagacattcaagaaaacaattcactgccaaataagtaagagtagatgaaatcataaaatatttgtcaactcctctgaaaaggagaatcctataaatctatttgattatgctgagcacaaacatattaaatgattatatgtttgggagaaatatattgtattgtgtcagtgtggcaaggccgttagttccatatctaaccaaatatggacttcacttttatagaaatgaacagatcgatagtttttttcccccctgaacatgtaggagaactgcatccctttgcattaaaaagaaagatatccactaaaactaaaaaccataccacaccaaaaacagagtaatgaagcatgtatatccattgcactgcagaagttggatatctttctttgggtcttagaaagatatccactaaaattactggaatgacaactatgttcttagaaagatatccactaaaactataaactaccacaccaaaaacagagtaatgaagcatgttctgaaatgacaactatgttctgaaggccaactataccttcatcatgttctctgtcttcccacattttccaagaaaatttaaaacatggtttagtgttccaacagaaatggatgagagcgaagaatccaaatattcaatcatctcacttgctgttttccagtcacgtatcctgttatgaggaagcagaacaaaatagaatattgagttattcaatgcatcaaaagcttgtaaacaacataacaccagatgtgtgcggtaaaaaggaatttgtttctgctcaacacttgaaaccaccaatatatcacaagtccaatacaagttacatgatgaaagcatggcagcatgccatgatagcctgattatctaaacctacaaacagtgataatgaaaggagcagaggctcactggcaagttgctgtagcccatcaaggaaaatgaaattatcaatgagctacaatccgaattgtgtaagcgaacaaatgtagattgccaatacagtaaccccaacattcaattgattcaagttgtcaattactggaatcgaattaacactacacagaacattccaccctgctatcttaataaacttgaaacttcatactgtttttacctattaaaaacttatcttttatatcgcatggttgcttaagaagaacaagcagatgtttgtaagtgactcaaatggtcacctgattaaaataatcctaaagcaaagctgcacatgacaggtaagatgactgagtcatgtacacctaaaagccataaacacgatgataccaaagcaagtgtgaatgcatatttatagtgttactagatcagcagatgttgcacactgctcagataataataatagacctaagttaccaatttagaattgcctgttcgacttaagacatcagtaaacgtacatggtgcatgaagctattatctcaaaataagatttttggttcaacgggatggattttttcttcatgaattccatcaattgaaggactctttcaggttcgccacccttattgaatgcttccatgagagatgagcatataatggcatctggtggaataccatttacttccatctctttgaacaggtcccaagctctcttccaaccaccttatggtccataagaactaaaagatcagtttaaattcttgagaagctaaatcaattaatcataataacaaaagaatattaccaccagcattataggcttggatcaatgtagtatatgtcaaaacatcaggaaaacagcctgattttttcatagaactgaaagtagattctgcttcagatagtttgccctgaatacaaatcattgttaggatagcaaactttttagagtaaacaacagagaaaataagagcaacacttgcctgtttgatatacgaataaatcaatgaagagtaaacctccttggttgaagaaaccttggagtccaccatgtcctcaaaaaatctcaaagattccgtatactttcctaatttactagatccactgatgagtatattgtaggttacagcatctggtttcacattgctctccctcattgatgtatacaactccaaagctttctcataatctccaaaacttaaataacttttaatgccggagttgtaagcaactgtatttagatcaatacctcgggacctagctgcttcaagaattgtctcaattcttgttatctgcctgcagcgaccgcaggcagccaacagagtacttatggaaacaacatctggctgaatgccatctttctccatttcatgcagcaagccaacagcttccttcaacattcccgcagacccataggcatcaataagtgcattgtaactgactttatttggtttgcatgagttcttcttcatcttgttaaagacctccctagccttctcaggctgtgcagatctaccatatgcattcagtaaggaggtatacgaaactatatcaggtcgtaacccatttttctttattaaattaaaaattgccaaggcctctctatgcatacctcgtgaggcatatgcacccaaaagcgaattatatgctacaatattaggcttcactccttcagcaaccatcaaatcaaagattgctttgcaattttcaacttgcccataaatacaataagaatgcatgatgctagtatatgtaacaacatctggaggacatttggttcttctctccctcattgagttaaacaattcaatagcttccccacactgtccaatctttacaaggcaatggatgataatatttaacgtgaaagtatcagaggtgacatttgctcctttcattatttcaaaataagatattgcttttgagtactgagctccattcttgagagcagacaagacaatgttgtgtgtaaccaaatctggtcccacaccattttctgtcattttcttacacagttctaaagcttttttccagttgccagcagccccacatgcatttatcacattattatacgtagtccgggtaggaggtatctgcagcaaaagtccggaacacaaccttctttaataaacaattatggcaactaaactaaaaaaatgaaatatataaactttgctggttttctaatagtctctttgcatttcaataacgtaaggactgatgaggcaatcaacagtgatgtgtccttgcacaaagtgagtgcatggagccaaaaactttatatggttccaagattctcttcaaattcaacccatattttagagagaaaaacttcaacccttaatcaagcaattttaccttactcaacaaactcccttaaaacaggattgcatttctcgctctgaacctctggtagttgcaaaacatgtttttcctgttattttttaactcttcattattttctttggtgcactaaatctaccatagccattactatgtatagtagaaaacagaaggaccctattgggtttatagatgaaaaattagctcaatatcaagaatggttatagcgaaatgaggaaagcaataaacgcattgtactcattgtaaagaagaagcatttccaaaattatttatctaaaatgaataaggttaaaagcacaaaagttaatgttttgtattacttcgaaaaataaaacacacaaacacatcaacttaggcatttgcaagatgagaaagcaagaatatagggtttatgtttcaaggaatgatactgacagcagcacgaagcatatcttccataatgttgatggcccaacgccattgaccagctcgagaatgagcatggatgagggaattgtatatatcagcatcaggtttacacctaaggttataaatgtcagtattttgtccaaaaaaaaaaagagaaggaaatgacagataatgaaaaatgatatatttcttatcacagtagtggaaaacaaaatatagaaatagcaaccacatggaaattgcacttagtattacacatattacagtttattatgataaagtataaatttcctacatgcgagatcagcaaccatcacttgcgctgttccctagatgatctgggaagattttggatttgcaaactcaaacaaattgaaccataacacaaacatgttatttgtatatagacaagttaccgacgagacaattactcaattatgaggtgataaatttttttagtaatatcaggcaaaactctttttgatggttgaaggaacgcagaagccaaattaaaaccttatgtcagaaatatatgttataacattcataccgccattcctgcatctca

SEQ ID NO: 7390 - DNA, 18809 bp, Oryza sativa
  unsure (1)..(18809): unsure at all n locations
agacagtgcttctatgggccggattttgtcgccgtgggccaggtgagcccgctcgtttttgctaacctcgctggttgccgtccgatgcagatcgtgcgctccatctccccgctatttccctccctctgactccgaatccgaatccgtagtcgagtctctccccccttcggcgtaaaaaggagaagagaaatcccccgtctcctccgctccttgcgacaagaacagggggagggagaggcgccgatccccatctgctcgagcaaagcagcggaggggaggggatcctgcaggtgagcagcatccatccacatcctccttctgattcatggattcatctctctctctctcccacccctacttttgtctggaattcgctttgtgtgcgttcgttaaccctagctttctcttgtagatctggaagaagctcatctcttaatttcagagagagcctcaaccttttgatacaagagtaacagtattgggggttcatctgaacccccaaatgtcccaagttggatccgcccctgagacgatggatctggagacggagaatcgtcttgcttctttacttctcgaggaggcgaggaggttgcaggcggaggctgacagggaaggtgttcacgcatatctgcgaaagcccaatgtaaggcaccgtccgaattcgcgcttccttacggccacagttcgtggagttcagcaaggttagcatcgtagtttcgatttatcgttattccatacttgatacctcctcctgttgattgattagctatccaaggcaactataataatttcttagtttcttgactcattgttaatcgtttggtagacttttatctggaattgaattattttttatagaacatattaattttattgtttgcccaaaaaaatgtctgttccatgtcttaaaggagaattataggtgtggttaaacacaaaatataaaccaatcgtgtaaaacttacttcctttgtctaggaatgattcgctggatagcaagtaatgacaatctcataagtatagctgatctcatgttgctaattttcttgtccaaagatatcagcggtgttctggttgtctacttactgaattggcatgatatgtgctgttcacctacagcgaaccgtgttgtggaggtcaatgaaatgtggcgtgccagaaaacaacttgannnnnctggagtcttaatgaaaaggagtagaggtcttggtgacgccagagagtgaaaaacgcaaaagtgacttgagaaaccagagttccagtccaagggttgaagaagaaggcatagcttataacagttcatattccgatcaggaggatggtctaggggacgatgacattgagaagtttcttcattcgaggtctgtattttctatcttttggttgttctactaccaacattttacacaagtagctatctgcaatgttgctgacagagatgtaactttggtctgctatagggtgaagcgaggtcgaggggccgttggttctaggatggatgagcctggtccataccttaatgttgcatctcgtagtcaagagaacgaacctaatgctgatactcaggtggaagaaaaatgggaacgaagagtacaaggcccggagaaaccagtgtctttgagatcaagatcacctgatgactattggcgtagggaagcactagatggagaaccttccagccctgaactccacaagaaaaaagagaagaagaaggaaaagagttcagagaaaaaggacaggaaagagagaaggaagaaaaaagacaagaagaaatctaagcatcgccaccaccaccatcacaaaagtcggcaaagggagtgattgttctgcttgctgagcataaaaaatgtacacaagaaacatgttagcttctaattgctactgttacttctcacttgaaacatgttgtaccaaaaacttgatatcgtgtggaatggagaactgttcttctcacacggagtgttgatacaaagccatatgttagattttagtgctctcgttggtcttgtgtatttattatcatgatgactaaatcacaccctcgttaattaggaataacgtggttttggtagctaaatgttacagcttccaatcttatctgcaactattgtatgttgtacaaatcgtacaaatcgatcaaatttgtatgctgtctgtctgtcaggcaaggattcctcaattggagcactttggagtccctgtttactggcattctagtttcactttcacatcagtagcccagatcagatattctgactcagaactttaaaacgctgctgatttgcactttgcagtatgacctcatgataatcctccaagcaacatgtaccttcgagagttcttccctagaactttcatttcgaaaaaaaaacaaattcacaaaaataaagagagatttttctctcctttaagaattagtttacatttcctgttcatagcctgataatgcagcataatctgtggaacttcatttgagtatcgatcaaaacagttcagtacccttgctgagagggtgaaaaagaacatagggatgacatgattgttcatatgtagttgcacaaatgtttacaggattacatgacataaaaaaaatgtaagaatgaaaagataatgacctagagtctaccacttctgtttacgcctgaaggcaatcagtggaacgctaatcgagatttatgggctctgtacagtataatgcaatgtgtattgaaggactggattcgacaaaatctatctgcaaaaaacaatgaaattgttactaatcagatcaaatgatcagaagcataataagggacgaagtgaagataagtagtagtaaataggcatgtggaatatggttaaactgatcatgtaaacatcattcacaaacaagcatgatgagcagtgatatttgatagcttaagaatagttgtgccaagcgaaagagacttaattctggaaggttagtaagaatcaaccacatgttcgataaataaaatggtttcaagtttcaacatacacaaagaagttaatgaccattgtactattctagctgctgtcattgagatggtttggagatttcaagtagtcaaggtaatttgtatattttgagaatttttgttgggacctgtaatgactacaaaaaattaacatactcaacaacatgtttaaatttaaaagtgtatagcgaaattgtatcagttactcccactcattcattgtgcaggtcagtcaaagctactctatgaagaaatggcactttagcttagtaagtggctattgccttagaaccatgaggcatatgtctgaacgatcatgattaacctgcctctttcttaataaaagagaatagccaaacctatatctcattgcaaactacaaatagctgaaattttagattgaacaatcgaaaatttgaaatgttgtcagcgaaatactccctccgtcccaataagtagcaacctaggataggattagacccatcctaagactagggtatgtccaaattcgtagtcctaggatgggattagacccatcttgctacatattgggacagagtgagtactcacattgcttagcagtgaaaagtacaaaacataaaaggtgagaaagatagcactgaatctattttctttaagggaaagcattgtgctgtgcaagttcctcaacatccatggctattgagcaacaagaaacaaccaagagaaggacctgaggcaatcacctgcatcaatgaatgaaggaagaatggcccaggaggattcagccaacaacaaaggggctgatctccccgttccgcatgccgcgggctatctcaccggcgatcaccaggcacgttgaaacccagccggggagcaccatccacaccatgtccacaatgtgagccgcaagcccccacgacatcgtcatcctcgcactcttctccctcaatttcctctcctctccagcctttccctacagctgcttccagggaggcaattccacaaacacctagcctgcaagcccacaaggaacccccaacagtttgcccccccccccccccccccaatcatgagtgagccgacaagatgccatggaggtgaacaagggttagatctatctagttctccaataattgattccatcttctaatcgatgggattgacaaggcacagaacaattacctctgtataatcctgagatggcaaattcacctcaccatgcaacaacagaatcgactccagtttgcaagaacccttcacccatggcagtgattgaatcaggatcttgtgtttcaccaccccagcacgtacaattcttctcctgcttcaataagattggaaaccaaatagaccttggggaatcttcagactcttcagagtgggactgtttccccctttgcttccgccctcagattctaccaaaccatggacggatagatccttaaatttagacggaatcaagaagagataagacaggaaaaataattttttttagaaaatacaccatcaagtttcttgcttgctttccccaaactcttgcctttcacctgtcgctgtcaaactgacccaactgagcaaattcaagaaacacctaggaccaacctgcacaagaaccaactggagactgccacataggagtctctgaccaggaattttggaggagatcctcatccaaattggtttatccaatcgtctttatctgtttggttagaggattagataggggatttggacaagtatacaagtattcttcagttttgtctcatcgtcaattcgtcgaaaaacacctgccctccaggtcagcacagtacattgaacagaaaaggttctactgctgagtaaatgcagattaatcattttttttaaagaaatacagtacagacacacgctcataacatgcacactcacgttataaacgcacacacggacatctcattatcgattggtatgtcatctaccactaaaaaaataatcgatctttgactccatcaacagttgtcacaatataagccattggcttgttgagcttttcaaacccaatcttaaattgttgcaagcatttttttttcatcgttttttttttctagcccaagtcctactcgaaaaataatatcttgttgacttatttatttttgtacagcatgtgagtctttttttttcatttctcatacatattgtgtttgcttccctgagccagttccggcttataagatttgagttgattccatcatctcctctctatgctacagtagctattcttaattaattgaatattgataagtactaataagttctctagatcttttttagaaaaaaagaaaagttctctggattgttgggtcagagactcatccaaatttgggccaggctctgggtcggcctgctgtcactaggccaaaagtcatgatccagtggcccagatcttattaggtccctcactgtcattaggaaaataatttggggaccaggtgaccctgcttaaaaagttgggttatgttcaaagcagggtctcctaatctcctatgattattttccggatttcaagcattgcgatagataatatatagcgggttggtcgtgaattaatctcttgatagcagattgtgtatagagagtgctatagcggctagtatgttccaacatacttcctccgtttgtaaatatttgacgccattgattttttaaaacatgtttgaccattcatcttattaaaaaaattaattaattattaattcctttcctatcatttgatttattgttaaatatacttttatgtacatatagttttacatatttcaaaaaaattttaaataagacgaacggttaaacatgtgctaaaaagtcaacggtgtcaaacatttagaaacgaatggagtattatcttgggtccgctaactttgtagtgctagcagtagaggactaccaacattatagcggtcgccattacggccactgcaaacactatattaattaccttgcttccaagtaactgagctacatgtgtagaagtctaagaagtggatctgaagtgtttgggttaaagtcactatattatttatatttactagcgtataatatccatgcgttagatcagaattaaggaaacattgtcattaatacattctcggcacaacaggcgggtcctttggcccccacgcacaaactccattttttcccttcacaacagtgtgcagggagttgatggtgtgagtgatggatgcggattgaccattcatcacacctagttgtttcatttaaattagtatatgtatacctagaaggtaatatcatggtttaagcatgaccaatgagtttatttttcttctagaaaggtataattaacaagttattactttgttacaataccaaagcgaatcgattttcttttgattcatcactgtatgtacgtagtatgtgctgacttatcatcaaatttacacttgaaaagaaaattgtgctgatctttcaaaaataaagaaaagaaaattgtgcgcggttcgttgtttcaatttgttcaaacaaggtaaaaatatgaaatactactcatcacctgctctttattgcccatcacatgataattacacaccgttgcaagaacaagcatagcacgcgaccataatcattttattcgtttgataaataaataatctagaatataacaatggcgattattatttatcattaaacagcatcagatatcaattaatcaccaagtggcaacggcgcgatccgccgtcgtcggcgcgcgtgtcgaggtcgcactcgtcgcgcccggggagcccctcggcgatggcggccatggcccccttcttgcacgccagcggcgcctcctcctcctcgacgagcacctccaccatggcgcgcagcgcgtcgcagcggcagcgcgccgccacctccctcagctggtggcagcaccgcgcccgcacccccggcgggtcgccgccgccgcaccgccgcagcaggtacgcccggcaccccggcagcgggtccttgggcaccacgccctgccccggctcgcacccatccgccgcgcgcgcgacgccgccgtagtactcctcgccgcccgcagccgccgcgacgacggcgccgaccaccaccaccatcagcgccaccagcgccaccgccaccgacgacaccgagagcttgctgttcttcgacgccattgtcgccgtcaggaagagaaatcgatgagcagtgcaaggtttgggttgttgggggggggggggggtggtgagattttagatggttggaaaaagggagagaaatggaagcgtggggaggaagacgaacagttgctttttttgtttttttgaatttgccgggaagcgaagctacgtggagagggcgtcgtgcatggcgcgcgcgggaattgtcagtgggcgtaagggattagcgtccaaattaaacaaaacgaattcatcagtgcatttccagggccgggctgcctacttgcttaatgggccgtgaaagattgggcccaaaagggacctgcacgaatctcaactcgatcggacaaagggtctcatcttttcgcttatacttattcttatcagacaaaatttgaatttttaaacttaaatttggatttgattttaagattttttcatcgaagtttatttttcaatctttgcttttaaatcgctaagaacacgtatataaaagtttaattcacaaattacttttcgtttgcaaatatgtcgtttcgcttattcagcgaaacgatggctccggaagggtttacttactactgggcccgcatactacctctccctttgtgtttccactcaccccgcctataaaaataccgccatttcatcagtatactatttactatagcatttattcatttgtattaaaatatacttatcattgagaccatgtaaagcaatttatgtgacttctaatgtccaagttgtcaacctctattctctcgttttctgcacgcacacttaccgaaccactaaatgatgtgtttttttaataaaagtttctataaaaaggttattgtaaaaatagttaactttggcgtgaaggactaatacttcggtttcaatttgcctcacgaagaaaagggtggatggaggaagaagattgatctgaccggtgggttccatgagtagatgaggaagaagatggagaaggaaggagatggatggaaaatgtgatggcagtggtggtaccaattttgtaaattttcaatggcatggttacaaatagatgaattgtagtagcatttatctgaatcaacatatttataatggcatggatccaattaacctaaaaatcaatacgtactagccctcttggaatcgtctttttcgtactgtaactaccttttactctagttcgtccatttttattggtttgcattgtaaattaaccatccatccttgctgtaaaagtgcgaatctgttaatcctgatgggtgtttaccccaatttgtctaaatttaatatgctagccgattttgatctcaattatcatcttggtcaggagtttttctagatcacggttattagcgattatattcatatcctaaggctctcggtggtacatcgtggtgattggtccctgaaaaaagggtcaacaatggcaaatatgcaatttatttcaaggcccctgaaccatattatctgaaagtttacttggtacgtattatctaaaagtttcctctatatatggttggctgttttttcttttacctttttctgattgcatgttgtccctagggactagtaattatattatatatttcagtgtccctcttgcacaaaggaattaaagaacaattcgagcgggctagtgaatcaacataagaacatcgaagttcatcatttattcaccacatacatacgtttccatgcaaatggaaacagtaattacagtaactacaccacaccacacaaagtagctatagcctagtggccagtcgccgggttcctaagataacccagccattagcaaacaccaccgatgccgatatggatatccacaccgcataatgccaggaggctcgccaccaccatgcatttcatgttgtctctccggcagccagggaatacctcgtccatgggttgcccgtgagccgccgtgccgagctccttgtacatgcctaccaacttgtggctgagcaccggacacctacataagttgttgttgatggtggcgagctgcctacagcagtctcgccagacttgctcatccacgttaccggctgcgccaccgccaatgcactggcccttcaccattgttcggcagcgtgggagtgggtacacatcgagtagtctattcttggctggcaaagctggctgggggtatacaccacctagcagtggtggtctgccattgttgtcgttgccacaagcatggagacaactatcgagagcaacactaagaaccatagtataatttgaaatttcattctccactggcaagcataaatctccctgaattttttggtttttttggtcaaaatttatttaaattcagtcaaaatatgttaaaaattcaaataatttcggtcagaaaaacccggaaatcacaccatattcgttaacccctgaaattacactaccttgtttggtgccattttgtttttctttgtgttgcagaaaattttagttagtctcaaattgtatgagagggtgtacaggtaagcgctacatcaatggtggttttatatgtagctacaaatactaaagtgattccagaacggacacaatttttatcatgagtgagtagcttatggttttgcatgtaatatttattgtggttcaaagctaatctaggcatcatttcgaaaaaaaaaaacccttcgttttatatggaccacactcttttcattttcattcttccatgcaagaaaacaaatgcacaaactgccaacagatatatagttttggaaggtaacaaaatcttttgatctttatttgcatggctttttctatatatagttgatccaatttggtaaacaagaaaaaagataatacttcagaacaaatattgttaagaggaatgctctggaagctaaaaagcatgcagtaaagaaagctgcaacactagattcagaaaattaagaaacgtgtgtttagtgaagaaacgtgtgattatgtcggagtattctgaaacacaagacgcgcacgttcacttaatttccttttattgtgtactctaatcttgagaggactgggcagttggatctaagtaacagagttattttaacaagccacggaattatatagggaagcacgtacgcataatcactttgtcaaaaaaaaaacattacaaattaaaggctagagatattgtgtgttattaccttgtcgtattgcaatttgcatagaaatgttttaagtaaagagtaaggagagcacaagaaataggtctgaagtgtggtaggtttgtcaatttgcgaaggaataaaaagagcgttgttagcttggggagtgagtttaatatctatcggaaatgtattaatttatttttaaatcttggttttaccatatcaattatcttaatcattgtaaaataaactactccctccgttttaaattatttgttgttttagttttgttacaaatcatatgtcactacaataaaaacctcatatgggacttttctagaggagtttacaacaaaaaccttatataggacttttctagaggagtttgtaaattacctctaaaatcatgagttctataacgtagaggcactttgtactttaaaaactgcccagaaaaccttttactctagagacactttttatatattttcaacatattttgttaattcttatctcgtagaggcattttttcggcactttaaaatatgcctgatatgtataagaaattttcttcaggcattttaaactctgtataaacactgtttagggccactaaagggtaagaccctgagcaaacaagccaggcctaaggtcaaacctgtaacttgcctagcatatgtttggttgctacccttaggattctagcatgatgaatcttgcctgagcaagccatgctatctcgctccacctgcctgagtaaaatcaccgcattagtgaaaatgagaccacttcttcctcctcctcctcactgctagcctagggtttttgcagaggccatttcccatcgattcttccatcgctcccgcagcggtgaccaaggaacttgcagatccggtggccagttgtttctttttccagtaaaaatcctgcatttggtgatctgttagagcgtacgctactggagaagtgatctttgctgagtcatacaaaaatcacatagtcccggttcgagtaggaaccgagactaaagatattctttagtcccggttcaaaaacctaggggtactttttgatctttactcctagttgaatagctgttagaccctcaacaaactttagtcccggttggtgataccaaccgaggctaattgtctctctcctacagcatctgttctctctctcttccttatctcctcctcctcctcctgcaaaataagctgccatcaaaccgtcttgggacttattttgtatcggttttaatagttgagggatatgttgtatttggttttccggttgaaagacgaaaatcggattcgttgacaagttaagggacctcagatgaacttattccaaattaactgtaatatatatttggttggttgcttattttttagcctagtaattataaatttcagtattccctcttgcaccatggagttaaagaaaaatccgagccggctagcgaatcatcataagactatcagagttcatcatttattcaccacatatatatgtttccaagcaaaaggaaacactaattatataggtaccacacaagacacacaaggtagctatttcttagtggccagtcgcggggttcataggataactcagccagtagcaaacaccaccaatgccaatgggaatgtctacattgcaaaacgccgggaggctcgccgccacgcgtttcatgtcgcctctccggcagccagggaacacctcgtccatgggttgccctttagcgggtgcaccgagctccttgtacattccaaccaacatgtggctcagcgcggggcacctacagaagctgtcgtcgatggcggcgagctgccggcagcagtcttgccggacttgctcgtccacggcaccgccggcgcactggcgcttcgccagcgcccggcagcggggcagcgggtacatcgggtagccccgtccggcagcgcatagctgcccgggggtataaaccacctggccacggtgatccgccattgtcgtcgttgccacgagcatggagacaactaccgggagcaacaccgagaacactaccttgatgaaagccattttctttctattgttgttgcagaaaattttaattattctcaatcctcaatgagtggttttatatatgtagctactaagactaaagtgatagtgattcaagaatggacacaaaacttttagcatgagtgattagcttgtggttttgaatgaaatatttattgtgattcacagctaatctaggcatcatctggggaaaaaaaagttggctaaagtggattcatatggaccacactctttaattgtttaaacccattttcattcttccgtgcaagaaaataaatgcataaactactaacagacacatagttatggaaggcaacaaaaatattttgatctttatttccatggctttttgtatagtggtccaatttgataaacaaaaaaatgatacttcagaacaaatattgttaaaaagaatgctctgcaagctacaaagtatgcagtaaagaaagcggcaacactagattcagaaaattaaataacgtgtgcgttctctgtatatacgtgcctgatcaagcatatattggagttttctgaaaaacaaaattcatatataagatagctttgatgtgcacgttcagtctttcacctactttttttttttgttgtactgcaatcttgagaggcctaggcagttggataacagagatatattaacaaggcacggaattatatttatatggacataagaagcacgtacgcataatcactttgttgaaaaatgttgcaaattaaaggctagaaatattgtctgctataacttttcccgttgcaatttgcactactaggaaaagcattatcgcaagcggccgaaaagggtcttcgcaggcggggcggccgtccgcctgtaagccaacgactatgaagatcgccgatcttcgcaggcggggaggccgtccgcctgcgaagataattttcgcagacggacgttggctagtccggtccgcctgcgaaaataggaatcgtccgcttgcaaaaaagaaaacttccgcctgcgaagataggtagaaaatattgaaatttaaatataatttggccgtaaattacttttaaattatttattagaaattcttgcaggtacatatattggaatattatcaagcatttggtactgagaaatctacttatattgcataaatcaaaagtgttgccaaaatatatatattacaatattgttttacattgtcacttcaaataacgtcatctagttacattatggcatagcagtgttccactcccgaagatccttgaattcgtcacttgccgctagggcaccctctgggtcgaagaaatctcctttgacatgacagcactcatggtggatgaagtggcacagatcacgctgcacatttgtgatacctgtatcgtcaaagcttgttcgacattctaatcttggcaactgcatgcattgaaattaatcaatatattagtatcataaatatcaagagctgtctagtaaatagtatagagacttacatcctccgcgttagtcctgtaccgtccattaaccctaaggaattcgcacgcataatacccgcaaaggaccgttcctcgcggttgcttgtgacactgaaggacatatcatagaaaaaagtagttataatttgcaattagtgaaactattggaatacataaagtgagtggagtattaccggccaataggtacgtactagcagcttctcccgtgttcgtgtctgttctccacccttgaacttgtagtattggtatgcactgtatgaatgtcataccatttcagagtaaggaggatatttatttgtaatacatccatatacaaatgcaagagtcataataacttactactgtaagattgttagaaattctttgtattgcttgtgtttgtaatcgagaggatccaagactaccacggttccgtctttagggtggatgagtaaacagatataatgatcgctacatattaataacattataattagttagtaacagctaaaataagacatatgtgtacaagataaatgtaccgaacttacttaaaattataagcggccatgacgactctcttattttgaaagtgcaagaaggctcgtccaatgtactgtgcgacagtaatcaatttctccttgtgcaagcccttcttgtattctgctatctctttcggattcttgcccttcagctggtctgaccctggatctagcgtaacggtatgctgtgtttggcagatctgagttggatccaagaagccgatgggttcttttttcttcttagcatccatgtattgcatcctacataagaagtttgttagtagcaatcacatggagttgtattggacatattttttatctaattaattaaaattcgtactcacatgcaccaaacaccgacatagttgacgtccatcttatcccgacgatatatggcgtggagatctgagaaatctagccatacgtaaccttcttcgccgaaacaatctgccggtgatcgagctattatattgcccaagcctttcttgctggcctccatgtagaagttatgtaaccttctcatctcccatggtgcttctttcagtgcccattccggcaagagtgctttcccatgttcgtacttttccgggcaatcatcggttgcgaagtatgttggcccggctagcacagaagccttctgggggtcgtcatctctgagcttggcacgttccttaccccctctgaagacggttagcatgaacttctccttgttcgcatctttggacttggattcgtggctcctaatcactcgtggcacctcgggttctttcgcaggagaagggtcttcaaatatctctggctctgtaccatcccattccaatcctggtacttcatctttgactgacccgactgatgccacaaattccacctctggttctgccactgtaatctctatgggcacatccggcacttgaatctccatggctgtctccggcggtgcaatctccatggctgtctccggcggtgcagtctccatggctgtctccggcaatgcaatctccggtggcacttccggcactggattttccttaccaagttcaggatcatccgccttatcagtcaccttcctcttaggaggcctcggaggttttcccaaacccggtttaggcaacacaggtttttccccggcgtcggtgcccaatccaaagaatatgtcattcttatgccagagaattacaagatcgaccgcatccccaagtacggatataccatctgcagtcgggtagtcaatgtcgtaggactcaaacccttcgtggaccacttgtggctgcaccttggcatacgcatcgggtaagaactgttcattgtatgttctaccagggatagcaatggctgtagcggcctcaagagttttaccggagcgtccaatgggaacgtccaatctgcagggtgtattctccttgaggtcatcgaaggggtaatctggctcagtttctttggtttcggggcgaagcaaaatcatgtgcttcgaccgtagaaatcatggacgaacggtcgacgacgagcttcggtcgtggacaacgaaggaagggcccgcgacgaggttcggccatggacgacgaacggcctacgacgaggttcggccgtggacgacgaccggccgaagacgtcgttcgcggccgaggacgtattcgctcgtggacgacgatcggcagatgaagccgttcatccgcgaacgaaggggtggcaaacggtggtgaaggggccaacgacgtcggtgcccgtgcgcgcggtgaaggggccgacggcggtgcaggagccgatggcggaggagagcgagctcgacggtggcggtggatgagccggcagcggtggatgagctcgacggtggcggtggcggtggatgagccggcgacggggctgcctcggtggagcgtggtggacgacgacggtcggctgcggcggaggacgacggtcggagagcgaaggtcgcaggcggggcggcggcggaggacggcgaaggcgtgcggcggtgaaaaatttcggcagcctgacggcgccaaattttttagggttcccgcctggacttagaaattttggcgccgcgggcttgcccttatatagggcaaagatcttcgcaagcgggcggtccgcctgcgaagatcttttcaacaaactagtaattgcacataaaaatatttacacttttcaaatattactaactttaaatttttttaactaaattttcacaattcaaatggtaattgcacataaaaattagtacttagaaattaatatgcaaaatgttgagtacaattgttcgtcaatttgcgatacgatcacacatacgaccattacataactactaacttcttagatgtttatatgccactcaacaatcattaccctttaacatttttgcccacaccgtccgtgcgcatgtaaggcttcacggtcttctgagtagatgtctcgacattcttaatcttctgtacaaactgactataaagtggcatactatcatattggttgtaatcttcgacatcttcaaccccatccactcccaatatcttttgtttccctggtagcactatatctttcttcaaatttgaagggtctttcacataaaacacttgtgccacgcgattggcgagtacccaaggatcatccttgtgacccactctcgcaaggtcaacaacagtaagaccgaacttatcaacatttaccctgttcgggtattttacccactggcacttaaatatggggaattgcattgtgtgcccatagtcaatttcccatatttcttcaataaacccgaagtatgattgtttttcaccggcttcatcaattgcctccacacggacaccgctgttttgtgtacaggtcttattatctcgggctcttgtgctaaacgaatatccattaatgtcatatccctgccaagaatttactgtagttgatggaccacaagccaaccgcttcatagttatttcatcggtagtttctccctcaggtaagtctaggtctcgcaaccaatctatgaagagacgcttgtgttctttcattatccactcggtggagcgacccttattgttagctcgtattagttcgatatgttgatcgatgtacggctcgacgatagcaaactgatgaagcacgctgaagtgagcttcttggaatgatttgtgatcatgggtgacgaatctcttctttcctatcgttcccctgccactcaatctgccctcgtgttggggcacaggtactccaattgcatatccatccttgagataatcgatacagcactcgacaacctcttcagtactataatcctcaaccattgatccctctagatgtgcacgatttcggacgtaacccttcagaaccgccatgtaacgctcgtatgaccacatttgatggaggtacaatgggccaagcgcaaccatctgcggcacaatgtgaacaatgaggtgctccatcatatcaaaaaatgacggagggaaacacatctcaagttggcactgggtctcatgtgcgaatgtacggagatttcctaactcttcgagactaatgaccttctgtgacactgcgttgaaaaagtagcacaaccttgtgatagcaacctttaaatgctccggttttatggctcttattgcaattgcaagaaacacggtgagcaagacatggcagtcgtgtgaattataaccagataccgacaaatctttcattgaaactagtcgactgatgtttgatgagaaacctatgggcagtctgacattacggagtgagttgcaaaatgacttcttctccttaggtgtcagtgtgaaacaggctggtggaagatatactttgccattcttttctccttcttgagggtgtaactcttccctgattcccatctcgactaggtccatcgttgattgcagaccatctttagtcttcttcggcatgtccaacaatgttccaactatgttgtcaaacacattcttctctagatgcatgacgtctatggcatgctgaacctccagatctttccagtacgggaggtacttaaaaaatatggaatgcttcttgaatgggggagggagtttatcatctggcttcgaactgtcatcttgcttcttactatcccctcccttcgtattcttctcgggtttcttgcgctttgtcccctttgatggtttcttagtcatttttccaaactcgcaaacaattttctctatcattgcacacacattttctcccgatgtaggttttggtgcaggatcagtctcttcagtaccatcgaactccgccttcatcttacggtacttgtgatttgtgcgtaggaaccgccggtgccgcatgtacacaagcttgttggaacccgggagatacctataggacgttccattcaagcagatcacacatcctgttttacctttaatttgacctgaaactaaaaacattgctggataatcgttaatggtcacgaagatgattgccttcactgtgaagtattcccttaagtactcgtcccacactttcaatccctctttccataaatcggccatatcttccaacaatggt

SEQ ID NO: 7391 - DNA, 964 bp, Oryza sativa
  unsure (1)..(964): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcggccatatcttccaacaatggtccaagaaatacgtctatatcaataccaggctaacggggtccctgtatgaggatacagagtagtacgtattttcgcttttgacaaagccaggtaggaagattatacatggtgagaagcactggccaagtactatgtgaactgctcatgtctccaaaaggattaactccatcagtactcagggcaaatctaatgttccgtgggtctttagcaaactctctatactgcgcatcaaaggttctccattgacgagcatctgccgggtgtcgaatcatcccatccttcttgcgcccttcttcatgccagtgcattagttccgcatctcgcgggtttgagtatattcgtgtaatgcggtctttcacaggaaggtaccacatcacaagctgcgggatttttctctgtcgtccctcagttgcttcagagggttctaggctagtattgctattcgacttgtaccagcttgcaccgcatgttggacattcatccaaagaagcgtactctttcctatacagtatgcagtgatttacgcacgcatgaatcttttccacaccaagtgaaagggggcatatgagtctctttgcttgatatgtgctgg

SEQ ID NO: 7392 - DNA, 105 bp, Oryza sativa
aacaaaaaaaaaaaaaaaaaaaaaaagaaaaaaaaaaaaaaaaaaaaaaaaaacgaagaaaaaaaaaaaaaaaaaagaaaaaaaaaaaaaaaaaaaaaaaaaaaa

SEQ ID NO: 7393 - DNA, 695 bp, Oryza sativa
  unsure (1)..(695): unsure at all n locations
nnnnnnnnnnnnnnnnnnnnnnnnnnnnnnnnnnnnccacaacaacggcaacaaaaacatcaccatccactggtccgttgccccacctgctgcagagaagaagagcattatatatcgatccttggctcgaaattaaacttacgatgtacgttctggatgattttactgtggcgcaggcacggtgtggaccagcctcggaacccgtggtctgacgggccggagttcatcacacagtgcccgatccggccgggcggcaacttcacctaccaggtgatcctgttcgaggaggaaggcacgctatggtggcacgctcacagcgacttcgaccgcgcaaccgtccacggcgccatcgtcatccaccccaagcgcggcaccaccttcctcttcaggaagctagacaaggagatacccgtcatcctcggtaatcaattttgtttaacaatgttagttccatcctgcaatgcgatgcgatgcaatgcttcgtaagtacgtgttttgatctgaaccatccgttaatcgtttatgatgatatgatgttgtgcatgtgagtggtggaatgacgacgttgagcacgtgctcgacaggcgaagcgcatcggcggagacgtggagccgtccgacacgaacaacattaacgggccagcccgggacatgttccccctttggttcagggacgacacgttcaaggtgggcgtg

SEQ ID NO: 7394 - DNA, 931 bp, Oryza sativa
  unsure (1)..(931): unsure at all n locations
cacaaagacacatgtatcgtaagatggctagattgttcgataatacagtggagaatgacactgccccagcagcacgaggtggtacatacgtgtatgagataacaaagaagattaaggttgtatatggaaagggaaagaagaagccagtaaagaggaagaaagctgatggtgacaaagatactgcgtcgcctttcaagaagcactcaattttcttcaaatacttagattactggaaggacctagagattcgacatgcaattcatgctatgcacctcgagaagaacgtgtttgatagcaccattggcacattgctggacatcccgagtaagacgaaggatggattgaagtcacgtaacgaccttgtagatttggccatacggcatgaccttcacccagtagtgctgccaaatgggaagaccgagattcctcctgcttgttactcgttgacacttgaagagaaaaaaaccttctgtaaatgtttacaaggggttagagtgcctactggtttcgcatcgaacatcaggaagctagtatcagtgaaggatttgaccatttctgggatacaatgcacatgactgccataggttgttaacggtattcctaccaattgctataagggcagtcaaaccagtccataccaaggtggttataacaaagttgtgctactttttcaatcgaatttcgcagaaggtatttgatcctctagaattaggtccccttcagacatttgccgtcgagaccgtatgccagcttgagatgtatttccgaccatcatatttagatatgatggagcatttgatcgttcacatcgtccctcatattattgaacttggttccttatacttacatcagatgtgggcctatgagcgttacatgtcgatcctcaaaggctnnnnnnnnnnnnnnnnnnnnnnnnnnnnnnnnnnnnnnn

SEQ ID NO: 7395 - DNA, 737 bp, Oryza sativa
aaatgaacaggatgtgccttctgtattctcatcaagtgcagccaaaagtgcaggacaacattgtgacgttcccaaacaagaggactgttctacgaagttctcttctgcagcgaatagagatgcaaagcccatggtgaatggaggacaacatgatgaacaaatgaaaaacagtgccagtgtcagagcaggtggtgaggggacagttaaccatacagagtcaatcagaaaagggggacttgaattttcaacactgcatgtatcttctgcagcaaatgttggtagtaaggcagggggaaagatgacatcgtgccctactccagatgttgctggtagacaaaaccctggtaatagggtaaatacatcagcagagacaggtgtgatgaatattcctaatccacggagatcggctaggaggaaggaaaatgctgatgccagcatcatccaggatacgcctagcaaaaagaggcgaaccatattagattggttttcaaatcctgactcaagtcgtaagaaagtggctgatgataatgttgtccgtgctgatggacaagcttgtgaacctcatgtctccagcgaagcacacaaccaccagaaaggaactactagcaatgaaggaaaccaggaaaaaaggaaagatgttgcacatgatacaaatgctcagaagaaatctggcattcctgggaacttttcctatcctgacccagaattttttgacttcgataggtgcagggatgtta

SEQ ID NO: 7396 - DNA, 635 bp, Oryza sativa
ctctcgtagctgaaacagttgaacaggcttttatttttgtcatagttgaacgataagtagggtttccaaaccgccggggccggggttactgtgccccggcggtaagcacggttaccgcgcggtaaccgtgaaaaaccgtacaaaaccatgtaaaatttataaaaaattcaaattatttttaaaatttatttgaatttaaggaggttaccgcggtatttatattaccgtacctccgcggtaagctcggtaactgcggtaaccgcgcggttaccggcggtaagggaaaccctggttacaactcttgcaaacagacctacctaaaacataaacaaagacaataaaataataatttacatttaaaacttttataattgtgtttattattaaatttgagttacaatgaggccctaatacttaaacccttttacgtacatgggacatgtgaactgatatgtctcatgtgcgacttctctttacggttacgcttatagaatacatatgatggtattcagttcgtcagttttttttattgagttcagctcatcgctactttttttctcagcatagtagtgcaagagttacttgaaaacttctaccaaactcttgctaagattagtaagggcctttacaatgcg

SEQ ID NO: 7397 - DNA, 1503 bp, Oryza sativa
cgataggcagtcattttcaaggttctaaaactcagcagctagtattcattcaatcacctcactgtggaatgcatatacaggaaccagccttgtacttggcattatactcaattttcaatttaaagtttgaatttatacatgatgtttatatggtatcagaacaaaaaaaaaatgttgcatcttttctatttatgtaggcttcaaaagctatccatagtaaaaaaacgcaagctgccaggtagaatgatcaaaagggggaatcacgacaataacgacatgaataataggagtcaatcatgtaattctaaatcagcgagtagaaataggactagtttgcatcaacagttcataacgacatgttaaatcagaatgtgtgatcagaaatcagcaagacagatcaaaacctgacaaaagttgattgcaagttttttgtgccacaaacttgttaactgacctggaacgcactaactacataaattaccgaacaaatggaccagttaaacctgttagcatactcgttttgcaatatactcctaaggaacaatcactcaatgaatcatccaaatctatcaacataccttttcaaaagaaaacatatcaattcgtgagttgaattaaaaaaaaaaaaactcgactggcgggggaatgacttccccatggcttttcattaagaagaagcctcaaccaaaccggtcgagaaaagccacgaaccctggccccccacacgcggactcaccccctatggatcagtccgtaacctgtgctttgaggcccctgctccctatacgagggcccgccataggtcaattcttaacacgtgtttttatgagaggccagtgagtgactttttttaactaggcctgaaattcgcttcatggggagtgaaacccaggacctacacgtgctacttgagcattattcattaggctacaggtccttccgtgagttgaataaaaaaaaactgtggaaggcatatgatgcaagtactcatttaatcaaaacattggatagctttctagaatattgatgttgtttctgtttattttatgtggtactgagaatttaatagttagtcaaagattaattgtgtcatgtgctctctttgggacagaataaatgcctccgctccagataacttgtttatatctagtcttgacatggctttaggtttcaaaccatggttatgctatgaatagcatgcgtacatggactccacttggagaacaaatattccatgttctaggcaacatatgctatgtggtcactcttttggatatgcaactgtcattagtgtgtgtattaaaattaacgtgaaatgtacagatttcaacttcaaattcactatcccctccgtcacataatataaggcatccaagaattcaaactttgtcccaaaatatctgcttcctccactcaaccacctctcacttaatttccacccaatctaacccccaaacacctttctgctcccccccccccccaacagataccccctcatttaat

SEQ ID NO: 7398 - DNA, 1446 bp, Oryza sativa
  unsure (1)..(1446): unsure at all n locations
tgatgaatcccctaatgattttgatcaaaatcattaagttaaggtagatacacatcttgtcatatgatcaaatggtttcgccaaaaatcaataatcagacaacaaaatgtgcgaactcgatattttacacgactctctttaccaattctgccccgaattacacttaaaacgactcaacagcttaacgttggcttgccacgccttacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatatccgtgagcaaaaacggcttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatggattctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatctctcagggtcgtgctcgtgcttgcccgtagacaaccgtgccatgccagcacaacccacaggccagtgnnnnnnnnnnnnnnnnnnnnnnnnnnnnnnnnnnnnnnnnnnnnnnnnnnnnnnnnn

SEQ ID NO: 7399 - DNA, 725 bp, Oryza sativa
gagtgcaccaacttttatatattatgaagaatacttttaatactatgaatagttacttctattttctaaagagttacttcctatataaaataaattacttttatcgaaaacaataatctatatatatgtatacacatatggtttaccttggataaaaaagtcatgtatttacttgtgtcatggttatggatgctacatacctaataatagttgactaaactcggcatggcccatcacataccatgtcttatacggaatcatacctcgtatatagaaggagttccggataaggaaagacaaatagagttctatatagaaatgacaaggactacgtggattgtatccatattggtctccctaattctacttggacaaagggacatctatgagtataaatacaagaccccctagaaggataggggacaagccacaagatcaacaagacacaatatatacacaagccaacacacatcgccagatctcaacatcagagattagcctagacatacctcatctggtgcctacggaggccgccaaaaaggatctagcaccatctctgatctcgatgagttcatattcgaggaggaaaattaccctgtcgttgactacgagttggttatccatgccgccaagtcgacgacaactagataggttatcccgaattatgtacttgtgtgatccatatgagtaaggagcaacaccggtttcggccaataagagtaggg

SEQ ID NO: 7400 - DNA, 54728 bp, Oryza sativa
  unsure (1)..(54728): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncataatgttgataacgtctccttgcttccataagcgtgctggtcgacgaacaatatcaaagcgtgattgcagaacaccaaatgcacactcgacatctttcctcaccccttcttgcctcaacgaaaatgttttatcttccgctgattgaggggcattaactgtcttcacgaatactgcccattctggatatattttatcggcaagatagtaacccatgtcatattgatttccaattacagtatagtgtaccgtaggagattccccttttattgcttgaattaacagtggtgacttgtttaaaacgttaatgtcattctgagaccccgcggtaccaaagaaagcatgccatatacgaagattttttgatgccactgcttcaaggatcatagtaggaacaccttgtttaccacttgtaaactgacccgcccaacctttcggacaattcttccatggccaatgcatgtaatcgatgcttcccatgcacccaggaaaaccacgagcctcattttcttgtaagatttattcaagttcatcgcttcttggaggccgtagatattcgtcaccaaatgtttcaatcacaccttcagcgaattttcccaaaatctccaaacaagtgcttgcagctattttcaagacctcatcaagttgatcagccgaggttccataagctaacatcctgatggccgctgtacacttttgaagtggtgaatgactatttctaccaatagcatcgactctttgggtgaaataaggggaccaatcgctaagtgcatgcacgatacgcaggaacaatggcttattcatcctaaatctcctacggaacatgtcatcggtgtagataggatttgcggaaaaataattagcagatttgcggaaaaataattagcaacaagatcatcatgaccttgttctcgattccttggtatgtacctccttggtccactctgtcgacgtcggcgatgtacagtcgatgcttcgatgcttctctgtccatgtcggccttgaatccctctgctactatttcttcaaaaatatcatcctctacgattaagtcttccacggtgaacacctcttcaaactcttcggcatcttcgacttcatcttcttcgtgcggctccattcaaagagttacgatacaccttgtttgatgcaagtgtttggatggtggagtagtgtacagaggagcgcacagaacaacgatgttttatagaataaaaaaatatgaccattcatatttacaaaaactgatcggcaccactaaactgatcaactactagcattcaagctacattcaaattcagcatttacatttacattcaagtggcacattcaagctactaaaaagatcaacgtcgcactacagcggctaaactgatcaactgatcaactccagcaccacttaaaagatgaccattcacatttacattcaagttcagcattgaatttcagaaaactgatcaactccggcaccactaaaaagatgaccattccattcacattcaagttcacacacacaattcagaaaatcatgcgcagtttcagttcacattcaagttcacaaagcacagtttcagttcacacacacagtttcagtttcagttcacactaaaaatatcatcctctgcgatcagtttcagttcacacacacagtgtcaagttcacaaagcactgtcattaccatttagaaaatcatgcgcagtttcacatttaattggatttcagaatttaattaccaggatacctgaaactgaaactaccaggataccataatttcagaatttacattatggcctatagagcaaaactgagtaagggagaactgaacatatatgggtactgaataagcagaaaactgaatttggctgaggttcatatatggctgggtactgagtaagggaaaacacggcaaaactaccagtatactgaacattgatactgaacatatatggctgaggttcatatatggctactgaatatgcagaaaactgaatttcagaaaaaaaaagcatgaatgagcagaaaactgaacatatatggctgaggttcatatatggctactacaagtgctaaatttaacaagtttgtcacagaatttcagaatttaacaagtttgtcacagaatactaaataagcagaaacttcatatcttcataccagaactggctgaggttcatatatggctactacaagtgctaaatttcagaactacaagtgctaaatttcagaactacacagataagaaataccttctcaaacagtttcaggaaaaagggccttcataagacacttcatcatcatagctcgctgtgccttttcctcatcggacattgaacttgtatcctgtgaaacgaggttgttataagtctccatcatctttgtctctttatcaagcttctttccttctttgtactcttgtgctgtaaggtgggcaatttttgtggcctctagcttctcagaagctatcttctcttgcctgtccaatagcttcatacgcttctcattgtttgcctcctaaaatttactgtatctatcaaatttgtctagctcaataggagaatcctttgagtgaccatcatcactactgctggaaccctttaacttgccatttttagcagctagagctgcctttttagctgccttctgaccaattggtcgttgtggcatctgatcacaagtgtcctcattttcctcagattctccttccagatggaatgctttccttttacgtgcattcttcaggttttcattatatgttttccactttggcacatctcggcaaattttccaaacctctgtcagcatataaggtccaaccacgtctttgcattctttgttgtcatccacatagaacttgtgtgctgcatcaagccacatttcagccgaatatccacttgtaaatactctacgagccttagcgtaagcacattcaaagaggtctgtccatttattaatcttgttccatctatccttgcattgcttcgcatttcttcttcgaagtggaggggtagttttgttgtacgtttcgacaacctcaccccaatattggacaccacccttatccgcaccacaggtaaagtcggttgaatgttctaaccaagcgctcatcactctaacatcctcgtccggagtccacatgatcctcttctcggttctaacactgtcattgccatgtaatatttccacttcgggcggtgaactaccattgtgtgcctgattcagaggactcatgtgaataactgcaccaaccaaatgagagttctgtgcttcatttccaaaatagctcatgaaaccaccaggtggacgtacatcttggtccctgcaggaaattgcaattaacatgaaattttccatggtccatctacaaataaaattcagatgcagtagtagtactattgtggctgtatttatgaagggttagaaggtaaaattagcttaaaatgatttcggcacagaagcttaacatgaaattagcttaaaatatgaaattagcttaaaatgatcagttgacacagaagcttgatgggtatttttactctttaagaacaactaacaaagagtacaatatgttggacacagaagcttgatgggctcatttttatgataatcatttatcagttgaatatctaacaaagagttcaatgaatcacttctggacattgttaaaatatggtataaaagggatccaggtacaacagtatgggatttacagattcacaatgcttaatatcaactacaaaattatctagattcacaatgcctaatatcaactacaaaatcagcaatgaaacaaggatttaccatgatccaggagatgagggatcaccgccggccgcatcaaaccaaggttgagacgatgcatggggaccaattgagctggtgaagtcacctccgacagaaccatcaatggagaaagccgggacggtcgtcgctgccgctactgacccgcgaccgtgtccgcgagaacggggcggcggtggtagcccgacagcgtgaccaaaagaaccccgaccgaatgagggagccgccgccgccgccccgacacctagggttcggcctggggccgtcgccgccgcatccaatgtcctcgatccattccttctccaagctgcgccgggcgtggacatcccgccgcaccaactccggcgagaataccagatggggggcgagcagatggcggccgcgcagatgggcgggcgaagaaatttggggcaagtcgcgagcagagcgcgggagaacagcgcgcgtggttgcctgggaaatttgtgggcgagcgcggccgcacgcgggatccgttcgcccgtcgcctggggatgacggcgctctacagcgcgtgggctcgcgtcgactccacctgggagaacgggatgaactcgtcgcgtcgggaggcgccgggctgcccgtctctgcgcgtgcacgggttttttttgcaaaatcaccaacacacagacggggcgaggagacgggttgtacatgccctaagtcataaagcctgcatgcagcccagctgacctgctgctgtacacgtggtagagagaaacgaccacggtcctcctgttcacaaggttttacacgaaaaactgtaaacagcgcacgattcctctctacacaatcaattaatgttaattacccttttcatatatacagaccatcgtccataatttaccttttttacacatgctaaactaccaaaatgggcatgcaaatatgcggactaattaatcatgacatcagcctcatttcaggttcacagcttgccatgcaaaacatgcagagttatatttattaacattaaagaatattcagtgaaaaaaacattactcaatctattgtactgtttgaactcatgacaattaaagattttttaaaaaaaatcaagacgtgtcttgttcattctggaggtgtagtaatatactccctccgttttttaatagatgacaccgttgactttttctcacatgtttgaccattcgtcttattcaaaaaatttatgcaaatgtataaattataaatcacacttaaagtattatgagtgataaaacaactcataacaaaataaattataattacgtaaattttttgaataagatgaatggtcaaacatatgagaaaaagtcaacggcgtcatctattaaaaacggaagtagtattaccatgtcaactggacacaaaatgaagaacatatacaccaatttgatcgcagtgaccaattctaacgactatatatcgatataatcgtatacaaatacaattgtatatatggaaatagagatatgagttgtataaaatctatatttaataaaaaatctagcctaaaaaatccgctatatttttatttttaatccctttgacgaattatacaaaagatgctctcaattcttttgtcgatctcacgccaagccacatatatgagttcaaagctgaagttaacacgataggtagcctcgtgctttttctgaggcgacaaatatcgtctccattggtctgtcagtaacaaaaaccctctaattaacaccctttcatcttgtactttaatttcacctcttcacacaaactgtatatgctgtcttttacttgacttgtagtgcaaccttccactgtcacacatgacgcctccatctgcaatggcatcttaattaatcatcagtaactccaatttccaaatagcacgtacgcatgcatgcgtccatgccatctccttcatctgctcgatcgatcactctcagatagattgattgattttactatctcgatcgagttggtcgccaattcgccatggccagcagcctcatcaacctcctcctcacggaggtggcggccatcgtcagcatcgtcctcctcgccctcctcgtcgtgctcagctcctaccgccgccgctccggccacccggcgctccgcctcttcgtctgggcggcctccacgctcttcctcccgctcgtctcctacgccgtctccgccgccgccaagtgggacgccgcgcgcgtcccgctcctcctcgcctggaccgtcttcctccagatgctgcgcaacaccatcgacaccgcccgctcgtcctcgtccacgatcggcaacggcagcggcagcagcaagttcaggccctccgtcgagcagctggcgaggatgggctgggtggcgttcctcattgtcagcagcgacggcaccgccgggagcccacagctcaccggggtgctcctgtggctgtgggtgctcagcctcgccaagctcgtccaccgcctcgttgccgccgagctcgccaagaactcgttcgccgtcggccttaacgcctacctcatctccgactacatgaagcagctgtacgggcaagaccaaggagaccacgacgtgcaagctcctccgttgttggtgatgggcgaggagaagctgcaaatcgaggcgaggccacaggggtaccgcattggccggacatcgccgccgccattgtgcgtcgacgccgggcatgtggtcaccatggaccggatatgccggctgttctcctccggcgatccactcgtcgcttctaacccgcagatcaaggacacatgcctctcgttcgccctgttcaagctgcagctccggcggttcgtcgggtgccccatcgccgaggcgggctctcgccgttcggtggcgttcgtgctcgacggcctcctcggcgagagccacgagcgggtgttccgggtgatcgagaccgagctgtccttcctcgccgacttcctctactccaagctcaccgtcttctacgcgagcgggtggtggttcccggtgctcaactcgatgctcgtgttcgccacgtgggtcagctgcctcgccgccggcggcgccatcgtgcacgacatgacgtgccacggcacgacgctcgccagcaactacgacaacctgagggagtacctgcagaaccacgacaccgtgttccacatcatcgtcggcctcgacgtgctcgtcaccgtctccttcatcgtcgccatcgtgttcacggaggggtgggagatcgctacctacgtccgctccgactggatcaaggtgtccgccatctgcgagtacgcgcgccggccgtcatggcgcaagtcgccatggactcgccgcaacgtcggccgagttctcccgctcaagccaatgcagcgctgggacgatcggttcgggcagacgtccatcctgcagctccgtccgtgctactgtggctgcgtctcccggcaggttgaccggatcgccaagtcgtcggccactgtgccggcggcggtgaagacggccgtcgtggacacgctaaggacgaaccaaggaaacctgggaaacggcgtgctctcgttgcagcggaacggcgtcgccgacaagctcgcctgggcgtgccaccacgccggcgacgagagaagcgtctccgagcagatcctggtatggcatgtggcgaccaggcttctcgagatcatgcgatcagaaggcgctcacgggagacacgacgacggagacggcgacggcggcggagacagcgacacggtggtcgtcgcgacacggctgtcgcggtactgcgcctacctggtggcgctgaagccggagctcctgccggaccacccggcctggacggaggagctgtacgagggcgtggtggaggaggtgtcgagggtgctcgcgcggttcgcaggggcggtggtgcggtacgagcgcgcggcgacgtgcctcggcgggagcacgaacgcgacgctgaggaaggcggccaagctcgggcggcagctggcggaggagctcggcggcgacgaggagttgccctggagggtgcttgccgatttctgggcggagctcgtcgtctacctcgcgccgtcggagaacgtcacggcgcattccaaggcgctccgccgtggcggcgagttcatcaccgtgctgtgggcgttgctcggccacgccggcattgttagccggccggacactgacgtctgactgacagtgtgagtgtggtttatggcgaacacatggttttctttccgcttttgtcattgtgtataccaaactgtcgacatgagatgtgtttgccaaactgtcgacaatttatttctgatttgcaatagtaaaacagtttccaatcctttacgaacaagaagcagaggttctttttatgaacaccgaatgatgttgcatgatcttctttaaaaaaaaaaatctataggcataaacatgaaggaattttgctagacatctccagccaggtggcttgaaaggcaaggccggaatctgtcatcacataagcaaaagcttctctggtcagaaaaccaggttgttgcacgctgcattgcgcagctgcaatgcaatcttgagacagaatcatgtgccgagtcgaaaagcaacgcaatgcaagctacctgttcagccagactaggtggctagcttttatcaccaggcagggggcatctttatctttcaggttgtctgtattgcctatatttttttttatacccaagtccctaattcaagggcaatgtttatctcttggtgcagaattctaatatctcagaagagctgggcttaccctttgatgtggatttgaggatatcagaagatactatgaggtatcaaattttgtagcataaattttgatagcttcacatacctcccaaaaatttgacaaagttggccctttcatcattgataaggacgttgagaaaatcctggactaggagaacagcacaatgaagcaagttgaatcggagatggatttaaatcttccgggtggatgtccacccgtttattgcatgcatgccaactaaatggttttgaaaaaaatttaaaaaatttgacaagatagattaatgcataatatataggcaataaataaaatgtaacgagtttacatatatttgcagaaaatttgtaattttgttaaaacttgtagaaaatgtttttgaacttgcatctttgtggaatgatatattccatgcttgtggatgctatagcaaactaggcagtgacccaaacaaaaataatcctctggtacttgtggaccttgttaggtcattcacagggcacatacgtaacgtgtgacaatgttggttcacatagacaaattgcttgcgtgtaggagagaggggagtggggaccgctccttcaccggcttcgcgtgaccatagttggtcactagaacctcccactcttgcagcagttctcgatcagaaaaagtggtcatctgcgcgtggagagagagagagagagagaatgggggaaacaaaagtgtctgactgaagagaaaagccggataggggtgcggaggtggtgaagtggcgacgagtctgaccccaacgaaggtgccctcgccggggacctcgtttgcccacgcctcccacctgcttcgatccgcgccggagaggggagaggagtaagggcgctgagcgaggaaaccggaggggagatgaaggggcgatggtgcctgaagcagtgaggggaggggcgtcatcggcttgatctgccccatccggccacgctgccagcgagctcgtcgcccgcaccaccaggtcctcctcgaccgccaccgctgcgtggatttggggtagccaaggaaggaggccacaaggggagagaaagagtggtggtggccggagcgggcgagggaggggcggttgtggtgggcggcggggtggctcgatcttccttgcattgccacgcggtcgtgccagcggggagctcctcaaccgccgccaagggaggaggccgaagggaagagagggaagggcggttcagtggtggtggctagagtggtgaaagggggagaggagagcgtcggtttcgaggaaagggagagtgagagagagaagggggaaggtggaggaaaaaaagggaaaactatttttgtggaccccacttgaggttacaacattgtgaaccttgtgtctttcaccattccttagcctacgagggatgtgaggtccggcaaacacatatgccacattgctatttctattgcccttattgatcattcagtacaagttgatgtagcaagatcagaaaatgctgtccaagcagatatggaggtagagtttcatcgtagcaagcagcggttcggatttttgaaatggggttcaacacttcaactgcttttagtaatatgcttagcttgtcgttccacctttaataaaaaaaaagcttgttgttccacctggatctggaattttgcatcaggtgaaccttgaatatctgggcagacttgtgtttaacaatggtggtgggatcctttgccctgattagcagaattgccgtacttactttgatacaggatttaaaaacttcatatgatattacatgttaaaactttgtttggttaatctcactaacaaggggattggaggagaattaattccacacctatccccctcaatttcctttgatcccttcttcatgggattaaccgcacaagacttaacatgggtatatggctgcattactatatattaagacgatatataataattttgtactttgacttttaacaataaccgtaggtagacttttagctgatcttaataatcatgaaaagagattgaaaaattaaaattgcccaaaaagctcttagatttattctagaatcaaataatacatttatgtaactacccacttttatttgcttcaaacaaaagctattcttgttactctcttcttttaccttttaactctaaggagtacatatgagaaccgatagctggccaaacaggtggcctggcccaatgcggcatgagtccactggcaacacaacccgctttagtacaattcgttaggcacgacacctgtagcaggctatgctatgtcggcctatgtgccaaggccacggcccaagaatagctcaagaagacaccgtgttgtgctgggccatcacagcacgactactgttacggctcgtgggtcaatgacaggcccaactgtacatatgacctatggaaattgaaatttgaggtggaaaaataaaaagcgaaaaagaaatagtgaaggtggaaaaataggaaaagtagtaaaaaggatggaaaataatgagtaaacatatggaggaaatgggaaaaggtaagggaaaataggaaaaatatgactaataaaaataggaaaaaatggaaaattaggaaatatatacagaaaaaatagatgggccagacaggtcgtgctcgtgcttgcccgtagacaaccgtgccatgccagcacaacccacaggccagtgtgccgtgccatgtcgtgtcgtgggctggtacaatacagtcatactctagtcatactctggcctagcttggcatgacccatttggccagttatatgttattgataagtgtggtgatggaagtgaaccattatcttcttttaaagaggtataaatcgcgttgtagaaatggacttacgcacaaactatgacagatggccttggccggtgtttctgatgggtgagttgatggtataaaggcagaagctgcaatgcttggccatgggcagccaatgagcatagtattgtcagggcttgtcggtttcaagttagagtgacaaggaagctgaggaatacagatttggtcctagcagggacatttaactttttgccactcgcagtatataacctgtgggttctcatgtgtctataatacgtgggatcaatgacaaatctttaattgcgacttgtaagagtggcaaataattaattattcctaactcgggaatgtttacttcaggctgataggaaacatggtgttttgtcggttaatttgctgaattttacgggggaggcatgagtgaattatcactgcaggttgatagggctacaatcgcaaacatgggattcgaatccaattgtaatgctgggagctgctatagttgccaaaatggcttgcgaattaggccttgaggtcaagccatggattaagacaagtctcacaccaggttctggacttgtgaagaactatggttgtactacttgcttaggaaattctggagaacttgatatgtatctgctgcaattgataacaatgatattagagtaaattttataaaactacatgtactttacacgatcttatcataaaactacagatttagtatctttgtttattacaaaactacagatactttacacaatatatcacaaaactacagatttaagaacttgtttcacaaaactatatatttagtgtcttcatttattacaaaatacagagttagtgttttcatttatcacagaactacacatttagtatcttcatttatcacaaaactatagatttagtgtctccattatcacaaaactataggtttcaacaatgctaaaatatgtagtttgtgataataaagacattaaacctttagttttgtgataaatgaagatattaaatctatagttttataaaacaagtttttaaatatgtagttttgtgacaaattgtacaaaccaggaattgaagaggagtgtgcacatgtgtacgtttgtactatatttctaaaaagaagaaatatgccaggttttttacgtaatgtcgtgatatcttttgtatgggggtgtataatcgggcaatcactcgtctggaaaaatgttttatttatcagtgtgaaacacgcaatcctcgctccgatgatgctccccaagtgcatctgaaatcctataatatttaagtttttcatcggtgcctttctatttatcacaaatactgtagtaatttgaggacctatttgtccattaaacagcaaacaattaattacaggtgctccaagcaaacaacttttaaccccaaatctaatgcattgtcactatacatgtacacttgtgctacaataaagtcaaagcgaaaaccacatatataaatctattatgtacaaaaacatgatacttgagtactattgtactcaaccaaagtttatcttatgagcgctggagaaatgtttagccgccctgaccatctcgccagccgcatcataccctgcgcggccaccggcggagccagagctcgccaccacctttgagcccaatcgcgcgaaccaagacgccacggccaaccacaaactggagccggatttcctcttcttgcctcccatgactaaacagttactacaaaaacgactgtgtgatcgatgaactgaaccacaaactggagccggatttcctctgctagtttgtttcaactttgatgagctactgtgtcgttgtgtttcttgtgctgttctgttggaagagtttgcagctggaggcttttatatagcattggaggcttggagcagaggtatgcatatgctgggacctgggtcctataagctttcttggcagccaagctgcaaatgaggagagagagtcagagagtccacggttgtgccgtgttctgcattttgtgccgtgttgtgcattgatgtcactctcgcttgacctgaaacatggtcatggtcattgtattcctcatcagtttaaatttaacccaaagcaggaaacgtgtactttgaattttgtgtattaccccctgtacatcttgacataagtcgacgttttttttttccttgtctttattgatacaatcatatatacaagctgtttttattttaatcttctggcaacatgctaatcatggcatgcttaggaatgttcctggatagctgcttttgaagaagaagctatttatcagacagtgatagggaagttagttacatggtcgtttcatcaccgtggcaccttcttcagagaaactcaccgattcctatagagctcacatgctttgaccttttctttttcatattgtaaaccttacatcgatttcttagcatgcttgatttgtgacgaagctacactactagtgtggttttttttttgtttgtttgcattggtcggacaagacagaaacgtaagaggagactgcttagagcactaacaatagtagacactatatgtgtatcatgtctatactattaatttaatgacatagatactactgtacaaactatttgcccaatacaacatttcttacgtgtgggaccaaataatacaaactatttgcccaatacaacatttctacgagtgggaccaaataataagatcttcccagtacatcatttctacccagacaagaaatacgagtctctaattatggaccaagactattcactacgccggaccaggtcatctctgacgggcccaaaccctcacctttaacgggtttggtcttggtcagtgattagtggtcactgatgacaaaatcacctgtgacggatgaaacacccgtcacagataacccatctctgaccggtatataagtcatctctgatgggttaaaacttgtcacccgtcacagatgagtcatttgataatatgagtcacagataagtcatttgataataagatgagtagttgattaaaaagtcaacgacgtcatacattaaaatatggagggagtataacaatattaatagcttgtcttaattatgacatattgtatcttattaatttctatatgtaacgcatgaaatcccaattgtatcttgattgttgcctaatcaaatccccattgattctatttatagtaggtaatctgaataataaattcaaaatttgcagagaaaaaatgaatggtaattgaaattcaaaattggtgcaaaatcatcataggtggctaggctaagtaatctaccaacgaaaatgatttctcatagataattggttgcccgctagcaaaaagatccattttcaccggcctatgttatctagtcacaagcggcgcggctggcctcctatgagaaaatgttcttgttgcccgcgttatgccaatttataatagtgagcaccatccacttccccttccctttcctgtgaagggatgaccatgctcactagatctagcagccacggcctccctggtggagaatttgatcgctcggagccgagaatgaacgcaaggggctagcatatatataggaggctcctcgttaatgaagatgtcgaccacactggtggatttgaggacgtgccaacctccgcagccacaagcccgctcctcgatctaccccttcctccctccccccccccccaaccaccactctctctatatgaaacgtatagttctttttttagaagcttagggcggccatagtaatcggtggatccaggccatggcagctgacggacccgagggtgaggaggcaacagtttctaccgatggatctgttggctcgatgtgatctttgttgaattcaagttaatatacgatttgttgatttatggtgaattattttgttgtgagttgatgcatagttgtggataatttgttggcttgttatgaagatttgttgatacatagtagtggaggattatttgagttgatgtatatatagttgtaggttgcgttgtacgatgatgttgcttatctgttgaattgagtttaaatttaatgattctagttggtgtgtaatagctgttgcaagagaaaatttgctgaggcttgagcccatggctgtactcagtttagaatgcattttctcaggcagggtcagcggcagcgcaatagttcctgggtaaacaaaatcgtttgccataagtcaatatttcggatttaagagcccaattcacatcttcacctggctctttctattttattcgaagtagaaacttcaggacctatttgaccggcccttaatcgaacacttctttttacaaattaacaacgaccttatgaatcctaaatatatacacatatgtgtgctacagtaattgaacagataataattctattatgtacaaagtacaaacatgataacatgcaccattaacagttaaccaaagtttatcttgtgagaactggagaaatgtttagccgccccaaccatcccgccggccgcatcatacccggcgtggccgcccgagccggagcccgcggccgccgcctttgaggcgcccaagcacgcgaaccaagacgccgacgaccagaaaccagagccggatttcttcttgcctcccatggctaataatcaaattaacacgaggggaattaacaaagctagctcaactagtacgtaagtgacagtgtgtatgtcttattaatgctcgcttaaatagcttagctacttgatgagcaccgatcgaactgactacggaatgtttttcttttgctgaaggagttgcagttactggaggctttatataggatgcatgcgagcagctgaggtaattaagctggaagctgcacacttgcttcgtgcttaattacttgcttggcgaccaagctgcaagtgagagaatcagagagagacctgcagtgttctgacttctgactctgaggatcgagagatgatcttgaattataatgtcgctatcacttgacctgaaacttggtcatggtcagttaatactcggtatatatttagtttcacttaaatcaggaaacgtgtacaattcaaattatgcactcttgtgcacaccttggcatcgatggacacgttcgaggcaagagcttgctgaccaagacatgcagacatgcatgcactaggaatggaccaggatagctatctgctgcttgttcaagaagaggagctgtagtgctgtactaatataattaacgacgatatcaaagagtgatagtactgtgataggaacgttagttgtttccttgattttaaaagcatatataaataggcaggcatcagcatcaccgtggcagcttcttcagagaaactcacccgattgataaaatgtttcacatgcttaactgcggttttcttggtatgatgacactacgtatattatatatatatgtgatagctagctaggtagatagtcaaagagaatacagtttatttgcatcatatccactccagtctggctagccaaacgccactagaaagcacagataatttgaagtcgttatatggtcgctcattaaacggaggtagtataagaaatggaaacgaacccatgcatggaagaagtcaaaataaagcgtggtttactattgacttagtattagcaaggagagccagttaaccacgacagcttttccatgatgggcagctctccgaaactttcctacacctgagagaattaagtaactttagcccaatcattttatttgcttcgtacactgacaacacatattgtaaagtttttcagaaacaagcagtaaaataggatacttacgtacctctgacccaaaatagttgtcattttgagtttttctttgtaagatttgaccattcctcttattcaaaaacttatggaattattatttatattttgtgacttgctttattatcaaaagtactttaatatgacttatcctatttttatatttgcactaattttttaaataaaatgaatggtcaaacgttgcaagtaaaaagtcaaagcgaccactaatttgggacatagatagtagaaattaccaaacgatcgtgcttcctaaactgatcagttgattggtgttcatgcccagaataattacgagtactaagaatatgacattcgattaaatttgagaatatacatgacttggacgggtgataggacgatgatgggatagtgttttccccgatgcaagtagccatgtccggtcaccaaggacggaacatgttgatgtatattcaagcaccctacgtacttccacttgctaggcatgggatggcttatcttagtaccgagtgaagttgtggttatctatgcccattcgtcattcgtgtgggatgtttcccttggaggtacccatgcgtgcataggttggtagggggtatctcccacgatggtaatcctaacttagtcacacgcacatgcccacggctaagttatcgagggcctatgcgtggtttaggtggttggggctgagcttgagaaaggatatgttatgagcttgaatcacttgaaggtcacacctatgtgcgtgtgaagcatttgatcgagtaagactattcgaatagccgtgttcatggttacaggatgatcacttgatgtattagtcagtttatgttagcatcaaacctgggataaatggtgggtattagtcacggttaatcttggtggataagtggctaatggttgcttgagcaagggtggtccatggacgatgtttagagcctgttgtgctcatttgttgttcacattcagatttatatacttgttgtacataaatttcagattgtgttattttgcaaattcttatagttttaacttattacttgctcaacaaaacttgctttgtgcaaaatctgaacccttatggtcctttgatatacaagcttatatattcctttgtaatattatatattgtgtaagtcttgcggagtactatttgtacccatgttgctatttttaggtaaggataccggtgactttgatgtgtcctactactatccagccaagggtggcgagggtagtgagtagctgagttggttgccttgtgggctattggctgaccatgggttgagacttctgccactatatttgtgatgtatgaagggcttatgaaccctattgtgtaatatttaccttgttgtgtgtttaattttattaaatacttgttatgctatcaattgcttgcagacgaaagtgccaggctagtcgctttttcctgggaactagctaagcatgagtaagtgttttgagtaattgagatgatcgtggaatatagcgtttgaataagtcctttgagatatataacacatttggtcgccaccttcgaatggtttgatggggcatatctttggtcgaaatcaactaacaagctattccatcgaatatctctcttactcactactcgatatcgtggttaatatattgaaaggtgtcaactacgatcatggatacactgaggatgagtgactatttatgcgagtatggatcccactaatccaaatgcgtgtggtggtcacgttggacactagactgagagaagttgatttgctctctctctctctctctctgaaaagaaacattgacatatatgtttcttttttttagtttctggcctaacattggaaggagtctttcttggaagcaaataagtttatgataaaaaaatatttatcatcttttttccttaaatccttccatatgtaaacttgatttagcatctatatctctcatacatcattactcacttttcatcaaattgtggagcaaaactatctttggaagcatttatcctatatcactttcttttctccataaatgttgcaaaatggttgattccgtcgctctcacacacaaatagttgtttttcaatagttcttgtagtctaactttgggagttactccattggcagttggcacactgtttctgcaaattttgggcatgggaaatctttttaaaggtttgcttttaatggagaaactgatcatcccccctcccccctctctttctgccttttatgtcgccctatatataagggtaccaattaattccaacttttttattttatgtagttgcaattttgttttagtactgaagtgcaattaggtttataaatttttatctataagaaattttattggccctatatttcacacttttccccataaattatgaaaagggtcatttggcctatatcggtttcatatatgttcacttatcatacaagttggcaataagagaaatttcatgatctttacttaatgataccatattttttaacataaaatttggtatctctgttcttgaagtgttgatagacaccatttttacaccaaaaatgttacctacgcatggatcatatataaaatcactcttggaagaatgttttctttgaagcattgttttttttaaaaaaaaagatatgtgatttgtcctacatcacaataagggagatttgatagaaggaaataaaatagacgcccctaattaaatgagttatggttgggactgagaggtgtttggagggaaaaatagcgctactctatttttttagacaaatttaaatagtattagggactgagggagtagtttacttgctccctctgaaaaaaacacatatgtttctcattttttaagtttctggatcaactttggaaggaggctttctttgggtgcaaataagtttattgataaaaaaatatttatcctatactgcttacttttttctataaatccttccatacataaagtagatttagcatctatctgtttcatacgttactcacttcagttccatcaaattgtggagctaaattatctttggaagcatttatcctatatcactttcttttctccatatatcttgcaaaatggttggatttatttttctctctcacacacagacagttacttttccaataattataatagtctaactttggaagttagtatctttagcagcactttacttcattggcacacttactgtttccataaattttgggcatgggagatcttttcaaaggtttacttttaatggagaaactgatcacttacccactttttctcccttccatgtcgttttatgtagtagcccattttacagatttgaaatttatatagtcacaatttagttttagtactgatgtgcaataaggtttataactttttgtctataagaaattttgctcgtctatatttcactcttttcttcataaatcatgaaaaaggtcatttggcatatatctctttcatacatgttcacttttcatacaagtttgcaatacgagaaattttacgatctttacttagaggtggcatattttctaacgtaaagtttggtacctttgtacttgaggttctgacagacaccatttttacactaaaaatggtacttactcatggatcattatataaagagtgaagtatattagcggtctctaaacttctgccggtgtatcatctaggtccccgaacttctaaaatacatttttaggtccctgaacttgccatgtgcgttatataggtccaaacggattctaacccactcgatgcgctgacgtggcaatgccacagtgacacctacgtgttagtggaatccacatgtcaagcatatatacaaaataaaattaaaaaccatattttctcctattaggtagacagaaaaaatataaaaattctaaggtagagaggagaaaatatgtttttctacttatatttttttctatgtggctgacacgtgtgtccaactaacacgtatgaactatcatggcatgccacatcagcgcatggaaggggttggagctcgtttggactcatatgacactccaaaacaagttcgagaatccgaaaatgcattttgagagtttcgggatctagatgacacacccacataagtttaaggaccgctcgtgcacttcactcttatataaaatcactcttggaagaattttttttaagcattgtttttttacagaagatatatgatttctcctacatcacaataagggagatggagggtaagaaaacaaaatagatgccccttaaatgagttatggttgagagtgaaagttggttggagggaaaaatagtactgctctcttttttggacaaatttgaatagtagaagtgcacttatcagggacggagggagtagttgacttcgctctctctcaatccctctaaaaaaaccacacacaagttctctctttttttaagtaaactagaaaaatgcccgtgcgttgcaacgggtgaaggctattttaatcatattattgttatatggtttaggtaaggtgaaattcactatgtcaactcgcttggatgtattattttttaaaatcatgagctgcgattaggagtctgatagtctcaaattaacatgcgtgtttttttaaagagatttcttatacgactctttctgtatttccaaaaacgaatgaacttaagaatcaactcaaatacagacatgtatttcaaaaagcgaatgaacttaaaaaccaacttatacacggatgacgtaccaaagtactagcaaaaacatatttgattttttataatagcagagagtagagatataatctagttaaggtaaaattcattgtgagaattcgcttggatatatagttttctagaaaatcatgagttgcaattaggagtccgatcatctcaagttagcatgcgagttttttttaaaaaagagatttcttatatgactccttctgtatttccaaaaaggaacgaacttaaaacctgactcaaatacagatatgtattttcaaaagcaaacgaacttaaaaactgactcatacgcagatgacgtaccaaagtactggcaaaaacatcttcaatttttataatagtaaagatttcacaaaactacatatactttgaccaaattatcacaaaactacacatttagagtgatatatcacaaaactacaaatttaacactaaatttcacatagaactacagatttaaggtagagtatcgtaaaactatagatttagcaataaaattatcacaaaactacaggttcagtgataatttaatcataaaacttacacgtgtataactcaaacataacactagtgctaaggatttaaactctaaaatatgtagttttgtgataactttgttattaaatctgtagttttgcgatactccaccttaactctatagttttgtgataaatttagtgctaaatatgtagttttgtgatacatcactataaattgtgataatttgatcaaagtatatatagttttgtgaaatttactatatttttttttcagtttctggactaactttggaaggaggctttctttgggagcaaataagtttattgatagaaataaatttaccctatacttcttacttttttccttaaatccttccatacataaagtagatttagcatctatctctttcatgcgttacacacttttcatcaaattgtggagcgaaattatctttggaagtatttgtcctatatctcttttctctccataaatcttgcaaaacggttggatttatttttatctctctcgcacacagatagacttttcaataattctagtagtctaactttggaagttaagcatctttagcagcacttaacttcattagcacacttactgtttccataaattttgggcatgtgagatcttttcaaaagtttacttttaatgaagaaactgatcacttccccacttttcctgtctttcatgtcgtcctatataaaggcacaacttaagctgtcatctatcaccaattcatagcttccaacattttcatttcattcgtaatcaggttttccacagggagatggcaatgaaggtgtatgggctgccaatgtcgaccaatgtagcccgcgtactggtgtgtttggaggaagctggggaacaatatgaagttgttccgattgatttctcaattgctgagcacaagagcccagagcatacttcacgtaatgtaagttattcttacaacttgttctctccattttttttccatcaattttcatggacaaaataacttccatttgtctgaacttttggatcaatcgactatgttgatttttcatgattccattctctctttttccccctcatacagccatttggtcaagtcccagctcttcaggatggtgatttaattctttttggtgagatttttttttcttcccaccatgcaaagtcttttttttcggagatgtttttttttcgcgagggaatgttttatttcttgcatttaccaaaatagttatgaaaaaaattaataagatagatcaatttatgatatcgcatatgtatctatcatcttatcaaaatattttttaaaaaaatattcataactattagataacaatgcaaagaaagaagacattccctcgaggggaaaaaatgctttcactacttttttttcgttcttgattatttttaatccatacaattttacactgtttcaacagagtcacgtgcaatttcgaagtacgtgcttcgtaagaacaactctgaactcctgaaggagcacaacctttctgacgctgccaaggttgatgtgtggctggaagctgagtcacaccatttcgatgagcccatgtccgtggtcatctaccaatgcctcatcctccctgtgtatttcggtggacaaaccgatgcgaaggttgtggaagagaatctggagaagctcaagaagacatttcaggtgtatgaagagcgtctgtgcaagttcaggtacttagctggagacttcctgagccttgcggatctgagccatttcccaactgcgtactacctgctggccacccctcatgctgctatgctcgatgagttccctcttgtgaaggcttggatcgatggcatgttggccaggccgtctgtcaagaaggtcatagagatgatgaaggcaactgcctagaaaaaaaataaatcgtgttgcttgttgtgatgatccttgtgatctctctaaaatgatgttgtctgagaggaagtgattgaataaaaacatggagcaggaattatgtttgggcggtttgcttcataagtacatgaatgtgttgctttgtgaatcgaaactccatggatttaagctaaataattagtttaacaactcaattccccaattctaacattcccagtgaatatgatggctgttcgaaggagcatctattaattgcacttgtttggatgttaaaaaaaaactattttagcaatcatactatcttgccgtactaaagatttatctccgcaatgatttgttttcaatggcgctagacctagtattaccgttgttttacaagtggtggcatatgagagcaatctttggtgtgcagtcggtgtcaaagcgctccatgaacttctatttaggtcagttggctcagctgctgacttgctgtgttttcttgcacgggtactatataaacaggatagcttcgattctcgatgtacctatatggcacaataaaccatgtggcttcatctattctttaccaaatcttgttttatcatggatgctatcaaatttaatacaattgataacctttttacttgctgtccagtggatcttggtgtgtgctcgctgtgtccttcctctgacatgaacagagctggtcttatatgtaaattgcatcagacatacctttaccctgtatctcaaattgcatcatgatgttcatcacagcagcaggatcccaaattgcataagacttgtctttgactcggtgtaaattcaacttctctgcattgtctcaatttgtacccaaaagcttttgttctatcttcagtgagtcaaattgcctgttctttctggttaatggatgaatgaattaaccggcacgattcttgaactcctaaccagtactattttttgagaaaaactttctatatacgaatttcttataatactgttttaaatccaattttctactttatagattcatttgtaccatcaaataattatcccaaatcattcatctattcagccattcattacaaaataattcatataattatcacaaaagaacacacaagctcttcatatttttcagtctttgtgaaccgttctcatccaaaacgcctgcatattattcccacctttgcaatggggtgttttgagttgacaaaggatttgtgcgatcagattagcaagatgatagcgaagtactggtggagcaaccaggagaaggacaataagatgcattggttaagttggaataaattgacattgccaaaaaatatggggggcttaggtttcagggacatttacatcttcaacctagcgatgctagccaagcaaggatggagattgattcaggaccctgactctctgtgctcaagggttcttagagctaaatacttccctctgggggactgtttccggccaaagcagacatcaaatgtttcctatacttggagaagcatacagaagggtctcagagtgttgcaaaatgggatgatatggaggatgggagatggatcgaagattaacatctgggcggatccctggatcccgaggggatggtcaaggaaacctatgacacccagaggcgctaaccttgtgacaaaagtggaggaactgattgacccttatactggaacttgggatgaagatttgctgtcacaaactttttgggaagaggacgtcgcagctattaaatccattcctgtgcatgttgaaatggaggatgttttggcgtggcactttgatgcgagaggatgcttcacggtcaaatcagcttacaaggtgcaaagggagatggagagaagagctagcagaaacggatgccctggggtctcaaattgggagagtggggatgatgatttttggaagaagctctggaaactgggtgttccaggaaagatcaaacacttcttgtggagaatgtgccacaacacgctggcgttgcgtgctaacctgcagcatcgaggtatggatgtcgatactagatgtgtgatgtgtggccggtataatgaagatgctggacatcttttctttaagtgcaagccagtgaagaaagtttggcaagctttaaacctagaagagttgagatccatgctagagcagcaaacgtcaggaaagaatgtgttacaatcaatttactgtcgcccggaaattgaacgaacaagtgccatagtttgcctttggcagtggtggaaagagaggaatgaagtaagagaaggaggaataccaaggagcccagctgagctctcacacctgattatgtcacaggcaggagagtttgttaggatgaatgtaaaggaaaaaagccccagaacaggagagtgtgcagtttggagacggccacccctgaactttgtgaaaatcaacaccgacggagcatacagtagtaacatgaagcagggaggatggggttttgtgatcagggatcagactggcgcagtccttcaggcaggagctggtccggcagcttatctacaagacgccttccatgctgaagttgttgcctgtgctgctgcaatcaagactgcgagtgaaaggggtatgtccagaattgagctagaaacagactcaatgatgcttcggtatgcgattcaggataattcctttaacctttcatccttaggaggagtgattcttgagattaaacatataattttgagctgttttcattccttctctgttagctactcgccccggagttgtaataaggtggcacatgagcttgccgcgtatggttgtaatctccagaccgtgtcttcctgggcaggctgcccgcctggtctggaacggctggtatccagcgattctgctggtttggtaatataaatctctcggtttccctcaaaaaaaaacgcctgcatatttcattcctcacttttcagagaagccacaaccacaaaccagcagcgtgaataatgtttattacggagtaatcactatttccatcagctgacaactttcgatactgaattactgatactcgttcagtctcctgcatacacattacagataagtactgtagtatttttgcatctatgtcatttctcaattactcctagtgccctccattgctgagcggtggaaccttttttttttttttagagaactctgagcggccaatctatccatcgttgtcctctgcgccagatttgggtgccactcgacttttgggtggtggatctatcacgaacagtagtaaccttctgatttgccttccttgaacctctgccagcttcaacttaattatttgtttctttccaaaccagcctccctatagatcagtagctgcaataaaattgtaaacattagccatgtgaaaagtatatcagaaaatttatcttcatatgtagcttcataatattgtataaatttacaatatccaccaacataaaattgtagaaattaatcaaaattactggtaccaggatggcatgtatgtgtaaacagtgtaattttcatttctattatttatacaagctctagttgaataatacaggttacctcatagcaggtagcaccgtggtagagcagattcttgactggaattcattcaacatggcaagggaatacgcgatgcagtgagatccaaacaacgaacagtctgaggttcacttcaatctgattcttgtctgtgttttcccactgttgtagttcattgttaggaaaaccacatcggaggcctatcagctggtgcagaactcaagtacatgatactgatttgaacaaagttttgaagtttgaattggaccagttgaaacctttaactccaaatggctataagattgaaccattcaacgagttaccttactttggttgatcttttcgctatctgttaacattcacttcatagtttcatgtgctacttttgacctcattattctctagcaattcaccacgtcacacagagagacctggccgtggtcctctccaccaagatttctccatactgtgcggcatgctagcattagcaagtcatgcacccccaatggcccttccagtgagatttagtgtacgggttgaattttcagaaatcagttcaaaccatggaaccagtatgcctcagcaccctttttcttcccaaaaccggtaagcaggagctttattcatgaaatagcactacagtcatctcagagcgaactcatgcttcaaggcacgtcaatgctcatccggcactgggccacaaacaactgacagattagcttccctctgaaacaaaccgaaacaaaaacccagcacatcctctcaggtacaggcagcccgcatgcttgacagttagcctgcaaatattttagcaaaataactaaatgccctgctccgaatactcgaatagaataaaatatattatcatattgcctaacataaattaaccatatcttttctatatggaatattcaccttaatttgattttatgtgtggctatctatttagattttgttgtttcttaatattgagaagttcaaggataacttacaaaacttacaataagagtagatggggtgggaatagattgttcttgaggcacccatgaatagatatgcatggacgtagtctcttgaaaagaataatgcagtgtgcattggccaatcagactgcccccttctgtagaatatgacagatcagattgatggtacagtggcgatgaccaatgacaaaagcatcaaacagatatctctggtactacctgtagtatctatagagcaggctggcatagtgttatttgctaaaatgtttcagtggcaccatactaattatgtgtcatatattcctcacttgtgaaagctgacaaaagctgacaatatgctgactggacacgatataactaggaactggtaaaacagaaattttccttggtatgacacctactgcctagtgtctggcccaaggtaccaggtcaattttccacttgcagatttttgtctataactgccactgaattgctatttacattatggtcctgcttcaccaaaatatagcctacaaagccacctattttcactgaggaaaattgaactccgaagtaaagcatcacgatctgcagtaagaccttcccatttttcaggtgcaattttgtgggacatcatccaatgtctcgctgtaattttgtgatgcagctctgcagcgtgaccattggaagtcattatgctggtatcatcttggtttcaacacatgactcatatggatttcaagtttccaaccactatggaaatagtagtggtaaccacatagcgaagttgtgttcaagttgctcaacaagttccttaggtgttacaaggcatatggttagccttcccattcagctaatcaaaaagtcgccatcattcttcattcctggtgtacacaccagagctgatggattaagacagcatgaagttatgtaatataggaaaaagcagaaaatcatggttagcactcctaaatagagatgtaagaaaactaactgaaatcttctttatgctatgctaattcatactttggtagtttgggcacatatgaagaacttgtcaaacatgtagagatggctgccgaattaagctgtctttataagttttgctgattcttgggcctgcatatcaatagacaaccacagtaatgagaaaaacaactcaagactagcacaataacaacatttagaataggaaacaccgaaacagcaatgtaaattgcaaattgcatacaggctagtcatcttattatcataaaattctgaaattatgttttcatgtaaaatcacataggataaatcagaatttcttttattacaatggaaatctctcacttagacagccacaccacaatagtagtggcatatttacaattagacattttaatggagttttcaagtacaatgattaaaatgattaaactttctaatatgcatgagcaaagggaacaaagctaaaaaatgttatacaaagacagcttctgcatcaatttttttgcacacaaacacatgtggtacgtgtgaacaggttgcgttatcatgtcagttacacaaattgcagtaaaattcagaagcacatagtacgtgagtaagaagggctctacaacaaccaccttactccagtggtgttagtagcgtggtgtacagtacagggccacaggggtacatctgaatcctcagaactttcgctagtatgccaattacataaccatattgtataaatatactcaaacaggagtcaagagaagccaatggaagaaaaaacaaaggccatattgtcatcccactgtggcaatccaaccattgaggcatctggctatcacagccagctaaccgcatcaagccatcgaaaagatccctaatttcccatctatccgtcattctgaagcatggaaaggttcaaaggcaatgcacctaacaccatgacacatgtagccctgtatcaagtgctacccccccccccccccccccaaacccacccctttcctctccaaaaataaaatagagtaaaattcctggctctgccacttactcacaagcaagttgagatacgctgaagatgagacccaaatcaagccacacaaacccaaggaaagtataatactaataataagaagggctctactgctgcaacgaaaattgtgtggtgatcatttttgaacttcgtaattcaaaatttcaaatggtaacatttcatagggttgtaatttaaatcacatttttttctagtacggcagtctaaatgaaatatatgtgaaaaagttaaggttagatagtttacaatatagggaaaaaatgcacaacagaaccagcacttctgtgataccataacagaaggggaacatgaataattcctactggcattgacactgagttagataatctaatagatgccaaaagtactgcaacaaactttttatatctcagtttttcttttatcctctgactttccagtaaaaacaattagtacttacttttcatatcctttacaaagtcagctataagctgcagatatccattccagttgatcttcttcatgagattctgccaatggacccagctcttcatcaaacgataacttagatgatgagtggtaaccttcatccttcatgtgtttagctagccttctcagctgtgcatttatattttctgcttcaggatgctgctgttcgccaactacaaacacatgaactcggctgttaagctcaacccagctacatccaggatctttgttaactcctcgaagtctcatcaaatgcctcaccctttcaacatcattccattttctctgggaagcatagatgtttgacagcaatatatatgctgaggaatctccggtacctaactccatcaaccgttcaccagcatatgctccgacatcaaaatctcgcaaagagcgacatgctcctagtactatacgccacaaacatgttccgtggtcaatagtaatggactctatgaaatcctttgcttccttaagcatccctgctcggctaagaatatcaaccatgcaagcatagtgatccagcctaggagttaaaccataatcttttgtcattaaactaaaatattcccatcctctgtcaactagacccatatgactgcaagcacacaatatattaatgaatgttatattatcaggtatagtgccctccatcttcatttcttcaaaaagatccagtgcaccattgccacacccattttgtgaaaaaccagaaatgattgagttccatgcaataacatccctatcaggaatccttctgaagacagacatgccatcttcaaggttcccacactttgaatacatcgtagacaaggcacttccaacaggggcccccaaacctaacccatatttcacgatttgcgtgtgcaattgtttccctggttccagtgctgcaatgccagcacatgctctcagaccactagctatagtcgatttactggggatgataccttccttgtccatcctggcatacaatgtcagggcttcctcgtgctccccattctgcacatgcccagaaaccatcgctgtccaaaggacaatgtcaacctcgtacaactgatcaaacccttcttttgcgtcagcaatacaaccacattttgcatacatgtccaccagtgcactcttcacatatatctgaacctcaaacccaagcttcaccatcaaaccgtgggcttgcttccctactgccaatgctcccaaatcactacttgcattgagaaccccaacaaaagtgaactctgttggtgtgaacccagcagcatgcatctgtgagaacatactaactgcactgtctgcctcaccattttgtgcatacccagtaatcatcgccgaccaagtgatcgaattcctctccctcgatgactcaaacacatgaaacgcagcacccatacacccagccttcgcatacatcgtgacaagcgagttttccacagatacaaaatccagcaacccatccttcacaatcagtccatgcatctgctcccccatcagcaaacccaatggcacactaactgcgctgagaactgctgtggcaacaaactcgcttttctcagaagggcactcttcgagcattagtcggaagagatcgaatgcctcctcggagcatttctctgcagcataacctgccaccatggtggaccaggaaaatgagttgcgctgaggcattccgtcgaacactctgcgagcatcagaaacaatgcccagcttacagtacatgttgagcaggctggtgcacacgtacacattggatacggcagaggggatcttgcaagcgagagcgtgggccgcggtgccggcgggcgcggaggccgcacgggcggcggcggtgaaggcggcagcgaaggaatggggcgacggaaggacggtggaggaggagagcatggagcggaagcgggagagcgcgtcgagcgggcggtggccggagagcgggttgaggagggagttccaggaggtgacgtcgcgggcggcgggagggatatcgtcgaacaccgcgaaggcggcggcgaggaggggccgggggagcgaggagtagaagttgatgagggagttggcgacgggcgcgtgggaggcggcgccggacttgagcgcccaggcgtggagggcctcgccgtggcgagggcaggaggcgcgccggcggaggagctcgatgaactgcgtgtgcgacattcgccgcgccgacgagggcgccgcggctgccatgctggacgcggcggaagaaaattacgcagttttttgttttttatcgactcgcaacagacaatgctacatattgacagagcattaaaaaaattacaatattacaaccttgtaagctcgtaatcagaaaaaaaaaataatctccacctacacactgacagctccaatacatagacccaggagaaagctagtatcagaccgaccgccgctagaccaacaaaagactatagtcgggatcgtccaaaactaacacagaactgtactctatttacaactttaggattaagggaaagagtgtaaaaaagaagataaaaccgttctccctctagaccattcgacatggtcaacttataagttagggcgtcatatacttggccaaacgggcggcacggcccgttaaggcacggctcctgtaacaggccgtgccgtgctcgtgccggcccacatgctaaggcctcggcctaagcacggctcaggaagaccacgggcacggcacgagcccaaatataacacacgggccggtgtaggcccattagcacgtttggcccacaaaatttgaatatgagaccgaaaactaaataaaaaatgtgaaaaaaaaatatgaaaaaggaaaattaaagggaaaaaaggaaaatatgtgaaaatattagaaaaatgacgaaaagtagtgggaaatagaaaataatatatggaaaaattgggagaaaatgagaaaaaatcggagaaaatagacaaaatatatgaaaaaaatagggaaaattttggtgggccaacgggtcgtgctcgtacttgagctgtgccggcccatgggcttagacatcagccaagcacggcacggcccacgagcgggtgtgccgtgtcgtgcctgggctggctacagtggtgtcgtgcctagatcggctgcagtggtgccgtgctcgggtcggcacgccttggcccggcccatttggccagcactatagcaccgacacaagaggaccggaatttacagctagcttgctccagttgtctaggaagtttcggcgaggggttacctagacgacgtctccagagagtggatcaacagaagcatcgccgccgccgtccatcgcggtctcaaatgagaaccgagactgggtttcacctggcagacgtcatagggatgttgggacgacacgacaactccctcaagagggaatccgacgctcgaaaacgcctccgttgccagcccagccaagatcgggctaagttttcacccatagtagtaaagaaaatttatctatttgaactttcaaattttaatatgaaatattatgggaaatgtaaatcgaaagtgcagtttcgtcttacggcacgacgcccgctaaaatcgtccgatgaaagtatcacatacgcgggtacgtagtactaaatttatctccacgtttttgatcttagagtcaaatgtgagttttcgtaactatgtagtactagtatatttaaaatttttggtgacttatatatttcaaaccatatattattttttaaggtctgttctactcaaaatatatgataaaatgagtaaactattgaaatatttaaaaataatttagtcaaatggtagaaataactaagctctatagtggaagtaactttttataacattagaagtaattacatatatgtgttaaaagaaatatcttcataggtaaagtgtagattcacaagttgtcgacgtttgagatcgtgactacggtatttgcatagtatggggattgttgataccaaggtatatgtgagattgaggtaaaagagatggagacatggattttatacaggttcaggccccttatttgacaggtaatagccctactcttattggccgaaaccggtgttgctccttactcatatggatcacacaagtacataattcgggataacctatctagttgtcgtcgacttggcggcatggataaccaactcgtagtcaacgacagggtaattttcctcctcgaatatgaactcatcgagatcagagatggtgctagatcctttttggcggcctccgtaggcaccagatgaggtatgtctaggctaatctctgatgttgagatctggcgatgtgtgttggcttgtgtatatattgtgtcttgttgatcttgtggcttgtcccctatccttctagggggtcttgtatttatactcatagatgtccctttgtccaagtagaattagggagaccaatatggatacaatccacgtagtccttgtcatttctatatagaactctatttgtctttccttatccggaactccttctatatacgaggtatgattccgtataagacatggtatgtgatgggccatgccgagtttagtcaactattattaggtatgtagcatccataaccatgacacaagtaaatacatgacttttttatccaaggtaaaccatatgtgtatacatatatatagattattgttttcgataaaagtaatttattttatataggaagtaactctttagaaaatagaagtaactattcatagtattaaaagtaattcttcataatattaaaagttggtacactcctagaggaaattaactggaaaacagaactaaccttttatggtgttagaaataactaaactgctagatagaagcaactcttcgtggtattaaaagtaactatataacaatgttatagggaagtaagtcttcataacagcactgctacaaaagtaaataacctaaatatattcaatattgaacactttttcatatattttcagtagagtatgatggtttgattggatattgaaaacaataaacgatttaaaacaggggcgacggagccaactgaaccgccgcatcgacggcgacagcagtggcagggtcacgtgtgaggaaggagattgcggtggcagggtgaggcacgctgcggtgggatgatggcaaggatggcctgcgccacaacgtgtcaacgtgttgagaaaggagacggcaatgaggcagccgccaccagcagtgccacaaactcaccggagtcgctgactcggggctatggaggggtgtggatgaaaacggagggaggaagatgtttcacggaatatgggacccactattattattattactcccttcattccaaaatatggtgcacaaccacccttaatccaaaaactcagaaataattaatatcacatcattgttatgaatcattccaactaatacaatgcatgcaaccaatagaattaaagatattgtgagtgtaggatttaaaataataataatttaggggagagaatgtgataattaattacatgcatgcatgcacacctcatattatgaaacaactttataaagtaattgtgccttatattttgaaacggggggagtattatttctatctagaatgccacctaagcgccacgtagaataaaaccatctagaaaaactccttaggaatcaatttgcattggttttgtaagatggaggaggcattatacccggtttacggttgagggatgcaattcaatcgagagcaagagattaaggaggcaaaatagatttattctgaataggagagctgataaccatcctaccctcattgattttcttcgttttttgaatttttttttttgcattctcgaggagatttgcacgtgtttggctgtttcgcaaaaagctccgcacgtttgcacgtaatatctcatatgtcacgcttgacgccccgttgtaatttatctggaaactccttgtcttttagagaaatacaatgcgaagaagataaaattccgcttatagggatagcactgtaaacatgaaaaacaaaggggcttttccgaaaaaaaaccaccatctccaatctccccccgtgcactgccgcctcccccgcgcgtcatcaccgtctcctcgcacttgtgcacactcacacgggcgccgcgcgcgtggcacccgtcagagtcgtcatcggtgccctctcccttctttttctccctccccttgtggtagtggtggcgccacggcgggggtagtgcggatgtggcgcccgttagagctgaagccgtgtcctccttgtggcaacgacggcggcgaggggacctgcggtagtggggaagcgcggactcctactaacagtttgtagtaggtgggtcagcgcctctgttggtcttagagtgataatccaattaccggccatataacttcctaagcatcttgccaaacactggagaagtatttcttcaagtatttcccattaattgctctctaaaatcattctccttgcaatgtacatgtggacttggaaataagctttacagtctgcccatttttattataccaaaagcggtagctcccctattcataataggctgacattaatgtggtcagacggtcagacctatcaactatcatgccaaacttcaaaattcttgtacaccgttgtaggctaagcaactcaggctgtgtttaattccacgctaaaattggaagtttgactaaaactggaagtttgaagaaaaaacttctatgtgtgtaggaaagttttgatgtgatgaaaaagttaaaaatttaaagaaaaatttgagaactaaactcggcctcagcatcactagtaagctttacagtctacccatttttattataccaaaagctagcttcctggtagctcccccattcataactaggtgataccccacgctttgctgcgggattcacggatgagtatatgttaaatattgtcgaaatgatgaaagttgaaatattgagaaaataatgtgaggaagatgatttgacacatactggttgatctctataatataatattgtagatgatatgccatgtttgcatgggatttaaaataggttagaaaagcaattgctagtgagtgaagatgtggcatgcttgtataggattttaaatgggctagaatagcaattgctagtgggtgatgatgtggcatgcttgtatgttgagctttagctttagtgggtaccaactatgtagaaagtatagacagataggctgacatgtcgcactccatctcaatgacagagtattcttctgagtcaacatctaacccaactatagaacctctcttgtactcctttgtaacatcaagtaaggtcacatatcatgtgactttaatctctatcttacgtaaggtgttctgatccaacctgagaattttgagacaagacatgcaatgattggctggacagagacgactgccaccgatggtggcgacggggacgtccggcggaggagggagaggagatgggcacggcgaggccacactactacagaaagcgtttttgcatacgggcggaatcgatcttcacatgcggttggccggcccgcatgcgcgaaatggtctgcaaagatcaccatttgtgcatgcagccggcccagccgcatgcgaagatcgatcttcgcatgcggtcacttaagacggccgcatgcgaaaatagatctttatggtccatttaagaagccgcatgcgaagatatattttcccatgcggtcgacttaacaagaccgcatgcgaagatctattttcgcatgcggccgtcttaagtagaccgtatgcgaaattcaatttccgaatagctcaaataatatttattctagccttttagtgaggtgtgtctcgtaattaatattaaattattgagggatttattatcatatttcggaatagtaagacaagtgccgcagtaacaaacatgtaatacataaccataaattcaatcgtaatttacatacgaaatatataatacaggtgccacagttttttcatcatatgtataagtagtgtacatgtcattgcatatgttctttctcccactctctgagaggtttaaatttgttgtccattgcgagttcactctggttgtcatagaagagacctcttgtattgcagacatcgcgcggatgaatcggtagaggtcagcggccacgttcaagatcgtagtgtcgttgaatcgttgtgcaatatatgggatttcggggatctacgcacagaaaggaaaataaaatggtactcaatgagaagtgtgtgctagatgggtttctgtgtagagaagagttcgtttacttactcggttaccgattgttttgtacctcccatttactctgagcatctcacacacgtaataaccgcacaagttggttcctggtggttgtttgtagcactgcgatataattatgggggaccgatctcagtagatataatttagtatatatgtattgttcgataattagttgtattggtatagatttgatagtaccggctagctagtcctgacggataacttcttctgggatggaatatgtactggtccacctcttttgcagtagtacttgtgtgctctgtttgaagaaaacaattgttttatcagtagttagaagactggcgatcgacctaaacaatttatattaatgaaatgtttatcacttacaaattcaaaatagtgaggaattccataaatgtctccttgtcatagtgtgcggggtccaatgatatgatcaattggtctttctgatatacaaggaataatatgtagttgtctctgcatataagataggcttattggagacagaaaattccgaagaagataaattaattaaacaaaaagaagagaaagcttacgtgaacgcgtagggggccattaagaaatctttgtcggtgtgcgccaacattgctattgccaagtatgttgctacttctagcttcttcctcttgtgcaatgtcttcacatattcttccttttcttcaggggtcttgccaaccaattgctcgcagtcctctctcagctctacggtgtgttgtgttttgcatattcttgttggatcgacgtatccaacctttgctccagttctatcagcttcgtggaattgcatactgtacaatgaacaaagaagaaatgggatttggtttatttgtttggaatgatacgtgtaacatgtaataaagagttcagacttacagacagaacgccgcaacgagattaacgtccattttatctagcttgtagagggcgtaaaggtctcggaaagagataaaaaatatcccattaggaccactcatgaaagcgccttccgggatggcgacgcttatgaaactgagacctttcctagatgccttcatataccattcgtgcattaccctcatttcccatggtagcttgttcataagataagttggcaagaatggctttgccatactcataagtgtcaagcacatcagcagataaccaggattgcacttcatcttgggctgctaatactgacttctaggagtctgacaagatgtgagcaagttcttttctcttctcagaattcctgaaagctgaaaacatgaacttctccttatccttttcaatctcctttgggtcgtatgtggatatcaactttggaattatacgacgaggttccaaaggattagacttcggttcggatgtggtaccttctggtatgtgcacttgttctaccagagcagattggggtgtaggtggagaggcttgaactgagggcggagccgggggagcatgctgtttagctagggaggtgggagaggcttgaactggttgcggggccgggagagcaggctattgataaggggagggtagtggtttaggttggtgaggcggtgacctaagcagtggtggtgacgccggatgtcgaggtgacggtggttcaggaggcgacggtggtgcaggagcggcagctgtccttgcctgcgatgaggatggagttgaagatcctgctgctggaacggccgcggttaggattatgtctctgcggtgccacaagataaactgattcactgcatcaccgagaagttcaatcccctcaggtgcaggtatgtctagttccaaggaaacgtggtcgctatggaccttggcgacctatacccttgcgtaatcctcagggaatgccgtgttgtggaattgacgtccgggtatcgctaaacccattgcaacctccttagtctttccagcgcggccgattggtacgacgagactgcagggagttggtccagttatactatccacagggaagggagttgtctgcactgagcctacactgctgggtacattagttgtttgctgtgcagattgtgtgggttgttggccattagggaataaccttggaaaggctgtcgggttttcagctgccaacgagtagaagtgttccttcacttgcgcatagattttgtctgatagttgttctttgtatttgtctctcttcttataacttggtgcgtcttatggaaaccctatcttccaactcatctttgaggacaaaccacttacacgtccagagtgttcggcggtccccaacgccgcagtaaagctggtctcgctccctccgtgggacgaactgtcctgatctttctttctcgactatctgctgcaaattagtagtcacttcttctatgtctggagtctcgaatagtatgtctccctcatccgagactttacctgtgctgcgcacccaaacccagttcttgctacgttccaccatggggtctaccagcaggggtttgccggccgcggaaaatctttgctcgatctcccaccattgatcgacgtgaccagcgtatccgctcgaccccaatctatggggatatctgttcttcttcgcgagctcagacatttttttcctcaaagccaatgcttcagctattatatgatccgcaacaaacgtatcccagtcagcctgtgatatatgtccataatccgtgaacggtgggagattcttctgaacataatcccgatttagatcggacttccactgtcgccatcgatctcccatctttttaagtgtgtaatctctccccctgacctgtgatccaggagggaacacaaaatacttctgcaactcattccagagaagtgtcttgatgttgtcgtccaccgtttcccacaacttgacattaatgggacaacgcgtcctgactagagtaccacaggcgttgctaaacttggaccgcactatcggtggctcaacgggcttcccatcctgatcgagagcaatcacgttgtatgtttccttgggtaatttattcttgcttctctcaccacgtctttttttcccactcccgcctgcacttgtagatgtctccgtatgttcaggtgcagacgtagcggtgtccatctcaacttcttcctctctcctgttccgagcggctttacgtttcgagcggcgtcggactaccatctgcagaaaataggtaactctctacaccattagattcatgtcacatcatagttaggaaataatacatggctaacgattttcagcacttacggcctgttccataggtatgtagtccggatcatcatcgcgaggggcgacttgtgttatttccattggaaacgggtcacttggtgtgcaccacgtttcttcactagaagcgtcaggctgcttgttgctaccggatttttgaggagcgttaccttcttgaggcgctattggtgcgttcgatggaaccttatcgttcgacatcttccaacttgacgtaaaaaaatttgacataagtcccaatttaacataattttacataagtcccaattacgtaagtcccaatttaacataagtcccaatttaacataagtcccaattaaacataaatctcaatttaacataagtcccaatttgacataaattccaatttaacataagtctcaatttaacataagtcccaatttaacatcagtcccaattgaacataaatctctatttaacataagtctcaatttaacataagtcacaatttaacataggtcccaatttaacatcagtcccaattaaacataaatctcaatttaacataagtcccaatttaataatccacaattaaacattctcaaaattaaacaatccacaatccacaattgcacatttcacaatccacgatcaacaattaaacaatccacaatccacaattgcacatttcacatttctttttttaagggaaatgttaccgggggactttggaccggaggagccggcgcggcggcggcggggaggtattgccggcggtggcggggaggacttggcggcgacgacacgcgaggggggagagatcctggcggcggcgacgacggcgacggcgagaggggcgacttcggggaggagccggcggtggcggggacgacttggcggcggcgacgcggcgaggggggagaggtcctggcggcggcgacggtgacggcgagggggaccacttcggggaggagccggcggtgacggggaggacttggcggcggcgacgacgagggggctggggacttagaaaattttggcagcctagcggctagggttcgcgggcgccgggacttagaaaattttggctccccgcgctccctatatataggggcagatcatcgcatgcggtcggcttaagcggccgcatggaaaaatgatctttccatgcgggcgacttaagccggccgcatgcgaaactgatctttccatgcgggccattaagccagccgtatggaaagatcatttttccgtgcgggccgttaagccggctacatgcgaaaaagatatttccatgcggctggcttaactcgcccgcatggaaagatctttttaccaaataaactcatattttttctttcgtctaaataaactgtacatatatatttttttccaatatttcggtacaacaaaaattccaaatatttttggcagtaagaaaactcatgaaaatcactcaaaactcgtaaccaaatgttacatgctaatgagtacaacataagggggacttaaattcatgcacgtacatttggaacacaatgacaactaaaggttacaaaataactatgactaaataaccttggcaacaccatctgctcgaacgtacgacatattcgctttatcgattgtactctcaaccttcttaattcgcataggaagatcagtaaacaatgttacatcgtcgaactggttgtaatcattggggtcttcgatgttgtcgatgccgacgatctgttgctttccagatatgacaatagtttttctttcatccgaagggtccttcacataaaacacttgagccacacgctctgctaaaacccatggatcatccttgtggcctgttttactgtgatcgactatggttaccccgtagtcatcaacggaaacccctgttgtgtctttaacccattcacaacggagcactgggatttggatattcaggccatagtccagttcccatatttcctgtatggtcccataatacgacttattttcaccactcgtgtcaatcgtttcgacacagattccactgttttgtgcggtgcttttcatgtccttcgtagtcgtactcaaggtaaatccattgatgtcgtaaccttaccatgaattgacaatacttgaaggcccacatgccagtctttgtaaagtaagttcctccacagaatcaccaactggcaggtttagatctttgaaccacagaggaaagtgatgcttgtgctctcttgatacccaatcattggaccgccctaggaagcaggctttgatttcttctaggtgtcgctcaatgaatggctcaacgatagcgagctgttaaagaacattgttgtgtgccgcggacacctttttgtaatcattatcgaagaactgcttcctaccaacaataccccttccagacaatctcccttcatgtcgatgaacaggaatcccaatggcattagcatcctttatgtagtccatacaacactcgactgcctcttcagttgtgtatccctctatcattgatccttcggggtgagcacgattgcgtacatagcctttgaggatcgacatgtaacgctcataggcccacatctgatgtaagtataaggaaccaagttcaataatatgagggacgatgtgaacgatcaaatgctccatcatatctaaatatgatggtcggaaatacatctcaagctggcatacggtctcgacggcaaatgtctgaaggggacctaattctagaggatcaaataccttctgcgaaattcgattgaaaaagtagcacaactttgttataaccaccttggtatggactggtttgactgcccttatagcaattggtaggaataccgttaacaacctatggcagtcatgtgcattgtatcccagaaatggtcaaatccttcactgatactagcttcctgatgttcgatgcgaaaccagtaggcactctaaccccttgtaaacatttacagaaggtttttttctcttcaagtgtcaacgagtaacaagcaggaggaatctcggtcttcccatttggcagcactactgggtgaaggtcatgccgtatggccaaatctacaaggtcgttacgtgacttcaatccatccttcgtcttactcgggatgtccagcaatgtgccaatggtgctatcaaacacgttcttctcgaggtgcatagcatgaattgcatgtcgaatctctaggtccttccagtaatctaagtatttgaagaaaattgagtgcttcttgaaaggcgacgcagtatctttgtcaccatcagctttcttcctctttactgtcttcttctttccctttccatatacaaccttaatcttctttgttatctcatacacgtatgtaccacctcgtgctgctggggcagtgtcattctccactgtattatcgaacaatctagccatcttacgatacatgtgtctttgtggtaggaattgtcgatgccgcatgtacactatcttcaaagacgacatcaggtatttgtacgaagttttctccaaacatatcagacatctagtcttccctttaatctgcccagataatgaaaagtttgcatgtaggtcattaatggtaacgaatatgatcgcacgtagattgaagtgctcccgcttaaactcatcccatagtcgtaacccctctttccaaagctcctccatgtcctccatcaaaggctcaaggaaaacatctatgttgattccaggttggtttgaaccttgtatgaggatagtgagaagaatgtactttcgtttctgacatatccatgttgaaagattatacattgtgagaaggactggccatgtgttttgcgagctgcttaagtcaccaaacgggttcattccgtcagtgctcaacgcaaaccttacattcctgggatccttagcaaattctgggtgttttgcatcaaatgtcttccactggcgagcgtcggcgggatatcgaatcataccatctatcttccggctctcttgatgccatctcatcaactcagcatcagtcgggtttgagtacagacgcttcaggcggtccttaattggtaggtaccacatcaccattgagggaatctttccgcgcttactcttatcagaatctggatcggtacactctgaatctatgggcccattccctgttttataccgacttgtgccacacgttgggcaactttccaagtccgcatattctttacggtataatatgcagtgatttttacaagcatgaatcttttctacaccaagagataaaggacatatgagtttcttcgcttgatacgtgtttgatggtacaaagttaggcttaggaagcaacacacgcaacaaactcatcagatcattaaaacttgtgtccgaccatccatgtttagccttcaatcttagaagttcaagcactgaacgcaagattgtgaaatccttatcacatcctttcgtttcgtcgtaaagaagatccttcgatgccttctctaatgcctgccaattctccaatcctcgtgacctacccgctagcacctctggttcaacatggcttagcatatcctctaaatcaaaaccaccctcaaaatcatcactatcggtggaaacatcgacatccattctttcactggacatgtcttcgattataaaattctctgcctcattcatctcgaaacataactcttcatcgtcatcttcgggatcggcgaattccccgtgaaaggtctaaaccttgtagttggcggtgaatccgtactccattatgtgacccaatatttcactaggatctaccaacaatttctaattcttgcaatgacggcacggacaaaagatctttgtcatattctccctcaaagcatgtgccttagcctgatcaataaatttagatgcttcctcaataaatatcggctatgttctccgcatctcatacatccatgacgaccgatccatctatttatataaagacaaaaaagttacagataaaaaaatagaccacaggtatttcatataaaagtttaaatgcatttgtccctccaaaaaaattacaacaatacatgtaactagtatgtacaagtgattacatgcaaaatttgcccatcaaaacatatattttgaagctagattttgcaaaaactagctagaacaaaccttgtcaaaatattaaaaaaactccactttccaccaacgaaatataacagaaatggagccaaatgaaggagagagagttattcacctttcgtatagagttcaagcaaaaatttcgagttgaaaacctcccccctaattggtgcttgctttaggagagagagagagcttcgttttcaaatggtcgagcttgggcctggaggagcatatatggccgatcatcgcatgcggtcccttaagccagccgcatgcgaagatccattaccgcatgcgataatgggcctattttcacatgcggccgtcttaagcagccgcatgccctaatacatgcggccccttaagacggccgcatgcgaaaatagacctattatcgcatgcggctgtcttaagcagccgcatgcgataatggatcttcgcatgcggctcatcgacctgcccctaggggggccgtttttgcaggcgccgccacaagcggcccacatggaacctaccaacccatggtacagaaaaacgattttttagtagtgccagccgccaccgccacgcgcgacagggatggcaagaacaatcagggcgagggaggtcatcgccaccaaggacggacgacaagatgatttttggttcgatcattttgtcaggagatcaaaacaaatcccgtaatcagagatgggcaagatggtccattcgctcagccattgcacactccatcacagtgaaagaaaacggaaaacgggagagagcgacggaaacctctaaacaggaacagaggaaagatttgggtgccatctatctattattatatactaaaattccactaaactttttacaaacgctcttaagatgtcacgtggcgctctaataaattagagaaaatcctagaaattctaagaaaaaagcaaaacatctacccctttattttcacttaaattggtgggtccaatattatacaccgttagataaaaatgatcttaaaataaaccaaatactataggcccaacctctcctcttttttttctttgaccagggtcccacctctcctctttatgcgtgcataggtaggtcacgtacatacatgggtatgtagtacgtacgcctccctcccttttgtttccttttttttcttattttttctatttatacaattgatatatattttttaataatcataattttacaaacaaagaatataccatcatataactctttataaacacacgtaaataaattagctctataatctttgaaaataaaatttacaacatattatatgtttacctagtaaatcaataagatagtttccacttaaatcggtgtactcattactttgtactattattttcaaataatgcactattttaaaataaaatttacataattatattgtgtacctattaaataaactatttaagatctatattaactaatatatagatgcacttaaacagataaatccattatttaaatcattggatctatttttttaattactttggactattattctcaaataataaattgttttaaaataaaatctacaccattatattgtgtacccattaaattaacaatttaaaatatatattaactaatttacatttacactagaaccagtggacccattatttaaatcatcggatctattgttaataactaaagtgtctaaagttctctttttggcccgctgcataatgcacgtctacacctttgcctttcggacgtgtgacagaatgtcatgtctgaggcatctcaggtgatcacgaccattgtagtgctaccgattttgttaataacatgaaaagaaaattaaaggtgtgatgccgtgagagaagaattaagcaccgtgggaacacttagctctgtttaagccaaaatcgagagttgattgcataataattataatgtattgtgttttgatgtattcagattttgtattatttgttcgtacaattgaatgaaatcattatattataaatgtgagcacaatattaacgaatatcaatagaactcttactaggataaaagtgttataagggagtttaaggccctatattttccttgattccatcttttgggttttcgtttgcatgctccacgctttccaagttcctaaatggtgcttttcttaaataactttttaactttttagaagttaatttatttgtttataatctcaaatagctatcacataaatcagataattcatcaatttcagttgtcctaaactctaaaccctaagtagtacatatttttttcatgcgagtcatggtgatcagtaaattggttatcaacgcataatcaaagtcgtaagatgaacatataagagctaatgtaaacaattgtaaataggtgtcaaaattaattgctattaattagacatctaatggcttgctagcaacatatttaatttctctctacatgtatataaacatggacaaagctaaatgaatattaacatatatcccatacatatatattatatggttaatattctaattacatgtggtaagtccattaaaatttcttaaaataccataagctgtcacgtggtgctcaaataaattagagaaaatattagaaattctaagaaaaaaaacaaagtatgattttcacttaaatcgatcggtccaatattataaaccattggattaaattgatcttagaacaaactaaatactacgaggtcccacatctccaccttcggtacacacctacatacgtaggtacctactcttccccctccctttttccatttttccctttcttctttttctccatgaatacgcttccctctctttcttactgtatcatgcaccttttttagatgatttaatcacaaaaattttaagtatcttgctctcacatttttcatttgttatttactcaagaactacaagcaatagtttattatttactcgagaaaaaaatatgattcaaaagtcgtaagtacttaatccatctcctactcaaaagtttgtgaatggatttttaagataccttaagaaaaatagaacccttaaattattacaaaataacaatatccgaactttagtttgcccttaatctataagataaaacttttgaacaaacagtaaaaatcttacttttcaataatacaagtgcccgtgcatacgcgcgggccaccttcctagttaaagtaaacggtgaactttcggtgctataaatctaaaaacgtaaacttttgatgctatataatcaattttgccttaaataagatgtctccatataataaacgttcataataaaaaaaataaaacaacattaaataacatactcacgcatatacgcgggctaccttctttgttaactaaacagcggctacaaagtctgagatcgctaggcatcagcaagagcacagagagagtgagaagaacataattgttcatactggcagttgagcttgagagacaataagaaacagtacattcgagagtcacccctgctttgctactttgccttatagccccatttattcgtcgtattccagcaaaatagttgtcctttgttcctacaaatccaagaagtaaatagatggtcaaggaacacgtagcaatcatgcaggaactaggcatggaagaacagcatagccaggagacttaccaaaagtcataagacagcaagcaaaaagatggtggatgaggctgtacggagccagtctgtagccttcctcgattctaccctcagcagctgtcgacagggtgccacttctaacatggtattgtgcaaggaatttcccgtggtgcctgtagatgagagagccatctgcaatgccaggaacagccttcgaggagacacacaggctcctttcatccatgaaaatggtgtagtccccaaatcttgttaacgggatgaaccttcccaagataatgtcagcaagtctgtaaaccacggcctgcgagtacgagcgatcagtgtgaccgatcagcaagacctctgattcacagttcaccagataagcgaacccaaacagcttttctactggacatgtagcaaacaattttggttctggtagggaaaaagacgaagcagagccattcgcctccacccggggtgggtctatcacgaaaattctgtttggagagaagtttacccatattgatgctgcataaatcttgccctggaatgccatgtatttccatgagaggttggtctgccaatttgacaaggtccattgctgatccgcagaggtggcaaaggcaacgcgctgtactctggtaacaacgaacatgatagtgatgactccgtcagggccgaagctaagagcagcgcaaatacgattgaaatatgagaatatgcccatctcttttcgctccatggctctcatataagccaactcagtgctggtgaagaagggctcaacctgcggccgtagggtctccagggatgataactcaacaatgtcaccggtgaaagggtggaggatacggatagcactgtcccgatcccgctgcaagaggaggaggccatcgaccgagtcgatgacgaagtgatccgggaagaacgggaggaggagacgcgcgaaggcgcccgtggagacgttgaagaagcgaaccctcccgtggagcttgcggtggccagggaagaggccatggctctcggggaacaagatccaccggcgcggatggaagcgcgggtccacgacgctgcggccgcgcgggctgacggtgctggaccgccaatggcggcaaacagcgcggagccggaggtaatccgccacgtcgccagccagcgcgtgctcggcgacaaggcggatgatatctccatccagtgacgcccagggagactccatccagggcgcggcaccatttggggcaacggcgccgaccgtgcggccgcgcttgcacttgcgagggattttgcgccgcggcggcgacagagcgcgcttctcgcatcgcgccggcgacatccgtgattcccaaaatacagatatggacagtcaaccacacacgatgatactagcaaatactccaaatctcgcgtaaattaaagaagagaattttctgctgcagaatcggaaaacgaggccgaagcgtaagctgatttgacttaggctgtgatcgagcaacacggaggacgctgccgattagagcacgccaacgtactgtcattccggaagattagtattgtcatttgccagcatttagtgacggtcacagtcacgcaatagcaattgcagcgttttgagctttgagagttttatgaccacacatgaagattaacagttagtaaattggagcaaaattcacctacaagcagtagctatctagcttgcatataccttggcttcacaggggattacactccagcctttgatggttgcacgcttttgctgttcttcaattctttctcagcgatggttgattcataaaccttgtccaagttggagtctttaaccaagaaaggccttataaatttggccacgaagtcttcctctactatggtggcgacgttgatgaaatccctgccgcgccacagccgccaagcctgcaccctgcagcacgctgaccacccggaaccgcgcgcggcacgagcctcccgtccaggtattaactgagcatcaccgggaagttggcgacgcgctcggcgtccatcccgacctccttggtcaggaactcccagttcttcctcagccgctccacggacagcatcagcaccgtcggtatcttggctgccgccgtcttcacctgcgcctccgtccacccgagctctgctcgtccctgaagaaggccgccttccaggcgagatgctccggtttcaagaggaacgctgcgacaatgacgtccttgaatggtcgcatcctgcgcggcaccccgaactcgtcggcgatcactaggacagccttggctacatctggtgctgccacgagcagcttggaggcgtaggagacgcagaaccagccgatgtcgtcgttggtgaggcctcccagtcgacgcagccgcggaggtacccgagccagaactggacattaacgaggagcgtcggtgagcggaagaaggcggcgctacagcgcgccacgatgaggtccatctgtaatgtggtgaagccgagcacggctgcgcagggcttgagtatcttggggacgctcggggtttgcattttttatttcagccaaaatttcggtgatttcggtaggatgaaatttacaaaaatttcatgattttcggcactttttagatcagaaattattaaaattataacatattttgactggatttgaataaactttgaccgaattcaacaaacatttgataaagtccgaaaattttaattgatatattgattttgctggaggggtccgaaattagagaaatttcgaactgaaactgcaatcactggcgacactgcaggtgagaatcttggggtcgcgagccacggtgatggcgatgaggggcggagagagcccgagctcttcggcgaggaatgcaagcacggcgtcgggcctggaaggtgacctgatggtggagagctccggtgtgacacgacacattgaggtagaggttgcacctgttcacgaggtagtcttccacggagaatgaggacgaggctgtggtgttgtccgaggatgtggatgcggcgacggtggcgtaagaagatgccgatgaggtgtgggggaggacgagggttgagagggacggcgggaccacagggccagggaggaggagcatagcggcggcggcggacgccagtgaatgggatagatggctggcaagcgatctgaggctgacactacttaaaaaatgattttcctggatatggacccatttagatttcagacggaccataacggtgttcccgtctgggaaaataagctcattt

SEQ ID NO: 7401 - DNA, 37149 bp, Oryza sativa
ccctcccctcccctccccttcctagatccggtggaggggaggggcgtcagcggcggtgcagccggaggggagcgcggagccgatggcgggcggtgcggaggccgccacccacgatgacgaggacgggagtggcgtcctcggccaaagacgaggatgacgaggaggaggacgacgacaaggaagaggcggcggcgccaccgccgaattctaggttttcattttttttttttcattttttctggatttttgttgccgcacacaaaaattacaattttcgcagacccctgggtgggtgcggaccgcccacctgcacacaaaaatcggatttgacagtagggaaaaacgttctcctagtagtgagcgagagcccgtgctggtaactgtaactcgggagaaatccgacgaaaacaacccgtgtgaccttgaggttatgaggttgactcccttctctcgtgcgtttgcatttttctgggaggttcctagcatgaatctcaataaaaatccaatggtcaaaaaaattgcaagatctctaaagaaaaaatcttgcgatagatgtatagaaatttcggtgtttatttgtgaggaaaaactaaaattgcgttgacatatttttagtggattacagttaattttcagggcttttgatttgttcactgtgcaagaaacgattttttagtgtaagtgtaaacgcgtgttgaaaatttgaattattttttaatataatattatagtaacataaatatattgataaaaaaaatcttgcgtttgtattgttgtgtatcttcacttttgcactagatcaatttgaaaacttccttccaataacttgtaaataaatatgagaaagatatttaaatcttgtttggcacaacttcaaatctcaaaaccacgataaatttaaagtttgtatattaaattatagttgtcatggttatggataccacatacctaatagtagttgactaaatctcggcaggacccaccacataccatgtcctatacggaaacaaccttcggatataggaggagttccgatgaggaaagaaccagagttctacatggaaacgacaaggactactcggattgtatccatattagtttccctagttatacttggacaagggggaacctatgggtataaatacaagcccccctaggaggacaggaggacacacactcaccatgagacgatcaacacgatcaccactatcgggacgaccacctcatcaacacccaacacaatcaacatacaagcctacatacgccaagacacgccgccggatatcgacttcagggataagcatggctattcccctacggtgtctccggataccgtcaggagatacgaaagcgctatctctgatctcgccggacacggattcgaggaggaaggctaccctgttgtcgaatacgagtcagaccttcagaccgccatgtcgacaacagttagataggctaccctacatattgtaggggtgtgattatggtgaataaagagcatcatcggctccgaccaacaggatgtagggttattacctgacaactcaggggcccgaacctatataaaaatccttatctccatctcttttatctcagtctcgcgtatatcctagcaccgacgatccccatactatgcaaataccagaatgacgacatcaaacgtcgacaatagtgatttaaaattttaaaatgcacctaaaatgtaaacaatgatttatccatacattattgacgtaatcataaatatacatccatgtaattttgaagttaagaatactcaattttaagatccagagatgtgtcaaaagaagggcctctgtgtttgatatagtctatttcaaaatcttcctggcgggccttctttaattttttttttttaaaaaaaagaagcttcctggccaccgaacgcatgcaaaccatgccctttgagactttgatcgagtgcatgcttaattacttacctcgctaggctacgacgaaatcacgacaaccacctactcaatatatgataatcgaatcgacaatcttcctagccgccgaatgcatgcaaacgtgcctagtgagacctttaatcgagtgcttcagggtacgacgaaacacggatgagtgcctgctctgctcaaggtcaatttcgttccgcgttgattaattagtcagttcgttaacaacctcgactactccatatgcccaattaattaagttaaccaactcatctaatgatgattatgtaaatacgcagggcaggaaacggatgcgcatgtccgggaaagactggagagatactttgaacttcaagatgtcgtcgtcagtttccgtggctggtccaaaggctggacaccatcgccacagcagcatgcaatgcatacatacaactaccatattcatgcatgcatgcgtttcctataaatacattggccagatggccatctcagctcaggcaaagcagcagcttacggcactgcgcacacgaatctcaattagctgtgtgtgttcttacgcttgggttggcgattgaattgtatgcgttcggcgagatgggaacagccaagatacctgcattgctttggttcctactagcaggcctggtgttagcacttgcagtgaaccccgctcatggagccaagactcgccactacgatttcttcgtaagtgattatctacttgaattctagcgtgatggatatgttgatgtacaggcagcatgaatgcacgaagttttaacttttaaccatgcgtgatgctatctgcagattacggagaccaactacacgaggctctgccacgagaagagcatcctcaccgtgaacgggcagttccccgggccgaccatctacgcgcgcaagggcgacttcatcatcgtcaacgtccacaacaacggcaacaaaaacatcaccatccactggtccgttgccccacctgctgcagagaagaagagcattatatatcgatccttggctcgaaattaaacttacgatgtacgttctggatgattttactgtggcgcaggcacggtgtggaccagcctcggaacccgtggtctgacgggccggagttcatcacacagtgcccgatccggccgggcggcaacttcacctaccaggtgatcctgttcgaggaggaaggcacgctatggtggcacgctcacagcgacttcgaccgcgcaaccgtccacggcgccatcgtcatccaccccaagcgcggcaccaccttcctcttcaggaagctagacaaggagatacccgtcatcctcggtaatcaattttgtttaacaatgttagttccatcctgcaatgcgatgcgatgcaatgcttcgtaagtacgtgttttgatctgaaccatcgtttaatcgtttatgatgatatgatgttgtgcatgtgagtggtggaatgacgacgttgagcacgtgctcgacaaggcgaagcgcatcggcggagacgtggagccgtccgacacgaacaccatcaacggccagcccggggacatgttccccctctgctccagggacgacacgttcaaggtggccgtgcagcagggcaacacgtacctgcttagggtcatcaacgcggggctcaccaacgacatgttcttcgccatcgcggggcaccgtctcaccgtggtcggcatcgacgcccgctacaccaagccgatcaccgtcgactacatcatgatcgcgccaggccagaccatggacgtgctcctcaaggccagccgcaggtcgaccttgggatccaacagccggtattacatggccgcgaggacgtttatcacgttaccggttgataccatccgtttcaacaatagcaccgccacggccatcgtggagtacacggacagtgccgtggcgaggccggtcgggccaccagaattccccgtcctgctgccggccatcaaggacgaggacgcggcgatggcgttcgtcaagcagctcaggtcattaggcaaccaggaccacccggtgcacgtaccaaagcaggtggacgagcacatgctcatcgacattgacatcaactttctcccttgcgacgctaacaatgcgacaaataaattgtgcgagggaccccaaggcaaccggttcgcggcgagcctcaataatgttagcttccagaacccggctatcgacgtcctcgacgcctactactacggctccggccgcggcgtgtacgaggagaacttccccaacaagctgacggtcatcgtcaaccccaccggcgacatcaacggcggcgggcccttgctaacgaagcgtggcaccaaggtgaaggtgctggaatatggcactgtggtggaggtggtgttccaggacttgtccatcgagaaccaccctatgcacctgcacggcttcaccttctacgtcgtgggacgagggtccggaaccttcgacgagcgcagggacccagccacctacaacctcatcgacccaccattccagaacactgtctccgtgcccaagtccagctgggccgcaatccgcttccgagcagacaatccaggtgagatcaattattcagattaatttcggattatagctcttcatgtacagttttaaatattctttttgtgtttattttgattgttcattgatcaggtgtgtggttcatgcattgccattttgatcgtcacgtggtgtgggggatggacactatgttcatcgtgaaggatggcaagacgccgcaggctcagatgctacctcgtcctccaaacatgccagagtgctaacgaccgtggttcaaggaaaatgcaaacacaagcaggcggaaatttgtttattttgttcattgatttagtggtttagtttattttatttccttgtttggctgaaaaggaagaaggcattttgtcatcttgtaattgttagtcatttcgttctatcatgtaagtttggaatttttgttattcaatttacgaatataactaaataatgttttttttcagtggatcgggtattacgacgtctttctttataaacacacacccttgctatcttggctattttaattcccagcgctatacattgtgttacactggattaatttttcacggttaagatgtccttcgcttattcttatacattggtggagaaatcgtttttactcctggtttgtaaccccttgtagtcttggtttttcaaccaggactatgaatccgagactaaatatcgctatctttagtcccggttcaaatacccaggactaaagatcgatcttagggcagcggcagtcccggttagtttccttttctttttttttcattgtttctgttgctacttactacttaatccctaactattttctcccaaatcaagtgggatacatatccccaaatcaaagtaacatcacaaataccacaaatcaaatatatcatagattatacatctcatatgtatgcaatgaccacaaatcaaatacatcacaaattatacatctcagatctatgcaatgatcacaaatcaaatacatcacagattatacatctcagatctatgcaatgaatcacaaattctcaaaaacgaaattatacatctcaatccatacaatgaatcacaaatccttcatctcaatccatacaatgaatcacaaattcttcaaaaaaaagaaaagaaaggacaaaagtccctgcaggagagggcgctaccggccgccggccgccgccgccctcccatccgccagctcgccctcctctcgtgcccacggcaggctcagccgctgccgcctcccctcctccccggtcgccgcccgcccggcccgccctcctcctacgctcgctcttcctgtgaagtgaagggaggaaagagataagctaagagtaagagcatctccaacagtccctctaaatctcactctccccattcgctcaccgccgacgctcgggctccgtccgccggtgcccctttggccgagctctcaccggccgcctcgtctcccatctcaccggccgcctcgtctccctcaacctcgccgtcgagcaacgccgccaccgcattccctcccatctccaacccacctagcggatgaggaggcggcggcgtgaggcgagggggcgcgtggatggggagccggcgacgacgacaccgttttcacgcgacgatggccagcgccaggccgccagacgacgacgacgacgacgggtgcatgaggcaacgacgggatccgctcctcgccagcctttctcgttcctccctcgccatcgagccgccccgtcgcccttgtcatgccgctgatggccgacgccgaaggactcatgcgccgtcaagccaccccgtcgacaacggcaacggcaacctcggggacgacgacagtggatggcgacgactggcgacggtgcagatgacggcgacagcggctggcgacctcgtcgacaatggtggcgctccagcgtgggttcaagacgctcgccgtgatgcgcaccgtcgtgctctccgccgccggcctgcacttttgcgccgcatcgagcttggatccccaagaaccccgccatggctccctcctcactgggcggcagcggcccagcgcccgtggccaaggggctccaccacaccatcgtggagatgcaggcggcgcatggaagccggtgctcgcggcggtgcacggcgcttgcgtcggcggcggcgtcaaggacgtggccgcctgcgccatcgtggagaagagccgaaggagatggggggaggaatctatgtggggcccatggttggccagtgatttctagttggccaaatttggctagtggaggggggttttggccagccggatgccggatggctagaggctattggagcttttttttttttggctaaaatggctaaaatttggcttggagagtgggatggagagactgttgaagatgctctaaggaaagagataaggattagagaggaaaagagagaggagtttgtgtgtggacgagagaagatgataagtcctagggattatatagtgcgttttgatctttagtctcggttgataatacaaaccgagacctgggactaaagatcccggagaaccctgacagcatgtgaaccaggactaaatatcacatagtcctgttctgcttataaaccgggactaaaaaccatctttagtcctggtttttattgtaaccgagactattgtggtttttagccgaccgtgtaaagatggtttctccagtagtgatataagattttttttaacctagtcactacctcttgtactgtaattaacataattaactcttagtacaagaggtaatgatttgcctgtggcaaagccgctagaaatttgcaggcctgcatgcgactcagtcgctaaattttagtgggagatagcggtcgcggggcgagcacgccgcgttagagcatggttaattaatagtatagtcagccagctataacaaactctattttattttacagctaatactaaagccaattagcataatagataggctcctgtgttgattgtatcttattaaccaaataatcaattcctccatacgcatattaatcaaaagtgtgttctattcttgtggctattttatggtgtgatatgaatatgagtagtttgtccatatagtactacgtataaaaagtctttgtcctctcgtcgtctgaatttttcaccaacgagcactgtccgtagatgtacatgctgtccggatgctcgaacatcacaaaaatcataaaagcttcactctatcttagccctgatcatgcccaaaatatccacgctatgcttaatgatctgacaataagaatcgacttaagaatcttaacatagtattgccaaaacaacaaataacaattaatcataaaccaattggaagagggactccgtccagaaagcatatgcatcagcagagaggaattgctggaatcaaaccccaaacccaacgaatcaagcaccggagaagacgagcaaaaaaggcagagaatgagtccagatcgaaacagattcctccttgactaccggcttcacctaccctcggtgagagttgtcatatcgatcagaaataacgcctcaccggatgaatctggagcggggggccagtgatttggcacacagcagagttttcacgatgcgggaaaacggaagagaagaataacgaggctagaggataggcgatttggtggcgcgcggagccatggtggaaatctcgctccgcttgtgacggggaggaagaggaaaagcaggccaagatgaacgcacatgagatccgacggggtagatgccgggctcgcaaaatgagcttgctattgctatgcgcgtctgtatgcgtgctatcactcagcgccgctagaattgtcgaggtttgacttttatcttagtcaaacttcttttcttttagagatgggttttttttaccctgtctctacatctaactggatatatacggctattgaaataggaaatttagcctcgcaaacaacccaatctaaaattcactgctataaaagtttaaactcaggaccatagggtactactcactgcaaccattaggttacatgccctgcttaaagtttgatcaaacttgtaacaaaatatagtaaacattttcaatacaaaataaacattgcatcaaaatatatttaatattaaattttatgaaactaatttgatatcgtaaatgttagtaattttttctataaatttagtcaaatgtaaaaaaataactaaaaaaagtcaaaagacttataatattaaacggggggagtactataattatatcataaccatagcgcaactaaaatatatactatatacaagatgcataccccgcgcattgctgcgggagaattgtgtgataatacaatagatatgagttctaaaattttctttcctacctactttataatttttttcatgtttttatatatttttgtacctttatcaattatccaaaagttataaatgattgggttgtatggtgtgccttttgggggaaagagatgcaatttgcacccttgatgaatcatccaaatactaaaataaattgaggtaatgtgaaaagaaggaatttagacccttgatgaatcatccaaaggctaaaaacaattgagatgatgtggcttcatgagagaagagagaattagcattaactacatttagtgggaatgaactttatagatatataggattaaaacataatacaattttatacgtaagttatatagtttactaatattgttacattgtaattatactatcagtgtcgttaaaatgtaacaatgcgtaattacaatgtagttactaagttacactattactttcactattactttgatatagttacatttgaaagtttttataaaaaaaactttgtgatagtttttttaagcaatttccttagctttatatttattaatttgccaccaaagataaaaggattgttaattttatcccactttagaaaaagtaaagtagcacactatgacggcgtcttgatttttcataaccaccaactggttgaatcgaatgaccgagatcttgttagggcattgcaagctacttagatgcgtgtatttatgtgtcaaatatgcaaagagcaaataattatggctacacctcctacagcgcatagcggcaagcgaatgtctatagcttcagatgagcatagagttaaaaaggcatatgatgagatcacgcatctaatacgggcgtggagtcgtgtcgcgtggacatctgatcttggacgcaggcgaggtgcaggtcatccctgtgaagggccggacaaccaactgggaattcgactcacatagacgtgtacgcgtttttcttacgtgttcactgcgaggccaaacaccatgtatctgcattgttagggcctttacaatacaggtcacgtataggattggcgcaagaggccatcaagatttaagacctagaaaagccacaaaggtccatggtgcatgtagaaaaagtggaacgaagcctcgccctcctaacgcgtctgtagccttatctcccctcgccaagaacaggtgatcaaagaagatcatgcgggctttaatttggtaggcctgcccacaaacgtggcaaagattgacaccgaatctctgacgtgaaaagaccgaactgaataacagctcaccgcattgtaaaggcccttactaatcttagcaagagtttggtagaagttttcaagtaactcttgcactactatgctgagaaaaaaagtagcgatgagctgaactcaataaaaaaaactgacgaactgaataccatcatatgtattctataagcgtaaccgtaaagagaagtcgcacatgagacatatcagttcacatgtcccatgtacgtaaaagggtttaagtattagggcctcattgtaactcaaatttaataataaacacaattataaaagttttaaatgtaaattattattttattgtctttgtttatgttttaggtaggtctgtttgcaagagttgtaaccagggtttcccttaccgccggtaaccgcgcggttaccgcagttaccgagcttaccgcggaggtacggtaatataaataccgcggtaacctccttaaattcaaataaattttaaaaataatttgaattttttataaattttacatggttttgtacggtttttcacggttaccgcgcggtaaccgtgcttaccgccggggcacagtaaccccggccccggcggtttggaaaccctacttatcgttcaactatgacaaaaataaaagcctgttcaactgtttcagctacgagagaaaaaaaaagaacaaaaaaaaaacaaaaagcggaacgggctaaagcagcgtagcaacgggcgccgaggtcagacttccacccagacttccagactccagaggcgagggcttcccaatgggcaacatcgcgagcagcggcggcgctagcccacgtccgccgccgccgcatctcgaagcctatagacacggggtgccgcccccgtactaccacagctaccctcgtccgccccccggcgccgccgcgccgccgccggtgccggtgcctgcgcacgtggagcggcacagggccgtggcggtcagcgtcggcgtcaacgtcaagggggacaccctgcggctggtgcccgacgacgacgacgacgatggccgcagcctactcctcgccttctccttcgacgccgatggccccggaaggtcccgctccttcttctttttcccctctcacctatttataccgggctaagtgggtttcttgattagacgctgtggtaatttcgttgctatagctttgatttaggatctttagatcgtagtaacattggtatactacattactaaaatttctgccagagagctcagcacaaacaaatgttgttgcaatcgtgatgctttcgattgtgtactgctttcttcttctcttttttttttggggtacaaaattggcccatcttgtgtttggcataatgtcgtgattacctgtccaaatgtaagaatgcttcaatgtagaattcaattaaacttagtaccagatcagatgcatactgcttgattcttcttgctaaagcaaatgtttcttacttgaatatatatatactagaaatgtaaaataaaatcgttcacataacttggtattgagtgtgaaaaatgaagttgaagaaagtagcaagaatcaatctataattcttactaagaattagatttgtttaggtagtgacatgggactcaccgtactccagacttgtcagaatcagagcttgatttatcttaatgattttggatgtctactttcattttattgtcaccattgccatgttatagtaattgagattctccaaattcctgctactctcatttctattgtcaccattgccaaatcatattagttgagattctcctaattcctgtgacttctgttactaatcctacatggttcagtctcttctgatgtttaagctatttttacgccctcaaaatgttccatgcttaatagtattttatccttggcacatctttcatcttcccaacaaagattaagacatggtaagatagcactcgtgaagttgtggctgcagaactcataaagatccataccaattatgaaggtctatcataaaatgacttgtgtacttgaaaagagtatcgagttattcatttctactttcaactgatggaacaatgtgtgatctagagcatttaatatccgccaaaaaaaatcatggcttattggattcattctgcatatattgtctgtcctgatgtgcaagatatctaaacttaaggagtatgtggttatttgggcacgtattggtattctccacctaacccatgtattctgaaaggtttaaaagaaatctcctgttcactcttctggcagattgaatggaactaacaaacagaagatgagacattaggagttgtaaccaatccagtttgtgttgcgcatattgagtgtaactctgttttcaaaagttatgccttatgcagaccaggtcatactagatttacaatttgaaactgaactgatcacaacttcatatgtctcttgttccatgttttgtggaattccaatccatgataaacattgaaaggaaaccttctataccttgattaggatgatatcatccttaggtgtatttccaattgcagacttctccaatttggtagtattttatatatgtgcatcatttttttcagaatagcctttcttttttgcagaaagctcaaacttagatgctctttgatttattaatttattgtttgaaaatagagttgtactgtttccaaatttccaattttctgggaccttcacaattagtatggctatctccttgaacctttttaaagaattgaacgtttactggctttccttgttgtcatcacttcttttttttttttgtaagattgtcatgtgttatgtttaactaaaagacctattcatcatgcaaacagcataactgtctgcttctttgcacaagaagataagtgtgccttgaagaccgcaaaggaaaatttgcttcaacctgtgaccgtgccttttaaggaaggtcgaggtcaggagttcaagcaaccaagtgggtcgggaatcgatgtctctcgttttgaggaatctgagctaactaatgttggggaaggtggtgtattccctgtagcattcaaagtacaaatggatgtgtcaggcaaccaagaatcagaaggggcacatgagaccgaacaatcgaaatatcttgttaaatatgctatatttgtgaagaaagacaatgctgaatatggagttcatgttgtgcagcagatcctttgggtaaatggaatcagatatgtcttgcaggaaatatatggtattgggaacacagctgataagaatgctcatgaggatgattccgggaaagaatgtgtggtttgcctttctgaaccaagagatactgctgttcttccatgcaggcatatggtaagttactttcttactaagtattcttgaaagaatcacgattttgccataagacttatctgtttaagcatacatatattattatggagatagagttggaaaaaaaatagttatggattttctcctagcattctttcaacttatcagataattttgaagttgcattcttcgggcattttccatctttgatttgctttaaactggaagagaatatgaaaaggtttggattgtgtctactgctatatggtttggagtgtgccattggaggctggaagagggatagttgaaccgctaagataaaggagtaggatattcgtcaaatcccactttaataataaataaaggcagtcactgtccagcatattaaggaacctgcttagcgggcatagatatttagattaaaacccattttttctttcagtgagtatgccaactatcttgccattttctcttaacttctttcctagttttctatgccaaagttcatggcttatattaaacgtaagaaaaaaaattgctagtgctttactctcttccagaaagtgaaagacagacctttcttaaagcacatcaaaggtctgatatgcagtaacatccactgctccactattaggtattagcacttgcaacccccctggcactgtactgattattgaagcaatgacaataagtttatgtacttctgaatggctgtagcattttgtgcccaaatatttacccttctgttctttttctcagcagctatgcatttgtgctatttcattttttatgccatggtaagaacttcgtgaatagattgcaccatgttaagtagctagggatgatgatagagaaataacgattatatcctttaattttgctgatcagttcagttttatgaaaatcaattaaagatagcatgtgccatttttgcagtgcctgtgcagggagtgtgctcaagttttaaaatatcagaccaacaaatgcccaatatgcaggcaacctgttgagggccttcgcgagatagaggttgataacaaaccgattccccaacaaggatctcagcagttaacagcacctcaataaagtctcatctgattgcaagcaaactacctgtacatgtgtcatgtgtatataaaaggtctgtgctttcgggaaggggaaatcggaagttacctggtagcaacaaagctgtttctgatattttgttaaaggatgaacctactgggatttaattgtctacgtttggaccaccaaactcgacttattacttggaaaagacactattttagattgtatggttcaagccttttgcaggggacaatcgttttcttgttctaatttagttactcatccatcactttgatgtgtttaagagcatacgatgtgttctttctagtggatgcacttattgttctatgatgtcaccaattggaagtttttcctccaactggcgtgtccctgggaagactagccaggcaacattttggtgctacatttaccatgcttaagatcttacgattacaaggttatgtagatcgacaatcctttttgggtcctttttgtggtattgcacgtttgcactgctgataacttgctagtgagagaggtcagaaatgagaacagctggaaatttctagtgagaattgaactgtttctattatagtattgcatatctatataatccttaacgaacacacctgtaaaaaacagtttaggcacaacttagctttgtttcttttttttaggattttggattttggattttcatttgaacgtttcccaagcttctagacgatggatatcgagcaaaattttctataaaactttctggactactctttgaaagcaacttttttccaattttgtagtagttaatttatttgtttataccctcaaattgctacgaagaaatcagataatccatccatccatcaattcagctgtctcaaacaggcctattaatgagtgcatcccgaagaaactggttctctaaacagaccttcacaactataaccttcgtcccaatttaagtgtagtcgtgggtttttgtccaacgtttgattgtccgtcttatttgaaaaatttatgaaaaaattaaaaaaatagtcacacataaaatattgcttatgttttatcatctaatgacaataaaaatactaatcataaaaaaattcaaataagatggacggtcaaacgttaaacataaacggtgtaaaacagcaagtctggagttagtagataaagaagtgtaatcctttaattggataatactctccgttggtcgcctgagccagatgcgaccacctaccgtggcaatacttgtcctccattgtaacgccccggttttcgttcgggattaaaaatcattaaataaagcatttctagaaattaaataaaattgaaagcaaattaatcaagtgaaataatagaggaaattaaaatttcctttaaaaaatcattggccgagaatattttgtaatattatctgtgccttaatgaactctttggaatttcctgtgaattttcggagctcaagaaataattttaacaatacaaagttcattttatcaattaaaataaaaaggaaacaaatataactcccccttcctccttttcgggctcggcccaagtcctcccctccctcggcccgctcggctctctctctccctcaagtctgttctgcctcccccttccaactctctctccctctctccccgacaggtgggacccatggaccctacctgtcatctcctacctccagccaccccacagcaattgccatggccgccgaaaccatcccacgccccgccgccttttccgcgccaccccgcccacctcctccaccccccgcgcgcacgctcgtccgtgggacctcgccgcccacgtccccgctcttctccccctctcgcgctcgcaaaaaccggccgccaactcccccacgatgccacccacgccgccggtggttgccgccccaaatccacctcgccccggcctccccgtcgcccccgagcgctataaaactcctccccgcactcccctcgctcgtttcccccatttacccgagcccgccgtgccctccattgctctccccacgctgctcctgtgcgccgctgctccccggcgatctccagccgcccctcaccaccgctctagccacctccgcactgcgtcgccgccaccgctagcttcgccactccgagctgcacgccgtccgccgctccactccctaatccgccaccgaaaccccaccgccaccacaccacccgaaccgccaccatagcagccgcctccagtcacctctcgccgccgtcccggtccaccccgtgctgcgtctcgccttcctcagcaccgcagcaatcgtgtgcagcccggccgccccttttcattcgccaaaggtcgctggaaccccgcttcctcagcccaaggtgagctccaactcgtgttgtcgccgccggccgttgtttctagccgctccggtcgccctttcacctccctaacccctcctttatcttccttagatcgaggccgagcccgtccgccccttcccgagtgccgcccgtcgccggagctccgtcttgccgtcttcccgaggagccccgccgccgttgttccttgccgccggccgccccttccgccggccgccgctcggtgggcatctcccctccaacccctcgcctccccctgctacctcccggctgtgccgccgcgccggtggtcgccgccccccggccggccggccggccggtgagccaattcccgctcgcccgtggccgcccgattcaccccgggtggatatggcccgtccacgtggccctccccgagccgctcggcgtcgccgcccctgtggcatcacgtcggcaccacctcgtcctccccgtcccgcgtggccaccacgtggtgcgcccgccggcatcgcgcgcgtggaccgagtccaccgtgcgcccatccctttgagccaccgataggtgggacccgcttgtcggtgccacctattccccttggtgacgtcataatccattaataattgcgcaataaatcattaataattatagaaatttatttaaatggctcaaaacttctaaaattcatatctaattcatacgaacttcaaattgggtcattcaacttgcaaaattcatctaaaattgagctctacctgtttgtttactttttatgtactgttttcttggtgtttattagagttttttcctcttttgcgtgccagcgtgtagaatccgtcattttggaagatcgcggtcgcgaggaaaagagttcagaagattgttgtgaagaagcaaggcaagtcacacattcctcttgagcatgttgatcccaattgataaatgttttatcgtttgcaaataaatgtgcatgttttgctaattacataggatcagggtttacctatctgcttgcttgtgccatgtttacttaatatatgtcatttgtcaaccttgggtaataaatcgactagctcatgttacttatgtgacctagctagaactatatgcttagccatgcttaattgccactagctcagttgatggaataattgcagtattagacctttttagtagcagaacgagctgtgtgctcgagacatccggccatgtttcattggccgtaattattcaactaaaatacgactgaatggtgggctgtggatgcatggttttgctagtcgcacccatggcaattaaagatcagttcacgggatgcactggaagacatacaacgcttgccacaggcgggaatgtgtaactgcctgacttgaagtatagctttcatctaactgacgttcccaggcaagggtgggcgtgatggagttgggttggccggggtgttcggttgatcggcttccggattcaccgtggcacgagagggaactgtcggctgccttgcgagaagtgggggtgaaacctgaggtgtggtgcgattggtcagagggagttatatgaagggtcttgtcacaaccactcgacatggtgacgttttcatcatgggtgcatgatgacacggtgacatgccggtggattgtgtcttctgggtacagtcgtatacctctggccagagtaaaactattcgaatagccgtgcccgcggttatgggcgatcgaccacattgaccatgattagtctcacccctaataaatcgacccaatgcactatagttcaggtgggttggttggacatgttcaacgtggtgtagcgttgatcagtggagatctaatttactctcgctttgaatcctcacgttgagcggcaaaatggcatgtggattatattggctttgaggttcatgcatgtggttagttaagtttttggcgttcacagtaatgtcacgtcacgtaggctacggcaatggatataagatctaagtttttcatagtacaagtgactctaggagtagatttaattttatatttcagccccttgatactttttatattagctctctttttaaaaaatttatgtggaggtcctaaatttacaccgaacaccctagaatccagaacaaagcgaggaaggagagtatagagggctcagatctgatcaccataatagaggaaaaggccgacctaaacctattttgtgaacttttgatagttcaacaagtataacttgatgctttatgtttaatacaaaatatctctactaggatttaaggaagtttcatttatttattaggctgcactccacgccgagcgcaagagattcatggaatgatcttaggagtgaaatttagttcacttaagtagagaatctatttaaaaaacataggataggagcgagaaacccatgagttgatcttaaaaatgaagtttaggtgagtttatttacttaatgtagaagaggtaactaggatatgtcaaacattacctgtgaatttttcgctagccccaacagaggacagtcgcggagatatcatgcgagactgataggcacggctctccaccagcccaaacaatagagtgatcgctggaagatggtttgcaattttgcaaccattgcatgcatatgggcaaaaaattctgattccagctcagtggctatgtgaatcaagcagcgtccattatcttctctcattcaactaatagggtacaaaacttgggatggcagtccaccatcatattataattatatgatctacttcgtattctcaatctgccgagttccatcagttcacgcatcatcgacaccagtcatagggtcagcttccttgggctcctcatctccaccatcgttgccctcttcggccagggcatccttcatctgataatccaccttgaaatcgtagtctgcatccatgtcggtcagcacgctgaacttgtttgccttgcgcctcttcttctcggctttcctcttgcgaggatcaagtattccctctgctgtgtacagcttgtcattctgtgtgctcgcgctggccgtcttggctccttcacgctcatttgcatcggacatcgactcatcatggttttcctgcgcaggttcattctgcttcttgccatcctatatcaagcacaagacaagtacattatctaattgcagtgtcatgactcatcgatgatgccaactatggcaatcctattcctagcacaaatgtcatgcaaatcacacccataaagaatagagattattttcaatgggacgaaaaccatagtaatacctctagcatctcttcgtcaatctgcggtggggcattagatggaatctcaatgtgacggaactcctccagtgatttcagaccaccaatatatgatgactcagctttgtaaatttcatcaatgttaaattctttcccagtctctgaaataattactgcatcggagtcgtctacagcatcccttttaggtggtaccgtaaaatagggtattttacctaaaaaataacagtgtcacatgactcagaaacggaataagagtaaagaaaaatcagtacaggaggaatcatcgaccataccctcattccagtcatgaagtacaattcttgcagcagcttcaacatccactataccaccttttttcaatttcccccggagtgtggcaactttctgaaggaaatcgtccactgaagtaaatgttggaaccctgtaaagggatagcagcttctcgtgcgggcatagatcgagaatttcctttactgagaggatgtaaagtgaagaaaaatggaacaagttataatacagtgcacttccagcaacatttaatgcatattgttgaatgagatagtattagtatacacataataaaaacatatatagctaattaaatgaagatttcagcaaaactatctgaatagcaccaaaatgatgcaagctatttttcaacacttaccaggactgattggatcttccatcttctcaactcgtttgcagttgcgaagggccacagatacaccactattggaagatttcagcatcacaacaccaggacaatctagcagcttcaccttcttgtctaactgaacttcttgcattgatctagtaactcctggagtggacccaacattaaccacacgggacctcttcaaactgttaatcagactgctcttgccaacattaggaagaccaacaatacccacagtaattgccagtttgagctgtaacatataaataataaaaattatctaaaagggcaacataaagcagaaaagaaaaaaaaaactcatatgcatcgctacaggtcagagtgtgcaaaatgagaattaaaagctcatgaattccctagcgacggtaccactgtacaaacatgacaaaatgaaagagaactacttggaacaacaaattcaactgtgcccatataacaaattaaggtaggccattcttgagattagaaaattattactacttgatgttatcatcaatgttaatatggtttgcataaagcagtacacagaacaaacggaatggaaattcaatattttcatgccaggtgaggtatcaaaggtactgtttgctaagatggcaattttaacaattactacagattatttcaacaagcagactctaacaacaatccatttacactgcccactgaagttatgatacacatgtgaacgttgatcagttacctcatgactcctggaataattcttgagtaatttgatcaggttctcagcaccaagacaatcactgctttgtgggatattgcttgatttatcaatctttgatgatttccatcccagttttgtcctctgctcttgggtattgcacttaaatgcgacagtaggcatttcctctcttaggtacgtaagccatttctctactgactccttgggaacaagatctggatgccacgaattgaaattgagatgttacaagaaagtagacataacacgagtgaagtccgaactcaaagaaaacttgaattgtacctatcttgttgagaagtagcacaatccgtttactgggatcagccttcctgaccatcttttccatgtcaatgcaacgagtgcccagtggatctctggcatcgagaacctcaagaatgacatcagacgcttcaataactttaacaagctccttgtagaaggctctctctgaatgatctggagatacaaccagcagatttaggaataacgtaactgcaaacagtaagtcagcaaagcatgacaagtaggaacattgaacctcaccttggctcttaaccacgtctaaagaggcattctcctttgctgcatccttctctgcaaactcgctgccctgagcagaagctgcagaggccaaattagcaatgtcctcgtcctcaagcaatccaagctttctcttcctagcctgaacagaagtggtcacaatattctaccattggtcaaacagtacaagcaagatgtataatacaaatgaaactaaataaggtgcagaaatatttaatcctctcttcccagtgcaggtatgtgttactcacacaagtccatgttaaggcactgaatgtgtagtgtttgcatacaacattctaatgaaatctcataaagttcagtgccattcatatgtgcattcaacacacttctgaacagatgtcccaaaatttcacaatcatcgttttttttttacaggaataaaaattagcgccccagacaatgacatatggcatgaaatctacccccaaaaacaccttgcttacagtaacagttacccgttcagttaaaacatctaatccaagaatttcattcaacgactagaatcgccaatcgaaaggaaaccagagaaatcgaccctggcaaaacaactttagcagcagcaaggatagaaagaaagacaaagagggagaaaggcggtgcccggctcaccctttccttgcgcgcctccttcttgagctcgagctcctggagcgcctgcgcgcggcgggcctcgagggccttgagctcctgctccttgaagggccactcgttggggatcccggggtccttctcgaccttcttcctgtggctcttcccttccttcttggcctccttgcgcttcttgcggtggtgctccttcaccttgcggagcaccttgtgcttctgccgcagcgtcacgcgcttgctcttgctcttcttgctcttcttcaccatcttctcctcctcgcgattgctagccgccgccgccgccgccgagggaagaagggaaggaagggccgaggaggggaggaggaggaaagaggaaggaggcgttggagggagatgagctagggttttagctggcggctgcgcgtggttccgctcagtaatgggctgggccgaccgtaaaatcggagggtcgtggtggctattgggctgccacgtaagtacccttctgttacaagaggaaggaactagtccacattgcgtcctcctctttccgtcgagtttaatcggcaactctaaaccgcaatacgagaaatcttcaccccctaacttattaaaatcgttaaaatcagatcctccggcagtatagatggctgttttttttatgactagacgtttacgtggggaaaaaatgagccccacgtgtcatcctcactctactcctccccctttcttctccatctcttatccccttttctctccaactctcgagaggagcaagcagcgcgcaggtgcagcttggagagctgatggatagtgcagttgaggagcgacctaacatggggggtggtgtgcccgcctacgtgtggaccacgatgcccagtgaggggtggggatcgaaggtgagggcgaaaggcgggcggtggggaaggcagccggcgagctcacctaacctttgttaggggcgagtccttggcggggaggtgggacacgatgtcatgcaagtgcacatcggggaggctgctgatgcggttgaagctgccacggctcgctttcaatgcataggtgaggaggctagtgtcaacaagcggtagcaggacgaagtagtgcacgaccatagagatcatgccaatgttggagtccagcatcctagcgtccatctgtccctcggtccgtcgcagtatctcgtcaacggtgaagcccacgagcacatcctcctcattgcgtcgcggttgcgccatggtcgcggcgccaacaagggtttggagcatggtggattgggatctaggattggagagcgtggagtggagtggtggacaaggcctacctcctccccgcctatcccacgtgacagccatcatcgtagccacctaccgaagtagttaatccagcttggtcgtgcagaatcgagcagtaccgacttgcagggcataaaagagagcccctcgacatgtcttggcgtaccctccccatcatcgcggctcctcctcccactcccttgtcgcggactacaacacacaccgagggtctgtgtcgaccttgcccaaaggacgccattgaccggggatgagccccagtcacatgtacggcgcgaagagtgagggcccgcatgaagattagggagcagccatacgggttgaggcagtagtagggagcggcgatacgggttgaggcactggctaggcccaatatgttagtggcccagtcttccccccccctccactttcttccctatctctatccaggcctccaagcgtgcgcccaatagggagaaggatggccggtggtcggtagggagaagggcagcgacgttgggaagataggagagaacaaagagggtgatagggggataaaggagagagagggaagctaggagtaatcgtcatcaacaatgcgacgagggaagcacgagctcggcgaggagagcagggaggtccatggagcatgatatcaccgcgctgctcaaccgccaccaccagcatcaacgagtgacccgcggtcgtgcttggacatggccaccctcccccgttctcgctcctcctccactcccaccgcttctcctcgtggcgctcctccccaatgtccccgttgcgtctgtccttcgcattgtactctcccccaccaatgctccctgttcacctcctccttgctgtccatcttgcaatcgcatccgatagatagataagaaggaagaagatgttgtttcactttcatgtgggtctcatatgtttttctttttaatttttgcttctggtgctacatcaatgtcatgttagccaaaataaccttcaatactgcttttagaaccgtagttatattggttttgaaagataagggacatattatatttggtattgcggttcaatgatgcaattcaagctcataaaggacctaaagtgaacttattctgttacaaaatacaacctccgttttttaatagatgacgccgttgaatttttctcacatgtttgaccattcgtcctattcaaaaaatttatataattataatttattttgttatgagttgttttatcactcatagtactttaagtgtgatttatatcttatatatttgcataaattttttgaataagacgaatggtcaaacatgtgagaaaaagtcaacggcgtcatctattaaaaaacggagggagtaaggccttaattttgattttgttttcaaacacagtaagacgtgcatataactactgtttttgtagcacctgttaaccaatataagcttcaatgaagtattttcttccggtagaaggacctcagagccaatccatcatatattctctatcattagaaaaagggaataactatcaagaaaaagaacgaacaaaattcagcaatgcgcaataaacctaagaccatgtgggacaaaactgaatattacacaaattttcaatcctgatttattagcttcttagcttatttgccactgccaaattttgaattttgaaacttaattttggagttaattttgtagtcttgtcaacgtagtatatttttcactattggcttttaaatcattaacaacacatatatgaaaaagttttaccataaattgttatcttgcttcattcatttttttatggattgtcggcttaaacgatcagaaccaaagcataatagttatatatgttaatcttgacaatcttgacaaagatgaccaatgaaaagataaaggcggcacaccctctactggatgttttagttttttgctgtactcttgcctgggtacattattatgtatttatgtgtagaggatgcagcctgcagatgtatcgttcatcttccattgtcaattcaggcaaatgtctctgttcaccgcatgtgttcaggcgcaagtgatttgtgtttctctgtcaacacgtgttcaggagtactccattctccttattctgccacgcatagaccagcttctttcttgaaaggaaataacagaaattgtaaaacagacagaataatactacttccatcccaaaatctcgattttgagtcagtgaataatttgcaggctccctaaatgatacagtatatatgcttcagtgtggtctcccgttgttctgtcccaggagcatcacaagtaaaatgaaataaattgaacaacagaaaccagggttttgttcctatcaactcagaaaacccttctttctaaaaagttaatgccactaaatacctaaaactcagcatagatttctaaaatctacatacaagcatgtcacatcaacccaatgaacacacaaagctcaacatacaaatatatagtaattatatctacaatttattcatgctacacatgataaatcatcattcacaaatcatttcataatatttcaatccaaataatttcatcatttctccaatatctaacatatatcccgcagtaaaacgtgaggcatcatctaattccttattgattttgtaagcttgcagactattgttaatggaaccagtagcccgtctacataaacgtgagctatataacagggctataagaaaatctacgtactccctccgtcccataatatagtaacctatgcatctgtctagattcgttgtcctataaaatgtctcatccggtcctaggttgctatattatgggacggatggagtatatgaatagctaattgttggatgcacctgaaaattttaagtttccagtcacctaaaatggcacatagctaatcctaaattgcaatgctatacaaatacaatgtgcaattttatttcattttaactgcaacaaggaaggaagcccgcggtgatgcgtgggcattttattttttaataataatgagaatactaaaagtagtattatcttaccatattcatcttataaattcaccataagagatggtaaattttcttataatggtaactaaaatagaagaaaaaatactcatgccgtgaaatagatcatatactttgatatactaaattataatgtctctcaaatttcaaacaaaaatctcttagtccatgcttagatataaactcacctatcaccactacagattattattgtcttgaaagttgggtcccttttcataaatggaattgtattagtaccataaaaagagtctaacacataagtaatacaataaaataatcacgaacacttcacacataattctctatcttatgtccaaatctatctgtagatattcttaagctattcctaccaattaatagggtagtacaattaaaattaaacttgaatgtctctctaacatgtgagaccggctaacacttctaagaaccatgtgaaaaaaacatttgcttgagtaacaatctctcactaacacaggggttagtgggtttcaatatttctttcttgtattatatctgaacttttttaaattttttcccgtgcaatattacatccctaggtagcatgtatgttttttttcagcgaatagcttgtactacgtatgtaagtttaggcggacagatcataagcatacgaacataacaacatttaatctgagtatcgagaggggagaattgattttttgcccgatcttgtatatgtaggtattatgtatgtttttttgggagaatggtgtgtcctacgtatgtatgcattttttcggcttttatccggcgaacaatttgcacgtatttttcttgtcgtcgtacatacacgtatggacatatggatggatgcttttcaattggtgtacaaattaatgtatggattgtgtgtcgtgctaaattgttatatgtatcagatattcagaagatattcagaaggtagctaggcttgtccatcttgctaagaccaactcctacaaaacttctcgtgcataaaaattgttcaaaaagagaagttcacacacacataattgtgtcatacctgcacgtgcagtagattaggagggaggttttttttttcgtcgttgtatacaacctagtacatacacggaagaagattaggagtggtggatttttaaaagatctaatctaatggtctaaaataatgggttcaccgatttaaatgaaaatagagagtttgaatgtttcctgtcacatggcggactaagagcgtttatatagtgccatatggcagtttaggagcgtttatagtatgtttaatggacttttagtatataatagatagatcgacggtaagaaagcagagcaatggataacgtgaggcgccgccgtggtgtggcttcttctcgacctcgtaggagtacttttggtacatatgcacagtttgaaaaataacttagagatcgaaggaaagagaaaactaccagacggccgggtcctacgtagttgtattgtaaaatacagaatgtagggttccattaaacgattatgttatatagacaactaatcaaaattatacggtaataaatatttagtatatatctatcatttattcgagatatttagatgtgtcaatatatatatcattctaatactcttctcaactatccaactgatcaaacgtacactaatcacgtgctggactgctgggtgctagacttaatttgtgttttggtggttgttttttgttcactacaggagataattccgatccgactcgttggttcgtgacagtctcgtcgcctccgtatatacccattaacatatgaataatggaccgtagattcgtacggacagatttttttctttccttttagccattagattagattagatttgttacattagccggtttttaggagagagagattttaacaaatctaatctaatggctaaaaataatggctccatatgtttgcgcataaatcaatggctagatttttttttccagaatttcttatattttctctaatttattagagcgccacatggcatcatgagagcgtttgtagaatgtcacgtggcagcttgagagcatttgtaaaaagtctaatggatttttagtatataatagaatatgttgtacttgtatatggtgttgcttcctttttttttatctaagttttaacacttttacatgtgagtttgtaagattttatgtgttatatttatttcctgcttagttaaaaaattttattcaacctttatgtaaaagaggactttgattttaaatgtatataataattgaagtttctggaacttcggttgcatcaggaagggctaaaactgccaccctgcagtccaccaactacttcactacctagttctggaccaatgatgaggagtagagcagttgcaagtcctactttaggacatgaacaaattggatcacctggtaattctggaccaatgacaaggagtaggaaaactacaagtccaactttgagacatgaacttagatatgaaatagatcaatacttatgttcaatgatgcaacaagatatagcaatgctctgaatttatgcgatggtctgatttttttttatattatacacttattctatgatggtctgaattgatgttgtcctgcacgtgcatcagtactatcagattttccctacagattgtggctaaaaaattactctgcttgatttcttatagtgcaatgccattcaaccctgaaaagtgaacaatgccattatgtttcactgaaattgaacactggaagtgaattcaaccgagtgaaatttacaatcagtacaaaactttcagtacggaccattccttgctaaaaccatcatcaacagaaccacaaaggttgcagaaccagtcatccaaacaagggttaatatatacttcctccgtttcacaatgtaagtcattaacatcaatatgaatgtgggaaatgctaaaatgacttatattgtgaaacggatgagtaactaacaaaaacggctggagtacgcctccgcctccatcatcaccaatactcgtatacaaacattttccaactccagaatcatttaaccaaaaaaaaaattcaatctttggacagaaacatttttctttggtccctgtagccgaaatgaagaccgttcgaaactatataccatacaacagattgatacaatttgaccatatcttgtgcatgaaatttctctcctcatccatgtcagcagaatattgcatatcatgtagacacgagtcctatcttccaaaaaactgtgcccaaagaattccagaacacctcacttctcatcctagcaaaatgtgacgaagaatctacagtaacagccattttgtagccacggccttctctgtccaagaaatgacgtgtgcataaaaacacaaaaaagcttataaaaagaatttaattttacagttactaataaagtagaagaaagatggctagaaacagtaaaatttatttcaacaccatatatcacatcagtaaacggcacctgcgaaaattcaggcttgtataatcaccaaatcttttagctaattgcttggcatgtgttggttctaaactcttctctccatctcagcatctgtgtcaagactccctggtcttgggagacctgcattacagaggagcaaacaggatgagttgttatttgtaacaccaaaaaggaactgctgaaaaaaaagggtgcctccacatggaccttagcatcatctggcagtccctgtgttcatatgaataccaaggaaatgattgaaggatcgaagcaagccaattggaaaagacacatgccattctcctctgcatcatcatgaaccagctgttccattctcagtcatccatggttctcatcctctgtcaggtttatttgctgttggcgatcacatggaagcagctactagcctactattagtgcaaggtttgtttatatactactccctccgtttcacaatgtaagtcattctagtattttccacattcatattgatgttaataaatctagatatgaatgtggaaaatgctagaatgacttacattgtgaaacggaggaagtacatgataattatcaacaaggaatattagcacatcatcaatagtactaatgaaattaagttggttaattaatgataactaaatcactttagtacatacttttccaatttttttctctagcctagtcagttagagctagtattttctagttcatgtcccatctaatccccccaagcaaatactaccatattgggcctccaggatccgggtcatcccattcctttaaccaaacagatagacaaaaccatctcattcacctcagccctcaaaaaaaggattcccctatctttttctacctaagccctaaggttgcattattgttttccaatcatataaccattgaccatcacattagcaatattgtatctagaaagacatagcatgaacacaacacagaagcatcctaccaaatgaaagggcacaaatatattaaagcacagcaagaagcaacctatatgttacaggttgcaatacttctttgagcacaggcccatgacaccactggccagaaaagaagcttggctccagaaaaattgcagtatgcatgacatttcccatttgctctcagggcaacgcctcaagagaaattgacaaccagataatcactgcatcacatgccaaatgccaatgcaacatgcaattttaacctaataactaactgaatgagcacagaggcctcaacattagaaaagatagcatggtttggtttgcaccacagctgcgtggtgtatgaacaccctactagaagagcatacaagagaccagatccttactatctccaggacagtcagcatcaacatttgccaatcagcggccgctccggaacaggaaagtatcaggaacagaagctggatccagctcataaaagccacagagtttgccaccgttttcttttgtcagccggaaagaaggtatcaggtgagaaaaccttatgttttcatttgtaggtatctccagagtgccccttacactgtcaggcttgaacacagctctgtagccatctactcgggtcaaaagtaagacttttgtgctagcttcagtgcagtcagtaatttcaccaattgtgtactcgaaagtatccttgctggaaggaacccaaccaggtgcccaattattgtagatggcccaaatttcccctacttgtggatgaatttcaaagtatcgtttccaaccaacttggctagtttctactaaatgagagaaagcatcattcgtgtctaactttatcctccagttgcggattttaaaagtcccacagctcacaggaatattctgctctaaccacatattctcctgctccagctgagggcagacttcgagccaagtcaaatgcactctgaacggatctgtatcaactttggtcacccaaccatagtactttggaaattgatcaagatcactgtaaagagcccatatctggccacgttcaaacttactatatgatcgatattcttcaaagttatgaaattcagagtttgggtaatcaaaagtactgggggaggaataggcagcactctgttgatgcactggggttcgttcaagggaatgatctttacgtttaccttcgttcatcaaattttctttcagcgcaccttgctcatatccagtgaaatcattaaatccactgttcattgtcttgcagacaggcatgcaagaatcaagagtaaccgatggaaaggctacgtccaagttactaggaagtgatgcagtatctagttcaagaaacccaccagcaacacctaccttctcatctccctttgttctaaaaaatgggatactgtgagagaaccgtagcatttcgcttggtggtataacgaatgatggtttctcctttacttttgcaaagagactcacaaaacctttaatctttaccaaagggccaacagcagcaccagcttccactgtgaaatttgacaagatctccacagcttcatactcataggctctatgcttatctgcatctgagctccactgcatactccaacccttatatagagcccatacctcacccttcctaggatatatttcgtatgagctcctttttctacctttcacccatgacacaatatgagaaaacatgagggcatcttgtgacaccactgtttttcctaagaaaaagttcccacaagccacaggcaattcttcatcagtccatttgtcctcttcctcattctttgcatcatgctccagccaagtgaactgaactctgaagttggttgtatcaatgcgtcttatacgagcataatatcgtggcatgccatcacggtcatcataaagtgcccagatctgatcaactgcaaacatactaacatccctgcacctatcgaagtcaaaaaattctgggtcaggataggaaaagttcccaggaatgccagatttcttctgagcatttgtatcatgtgcaacatctttccttttttcctggtttccttcattgctagtagttcctttctggtggttgtgtgcttcgctggagacatgaggttcacaagcttgtccatcagcacggacaacattatcatcagccactttcttacgacttgagtcaggatttgaaaaccaatctaatatggttcgcctctttttgctaggcgtatcctggatgatgctggcatcagcattttccttcctcctagccgatctccgtggattaggaatattcatcacacctgtctctgctgatgtatttaccctattaccagggttttgtctaccagcaacatctggagtagggcacgatgtcatctttccccctgccttactaccaacatttgctgcagaagatacatgcagtgttgaaaattcaagtcccccttttctgattgactctgtatggttaactgtcccctcaccacctgctctgacactggcactgtttttcatttgttcatcatgttgtcctccattcaccatgggctttgcatctctattcgctgcagaagagaacttcgtagaacagtcctcttgtttgggaacgtcacaatgttgtcctgcacttttggctgcacttgatgagaatacagaaggcacatcctgttcatttagcataactgctcgaaaatcttttttgcagttctgacaacggagtttatgattcagaacattggagtagtactgatatttagttttacagttaacacacattgtccagaatgcttctccagcactgggtggtcgaactgatgatccatatccttccttagcattactagctctatttgcatctgttttctccattggttcagtagcatgcttcggttgagtagcctgcatcggttgtgtactctgctttggctgtgcactctgctgtgtattatgcgttggttgtgcactctgatttcgttttgtagccagcggtggttgtgtacactgttttggttgggcagcctgcgctggttgggcaccctgctttggttgcgtagcctgctttgatgcaattctccatttgatgtcatatgcacgccgttttgttcgatcagacaatgttgactgagcttctgcaactaatttgaaagcagcttcagcgccagcgaaaccgtttttatcagggtgaagcgaaaaagcaagcttgcggaattgctttttaatggttgcttcatccgccattacatccacttggagaactccatagaagtccaatagtccattcatctttgcttctgccgcacaatgtacttcacagacagttaacatctgggatatgttctcaagctctggaaaaatcctttgagctttaagcgcgatccttttggcaccaacaaagtctttgctttccatcttctttgcagcaatatccctggccttgagggcctcttctttgttgcactccatcattcggctcaccaaattgattctagaaaatcacaggccttcttgacataacccacttatactttctttgatgccattttccaaactatctcaaaagagcatatggatcttctctcatatggaaccagagcctatggcttaacaagttctgcaaatttgtaaaaaaaagaaagtaatgtaaatagaaaaccacaggctataggtacaaatgcaaaacagtgaaaatatgcggtcatggtaatttaggggcggaccttacgttgggcatgggggtttacttgaacccccaaaatcttgatttggaaacgaacttctattggttagggcaaagagaaaaaggcttccagatctacaagagaagccaaggttaagggcaaagagagagcgtgtgggtagagataaatgaggaagaggatttccgtaccgggtgccctcaccggcgatgatattggtggaagcagcagcacgtgccccgcgccggcgctcctgctcgcggtcacgggatggaggccggccccgccgctcgcgggatggggatcggcggcgtctcggcgcagcgcaggcggcggacgaagtgggcgaggagccgaggagacgggaggccgaggccgaggggagatcggacatcggactagggagggagcattgcgtaagccagaggtgggacttgggccgacccaggctagcacgtcacagcccattgtaggtaattcgtgccgaagcgtcagggagaataaagtccactttaactctctcaaatatatgtccatctaattcatacttctatactccctccatccaaaatgatcatcatataagtttatacatcaagaccaaagataatttaaatcgcatcaattaatacatcatgcacatattctcccgcaatacatgtatcgattaaaacaccatactaattacaccttagcatgcacacattctcccatgatgcattattccgatgaaattcgtgtccatgtgattatatgatgatcaatttgagaaattttggattccattatatgatgataaatttggaaaggagtgagtatccctcaaccacaaaaccggatataataacaactccaattcttgacaccggttaaaaagactctcagagcagtattggcagtatttgctgacgtggtgtccacgtggtagccccatcactaaataaaataaaaaagagacatatgtcctacatactagcgtcttctcttctcctcctcctcccttcatttatcccttttccccaaccacgacaccaactccggcagtgcggcgccctacatgctaagccatcgctttctccttcttcggtgttcacatgggcgttggtggcgtcagcaatagtagagggagaaatgataagcgtagatgtcgaccaattgacagtctaagagttgatagacgcaaacaaaccagatagctagccaccctggctaacaggttttacattatttggtccataattaactaagcaatgtggtggctagatgaatggatgtaatcttatatatgaattactcaattgaattggtgttatgtaataaactgctttttatattttgttatccatacggagacatataaacataaacaaagaatgtgttgaaatacattcaaaactatatcaaccatcattttatgcatatattagtacaaacaattatagaggagtgtttgggcatatcaaatttatacacgcaattagatatattagtctgaacgagggcatctgggtgagtacgagctgccactctcagtaggagccgagctgtcaagatgctaatgcgaatcgtaacttgtagattttgattcttattctaattgccatgacatgatgccaccaatgtccacctgagctaaagtcagttctcacatctcctggttggcaccccaatttgtaaaatcctggcttcgccaatatgttcatcatacccttacactattagtttccgatggtagaaaagggtctacgtagtacttagaatcacggttttttttaataaaacgaacgatatttttgcgattgcattgtgtacttaaaaaagcttatttcaacgaggaacggacaagagattttcgcttgtttcatccaacccctgtaccgtgcgcaccgtcttgtatgtagcgcacgcgcactgaacaattagagacgtgagacggagcggagaaaagtatgacgattccacgacccgctgcgtcaccccctgaacggcaaagattcatcaaacttctccagcggcaattccaattcggccattcccacaccaaaccaaccaaaaaccaaaaacccactcccacccacttcaccaacccacccccactgattgctgatctctagctgggtcc

SEQ ID NO: 7402 - DNA, 2093 bp, Oryza sativa
  unsure (1)..(2093): unsure at all n locations
cccccacccacccctcccctccacctgggcccgcccgccaccaggctagacccagcctgaccaacccacccccactgcttgccgatcgctcgctcgctcgccggcgaaggacgaggggagagatgacgctcctgtgcgtgccgctggtgtcgcgcacggtggaggcgatgcaggccgacgcggcggcggccgcggccgccggcgccgacctcgtcgagatccggctcgacttcatcgaggggttccgcccgcgggagcacctcccgagcctgctccgtggctgccctctccctgccctcgtcacctaccggtgagatccccctctcctctcgccctctaccccttctctcaggaggcgggctccagattctgcgtccatttcccggtatatccgcagcgcgtgcgcagatgctttcacgtgtgttctcgtgcgcttgcaatgttcgatgcttttcagctgattcctgctttgttttgggtggcgtcgcccccgtttttgggatggattttgggtcaacatctagtcatagccaactgcattttgtgttctccgttagaatcagcttgtttttgacgccgcgccgtttaggccgcccgatcataacaaaaattaacaacaattgagtatccacaaatggtggaggtgaacaattacagataagtccgtggaagatgtgaaaaattgcagaaatgcccctcggcaggtggatatttgcaactttgtgccgttgatccttaatatttgcaagtatattctcgtgaatgtttaatctcagttgattatcgtcgacctttagttcgtcgaggtagtaggggagacatggtgcatggaggaacaggggagacttaattaatccctggcacggagaacggagcagcgattaccgggtgattaattaagtatttactatttttttttcaaaaatggattaatatgattttttaagcaactttcatatagaaatttttttgtaaaaaacgcaccgttaagcagtttgaaaagcgtgcgcgcggaaaacgagaaagggaagttgggaactagaggcaacgaacgcagccttagagggatagattgattattcattgcttatttaaatctcacctacaaacctaacaccatctctaagatacaaacctcatcctcatgtactaccaactatattgacgataggttgtggtgctgaggatagggtaatgtccttggagactgttggctcacaggcaattgttagcaaacttgcaggccgctgcgcaagcaccatgtcaggcatgattgcagccatgtcagtcatgtcaattttttcaacttcagttaaaaatttattagaataaatagagatgctatgttctctgtgaatacgactgctgtgtctgtcatggcttcaatcatgccatttgtcagttattcttttggtcttaacatatattccctctgtcccataatataagggattctagttttttttttgtggagagattaaggatgaatgaaaaagactataatgcccatcattaaatgagggggtatctgttgggggggggggggagcaggaaggtgtttgggggttagattgggtggaaattaagtgagaggtggttgagtggaggaagcagatattttgggacaaagtttgaattcttggatgccttatattatgtgacggaggggatagtgaatttgaagttgaaatctgtacatttcacgttaattttaatacacacactaatgacagttgcatatccaaaagagtgaccacatagcatatgttgcctagaacatggaatatttgttctccaagtggagtccatgtacgcatgctattcatagcataaccatggtttgaaacctaaagccatgtcaagactagatataaacaagttatctggagcggaggcatttattctgtcccaaagagagcacatgacacaattaatctttgactaactattaaattctcagtaccacataaaataaacagaaacaacatcaatattctagaaagctatccaatgttttgattaaatgagtacttgcatnnnnnnnnnnnnnnnnnnnnnnnnnnnnnnnnnnnnnnnnnnnnnnnnnnnnnnnn

SEQ ID NO: 7403 - DNA, 1127 bp, Oryza sativa
  unsure (1)..(1127): unsure at all n locations
cggatttcctatgctagtttgtttcactttgatgagctactgtggcgtggtgtttcttgtgctgtctgtggaaaaagtttgcagctgnaggctttatatagcattggaggctggaacaaaggtatgcatatgctggaacctgggtcctataagctttcttggcagccaagctgcaaatgaggagagagagtcagagagtccccggttgtgccgtgttctgcattttgtgccgtgttgtgcattgatgtcactctcgcttgacctgaaacatggtcatggtcattgtattcctcatcagtttaaatttaacccaaagcaggaaacgtgtactttgaattttgtgtattaccccctgtacatcttgacataagtcgacgttttttttttccttgtctttattgatacaatcatatatacaagctgtttttattttaatcttctggcaacatgctaatcatggcatgcttaggaatgttcctggatagctgcttttgaagaagaagctatttatcagacagtgatagggaagttagttacatggtcgtttcatcaccgtggcaccttcttcagagaaactcaccgattcctatagagctcacatgctttgaccttttctttttcatattgtaaaccttacatcgatttcttagcatgcttgatttgtgacgaagctacactactagtgtggttttttttttgtttgtttgcattggtcggacaagacagaaacgtaagaggagactgcttagagcactaacaatagtagacactatatgtgtatcatgtctatactattaatttaatgacatagatactactgtacaaactatttgcccaatacaacatttcttacgtgtgggaccaaataatacaaactatttgcccaatacaacatttctacgagtgggaccaaataataagatcttcccagtacatcatttctacccagacaagaaatacgagtctctaattatggaccaagactattcactacgccggacaaggtcatctatgaggggcccaaaccctcaccttaaacggtttggtcttggacagtgattagtggtcactgatgacaaaatcacctgtgacggatgaaacacccgtcacagataacccatctttga

SEQ ID NO: 7404 - DNA, 687 bp, Oryza sativa
  unsure (1)..(687): unsure at all n locations
agaggccagatccttactatctccagaacagtcagcatcaacatttgccaatcagcggccgctcggaacaggaaagtatcaggaacagaagctggatccagctcataaaagccacagagtttgccaccgttttcttttgtcagccggaaagaaggtatcaggtgagaaaaccttatgttttcatttgtaggtatctccagagtgccccttacactgtcaggcttgaacacagctctgtagccatctactcgggtcaaaagtaagacttttgtgctagcttcagtgcagtcagtaatttcaccaattgtgtactcgaaagtatccttgctggaaggaacccaaccaggtgcccaattattgtagatggcccaaatttcccctacttgtggatgaatttcaaagtatcgtttccaaccaacttggctagtttctactaaatgagagaaagcatcattcgtgtctaactttatcctccagttgcggattttaaaagtcccacagctcacaggaatattctgctctaaccacatattctcctgctccagctgagggcagacttcgagccaagtcaaatnnnnnnnnnnnnnnnnnnnnnnnnnnnnnnnnnnngtcacccaactatagtgtcttnnnnnnnnnnnnnnnnnnnnnnnnnnnnnnnnnnnnnnnnnnnnnnnnnnnnnnnnn

SEQ ID NO: 7405 - DNA, 817 bp, Oryza sativa
  unsure (1)..(817): unsure at all n locations
nnnnnnnnnnnnnnnnnnnnnnnnnnnnnnnnnnnnnnnagaagaagacagtaaagaggaagaaagctgatggtgacaaagatactgcgtcgcctttcaagaagcactcaattttcttcaaatacttagattactggaaggacctagagattcgacatgcaattcatgctatgcacctcgagaagaacgtgtttgatagcaccattggcacattgctggacatcccgagtaagacgaaggatggattgaagtcacgtaacgaccttgtagatttggccatacggcatgaccttcacccagtagtgctgccaaatgggaagaccgagattcctcctgcttgttactcgttgacacttgaagagaaaaaaaccttctgtaaatgtttacaaggggttagagtgcctactggtttcgcatcgaacatcaggaagctagtatcagtgaaggatttgaccatttctgggatacaatgcacatgactgccataggttgttaacggtattcctaccaattgctataagggcagtcaaaccagtccataccaaggtggttataacaaagttgtgctactttttcaatcgaatttcgcagaaggtatttgatcctctagaattaggtccccttcagacatttgccgtcgagaccgtatgccagcttgagatgtatttccgaccatcatatttagatatgatggagcatttgatcgtcacatcgtccctcatattattgaacttggttccttatacttacatcagatgtgggcctatgagcggtacatgtcgatcctcaaggctatgtacgcaatcgtgctcacccc

SEQ ID NO: 7406 - DNA, 678 bp, Oryza sativa
aaaaccatctttagtcctggtttttattgtaaccgagactattgtggtttttagccgaccgtgtaaagatggtttctccagtagtgatataagattttttttaacctagtcactacctcttgtactgtaattaacataattaactcttagtacaagaggtaatgatttgcctgtggcaaagccgctagaaatttgcaggcctgcatgcgactcagtcgctaaattttagtgggagatagcggtcgcggggcgagcacgccgcgttagagcatggttaattaatagtatagtcagccagctataacaaactctattttattttacagctaatactaaagccaattagcataatagataggctcctgtggtgattgtatcttattaaccaaataatcaattcctccatacgcatattaatcaaaagtgtgttctattcttgtggctattttatggggtgatatgaatatgagtagtttgtccatatagtactacgtataaaaagtctttgtcctctcgtcgtctgaatttttcaccaaacgagcactgtccgtagatgtacatgctgtccggatgctcgaacatcacaaaaatcataaaagctttactctatcttagccctgatcatgcccaaataatcacgctatgcttaatgatctgacaataagaatcgactaagaa

SEQ ID NO: 7407 - DNA, 762 bp, Oryza sativa
  unsure (1)..(762): unsure at all n locations
nnnnnnnnnnnnnnnnnnnnnnnnnnnnnnnnnnnnnnnnnnnnnnntaacacaatgtatagcgctgggaattaaaatagccaagatagcaagggtgtgtgtttataaagaaagacgtcgtaatacccgatccactgaaaaaaaacattatttagttatattcgtaaattgaataacaaaaattccaaacttacatgatagaacgaaatgactaacaattacaagatgacaaaatgccttcttccttttcagccaaacaaggaaataaaataaactaaaccactaaatcaatgaacaaaataaacaaatttccgcctgcttgtgtttgcattttccttgaaccacggtcgttagcactctggcatgtttggaggacgaggtagcatctgagcctgcggcgtcttgccatccttcacgatgaacatagtgtccatcccccacaccacgtgacgatcaaaatggcaatgcatgaaccacacacctgatcaatgaacaatcaaaataaacacaaaaagaatatttaaaactgtacatgaagagctataatccgaaattaatctgaataattgatctcacctggattgtctgcttcgaagcggattgcggcccagctggacttgggcacggagacagtgttctggaatggtgggtcgatgagggtgtaagtggcttggttcctgcgctcgtcgaaggttccgaccctcgtccacgacgtaaaaagtgaaagccgtgcaggtgcataaggtgggtctcgatggacaa

SEQ ID NO: 7408 - DNA, 724 bp, Oryza sativa
  unsure (1)..(724): unsure at all n locations
nnnnnnnnnnnnnnnnnnnnnnnnnnnnnnnatattatatagagcaagggtgagtacgggagtactcagcaagctaggggaaataagtgtttaatgcaggcttcaaggaaaggctgttgttttcgtaattgattttatttgaactcttttctaaaaacatctaggtgagtgcttctcaaacgacacggttgagacagtgcgtcccgtccggtcggagtatgtgcaatgtatcaatctttagatcttaaaacaaggttggcacccggccaacagcttttcaaacggccacccgggcctagctgatcccgtcagctgctgatttttcaaacatcgaaccctttttcacaacagtaatttcacaagcagttgtcaaacaaaactacgctaggaatcacctcacatccgcccatgaccgtgggcacggctgttcgaacagtttgttaacctctgcagagggggtacactttacccacacgacattactaatccggatcacccagcccgtggggatcagccacgtcgggagacctccaagctttcatgacaaggcatttccaaagccgacacaggcttaccatatgccgacgagaggggtcccagaccaacaacaggttaggtcccagaccatactgtgccaggaagcctagggggtcctctccgacaccaccccggcgaatccacatgtctctcggcatcatggctcccctgataagctagttactca

SEQ ID NO: 7409 - DNA, 10766 bp, Oryza sativa
tgctggatgtgcatgcaacagctggcccaagtcaacttaatcggttgatgtaagaaagaatgtttcttttacacaaaaaggaaattatataagcaaagcaggtatctcgagaaattattaatttgtctagcttgttcaactctatttcataagtaagtagaaccgatctccatagcttggcgtttagattagcttatgaattaggttgggtttttttaggacggaaggagtagttccttatgtcggtagaacatgtcgtttggggctttctgcaaaggtccagaaaaaagactgaagttttacctcattctcagtataacgactacgttcagtaaagaagcagtatcatttcccttaatttgatacaatatcaagatgtctcaataatcattactatcaaaatcattatgcaccttgtatgcatatacagatactcttgtactgtactagatttatttttgacctgaagaagcaggacttgatgattgttagcatcgttgttggtcaatggctattagtagtagctatgactgtgtttagtaggtcttggattccatattcagaacgcggaggataatatgtggtcatctggacacgctattgcaattgcaggcattgatatctgaagcgcgttgaagtggagtgccctctagctccctccctgcttgctgatgccgcagttcgtacgtgagttttggttaacgtttgagtaaattaagataagcacccgtgttaagtctcaccgaataaactgaataagaagaagaaggcacatccgatcctatcacctatggcgatgtttgttcaatacttgagtccttttttttagataaatacagtacttcggtctggtgtattttgtggtgcaatttaactccataaattactttcagaaatgtgcagacctagcaatgtaatttcaaggtctagtaatgtaaatgagtgaaagaaaacatgaagaaaatgaaagctgctagggtttgctggcaagaaagagaggattgagaaccaaaactcgtcaaaacaaacacaagtgaaatgatttggttccactaatttcgtgtattattaattgacagttttgtgcgaaggaaaaaaatacaaaggggttttctacacaattctagatgcaattttttaatcctacaaaatatgccatgagtacaaggtatgctcatagatagttagatggataaatgactctttttatttacattagtaatttaaatgtgtatttttaaagtaaagtgacttgtctaaataagctggattaccctttatacattttactttaatctctttgtctcctttatcttgcagagactgtaaattcatgaggtgatgagattattactgcaaattggatatggagaagttgttctttttttcttgtgaaagagcgagaagttgagactgagaagagcagccagcaatggacacaggaaatgggagcaagaatcttgctatatgtacgaccgagccgtacgatttgtttccgaccgagtcatgcaaccaatcactgaaattatgcttatacatacaccagtccaatggatgggtcggacgtatagcaatttcgtgggagcaaatagggatcagtagtactgtagtagtagtagattcgcttgccgtcactctcgtcccgtttgccgctgcactgcactgttgccctcggccgctggctgcctggattagtggtggtgacccaaaagtcaagaaaagaaaaaacaagttgcacttgcagttttgcggctcacttccccttctccttccccttccgtgtgcatcccggcttcctctagctccgccctcgacgccaaccccaccaatccgccgccttcatgccctccccttcctccccggcctgagattagcttcgccgccgcgcccaatcgccccgccctgctgctccccgccgccgattccgtcccccgtccaccgccatggatcgcagcagcagcagcagcagcaacagcaacccgcatctcggggtcaacaagctcggccgcaacatccgcaaggccacgccaccgccgccgcagccgcagccgccgtcacgcccgccgcagccgcagccgcaggtctacaacatcagcaagaaccagttccgcgacatagtccagcagctcaccgcggggaccccctccccgcctccgccgccgcagccacagcaccagcaccacccgcaccgcccgctgccgccgcagcaccagcagcccaagcccccatccatgcgccttcagaagatccgcccgcctcccatctccacccccgtcgcgcggccccctcccgtccacaaccaccagatccccaaccctaaccacaaccccgccttccaccgcccaccgccgccgcagcccatgcccatgcctatgcctggtccccccgtctgggctgactcaccggtcaccgcctacatgcgcatcctcgagaactccctcttcagcgccaccccgccaggcgccgccgccgccgctgccgctgccgccgctgctgctacgggacaacaggcccctccgcaccaccctcatcccccacccccgccgccggtgccgtcgccagggatactcccctcgccgagcggctttctcaacctgctctcgcccacgcccaggtcgccctacccgctgctatcgccgggcttccagcacccggggccactcacgcccaacttccccgcgctgtcgccgctgccgggcactgggatcctgggtccagggcccatggctccgccgtcgcctggcctctggttcccgcagtcgccgtcagggctgctctcgccctccgggttcttgccaattctgagcccaaggtggagagagatgtagtgcacatcgctcgccgcagcgcagcacaaagctcccgtgaaggccacagccgggtaacatttgacgctagggttgtagctactgtgaggtgaattggtcgctgccccggagatgggcgcaggtgggttgcagcttcggacaccactatttgttgctctcacttactgcttgtgtgattagtcagtcattatatcagtcagtctataaggtggttgctcatatatttgtaattgtataactgggaaagtttttaattcattcacttctcttagctgcaaaaacctggacagcaaaaactgggcatgttgtagtttagactcttgagtgattaggcttgaaacatgtaattgtaaaactttagttcattaaagattagccctttctcactgttattttgcttacgagtgatgtttggtttacctactcttgagcagaatgtttgccctacctttttctttcctagggggaagctaacttttagacatcagcttgacaggagatcagcaactctgtcttatttgtaccaacacctatcagatgagagttgaggtttagtacatcattgttatcgctatcactttttgagcgcttgccagatatactcatatatctttacagtaatatggaattaatattccttatccctaagtgtgtgatgtatatctttacattgtgatagataccgcagcaatgttactttcgaatttgggaaatgccacaatgtgaatcatgctagtcttttcatgcatccatggagcttgataagcttggttagttggttgcatatccatggttgaaaagtattggttactggtttctgccagggatatatatacctttttggtcccagttattagcatccaaaaatgtccatatacctttttgtacgaatggggatacactgatatactctttggctcttgtatgctactgattcattttcttgtgtacctacaatgtgtgatggacccaaaagttatgcaacacactaccaataatatatcctctgattgaaactttcaatgtgcaaaaaaaaaaattctagataaatttgatatttcttgaaatggtgtggttgatgtgtattattctgtgcatcacagaaatgctgttgcttttgcaagtgagggttcctgggttatcttaattttcttctaggttctagccttttgagttatatggcttattatagtctgctattcctctgttctaggattaatttgacatctccttgtgaatcctggccttgtaatgataaggtagggaataacttaagggtggttcgtgttgttctctatatataggcaatcagtattctttgtgcacctcatacctttgtaagttaaagagtattattgcaatcattatcaaattttgtaagttaaagagtattattgctatcattatcaaatttcatggtaatggcatgatagtttttctgaaaaggaacaaggtgtatgaccatgccatgcttgcttgtcgaagctagggcagcttccagaaagcaataccgttgctacattgtggtattgttgcataatactttcaaggatgaaaatttgaatctctggatggctttcttttacagcttttggtcccttatactccggattcagggaatctcatgctgcacataagtaacctttccaattctctttacctgttctaatgcaatactggtatttctccacttattttgaagaaattaaagacattgcatttgccatatcaactacaccattgcaccatactttcctgctgtttctggtctgtatccaagcatatttgcttcagggtaacaagttaaataccagggtgacacgagtgacaagtaattagccagctgtaactctagtgtttttgaaggcttgtgttggttagcaggcgtgccaatcatgccggatagcttagaagcgttacactgtctttgtattcgtgaagataaatttggcagacgtggtacaattttttttaataaaaaatgtaaagcagtactagctgtttgcctcgtcgtagaagtagaagggatatattcatttggtgatgcggtatttgtgtaagcaaatggatgttgctaatgcttggcgtgtccgtgtggagaagaagaataaataatccttgcatagctttccggggtcagccgaaaatatgggcaattacaggacgtaagacatttctgtggtcaagtaaatgacgtggcaaattccagtttactttaagggacatatatttgcgtgggggccgtggacggctgacgtggaaatgggccagcaacctttatttgtagtgcttcattatattgcttgctgattctggatctggtcaaatcaaatctggatcgaattcttcacattcacaggttagagcgtactgcgtgtggcgagcagattaaccctctgttgatctggctggcaccacttgactggctaagctaaaatgctcttcttatacaaagtggctgtcaccatcactcatgtaccttgtttttcattttctttgtaagtattttttttggtcactttgttcttgtgggatataatcggcgtgttctttgcaatttgcaaaagaaaagcggggagaatatggcaagaggcaggcacagcacatatactagagaagatgatgattatgatagtgatgtgcttccagtccacaaaccggcctctatccgagctggtggagcgcctgctggtagcctggtagtatgttgtttgtttggcaacccacaattatcaataatacaagtatgtactccttttgccttgactaaacgagacatttcttatacaacgaatctggacatgtaagacatttctgtattctaattattttgggagagagggagtatctatctacatattgctactgctaagctattactactaggagtactccagaatctgatgaagacgattaatccaatccatcctgcaggctgcaggaggacaggagtggagggagacggaccaccacccatgtatctgcatctgtatcattcccagtggcccagatctatcgatatgataatgatgatgatgatgatgatgggaaagacaaattaattattgacttttcaaagcacaccctcatccgcctcgctgaaatctttgaccaggacgacgactactggagcctgcagccgcctgatgcatccaatccaacggtaacaaactgggggacctcttttcttatcttctcttcccttctgttattatagtactagtatactccatgatgaatatcaacggttttagatttcaattctgctagcatgtccaactatcatgcctacatactgagggagtagatagtactttttttttttttgaaaggagtgggagtagatagtactagcagctgtgatatttatttaacagcaaaatgggtgatttctggattcagagtttcagacatttcatatggatacatgttgcttctgtacgtttatggttcggtgacaaaatcactcaatgggtacaaattaacgagcctaacactagtaccaaaaaccaataacctgaacatatatggagtagttgcgaggaaattaaagaacgggttgttagcatagggtgtacatggaattcgagtttaagatactagtttggcatggctgttcaacttggtgaaatgagctttcttcttgagcaggctcccgaatttcttcagcaaagccttcttcttcttatgctggttgtgctgctccttgttgaaagacgacgtcggcccatgaatcagcggtccattcatctgctctacagctgcatcgtctccctgcgactcgatctcctcatcgtcgctcgactcattatcatcgtcgtccctatgcttgcttatgtcatcttctatgatcttgctgttctcaagagtcttcacctccattgctaaagcctcctcctttccatgcttcactatcacctgctgctgctgctgcttcatgatcaccgtctccacttcgacgtgcttaatctcatcctcttgggttctcctgttgctgctgttcacatcatctcgcacattgtccatgggcgagcagatcatcttccggaacatgttgtgctgcttctctgggctcctgatagccgccactccattagccgagtactctcctgctagcttcctagctgtggaggcctctgcaaccagtgaagagagctcatcgatcttcgcttgcgcagcggcctctctcgtccgcaggccgtcgtactctcgtgcaatgctcagtagctcctcctccttctccgcaagcgtctccttcaaccttaggctgctgattttctcttcttcggcggtcaggttggcctcggtcatcttggactcgagcagcctcagcttggcctgcagctgagccttgtcatccttggcagcatttgcttcttgctctgctgctttcagtgatcccagcaacttgtccatttccagcttcatcagtagtaccttggatttctctgtgccttttgccgcctcttcttcttcggctttcttcgcagttgcctctgctagtagctttgagagctcgttggcctttgccaaggcagctgtctctctgagacgaaggtcagtgacctcatcattcagagcaagcacttccttctcctttcttgacacaaggtccttgaggcctactgtgctctcggactcatcagctgtttgttgaacgccagtagatgagatgctactaccttctgaattggtgagttcagattgtttcagtttatcaagcagctgggttctctctgccttgagctcctgcacttgcttctctgcagctccaagtgacaccattagactgctcatctctgacttgatagagctcatttcttcttctgatctcctgatcatttctacaaacccggcctctttcgatgcccattcgtcgttggaaatcttggcttctgaacccagcttctcaactgtcttgctgatgcattcaacctcgctcttggattcatcaagcattagctggtacctgtcctgtgcattcttcatctctgccttgagctcggatatctgaagctgtgcactgtccagctctgtctgttttgccagtacacgttccttggcttctcttgcttccgatgacacttcgcgcagcgcagccgctaaatcttcgacggccttcttggccttatccctctcatctctggcaccatcgagctcctgctcaatcctgatcttgtcttgagacagcaggctgatctgcgagttcaccgtcttctcgttggtgacaacctgctgatgtgcttcgttgagcagcttatgttgagaggtcaagcgatcaatggtggcctgcagctgatgcgactccttggttgcaacgtcgaggcgcctgttggtctccaagaagcactccttgtactcgcgcgcttccttctccaaggatgacaccttctctttgagctggacgacctgggattgctcgtgctgcagcatggatttgcattcgtcgaagctgctcgtcagtgactggagcgagtcctcgttggatttgttgagagaggagagttcgtggaggcgagcttgaagcgactctgccttggtcttccactcctgggcggcgaggttggcatcggcctctgccctcttggcgtaggcgatgtcaaccttgaggccatggagaagctgctctgctctgcccacgtcctccttccgagacgcctctgcgttctggagctcggctcgtagcccggaggcctcggactccagcttggcgacgatcgccgtggcctcctctgctttcgtctccagctccgactggaggcgggacacctccgccgccagggtcgccgccttgtcggcgttggcgtcggcgatctgcctggccgtgttcgtggcctcgacggccagtgccagctcgtccttgaccctgccgagctcggcggcgagctcggcgcggcgcaggtcgatggcgtggcacctggcgttccagtcgcgttctttcgtctgcgccaggtcgatggcgagctgctcacgctcgatggacttgaagcgctcgaggtcgagggcctcctcggcggcgctctgagcggcgtgggcgtcatcggcgaggcggcgggcgagggagaggtcgtggaggagctgggccttgtccctgtcgatgacggccaggtgttcccgcgcgttcttgaggtcctcctgcaccgcgttcagctgcgcctgcagcagctgctccgccgccgacgccgccgcgggcctcgcattcgctccgcgcgctttctgcattctcttcgatccaccacatatcaaccgatcaatctaagaaatctataaaaactgaattcgttgatcgatcgatgagaatgcatttgatccaagttagttggggaaacgtacatcgggagttgtggcccgggatgccttgaaggatcgtcgttctggcttgggtatgtccatggaagatttgtcgagcagcgcattcgcattcgcatgcgcattgttggaggtggaagcagctgatgatggcctgacctgctgcagcctagcaactctaggcaccgatgaggaagccctgcagacgatttagctttgatcaccatctatccatcttgttactccaattaagagaatcaaatactagacatgaatacatatctgacgactgactattgatgcagcagcagcagtaataaagctagtattagatgccttaaaattaacacagtgcaaatgcaatgcagggagatgcacacatacttgggcttggatgcttgctgcattttgttggccggccggagcgtacagttttaagttgagagatggagcatgctgcaatgcacacagacaaatgatctctcgtcctatttgttagtatgagctactcctatatgatagtatcgatccatcgatgatatatccaggtccagtatggcaacaatggacgtgctgggctgtttcgtcccttaataattatggcatgcagaccactactctaatgttatacgcatgttgagctggtgatgatcgatacgatcagtgcttttgcctgacgttgatgcccaacactaaacacgattacatcatactctttaactcatggccccatgtttgacacacgtactattcttcttcaaggttttattttgcttgatgatttcttatttaaaataatggcatgccaacacaaacctgaattctaaactctaaaactaaggaattttgtggcttccaagttatggcaactttgaggaataaaaaaaatatagttgttgatgttttatatgtgaggtgtatgaataaatgcagttgcataagatttttgtctttcaacttgggccttattatggtccatttgatcactcagcctgtcgaaatacagctagtcgccccaattgtcttattatcaaagacaccaccaccattagtgaagtgtttgagagcacaagcaactatccagctccaaattaaggttcttatatattactgaatgtgatatttttgtgtccccaaattttggatccataccaagtgtataatataaaacggtatttcttgactataacagatgatttttttttgacaccaacagatgattcgttggttgacagtagtaccaacacagatgcaagtaaaacatgaatctgaattctgaagttgtccgttcaaaaaaaaaaaaaagaattctgaagttgtcgaggaaggagacaaaaaagtgtaagtttacggagtttgataactgggccattggaccgttcgaaaaagataagtgggccattggtatgaggcccagcagataggcataaggcgaggccagcccatggggcagtattcctttctttcaacttttggcagagtccatgcttagtggctaagctaaagcagaggaggacgacagacaaactcaagtgaagactggagatttctttctttctttcattcctttcctcctgcgagtgcgagtgcgatccggggcaaggcaaatccgattccgagctcagaggc

SEQ ID NO: 7410 - DNA, 4815 bp, Oryza sativa
  unsure (1)..(4815): unsure at all n locations
nnnnnnnnnnnnnnnnnnnnnnnnnnnnnnnnnnnnnnnnnnnnnnnnnnnnnnnnntccggggcaaggcaaatccgattccgagctcagaggcatcaggcgtcgagttcgtcgatcgatcgctgcagagaagcagagagagatcgagagagatgtgggtggagattctgtgcgggctgttggcgtacaagatcatccgccgcgtcttcttcgccgactccgacgaccccgcgcacctcgccgacctcgattccgcccactccgacctctgcttcgccctcgcctccaggttccgtctcccgccccctcccctaatcctcccccgatgccctaaatcccctatctccctccctccaggctcgagaagctctactccgcccgctgcttcgtcggcctccgcatccccgaccccgacgccggcgagcgccagcatgtcgacctcgtcctccttaccaacaggtacgtccttcctttcgtccccccgtcttccgccccattagtacctctaccctacatcccctgcttattacagatttcttcaattctatgtacggatttgtaccacctctctactgcacctcacaagttcacaacactagaatcgaccaatccacactggccttcactgtaatttgcataccgcactacaattcatggatcattaatgtgtgcgtttgtatcatccatgttcaattacttgtggggatattgctttgtgcaaccaacttctcaccttctttcctcaacagggaggtcatggtagtggctatccacaacatttctggttttgttgaggtcgataaggatggcaactggacttgccccagtgataagaagaacaagcatggtgttatcccaaacccggtatgtcatttatttccttcactgcctcattatgacccattgccattgcctcttgcagtaaggcaccatgtatattgcaactcttgttttcattcggtgctatactcttgggtgaaaaaacaaaaaacaaaggcaacatacataattaggctccgtttgacattttggtagattatggtcatcttgcttggtgcaacttcttttagacatttcagcgttcggcaaatttcttttctctcgatctttgttgcagatgataactattatgttccgaaaatttggaatagttgtgagaaacataacagttgatggcatatttttctaaccttaagtttatataattaaaaggaactgtaccgattataaatttccatttccacagcaacttcaaagtaagttataatgatgctaactgtcattggtcagtgaggcttacaacaaactctaacctgtgtacagattctgtcttgtgacgaaaactcttcatgttgaattcttctgtcagtaaactttatgctgcttagtcccttactcccttgctattattgtcttccaaaccataaacatatgtgcatatcaggtcggaatctgatttgggattttgagtgtttgagcgtgcacagttgatagcccttctcatgttgagcattttgttttgctaattgtttcttacattttgttctgtaggtactgcaagtcaatagactggctgccaatcttcaatcgtacttggagaagaggggagcaaaactgcctgatggtcatataactggaaagattgtactgccaaatcccaactgcaggttagttcttcatattgagctatgttctttgtgatcgtacttgcagaatttttctttctgttttttgtttgtctttttattttttaagttttaactatctaacaagtgctccaccaggccttcctatgccatcactcttcaaccagaagttatcttgtacgatcaatggaaagatcttaaagcagattccaaaggtggactttcaacatggattaaaggtgcattcagtggaagcaaaggtgacatgcaagattcgttactccaaaatctacatttcattctcagcacgtcgcctatgtgggacaggtaaagaacatggccatgaacacttaaagcgaacagccaagaagcaatctaaaatttattccgataatcgaatcgcagcctatcacagaacatccgttacctgttagttctgcacaaagatgtagaggctgaggtcaaacttttatagttgatatttccttgtgtaggttggaactcaaaggggacaggaatattcttggtgaattcattgaattcaaaggcaggcacgatgatattcaggccttgaaatgtctgaagagatcaaaagtttgccgattcatagtccagaaatcaactctgtttggaggttttggtaacttttctgcactgtaccttcttgttattctgtttgcgaagcactcctgtgaacgtacatgggtcgaataatactctaaggttgtcagaaaaatgcatttgtttcctggaagctatgctagtacaaaatgaaataagaaatgagaatagatcaactgatatgcacggaaattgcttattgatgtcttgcactaattcatatttgtaaaataaaaggtgatgtcttgcactaattcatatttgtaaaataaaaggtaaattatataattcagtagcagtagatgattctgttgtcataaataaatgagataattagcttgattgacttgctacatttaccttacctggtcgttttgttattgcattgcaggtcggtcaagagtgcaaatattgtattcaccacgagattatcgtgctgaaggaacttcatcctctgaatggaaagagatatcagtgaaacaatatacagaaattctttttcagccattgcactcgaaaaaagttaagaagttcaagctgtcaagtgttgcttctgtgacactgagtgcctagtgagttgaaattttatccacggggtacttcctgttgcagtagtatatagagtaccttcctggcttctgtatgtgctcctcagttaaagtttgtcttgttgtttctgtacaccaacctgtacttactttaagatgtcagttagcatgaaattagaaaaaaatgaatgatttgaatatgcctcttaatcgttgatatttagtttcatatctgtcactggaagcggagtccctatcccttcacagtattgctggtagggattgtcggtctagtttattttgttctttcttcatctatgcgctaaagatgtgagtggtcattttctcttctccggacccacctcattgattcacaagatggacctggaacatttccttgctggccatgtgcttttagtctatgaattcgtatgcatcaagaaaatcgtgtacaaattgtcaaggagttgtgttgttttgggactaagggcagaaagataagagaaatcgtgaactgtaatacatattgtcaacgagtgatgttgtgttgcgactcaagagagggcagagagataggagggacgtttacaatgctatctgtatctgactgactagggtctccgtcagatgtcaaacatgattttattattattatttcccatggtttttgtttaaaggttggtgatcttgacctctttggatagggtatttgatgtttgtcaaagttgtggttaaaccatgataatggatggatacattaaaactgatgtgcaactatatctttctcgtcccttcaacatgactacatcacaaaatggctttgcatagagagttaacacagctgcaaatatattttcctagtgtttgatcacctagggattttgtttgttggtatataagtaatcattgaaatgatcttaccctctgtaagaatggaatacatgtggcagcttggccatgtacaacatgtacatttgaccaaaccaaatttccctccctttagaggagaaagaataaaagaaatagaagaagatacaagaggagtagtacatgtctagttgcacgtgtgatatataaaataaaggaaggcaaatcccctagtttaatttaatttatgtccccgtatacgccactggtgaagtccagcatgagtttgttgagcttctttgtgtggatcctctgtgggatcaccttgagctcatcactgcaatttgcaaacaaataaaaaggtccatattaatcaattgatactaattcatattaattaattaattaatctaatctaaatgacgaagaagaggaagacgatgaaggaacctcggcggcgcagggggtcgcggcgcggcggcggaggaaatgagcatctgggcgagcttggcggcgtcctccgggcggcagatggcgttgttgaagcagaggtagcgtccgtaggcggtggggcactcgtaggcggcgatgtgggcgtcggcgaggaagtcgacgtcgacggtgacgaggacgccgtggtcgtacatgtcgggtgcacccttgaggtaagggtggccggcggtgaggccggggccggtgagcaggccggcgttgatggccaccatgtctactcctctgtccattgccagggcccacgccgtcctctccgatagcgtcttggccagagcgtgccacagctgcaattgatttaaacacaatgtcactctcactcactgtgcaattcttcttcttcctaacacaattcatcaataagctataatccgctacttggatggctgtcaatttcatgatccaatgaacaagtaaattattaaaggagtctgatactacctctttttttttaagagacaatccattatatgccactgagtttgtcatagctctacgatttgccactgactttgtcacgttctataatataccatcgacttttacttaacttctatgatttaccattgccgtccagttagtctccgttagtactgtacaattttgtccaaatgaccaaaata

SEQ ID NO: 7411 - DNA, 1851 bp, Oryza sativa
  unsure (1)..(1851): unsure at all n locations
ggcatacaatggattatctctttttttatgtaggaatatcgtatctagtaaccaaaggagtaggtgattataataatgaagagaagcagaaaaagggtgggctgggatacgtgtgatcgttttccgtaggtgtcctaatcccaacagctcaagagtcgcactcattcattcgacgtgcatgcgtatgcgtatgcgtgtccatcctcttctcttcttcttcttggcgcagccacacactctcagctggtttgggaatgaaagaggaccttttgttgcggtcaagacttgccaattcttctcttggacacctggattgtactccacttatcaggcgaagcaagagttgacatattcagaagccacccacactagctagtagtagcagcttgttgttgcttttactctcaagggtttggtttggtttggtttgttgttgaacctgctgctttgcatgcttgcttctagataggctttgctattagtgtttgcgatacaaagagggagggaggttggtaagagggaaagccttgatgtttaagatgaccctatttatatcggtgatctttgtgtgagcgaaattgaattgcttgcacacttttgtactactaatacaagcactaggaggattggtggcgaaaagggaagtgattaaatattaaggtgtagtcactcatgtactagtggctctggtgatggcgaaaggtaccggccgccagccacccagccaggccatatatggttgagctgagtagaattgaccggccatatggtatagtacaagtatgtactatctccgttctaaaatccgtgcccaacatttgaccgtccgtcttatttgaaaaatttatgaaaaatttaaaaatatttagtcacacataaagtactagtcatgttttatcatctaatagcaataaaaatactaatcatataaaattttcaaataagacgaacggtcaaacgttaaacgtgaatagtgtaaaactgcacttattttgggacggagggagtagtgtagtactccctctgtcccatgatataaggaattttaagtttttacttgtattatttgaccacttgtcttattcaaaaaaaattgtgcaaatataaaaaacgaaaagttgtgcttaaaatactttggataataaagtaagtcacaaaaaaataaataataattccaaattttttttgaataagacgagtgatcagagagtgcaaacaaaaactcaaaatttcttatattatgggacggagggagtatattgatgagtagagtaacctccgtacttgtaaaggaaaatcgtttttgacagcgacatggtctccaaaacacaactttgacttcttatttctataaaaatatttattgaaagtgatatatgtatactttgatgaaagtatttttcaagacaaatctattcatataatttttatattttcaacctcaacaaactgagagttattcatgatttatatttgtaaggtttgacttaaattttgttctaaacgattttttttatgagtatagtgtagtactcggtaacatttgttgttgttgggtggtgcatgcaataactagtttgttcagctacttggaccagcgctactgccgtaccaatattactaatttgccattgcgttatcaatgagcggtgtactgctgtgccactagttgatcgaatcgatcagtgacgacacgcatatatgatagaatataataataaaaggatcggcatgatgcgaatcaagtgaattgcagattttgagtggaataataatacagtaatactaataaagaannnnnnnnnnnnnnnnnnnnnnnnnnnnnnnnnnnnnnnnnnnnnnnnnnnnnnn

SEQ ID NO: 7412 - DNA, 1380 bp, Oryza sativa
ttatataatttcctttttgtgtaaaagaaacattctttcttacatcaaccgattaagttgacttgggccagctgttgcatgcacatccagcaaattattccatgtcttcttctgaactttttttttttttgagaaacgtcttcttctgaactcaacatttttttccttgcgataacaccgaacttgtggaaaactgcaggaataacaagcttttgtgaagacatagtagggtttatttatgaacaggaaatttgtgaagacgtaattagcagggaaactaagctgatgttggcagggcaacgccaagcgaaagcaaggaaactaaagccaaacaagacaaaatgacagtcaacgacgatgcatgtcgtttttgctcctcaagtactataatacacttcccctcaaaaacaaaaatactataatattcctcccgttttatattataaatcgtttaaacttttttcttatcaatcttccttaagtttaactaaatttataaaaaaaagcaaatcatttacttcaaattaatttcactaaatctgttatttcattaaattacttcaaattaattactccattgtcacgccccgagctagtcccgactggaattagcccgtgacgctctaaattaacctgttaatcgataccagtcccaggaaacagtgctggtatcacaggaagatagaatatcacagcaacagaggtctctttattatagagtaggagtacagtcatgttgggctgcggacagatcccgagcttacaactgcattacaaaagggaaacggaagccgggacttggaccaaacaacacaggcgcgacttgggaactaggccgaaaccctaaaactcatcgtaaccggcttgctcctggaagaactcctcatcagcaggatccgcttcatctttatcagcaactggggggatatttatatagagcaagggtgagtacgggagtactcagcaagctaggggaaataagtgtttaatgcaggcttcaaggaaaggctgttgttttcgtaattgattttatttgaactcttttctaaaaacatctaggtgagtgcttctcaaacgacacggttgagacagtgcgtcccgtccggtcggagtatgtgcaatgtatcaatctttagatcttaaaacaaggttggcaccccgccaacagcttttcaaacggccacccgggcctagctgatcccgtcagctgctgatttttcaaacatcgaaccctttttcacaacagtaatttcacaagcagttgtcaaacaaaactacgctaggaatcccctcacatccgcccatgaccgtgggcacggctgttcgaacagtttgttaacctctgcagagggggtacactttacccacacgacattacta

SEQ ID NO: 7413 - DNA, 1527 bp, Oryza sativa
aaaaaaggaaggatcaaatgcaacaaattaggcaggtccgccaatctgccttgcagacggaacaacagattaagtgcgatcctatcaatgcataatattttgcaagcaatataattaaatttcaaatataggctcaagatgttcaaaggtggcttgccttgctcgagatctggagcttgatcctcgaaatcctcgcactgcgggtcttcgggctccggaactacacgcgaaatgggacaactcaacaaacggcgaaaataaagccctattaatgacctctaagcgtgccattagatagatctcgagatttggggaattttggaagttgaacggagtcaaacggatttacggtagggaagatattgaatttctaagattattggatttttggtctaaaggaaaaggatttaattaaatcctttttggaaaagaaagaaaagaaaaagggagagggagggaatatagacttccctcgggcggctagggcgcggcccgagagaaagggcggctcggccgagcttaacgggccggccggcccaagaaggtggcccaaggcggcccaagacgcgcgcgcgcggaggaaggatagagagtctggtggaccgggctcaccacgcgcggtcagcggctcggctcaccgtgcggagggagcacgcggcgcggcgctagggtgaaggatggacgtggtgcacgcacgtggttcgcggtggacgcaggtgtggcgggcccacgcgcagcctcacggctcgcggtggaacgcgcgcacggggagggactgaccggggtcggctcgacccggtctaggctgagctggcgccgacgtggcgcctacgtggctgccacgcgggccggcgggaggtagacgacgacgccggccggaacggacggcggtcgacagcggcgagcgacggagcgaaccacggcgatacgggcaaaagcgagcacaccgggcggttgcacgtgacgaggggagacgaaccaacggctcggatttgctgggggttgctcgacggcggcggattgcggcggaggcaaccggcggcgggagaagggggaaacggcgacgaggtcactaggggctaattcccggcggcgagagcatctacgcggttacgggaatccgatgctagcgtcggattgggcggaactacgccgagcgaggccggcgacgagcggcgcttccgagctcgggcggcgacggcggcgagcacacggcgagcgacggcaacggtcggggcggcgccggctaacttcggggagactactcgagctactaccgaaagctaaggggggggagatggagcgaggaggaagaacggagggaggcactaccgtgcgggacgggcgcggtgacgagaggccgacggcgcgggagtgatctctccggcctcgggccgaggaagaggaaaaagagggcgcgcccggagtccccttccgcgtccacgaacgcaccggctctcccggcgcttggcgatggacggcggaggcgggacagagcacgggagcggcaacaatggcacggaggcg

SEQ ID NO: 7414 - DNA, 6485 bp, Oryza sativa
  unsure (1)..(6485): unsure at all n locations
ggcaaaatggacttttgcggaggaatttgatttggaaggatttggattcggaaatgaactcgacgatagatcggggattgagatcttgagatggcacggacactagacaacaagcgaagaaacaaatttcgaaattagggtttttaggagataattttcccgctaggcgccacgacggaacgggcgctacatccatccatccgtttcaggttataaaatgttttgactttggtcaaaaaatcaaattgtttcaagtttaaccaagtttgtataaaaaatagtaatattttcgatccaagataaatctattataaaaatatatttaattattaatttaataaaaactaatttggtagtgtaaatattactatatttgtctctaaacttaatcaaatttaaagcagtttgacatctataacctaaaacggagggggcatttagatagtatgcttattttgtgttgaaaatgtcactatgtttttgataaatttagtcttaaagaattttgacttaaagataagttaaaacgatttgtaatattaaatggagggaaaatcttttaatctccatctccctgtattgcttcgttgatttaatgatttcttcttccttcggatagtttccacattccagtatcaggaatggtccaattgggccaagaaagaaattgctctgcaaatagtaatatgccaggcagctaacaggaattgaagttcagaccttgtctgaacttcttctccttctttcgaaaaacgaagggtaattgatgctttcacataaacatgcaactgaacgaagggtaatggaacattgcatatttgcattgcattgcattattcagttgtaacattcaaaaggcattcagaagaactgaaacatgaagcgaaacacagaaggcattatattgcagtagactgaatcaatgtgtctgtccagatgaaaagaaaaagaagaagctactatagtagcaatgttgtttttgttgcttggatgcgaagtgtatcactggtagcaatgtcattctattcctcatcctcctccacctcgtggaagcggagatgcttcccctccggcaccggcaggcccctcagaaccatggtgcagttctccaccggcacatgcgccacgtcctccctctccatctcgccgtcgctgtcgtagatgaacctggtgtgcttcccctgaaacgcaggcagcccagccttcttgtcctcctcctcctcatcgtcaaacacagacatcttgctcatcccctcacacagatcatcaaagcactcatcatcatcatcatcttctgttagccactcctcctcctcctcctctgggtcttgatcagtgaacgtgtcctcgtcgcccttctcggagctggcattgacctggattgaccaagccgatgagctgtcgtcgtccggtgatctgtcggtgctgctgctgtcctggaacgagagggacgacgacgagagcaccgaggcagcattggacaggtccgatttcccgggggagtcgtcgaacaccagtgcacggttgcactctccaaggtggttctcctccgcctgagctggaggtggcggcagggcatctgcaatgacctgcaccacagacagagggaccaaatcagctcaagaccaattgcaacaataactacacatggatagcttcacaaacacaaacacaaacatttgggcaagtaagtttatgcatgtactactgtatgtactgcaaacacatgacaaatgtccttgtgcagagttggtgttacaggtcatgtaagaagagcgataagcatcttctggatccttttgtccaatctattttgaatgcagcaagccaggaaaccaaacattactatcttagaacaatccaacagaatagcacccagtgtagaatcaataccagactgaagatatagacaaattgaatttcatgtacaacacctgacaaatgtccttgtcaaatctgcattacgtaatgcagaggtcgtgttacaggtaatgtaagcgcagcaataagcaaatacagtaccatcttctgaatccttgggtctaatatatttggaatgggcagcaagtgaagaaacgaaatgttatcctagaaaatgattgctgcgacgcatggttaatcgaacagaattcgcctaatgttggatgtcctacagctagaacagcaatttcgcgcataacaaaacacacacacatatagattggattggattggattatttgaagaaaatgattgcacgcatgattgattggtggaacagaagcaaaggaaaccatattgggaagcaagcaagggaggaggaatgggggggggggggggcaaaattaggttaatgtttacctgcagcttggaaagcaactcctcctcgaggacgcatggcaccgtcatggtgaaggcgtgaggggcggcggcggtgaggtgcggcgtgttggccggcgtgggggcgaggaggtgggcgggcgacctggcgagaccgatgggcgcgtggatgcggaggatgttgggggagggaggagcggctgcggcgcaggaggaggaggaggaggcgtcgtggtggaccttctggaggagcgtcttgacctggccgcggaggagtgcctcgccggatccgggggtgcggcgggaggccctggtggggcgggccttggcggcggtggaggccggcgtgcggaggcccgaggaggcgaggccgacgatgggggagtcgttggtgatgtcgtgcagggcggggcgcggcgggtgggccgtggacgtggcgtcgggggcggcggcggaggccttgcccatggagcgggtgatcctcctgctggagaggggcgtctccatgcttggctgcttgctgctgcgtatgaggaggaggaggaggcgcgagactgtcaagagaagaagagagagagagagagacggacggacggacggaggcggcggctgctgctgctgctgctttaaagtttaaacgcaagtgcgtagccgttcgttcgttcgtgggtggtggagtacaacggtcggtaatatgaccgttgtcccgttccgcggcgccgctcgcctcgcctcccgtctccgtctacacgccacctactagccgttgcaactaggcccacatacgtactacggcccagtccatctagcacatgtacgccttcaacctcaaccctggcctgctagtctctacgggctgacaccaaggccgcatataactatttgccacccttacatttagcgtttaactattttatcatccatttgttaatgaaacacgtgagctgagtaaatagttgtgttaaacatggataactgaaattgtggggacatacaagtaggagtatctattttattctttaagctttacattacaattaatccattctaaacataattatactatcatttttaatatttttttgtgttcacgataaagtgtgaaattatatctactatatttattatctaaaaaaatatctactatatttcaaaaacactaaatataattattattttacattttctaaaaaaaatgctagccactacactagttggaataattaattaactgtatgttagggtgcgcaaaacgcgccgtcgatcctagaataaccaaagcgcaaaacactagtaaaacgcacatgcctttgctatgggtaaatgcccagtctattcactggaatccaaataaaatatcaaaaaatgtcatcaataactaatttgtaaaacaagttaaaaagttggtggtggtaagctggtggcaaagatgtcacctatcattattattatcttttatagtataggaattaacatgcatgcaacccttttaaaaattgagatataaaagatcatagggtacacccggttgatagcaaaatcaccaaataattgaatcgaatcgaatcgaacgaccgaaggaaatacgagtatatatatgaactggaaaatgtgtcagtgtgcacgtacgtacaaactcatcatcgatcatctagaagcaggatcaactggtggaataatgcatgattgagattacacagtactagtaaataaattagtcgatgcgcacgcctgaaccagtggcgtatgtggcgctggaactggatctgctgttgatgacacgcttggactcgccccatgcgtggaagttgtcttgctccgactcgtcgcactccgggaagacgacgccggtgccgttgtagcgcaccgtgtcgtagcacgcgctgtacgtcaggtgccgcgaccggaaccgccgcatggagccgcgcttcgccggcgtcatcacggccacctccgacgtcatcaggcccatggcggcgcagtggtcgtcgtcagtaccaccggtgacgacgaggtcggagaagacggcggtgaagggcgcgtaggcgtagtcgaccttgtgcctgccgccgtcggtggcccaggcggagccgtcccagatggtggcgtagacggacatgggcttggcggggtagtcgccggaggagcagcgaacgagctcgcggatggggatggcgtcgatgtagaagatgacggcggcgggggtccaggcgatggcgtacgagtgcggggcggcggtggggtcgaaggggaggaggtagcgctcctcgcggccgcgcccggtgctgccgttgccgtacatgttggtctggacgtgccatgcgtggcctcgccggttgcccaacagctcgaagtccagctcgtcgtgctgccccgggaacacgtcgccattggacagctgcatgcattgtattcaaacataaattaatttgtgatgtttttactggtctctaaaatcaacccaaggaaatacgtacagtagtacgtactagcaaacacgcacacgtagaataggtgtagcatacagccgtcacttttgaaaaaaaaaatccctcactaaagacacaaaatctgagtatacacattatacatactccctccatcctaaaacgtctagacatgccttatatttgtagttctacaatgccctaaaacatctcattccagtctagattgctatattttggacggatgtaataccaactgacataataaatatcatcgaaaatttagaaatttttttaaagtaaaaatcagctatttttaagagtataaatccgttatacaaataaatacaaacacatatgtatactttatacatatgtataatattattggaagtatattttttgaaaaaaatttggtgatatttatttgttatgcgtacaagatatatttgtgtggtatgtatactagtatatacatgtattctagtatatatttgtttgctttttggctataaaattgaagagggggaaaaaggaaaaggtgtgacaggtacatgtcgcctaccattgagggtgaataatcaatctcctccacccatcgagaagaaaagaagattgggcggcgatttttgattgatggaggccgggcatgggctagctactataccctattgcattgcccgatgtatatactccatatgcataatatggccaatgagtataatggatggatatgctgggtgtggcggcatatatgcatatgtgcgcgcgtgcaatgcgcactcacctactaatcgagcgcgacaataacaaacaaataggtacctcagctatatgcgtgtagtatgcactccctctatcttaaaataatctaatccgacatcatttgagtagtgttttatggggtagagaaaatacgtgataattatcaactcaaaattcacattaaaaaatatgttaattagtaggctcagctttataactttgcgtttcagacaaatgttttgcaggcttattttctttgtaaattatatactatagtctccgcgttgttgctatgtaattctaaaaaaatatactatagttgtttgaaaatgtcaattaattatgtccggacagagtataagataactagctataggtttattaatatccaccacccatctgtcgacctttctctattgatatacatattgccttttgcctttgtcatcgccatccaaatttcaaacccacacaattgcttagaatttatgaaccaactaacttaacacgtaccaacttaacggaccaattaattaagatgagatgagtgcacggctgctacgtacgtcgatcttttgcaggtggacgtcgtcaacaagataacaccatgctcgctcgcaaaagatcgatcgaagttgcaaaaagaaattaaattgtcaacaagataccagcgagggtacgtagctccaccgtccaaattcataatcgttacaacgtacgtactccacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggatcctctacagtcggcgt

SEQ ID NO: 7415 - DNA, 5307 bp, Oryza sativa
  unsure (1)..(5307): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctgatttccttgccgagtggaccaagtgccaagaagacatgccagaggaaaagatggaatattggactatgcattttgatgggtcgaagaggcttacaggcactggagctggggtcgtcttaatttccccgactggagaaagattgagctacgtattgtggatacatttttctgcgtcccataacgtggcggaatacgaggcgctactccatggattaaggattgcaatctctttaagcattcgccgattaatcgtccgtggagactctcagttggttgttaatcaagtcatgcaagagtggtcttgtctagatgataatatgactgcttatcgacaagaggtacgcaagttagaagacaaattcgatggactcgagctcacccatgtcctccgacataacaatgaggcagccgacagactggccaattttggttcaaaacgggaagcagctccttcagatgtattcgtcgaacatctttacgaaccgaccgtgcccagaaaagagacaactgaagccatggatactcaaggcgtaagcatgattgaaaccgactggagagaacctctcatagaattttttaccaaacgagaactccttcaagacaaaaatgaagccgagcagatttccaggcgcagcagactttacattattcacgaagctgaactatacaagaaaagtccatcaagaatactgcagcgctgtgtatctttggaggaagggagacaattgttgaaggatatacattctggcatttgtggtaatcatgctgctgcacggaccatcgtcggcaaggcttaccgacaaggttttttctggcctacagctgtgtccgatgcggacgagattgtgcggacatgcgaaggttatcaattttttgccagacaaactcatttgccagcccaagagttgcaaaccatcccgttgtcctggccgtttgctgtctgggggcttgacatggtcggcccatttaaaagggcagtcggcggttacacgcatctctttgtggctatcgacaaattctccaagtggattgaggcaaaaccggtcatcacgatcacagcagataaagctagagattttttcatcaacactgtgcatcggtttggggtacctaattggatcatcactgataatggcactcaattcaccggcggagcatttaaagacttttgtgaagacttcggcattaaaatttgttatgcctccgtggcacaccccatgagtaacggacaagttgagcgagctaacggcatgatactgcaagggatcaaagcacgagttttcgaccgactacgcccctatgctggcaagtgggtagatcagctgccgtccgtactttggtctttacgtactactcctagtcgggctaccggccagtcgtcgttctttttggtttatggcgcagaagcaatattgccgagtgaagtggaatttgaatcactacgatttcggaacttcaacgaggagggctatgaagagggccgagtagacgacatcaaccgactagaagaagcccgagaagcagctttaattcaatcgactcgatatttgcaagggttgcgtcgttatcataatcagaatgtccgatcgcgagcctttttagtcggtgacctggttctgaggaaaattcaaacaacacaggatcagcataaattatctcctttatgggaaggaccgttcataattgctgaagtcactcggcctggttcttatcgactcaagcgcgaagatggtactatcattaacaattcttggaatattgaacaccttcgtcgattttacgcttaggcatttcgtttgtatctttcctctttgactgctaacttcaagtttttcctcgaagtttttagtcagggggctactataataataatggagtgtgatttttatcaattcagtttgcttacttgatgtatcattgccctgtttgatttcttggcttagtcaatgaggactgaaagttttttaacaacttttgtgggttttaggctcaacaaggtttgacaaaaacttttaagaaatcaggagctaagctaagatatcaagcacagcataaattcatcagtattgtacaaattgtgcctccatcatcgttaatcatcaaagttatcggtacattaatcggtatcagtcttttcatcatcagaattttcaggaccagtcggtcgaagatcgttgtcctgaaatctctcaactacatcagcagcaattttgtcagccgcttttttcgcatcactgatgaggtcaagagcagcttcttcgctcgtcccgtctgcaaagccatcaatggcgtcaatatcaactctcggataaagggatttagtcatcgccaacgccatacttgctcctatacttccagcttctttgatgttcttgaaatatatatccgagcaactctcagcttgtcgaaaatttcagaaacatcaagtgcactcgggccgttgttattgaggaacatcgcttgaacaattggggcagcagtgttagcaacctcatcccgggctccttcaagttttttgatcttgccaaccaggacgtcaaattgagcttgagatttgatcttgcggtctgcatcgacagattcacattaataagtcagcatatggaggataatggattttgaggtattgattgttgataccttcaacttcctttgaagccaggtctctttgtcttgccagctctgccttgttattttccagaatttagatctgcttctctagttgagatatcttggcagcttgcactacattaacttcggttaatcaggattacagagataacagcacaaatcagttgggcagagtttgcgcaaaccttttgatgagccactcagttcaaaattggattcctggagctcagcaattcgattcctcagatcatgctcatttttcctggcaagctcttttgtctcgtgcagcagactcctggtggcttcgagggtcccgagatgagggactagcttctctaaggtcgccgttttagcttcgttcctaagatgaatcctctgcaagacagtttaattagcgcatgaattaaatggcaaacaagatggttgagatcaggtaccagagggcttacatttacaatgcgggttgcctgaccaagtgccttcttcagtaggcgtaactcttcgtcctctttttgcttatttatcatgatcccttgaggctgcatgttgtcatcccaccacttgaccagaatcggagggcgtgaatcctcagctgcttgtatgcggggaatttcttcatcatcaccgatcattggtcctaatgtatccactgacagaggttagacaattggtcagagttatttgggtcgacatggtttcagacaaagtgttttacccgtaatgatttctggacgaggacgagtgggttcggatgcctttaaaggagatccagatctctggtcattgctggcgtcttgtccgcgaaggctgtctgcttgagctccaacttctggaatctcttggcttggccctgcgtccgactggtttctagtcgggggctcctgattaaccctggcttcggcttcgaccgactgattcccagtcggtggttaatcaccagattctacattatcggttgccggctgattgtcactcggacggtcctcggcagatggcctggtttctttggaagaacttgcgtccacgctagtcgggtcagagtctttcccagacggatctatgtcagatggtttcctgcaagtttgattatcagtattattgccgcaatggatgcgcatcaatgcaagagagatcgttgtatgagttgtacctggaagacttcctgatctttggcgcggggcgactggatgttttcttccttggagtagcctgttttggtagtttcttggttgtctctcggtctccaggcctcctggtagtatcatcggcttcgtcatcactcagaaccagcttcctctttcgagagtctgactggccgactggatcaaaagcacttggttgagtttcagaccgaattcttggtcctccgctcccttgcccagtttggtggcggggagatcggcgttgagcgattgggggatccgatttcatcaaagcaaattcctgggtgcaatatctttcattgttaattgattcaataggaagacaagatcatatcttgaggaaggttgaaatgtttgagtgcataccggtggaggagggttgaatgcgttgaatggcacgacgggtagcagatgtgaatagctgacaacaatagcgtttgagaagatcttgtacattctttctttcatgaccttaaagtcaagagaatctggatcttcccgatttggatcatgcttgccatcgaactcaaaagctgtgcgggatctttctttgattggagctaaccgacacttgataaagtgccgggtgatctgctttccttgaagaccctgttcttttagctttatcatcctctccatcagttctactgcctgagcagcttcatctcctataggcaatgagtcccatgtgtcctggtaaaccggaggaagacaacagtactcggggagtgcgggctcaggattctgaacatagaaccagttcacatgccagcctttgtttgaggttttgaagggcatggagaaatatttttggctcaaggttcctctgagttggaagccagctcccccaacaacgcacggcttgcttttgtttggctggggcttgaggaagaagatgcagcggaacaaggcgaaatgaggcctaatgcctagaaaagcttcgcaggcgtggataaaattggcaatatgtactatggagtttggattcaagtgatgcaagctaatcccgtagaagttcagaatgccccggaaaaatcttgaggttggaagagaaaatccgccatagaagaaatgagcgaataccacgatttcgtgtgtgtcgggggtcgggaatgcctcaccaaatgctggtcgcctgtagcgcccgttccgtcgtggcgcctagcgggaaaattatctcctaaaaaccctaattgcgaattttgtttctttgcttgttgtctagtgtccgtgccatctcaagatctcaatccccgatctatcgtcgagttcatttccgaatccaaatccttccaaatcaaattcctccgcaaaagtccattttgcctcccccggggtcgatg

SEQ ID NO: 7416 - DNA, 19052 bp, Oryza sativa
agccgcccgcggcgagccgagtcttccctctccgctccctcgctgccgctccccgagctcgttcgcgcgcgcgccggcgtggttgccgcccgtgtcgcgtcgcgtctgcgccgcccggtcccgctgccctgccgcctgcagccgcgcagccgcttggccccgcgagccagcgcgcgtgcccgagccgcgccactccatccgccgcgcctcccgttgcaagccacgtgcgcgtgccgtggtggccgaccgcccggtcgccgccgctgtcagcctctgcacgcgcctgtcgccagtgtcgccgctccgctccaaaccgccccgccgtcatcgccgtcgtcatcgcctggccccgccactccgcgcgcaagccgccaagggacggaggcagcatccctcctccctctgccgcgtcgcccccgctcacctcctcctttttcccgaatcggcaaaggggcaagccccctttctccccctccttttcccctttttcctcctcgccggtgtcatcctccctgtcgccgctttggccgcgaccgccgagcaccagctcgcgcctttgaccgcgcaagtcggttcccaaaccgacattgccgcccatttaaaccccagcctcccctttcccttcctcttccattcgcctccgtgccattgccgccgcccccgagctctgtctcgcctctgccgtccttcgccgagcaccgggagaaccggtgcattcgaggacgcggaaggggacttcgaccacgccctcttcttcctcttccccggcccgaggccggagagattactcccgcgccgtcggcctctcgtcacagcgccccgtcccgcacggtagtgtctccctccgttcttcctcctcgctccatctcccccccccttagttttcggtggtagcacgagtagacttcccgtagctagccggcgccgccccaaccgttgccgtcgctcgccgtatgctcgccgccatcgccgctcgagctccgtagcacccgcacgtcgccagcctcgctcggcgtagctccgtccaatccgacgctagcatcgagttcccgaaaccgcgtagatgctctcaccgccgggaatcgacccctcgtggcctcgtcgccgtttccctcttccctccccgccggttgtcgccgccgcgattcgccgccgtcaagctccctccggcgaatccgagccgttggctcgtctcccctcatcacgaacaaccgcccggtgtgctcgcttttgcccgtatcgccgtggttcgttccgccgttcgccgccgccgcccgccgtccattcggggccgggtcgtcgtctacctcccgccagcccacgtggcagccacgtaggcgccacgtcggcgccagctcagccgaggtcgggacgggccgaccccggtcagtccctccccgtgcgcgcgttccaccgcgagccgtgaggctgcgcgtgggcccgccgcacctgtgtcctccgcgaactgcgtgcgtgcaccacgtccattctccaccctagcgccgcgccgcgtgctccctccgcacggtgagccgagccgctgacaagcgggtcccacccgggaccgcgcgtggtgagcccggtccaccggactctctctccttcctccgcgcgcgcgcgtcttgagccgctctgggccgccttcttgggccggccggcccgttaagctcggccgtgccgctctttctctcgggccacgccctagccgcccgagaaaagtctataatctctccctcttttcttttctttatcttttccaaaaaggatttaattaaatccttttcctttagaccaaaaatccaataatcttagaaattcaatatcttccccaccataaatccgtttgactccgttcaacttccaaaattccccaaatctcgagatctatctaatggcacgcttagaggtcattaatagggctttatttccgccgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatttaattatattgcttgcaaaatattatgcattgataggatcgcacttaatctgttgtcccgtctgcaaggcagattggcggacctgcctaatttgttgcatttgatccttcctttgttaattgttataccatgtccccttgtaaccacccagttgcgcctcgatattcgtgcactctgtgcgagtatcgacggtcgccttcaaacttaaaatctaaaaaacaacttgggtaaaacttgggttttacaaaagacttggaaaacccgacacctgggtcggtgcttgcaaactaaatgaatttctaaaatcgcggaccggggaacgtaccgggtgtatggttttcccgctcccgcacttaaggaccgattccttggaatttcatccgaacataagacaagtacgaccacatgggtggaatgggacacctctggctgagtaactagcttatcaggggagccatgatgccgagagacatgtggattcgccggggtggtgtcggagaggaccccctgggcttcctggcacagtatggtctgggacctaacctgttgttggtctgggacccctctcgtcggcatatggtaagcctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgacaactgcttgtgaaattactgttgtgaaaaggggttcgatgtttgaaaaatcagcagctgacgggatcagctaggcccgggtggccgtttgaaaagttgttggcccgggtggccgtttgaaaagctgttggccgggtgccaaccttgttttaagatctaaagattgatacattgcacatactccgaccggacgggacgcactgtctcaaccgtgtcgtttgagaagcactcacctagatgtttttagaaaagagttcaaataaaatcaattacgaaaacaacagcctttccttgaagcctgtattaaacacttatttcccctggcttgctgagtactcccgtactcacccttgctctatataaatacttccccccctgttgctgatgaagatgaagcggatcctgctgatgaggagttcttccaggagcaagccggttacgatgagttttagggtttcggcctagttcccaagtcgcgcctgtgttgtttggtccaagtcccggcttccgtttcccttttgtaatgcagttgtgagctcgggatctgtccgcagcccaacatgactgtactcctactctataataaagagacctctgttgctgtgatattctatcttcctgtgataccagcactgtttcctgggactggtatcgattaacaggttaatttggagcatcacgggctaattccagtcgggactagctcggggcgtgacatcaccacccgatgatctcttttgctggaagaaagccgtgcgccaccatctccttcagattgtcttccatcacatcggagggcgcccactgactctcgaagctttctctttcttccgccatgaatgtgaactagatggtttgatttagctcgagatacggctgaaaagagatggggaatcggagcggtggatgcggggagaaattttgtgaagtttttgaggatggattggagcggattgatgaaccctaacttcgtcggcgcggttctgtactgtagcacggagtggggaatggcgagagtctcggcggggaagacgaagcgacgtttggacttcggtatttttagggtatcgggagtactaatgggcctaggcctgtacagtacttcagcccaattatgttttcagcgtggcccgttgtgatcctaagggacttaggcgctttttgctttggcaatatgtgctcacaatgacacggcccgatgctgttaaaatcctttttaacgcgattcaataattctttggaattattatgatgcacatgaaaaggtgcctgacagaaaggtgttataccatttttttaagcttttttaggctacaggagctgttgggttaatttgagatgactggtttattagtagtcattctcctagcatgttatatgcttattttggctatggtaagagtcacagcctaggctgttagactcattaattaccataattttctgtcatttttggtggatcattttaagagtttcttgctcggattcctaccaaatatatctatttttgggccttttgagtgtttgtcactcggcccttcttgtattttttgtccttgatatattcaagttgagaagcagtcggctgggtatcttactaagtaccatgcgtgcttcgctataaaaccactcggtgcttgactatatgtttagttttttaactaatcacatagtcaagggctacacctaattaggtgcatctactcgatgcaccatgttttatttttgcccttcacagtttttgatttttagtactcggcaagctggagcaagttgaattgaagcactcggactactagtttttgtttcgagaaggttgtttcgtcaactgcgaaggtctcgggggctactgtggagattatggataccccatatctgcatgacagttatactttaatcggatatatggtaccaaatatagatagaatatctttatgaggactcggggtaggttctcaacttgtatgtcaagaaaatacccgggatcctagtcggctacgattgtattttatctataatcccatattccgttaggatatggactgtaccttgtattacggatcccttcccctatataaggagggtccgtgtgcttcttggggcacgattcttttttctcccaatcatacaatcaataacacactcggcggaattatccccggacaggagtagggtattacttctttaataagaaagcatgaacctgtataaaattccttgtctctaaacccatccactttcctagcttgatagccaccccttttattattgccgaaatcttgtttcgacagtgaactaaacaggcccttaatcgttctcctttgtcattctgtccagtgtctgtcactttgacaagacgaaatgtagcatttcagacagccagaactctgaactttctgttgggcaaaacaaaaagaactctgaactcgaccacttcatcatgtcataataaaccattacaattcacaatttagtagtactcaagaacaagtaaaatagagagagagtatgaaccagcaggagatagacacctcatatgttctgggcaggctgtacgctgacactagagagccaatgcgtggagcagagaaatgcagagagcagagaaatggggatgcaagacatttgccattgccattggcattggcatggagagaccaggcagaggagctgatgcagcatcatggtccatgcatgtcacctgtctctcgccctatgccacctacagatcctcctccattcactcaacagctactatgtcagccatgtagggcacaggaggcagatgctcatcttgttaacatcctcattagtgtagtgacatctcaaatgcagcttgcttgttaggactaaacagatgcttgtaaatgccatcagttgatgattgggttgagttgctgtctccctcaacagcacacagaaaaacattagcaaatgctgcatggtccattcatcaatcatcatcagaggatgcatggtccatcatgccattaagcttgcatccagggggctacaactacactaacaccttctcactttctgttgtcattgtcagaaaaccccccaagaacccagctagaaagacatagggattcctgatccagcttaggcaagcatgaatggcacacgcaaacacacatgcatatcgatcacacagaggaacaacacaacactagcttaggtacacgaacacaggacaaatctagttatctactcgtaggtaggagggtagaagaaagacagtagtaataagtactagtagttcatagatacttcctccgtcctaaaatgtaagcatttttgaggttggcacgggtattaaaaaagtagatgagaatgattgaagaaggtgtatgattggttgaaaagacaaagtaggtgaaaaagaatggttgtgattggttgagaggagaaggtaggtagaaaaatagcttcattttaggataaagtactgtgctagaaatagctatattttgggacggaggtagtactccagtagacagggagatccagccatgccatggctgtccagtatgcaagcaaattagcaagcaagggaggaagaagaggctgggcagccggtccctccctccattggtatttatgagaggcatctcctcaccaaccaaacagacacagcatctccgtgtatagtacaggggaataaataagcagcagctgatgcttgcattgcattgccatagaggcatagagcattgcattgcagctcaaaaattggtccaggatccacagtggtagcttgtcagaatatttcaagcaacgcaaaggaaggaagaaaggaggattgtagtgtaggagggatccaatgcaatgggcaatgaggcaatgaaatgcaatgcagcagcagaaaggcagggcattcatggctgggcacatattaggttggcacaaaaaacacaagccaccatggacacatttactccccttcaaccaccccacagcatacattgcagaagaacagagcaagtcaatgcagcatagtagcaaaaggacaggtaaaaaatgaacaatactagtagtaataataagatagggcaaaggttacagacaaagagtgcagagaggtaacaagtcaattcccgaaccaagacccccttctagtgtgaagaagggtcacaactggttcgctcttgacttctcctctcctcctttctcttatctcatctcctaataacaatctgcttaatgtcttcttcttcttcaaccttacacaaagtctagctcgatcttaacacaaaccacacactcaagctaccaagtcttcttcttccatcttattattacaaaaattcaaaacaaggagctaaccttcttcacatgcagttctcacttttgatgaggaaagggaggaagaacctaaagagggatggatggagtagcaagaaaccgatgcacgaccaaaatgcctgcagagctgatgtcagcaaattcatgaatcagctggttggtgcaagtgagagcttgacaagaccctttctttctttctttctttctcagcagaagtagcttcccaaaatgatcaaaatgccccccatggctttgcttgttggctggttgggggtattttcgtcattttgagagcagaaatatggcgggaagagaggagagatttgagtagctgttagtgttggcttcttgtcaaaccctcccttgcacctgatgaaccagccagaccgagagctaacagaaaaacaaactgcgatgttagcgaaataaattgggaggcattttggtgtctgatcccatgttgctccgatcccctctcctccaggtctcctttgctactgatcggacgccggctcacccccagcaccacctgctgaacttttgagtgcagctgtgatctggtgaatggcgttgcagacatggctgttgatcgcagtgacactcgagaggttgagcttggcagaaggtacggcgctggccagcacctgcatgccgacggtgaggaggcagccattgggaggcagcagctcatctgcattgttgttgttgctgctgctgtttcttggaggagtgctactggtttcgccattgccattgccagtggtggtggtggtgcttgagctgatggtgggtgcagcagcaggtgatgggctggtggcagggaagatggcgaagcccagggggaggagagggatgtaggaaggatcctcgccgctcatcgtcacctgaattgcgtccacgtccaccgtcgcgaacaccaccaggctcccaccatcagggtgggtgctgctctcctgcagcaggagctccacattctgtgacgagttgcttgcagcctggacatcagtttttatcaattggaaaaaggtcagctcttgttatatatctagtttcaatcagcagagggaaaaaagtaaagtaagcaactctcattatgaaatgagctagatctatgtgcatggtacattatgattgtaagcattacaaggtgtacgtgtagtatatgaaaaaaaggggctaatatatatatcagaaaataaaaaagaaagattcagacataaactgtccatgtaatgacagcaaattcagagatgcatgtgcacacagccccagcatacaccactaaaatctcatttaatatggcatattgagtcatgtacagttcaagtagccggtgttaatttcttgtccttggcattggtagcaaacagtgagtgcttgaaactattgaattgaacaacagttcttcaccagagagtgcagttacagcagtaactcagtagctaccattgctaccattgagctattacaatttatactacaataattaatttccctatctttttctagtttttactgtataagacataaacacacaacgtgtgcatattgactcatgttttcatgtcccttcaggactctacaggacggggggagatattcacatgctcaccattagtaatccataattctgcaactatggaagaaactagacaaacctagacaataagtactacataatattcttgatcagaatcatttaagagctagctaagtcgtcgtgattttgctctttaatcaaagctactagatattatgcaccattaagcacttcaattattatgatcatgctcttgaatcaggaaattaactactacaaggacgaaaaaacatggcatcattcaaagaggtggtaattgggtactcacgttaatgcgaagaagagagatgcaattccttggatgtgatccatttgcaatatgtgccacctcatgaagggagccgccgtttgacaaaatctcaagctgcaaaaggcaaattaacaaacatgaccacaacgaattataaggtgaacaacaacaattttcagtatggactgagtatattatatggctcttcattgtacctggcagcgctgttgttcatctgcaagaagctcaaacacctgctgatgggtaaaaggaagccagcttgtggagacagcggtgaggatgacaccgctgggctgtccgggctcagtgttcttccgagttgtaaccctgatagtgtcctgggttgaatccgagagggccgtccaagattgggttccagaagcactgatgttagcacagaaagtggtgatcatccgctgcgacagcttcatcatatttgttcttgcctcaggggtgcggatcactgtgaatcagaaacaaagggatcgagaagattatatcataaatggtcaggatggattttgtgaattgtgagaattcagaatccacacctctacacaaactgtggattctgaattctcacaatttacaaatagctagtggtaatgcgcacctccgaggtcggcgatgttacgggcgagctcactggcgaggcgctcgcactggcgctggaggatggagagccagcgcgtggccccgaaggcggcgccgctggcgacgtagtccctgaacaccggctgcagcggcttctcctccccgaccatctccatgtgctccacccacaccacctgcattgccattgtcacctccattcatgttcatgctcaaattaacacccaatgcaagcgtatgtacgtaccctggagtatccattgggcatgtcctggatgatgcagccggacggccgccgccggcacctgaccaccgaggcttggaggagcccctcctcaaacccttccgccgggaaatccacgatcgcccagctcccctcgtcggcgttgtgcacgcagtaacggaagaacaccacctcgcgcgccgccaccagaggcgacaagaactgcacctctgcttgcatctgcatgccatgtaccacgcgcatttcagtccccatccatcccaaaaacaactaatctaatcaatcagtagtaggggagtagtaatcagttagtaattaccaagaggagagttccactgccgaggtgaccagacgcagctccgtggtttatgatctggattgttcttgccttgcaaacaatcgacgggaacagctccatccatttgttctgcaaaacaatattaatcgacattaatcagatgattagaaatgaagcatcatatactagtggaaaatggcagtatcactgcactgcactgaccgcatcgaggaaggcgtccaccaagttgatgctgttcatgatgaccaccgcgttgtcacgcgtcccctccgccctcgccaccgcgccgccgtctccttgcttcgcgccgtccaccggccagctgaacatccgcgcgtgctcctccacggccatcacctccgcgccacgctgccgcacccacagcggctcgccggcgcggcacatcctggcgagctggtccgccgccgtggcggcgaggtcgaccaccagctgcttgtcctgctcctgcacgggcgccatcatggcgcccatgtacgccgccgcgccatcgtgctgcggcacgacgggtggcgggatgaggtcgccgcagcccatgaccggcgcctgctcggcgaagtgccgcgagtagacgttcatgtcgaggtcgagcggtggcatgaggaccggcggcggcgccgagatgcagctcagggccgacgtcgacagcaccggctgccgtccgccgccgccgccgtagcgggtggcgatgcaggccaagcggtcaagctgcagccaggaagcatatataggaggagtattatgtgttgggaattgggaatgaatggtaggtagggttttagggagctagcgacctcgtctttgagcctggcgttctcgatgcggagctgctgctcctcgtaggacatgtcggcgaggacggcggcgtggccgcagttggggcagacgacgttgcggatggcggcctggaggcggaagttgtcgctcttgaggttctcgttctccgcgcgcagaatcacgttgtccgccctgtcctgctgcgcctgaacatattcaacccagccaatgcatcatgaacatattgccatttgcatttgcaaatacagtagcgtatatatggaattattaatttgcatatatatagtaccttcatctgggtccggcgattctggaaccagaacttgacctggcgaggtttgaggcccagttcctggctcagcttcagccgctgcttgtcgtccggatgcgggcactccttgaacagcctgcatggatggatgcatgcacgccacttgtcagtatcacaatatcagcaaggtttaatggagacgaatcgatcgaaacggctggcaatggcattgaagaggaagaagaagatggagatgaaaaccgcacgcctacatctgctggatctggtgcgccgtgtggcggtggtagcccttctttttggcgttgccccccgcggcgccgctgggctgggcggcgtccggcggctggtcatggccgatgtgctgccgcttgtggtcgtagtcgacgtcggcgaagctgaggaggccgtccaggtgggcgctgcccgagccgccactgagctccatgtccatctcgaggtccatcccctcgtccttggccacatggaggcctgccatcaacccctcctccttctgcaccgcacgcacgtatatagctagtgtcatgaggctatgcaaagaaagaaaggaaaagagaaaagaagagattagcttacaggtattaaggtggcggcggcgttggagaagtggtggaagggcatggcggcggaggaggacatgaagccggcgagagcggggttggggatgagcggcgaggcgaaaagcgcgtcggcggaggaggcggccccggccatggcggccatggacgacaggacctggcagtccccgaacatcctgcgcatatgtccggccggcgatatcttcaataggagtagctagctagctagctagtggttccttctccggcgatccggccagcgccctcctgcctagcagtagtagaaaaaaaaatcaaagacgaaggagcatggccctagtcaatcactcacacactcctaactcccgagaagaagagaagagaagaagaagagaaagagattggaggatggagatggactactgcggagcaggagggaagaggagaggtggtggtgaaaggagacaagcggagtaaatggccggagtaaataccctgtcggttgttccgtggccttccttccttgatcacttcttctccttcttcttgatccctgcagctgccttcccccttgagatcaatcacggctggctggctggctggagaagaagacgatctctctctctttctcgcctcctcttcctcctcctctttatggttgcaatatcgatggaggtcaaggctaaggcagcgagcgagcgagcgaggaagaggagtaaccgatggctttggctggcgcttatcttgtctagtagctactgtgacgctctttgacctcctccccccttattccgccctcaccacgtcactcacgtcgccgcgcgtgctccccgctcactgacgccccggtcccaccgttgaatccgcaccagcggggcccacgaggcagcgaccctcccccgtcagggtctcgacgaagacccggtgacgacgacgacgacgccttctccgcggcagtcgcggggtggtccccacgtaaagcgcggaggaaaggggggacccacgtgtcactgggagagggtggagcggggtactgtagtggtgggaagggaagggagttaatgcggtaattaggagagcggattacagtgagactgacagagtaaatgctcgcgcggcaacagtgggtaagtcgtaacgctgcgaatccccgctctttttttccttttcttttcttttcttttttttttcccccacccaccggctgaaatacagacagagagaccaggtcaactgcatgcatgcgatgcggtcgatctcgtccgtccgatccagccacgaacagatagagagaggaagagagatctgggccgtccgtagcgaagccgcgttacggcgcgagggggtctctggagcagcatgtgtgcgagtggccatatcatatcgtgcagcaattaatttgtaagatttgtatgtacagccagccccaaccccggcacgcagctatagctgtaggtaggataggagtaaacagtaactgctccatatcatccagcatcatcgcccgtatctctctgcttaatttcacttttgctatagggcagtcacacccatgtcatgtgtgattgtgttgtgttgggtattcatatccatatatgcctttcctgccaaagatatcaccacattgatatcctttttatatccttttttgtctggctagttttaatttgtttaatttcctgctacaaaatacttacttgtatacatatcctcgctcaaaaaacaagaataccactccctatgccctcaaatatatggatttctgaaattatccgtggtgattaaggaaatatgtgaaaataaataagagatggttatgattgattgtgacaagaaaataagcgaaaaataattatttaaaagatgattctgactgagacgactgagaaggtggaaaagttgctactccttccgtctaaaaaaattgacttctgataccaattcgaacaagcatatgttcagatttatccctaaaagttgatttgttttcctagtacatatggtgtatgtttttaggatggggaagtattatacacatgctgacatgcatgccattatactccctcattccaaaaatctgagaactattttattctttggtttctccaaaaatctgagttatatttttagtcactatatgctaaatgaaattgttgatcggaaataaagaagccattctagtacttattgattgcatattcattggttttgccacatagtgagtgagttaattgcttcttgtttttgatgaaaaagaaatatatctcaaaattttggaaggagggagtatatattaaggtacgtacttttatagttttgatcataacttcaattgatgaatagcatgccacgttcgtttgtgtgaaatatatgtacagtatattatattgtacatagctagcaaaatacaagacatacaagtgcagaatcgctgaaaacaaaagagcacgttaagtgttaatttcagtgggtacaagaactggccgagactcttaatacatacatttaagagaaaactagctaattaaagcgggccatggtcctccatatgcattttgctactcctaaggatcagtaacacagttgctactcctaagctaatactactgctccctccgtttcaaaatgtttgacaccgctgactttttagtacgtgtttgatcattcgttttattccaaaaaaattaagtaattatttattctttttatatcatttgattcattgttaaatatactttcatgtacacatgtagttttacatatttcactaacttttttgaataagacgaacggtcaaacatgtgctaaaaagtcaacggtgtcaaacattttgaaacggagggagtacttcactattagtttatttttaatttactactttaatgtgtcgatcgactagctagctactagctctagatcatccatggaagaatgttctccaaggttgttgtacttgtgtgtgtgtgtttgatagcatgcatgcatggcccatcctcctccgtttttgattcatgcttcctatatcccctgcatgctggatgcatgagtatgaggagctactagaacagtttaattaatttgagtttggaccgcacatatatatcaaagaaaaccagaagatcagtctgttatagttgtgatgatgagtttctctaaactagtttgaagggagagcacatgcatgcatgcgtactggacaggtgtttggaaactgaaaaatggtatggcaagctagctagctagctgttttttcttttatttcgtgtgaagtactatatactagcatatatatattggaggccaataatgtttttctttgcttggattttttcgtggaatatgtccaatatattatctaaagaaaatgttcaatatattatccggtcatgcatgtttccctccgttttatcttgtcttttctgcttcaccatgttcctctagcagttgctagctagctagctcgatccatccagctggctggtgacgatgtaagagctgaggtcgccatgaactaacggtgtttaatggtcgatcagctcgagcttgttcgatcgatcatcgatgatgatgcatgctatataatgtttagctatatacatacatataatccaaccagttcattcagttaattgcataccgaccgatatgatatatatgctgatatatagagttcatttcgggggcagccagctagctgtgggcgggcggagtggagtggtggcaatctatatatcgagttgagctagctagcttaagctaggtgaggtcgcagtgtagcagggcagtggggtgtaccgtgtacgtagtacgtactggtgcatgctggccggccgggatcgatctatttattcatccaacacgtacacgtactgcttatctagtgcatgcgcaccatgccatattgcatgccatcgctacgactattcccaaacacgtatttactccgccccatgtgatctttgcgtccgtacgccccgacgcgtaccgtgcatgcatgttaaccacaaatatgctattgggcacacgcatgcatgcaagaaacacaagcagcgcacattctattcattttatcagattaactggctcttgtttttatccaccccatcatatactccctccgttttaaaatgtttgatattgttgactttttagcacatgtttaactgttcgtcttattttaaaaaaataaaaaatatgtaaaactacatgtgtacatgaaagtatatttaataatgaatcaaataatatgaaaagaataaataattatttaaatttttttaataagacgaatggtcaaacacgtattaaaaggtcaacggtgtcaaaaacattttgagggagtatatcacatcgtcttcgatctcccaagccgcacgactcactgcaccgctgcgcctccttcctggctcctctcccaggccataccaccacctgcatgtagatcgagctctcctcttctctcggcaaaatgccagcgaaactcctcatatctaattcactaccagagaaaataacttcggtgttagatagtaatccctcatcagtaccagaaatcaaaccgacactaaactgtagttagattcgaatcaaaagtttttgggattgtgaaagctggcgtgtatgcacactagtaccaaaatctgactcattgccgaatcagatagtgaaacgcaattgcagtgcaggtagcagaaacccgagacggagatgtatacgtggccgtgggttgtgcatgtgcgccaccttccccctcctgacgcaccactccacttacgccctgaaaagaaaaaaaaaaggaaaggaaacagaaaatgccgtcacggcctcgcctaaactgagctgggcctcgatggatcgatcgactaggccgaaatcacggtggcccagtccaaggtaataactaatagcccatcaacaaacggcccaaaacaataataatatcccaactcccaccctgaaatgtcgcgtcgcgtgccacctctacctttttctctcctctcgtgaactcgtgttcggtgttcgtcttcctcccgcaccgcacctcacgccatggccatgcctcccccgctcttcgccgccgcctcccacgcctcccttctactcccctcccccaccattcacagctccaccggatctcgccgccccttccgcctacccctccgttcctcccgccgcccgcccgtcgcagcagcagctgcctctggcgtccccgacgagtggggcgaccgctcgccctccgcgcccgagccgccctcccagcccgacccccccatcgacgacgacgagtggggccgcgacgacccctccgcctccgggaactctcgccccgtcctcgtcaccgacgagtggggcgagccgggtgtgcccgagccccaatccacctccgccgccgacccccctaccaacgacgacgagtggggtggggatccggcgccaccgccaccgccacctcctgtgccggaggaagacaacgaggaggaaaggcgggaggagctcaagcgctgcttggtggacactgtgtacggctccgacctgggcttccgggcgtcctccgaggtgaggggggaggtgctagagctcgtcacccagctcgaggccaccaatcccacgcccgagcccgtccaggccacccacctcctcgccggcaactggatcctcatgtcagtacttactattctactctctacacacgctctcctctacttcctttcttccttcttctactactacattgtcttcattggactacaataccactcaactactactagttgttattggtgaaatgtcaaatgctaagcttaacatcatttattagattttcattttcaatgaaaacgtttgctgttcctgaaatatgtcttgtgttgatgtcatcagcatctttttactagataactgatcgtctcaattgtgcatggtcatttacttgcagatatacagcgtattctgagcttctacctatcctagcagttggtgcagcaccattgttcaaagtcgatgagatatcgcaagaaattgacacaaatagcatgaccatagtcaatgcctcaactatctcaagtccattcgcttcgttttctttcagtgccactgcttcttttgatgtacagagtccatcaaggatagaggtacaaaattccttgctataaaatgaatcttgtgcttctttggattcagtaccatcatcttgtttggaatagagctgtttattcagtcatgaatataggtaatctaaaagaatttttttgaccgtttgtttgttgggaaactaaaaatgccatgctaccttgtttgatttcttccaataacctgtattaagtttactttgctagatatctctacctactaattctagtggaattcagttagcaacacaaatgttaaagtaagttttatgacttctgtttcctgccataaaagggtacactatgcatgcctgaattgacaagccgctaattttgtctttgatggtcgtacatcaactcaacgtcagagatttccgttccttttaatcaaaaaggttttctagttcatcaaccaagttactattagatgctacttataggcttgaacagtatggaatatgcagtttctattagatgctaggattgaacaatatggattatgcagtttctattagatgctacttctaggcttgaacaatatggaatagctgggggaggggccgagggggacctttcctggttaggcatagatatgattctcgctagctaaaatctgcacaactcgctagctcaaatcttgtaggatccaaaatgtgtatccatagatctgaagacacataacaaggggattatagacttgtacaaatatttctgcttgttgaacctgtatttatcaaggatttctacacaaacctcggtgcaccagaagcttgagatgtgcatagaaattattgagatttctgatcatcaactttcttgtgcaaatatgtacattgaccaaactgacatgttgatggtcattccaatgaaggtccaattcaaagagggaagctttcagccaccgaagatatcatcatcggtagacctacctgcagaggttgatatatttgggcagaagatcagcttgggcccagtccagcaggtgctgaaccctctgcagcaagcctttgcaagtattgcaggatccatttctgggc

SEQ ID NO: 7417 - DNA, 12166 bp, Oryza sativa
  unsure (1)..(12166): unsure at all n locations
ttaacaaatgattggtgcttgagcttgacacacttcgtatctaggcaggtgtacagtcgaatgacctttacctttttccttcaaccatgtaattacataaaacattctatcaaaagaaccccattccgtatcctctaaaagaacaggtccagatctttaaagacgagcgacttctccttatcgctcctctgatcctctcttctgactaaattgcagataactgtaccttgaggtcttgacttctagagttctacttctactgttattaccatgctactgccaaaactcaaggggaaccaaacatgaaaatacatacagacggcagacaacatagcaacatttgcatcaaaggcaaggccgcaagtccgcaagcttctgcccaaatcaaccaaccccgtttgaggaatgtttttctgtagctctggattatctttcatcatgaatcctgcatttttgtaaagaataggccaattagaccccaagtaaagacacaaatgcatgatattaaaatgtctactgacatgataaaaatgactattcatcatgtattcatgttaaagataggatattccttgaaaatatgttaacgctacacacaacatctgttaggtaactttctttttttttgcatattaattaactattaaaaaggaacatagtgttgccatgttcatgtctggaaatttaagcatagggttccaaaaaggaaacaatttggaaatgggctaaacgtacatatcctcttaacagtgatgcttagcaatggaatcagcggttcagcagtagtagttcccgaatagagattaaatgaaatcacaaaaacaataatatatgactcgaaattcactgcaagcattagcttttaccactagacccttgttgatgtaggtatttattttttctcatttgctaaacattaatttgcatggcatattaccctttgacagtgccgatataacattttatcacagtgacctcagcatgacacaagtccctcaggaaggtgccaaggtgacagcagggagtcagggaggcatattcaacagacctgaaatacacagtggtactgtaaaataaagaaatgaaccaaataagaaaaacctttaaccataacatgcctgagctttgtgctttaccagatttcatgttaagactgtatcctgcatacttttgaaaacctcacgtacagatgaaggatctatatcacatctaacaccctcacctccatacagcacaaagagatactctcttgatgacattggagggggcaaaaggtcagacagctccactagatcttgtttaggtggtaaaggaatatccctttggttcaatgaataatacacatcggccataagaagccagacaaggtcagaatcaatagaagcaattcccgtcaatgcccttatagcagcttctcgcaggccgatcaaaccactataggcaattcccaccacaagtccacaaaccttctttagtacacttcccagagcaatagcacttcgtttgttggaagatatttcagcgagcatgtccagcactgcaatctgaatcttttggctggatatctcagccataggctcctcggatgtaagtgaggtattcctatatggtaaaataatagctttctcatccatcagtgccattctttttcgttggaagggagataaggttagcaacctccaaataacagatccatccttatgaaaccggcgtacaaaaaaatcgcctccagatatctgaatgactttacttaacacctctgtgcattttctgacaacagactgcaaataccataataatgtaagctataaggataacatacagaaggaaccaacaaggcaaaaatagatcaaaagcatgcatacaaagtaaacaacaagaaaatgaaaactccctattttagcatattcctgatacatgttttccaaaaaaaattgtatagggcccacttcatgcacactgtttttagactagtcagtccaaaagcattttattttatgacagaagaaccaattaaaccctcaacgatggcaacaagtgtacgagtgataagaagaatcagtatatgacaaagttataaggttgcaacttcaggtggtgtttggggcgtattgtatacctaaatactcagcaacatgtattgcatccatctgattattgatcaataaagatgatcaagaacatggaaaaaggtctggcagcactatgttctgttctgaaaatgctgaatatagttgtaatctgtttacttcggaatttcttatgcaaacttgtatctcacagagatgcaaatatattgaggcattggattatggatcaactccccatggcaagtcatcaaacaagatctagaaatgcctaggtgtcatttaagaggtgaagttactgaatgaggacaggccccaaaataacaattacttcctatgtttcacattataagatgttttgggttttgaataaattcatgcatgggttcatgtatgtaccttcatatatgtgtctaaattcatataaatgttagtgaatctagacgagggatagagatgccaaaatgtcttataatgtggaatggcgggagtagtaacatactaacatgtcacgggataatggaagtattggtaaagtatttgagtttgatcacacaaaagtacctggattcacaagcaactataggacccttctaatccaacaaagtaaacagtgaaaagaaaattacgaacttaaaaagaaactatggtacagtcaactccaactcccaaagtccaatgtctgattatggtaacaaatattgaatttgtgtgaaattataatggcatatttccaaatacatgaataccagtggcatatttcaaaactagaaattttttaatggtatgtatccaattaaccctttgttaaaaggaaaaggcaggagttttgatgttctctatattgatcgtgttatggtttcagatgctctacagatcaagagccctcaatattcatttcgtgcaagtgagacatgaaacaccaacaccaatgaatgaatgtaagcatctgtttaaataaaaaaaagagagaaaagaaagctaacaatctttttgttgcaaaccaatgattaacagcatgcaagaaattgtaccactgagattttgttcccaagacaaataaccaagtatggccatagcttgttcacagctgggagtagtctattctcatcaacatcttctgcagcatccatgtcatcatgaagttcatccactgataataattgaattgtctcctcaataactgctttgcatcgactttcacacttataggcttcctcaaccttggctatagacataatagcattctggacaaaggaatttttttttaatgtaacttcgtctatcataggctcatagcgaacttcatgccaggatgaatgaaaagaactcaagcaattattccttataattagcattaaagtgttagcataaatgcagcataccttttccttttatttactaccaaatgacaacagaaatggagatataagggctatgggcatgttcgttttgatgccaaatttaaccataccaaattttggcaatgctctgtggcattgccaacttttgctaagctagaggtgtgtgaaggtatgtttgttttgatgccttaacaatttttggtgtcctgttaggtaactttcttgaatcaccaaattttggtatggaaagtcatttgggacgtttggattgtcacgtcgccaaattttggtaaggatgaaaacagtacaaaataaaaaaaatgctccctatttcaccagaattagaagaaattttcttcctagttgaaatactttagagcttgacatttcttgtgagaaataatggaagataggtcaagatatcataatatcattttttgaaaaaagaagtatttggaacgccatgaaaagatgaccaaaaactattgttagacgaagttgtaggagaattatattgacattgcaagtaaaatatcttatgaaatggaaccaaaaccttgtctacattagcaggggaacaatacctctacaatgtcaagggccacaagacaagctgcttcttttgttgaagatagaagtggagtggaagctactacacaagagccaacaagagatcctactattctcctgtatcttctcatctcatttagtttgcaaagtagatcctcccaatattctaatcccataaaatcaggctgagcatcaacatccattctttctgatgcaatcgcaaagagaggttatgagatagggactacacgaataaaatattgcatagagaagtcagaacaggagatgcatgcaatatttacttccataattattatattgctacctaatgtagaagatattgtaattaattattaaacttatcaagctattaccaggcattgcacaggtatccctctcttctctatcaaactttggattgcttcaccttccgatctaaccttcataaagaatgattccacctcatctggcaaactaacagattcatgtcgagatgccttagcaacctcagaaacagcctagagaaacccaaaaaagaaaggggaaaactggctctgttagacgggtaatttaagtaaagcgtaaacaaaatatgaccccaataaagttatccttggtgtaaaagatcaacttagcaatctaagaaatgagagttaaaatgatcagaccagcgagaaattcaaatccccttaaagtagaacaatagacagatacaacatgttatcacttatcaaaactttattttttagtaccttcagaaatggaacagttaaatgcgggtgatcatgcctaccaagaacctccagctctgaagaaacagcacgcatctgcaagaataaaaatgtattgacacagacattacaaaaaaggcacctgcttcaagtgcaaaaggacatcaaaatttgttccgattaaaggataacatttgcccctttctaccccatactaattacatcctcttagccatatattttaaagtgctctgtaaaaataagtgtttccacttttcagagcaaataagggccaaccaatttgactggttcagcaattagaacaacagatgttgggcacttctcttacaacaagactgtttttttaaaaaaggaatatacaaagaatggattaaatggatatttctgattctgagattcatagccaccctaatcatcataccggttcttccaggaatggtaaaatgtcacgagaagcaccaatataacacagcatagaagcaagaatatcagggacgtggggattgagatccaaatggtgcaactgtctgcaaagagagtcaacaatgtagtcggcatttgccacaacaaattgaccaacctgtacagggaggaagaaaaaacataaatgcaaagtccagaagataaggaaaaaaaaacttgcaagaaataaggccatgtattaccgaacagtaacctccagcagcagcgagtgctcttaagacagcatctgaagcaattcttatctgtacacttgagctgataagttttcgaagcagaagataaagtgaagagtgcataaatccactacttgcaaaatcttggccaagcacaacaccaaatactccaattccttcaatcattacctgataaaaaagatcaaaaattgagcttgagcaaacaagacagtccagaacagaacaagcaaaaggagaacttttgaaagaccaactggcaaattgtaagtgcatattacttggtgcaatgcagcagtatcacgaaagaaatacaagggaatattcaactctgttagggatagttcagagtccggttctgttggaagatcccaaacttctggtgccatatattcatgcagaatacttccgatacaatgaataatgtggtttttcgtgcccatttgctcactgatcttccaaatatttctgttagtgcctccattattctggccaaaagcagttaactgatcattttgaccaggtgctcctatcatctgtgctgagttcttgttgaatatttgtaaacatatactgagggaacgatcagatagaccatatatgagctcattgagcatgcaaacagcagagcttgcctggcgtagtgtttgcccagcatcacttttcatgtaccacctctgcccaccactccgcagctcagtgctcaacctcctgaactgatcaagtaggatatcaacaaagagagacagtgatgcactggtttcttcgcctagtatcatcaaaagcaaccaaaacataagattcaagtaccatacgtggcaccactggatacaaaatgcaagactgagattaaccctaaatgataatgttggcaggcatacaacatagtcgagaaagtacctgaaactgccgatagaccaacaagcctaacaattccagcaagagcaaaataaagcttctgactattcacgtgaacaaaccatggaggtacatggggtaactcatagtcaactgaactatgtgttgtatttggcaaaccattatcatggataacagatattttggtggctgttgatgcaggcatggcatgctgaaaaccatagttttcatctttaggataggcaccactttttaactcagcaacagaaaatagatatccaacagacagtggctttgaaacaattagcttgtccatggaaccagaaaattgtgaactttgactgatacataaacccaaacagtcaaataaacgagctgcaacaacctgaaagtggaacaggataaagttaaaagcaaaagaatcattgatccaacaaaagggatgtagataacttacaggagaacggtgaagataatttgccaaaaactgagggcctgcataataagttagagctagtagtcttctagcatgcgaaatagcagtggtctcctcactaccaagtaccatttgtggtaacttttcaacaaacctgttttacatgtcaaatggttgagaactttacccaaactatcacttgtgttgttaacacagagtaaaatagaacgaacctggtaaaaatatcagaaacatcatcttctgttagaactctctcaccctcaatgaaaagataatcaagagagtcttgcgcagcctcagacacagatgctgcatcatcacatgccagaatacataagcattcctgcaaccatctttgagaagttaaaaataaacatatagcataattctaggcacaacacctcaacaagtgataaaatatcatatgtgtacttaccacaagcaacatcttgcttttccttagtgtatagctgcagctggacaaaaggactcttataccattaaccaccgacctccttactttctcagatgaatgaatagaaagctgcaaaaaaaaatagctctaatattcacttttgatggtccaaataaccactcaaacactaaataaaaataacagagaagaaaaatactggcatacatgtggaaatgtcgcagagagtaatttatcaacattattagctgtttcctcaagccatttttttgtccgtttaacatgcagttctcttctatcagcagaggttttactgccatcagcgttcacatcttctgtagcttcaccactgccgatctgcttagataaagttttggccggtaattggcgaagcatctgcaatacatgttcactagaactattgccaccagaacaaagagccacattctcaacgctggaaatatcaagttcactcaaattctccttgtcatttaggactacgatcaaggcctcggtcaatccaagaacagcttgttcaatgctcaaagcactcccagcagcaccacttatcatattcttagatgtgtaaagaacctttccaagacgactgacaagtccaggaaggaaaaaggcaagtgcatccgcagaacctacctaaacaagaagagtaagtttactgaattgtttgtacaatgggaaaacaaaataatagcctcggaaggagtcatgccccagagaaaactaaaacctctgtaacatgcttttacacagaggtatcatgccctaaagaaagataatggatatactaagaaaaacagtgaggctgattcttgctatgaatcagaggaaactgggtatctatcatctctgaaggttggtgtatctaacatcagttcaatatattttattctctctttttttaaaaaaaaaaagagtaaaacaactagccttgtcatcctctcaaaaagaacaaaaaaaaagcctggtcattatgccaatgcaacagctaaacagatactgctggttttttttagccttcatcttttcatggctttacagttctgcaggagaaatgacagcaaagaaaaatgctaatcgacattatgattaagcatttcctgaacaacacaagtgtcttggctagtgacccatccatgtgttgcttgcaaaaaacttctcaccttgccaataagaacacgcagtgtaatcagtgattcttttctaacatctgcactgccacggtgaccccttgatgcctcaagttctgatgactgaaagtgaaaggtgtcatatcaaccaaaaagacaataaaagaaaagaaaaatcaagtgaatcagaagataaaagtaaatgaatgatgtacctggagaagtagtgaaagccagtgccccacagcagctgaagcgttttgggactggaggaacgcaagcaagcactcttctggttgtgccgagtattttggggtaactatagtgccaacttccaaacttgtaaaagatagggctgtagacaatgcagttgcttgtttgcaagaacaagagcggtccaagcatgggtgtagctgcagaatcatggctctgaagcatcttatgatgccttggcggaattcctctgaagcctccgaaggtgaaagcattgccccgaaagttaacttctttagcaatgcaaccatctagtaaggcaaacaaaaagaaactcatgtcaaatatgtgatgagactcattaagattaggatccaggatttcagaaaagttctgcctgccatgagctacacagcacacaggaaattatggtttcatactgtcctcagttgttcgagatcaattgtcagataaaataatacacagattggttaacaagttattactaatgcagctaatgtgtacaggttctagttggagatgatagaatattaaactagagaatcatcaggtatacggaagcagagaaaaaaaaatgaagcacctgattgaccgaggtgaggcggcatttggtaaggagcacctctaggcacgcaagaccgccttcggcgatggcatcaaagatgtggagctcccctgacgcattggcttccttcctgcattgcaccgcagcatccaggagcagcaccaatggaaacacggtgtaattaggcacccaacacagctccaaacaagccatacattagcacaaccaaccaaataaacaaaaaccaacacgcgcagacacttggggcgggggagaggagaggagaggagtgggtactcgaagcagagctgcaaggccggggcgggggcggagcggaggaaggaggccatggcgcggagggaggaagccgcggcggacttggaggccggggtgcgggtgcggatgaggtcgagaagggtgacggtgtggggcttgagctgagcaaagatggcggctagggtttcgtcggaggccgccgcggccgcagcagcagcagcctccatctccatctcggaggtggcgacggcgaggaagcttggctgcgggaggtagcgcaaggactacagtcgagttgctgctgctgcgttggtgcgactgcgagtcgacaactcgagagacctcctcaggtttcgtttcgttcctctggagaagacgacacccacaggccaaaggccaggaagcgtacttcgactttacgtgtacatgtatggcaaacggtattgtgatttccgcatctaggcctcgttggcatgggcttctaccccgggccatctacgtgtacggacggaataatagtaaggaataagttcacttttgatcctcaactcataatattggtgtaaccaaggctccatcgtgtccagttttaactgacaagacaagttagcgtatgacccatgtagcctccgtgtgttagtgactaatcttcttccttctctctaccattctcccctcttttgcctatctctctctatggatagtatattttgttgttaattattatgtcgattatggaaagattagtgataattaaaatatttttttgttaattaaaaatttactgttctcatctcattctctctcatccagccgactaaacaaattagttgttttcctatctagccaatgattaagagataacgtttggatgatttttgtggtaaatttgtacaaagacaacagtgtatagtagaggtagatcctgccgagtcctaaccaatacactccagtagtaaggtagaaagaaaaacatacagatggcaggtgacaattaacaagaaggtactactccagtacaattgtacggctgtgatctttagggcctgtttagttggaaaaaaaaacctacataccacatcggatatacggatatatggacgcacatttgaagtattaaacgttgtctaataacaaaaattgcagattccaccaggaaactgcgagacgaatttattaagcttaattaatccgtcattagcaaatatttactatagcaccacattgtcgaatcatggcgcaattatgcttaaaagattcgtctcgcaatttcctgacgaactgtgtaattgattttttctacatttaatactccatgcatatgtccacacatttgatatgacagcgtgggaaatgttatttgggaactaaataggcacttagtctactactttcccaacttcatatccctcgttttttcattatatgcatgcttcccaaattgttaaacgacgtgtttttaagaaaatgtagaaaaattgctttaaaaatcatattattctattcatgaattttttagctaatacttatttagacatacgctgaaccgtcatttcgtattgcgtgcaatggaggaagtgttcacaacttcatccggctcagccgtatcaagccagcactacatacatatggtgcaggaactctgtgtttagatctatgggcgtaaagtttagatatacggacatatatttgaagtattaaacattgtctaataacaaaacaaattacagattctgccaggaaactgcgagacgaatttattaagcttaattaatccgtcattagtaagtgtttactatagcaccacattgtcgaaacatggtgcaattatgcttaaaagattcgtcttgcaatttacacacaatctatataattgttttttattttatttatatttaatactatatacatgtatccaaatattcgatgtgacatggtgtaaaattttaccagggatctaaacaggcccctactccaccaaaagagcacaaacatggtaacactaacaccccccgtgctgttctacagctgtaacaaacacatacttcctccgtttcacaatataagactttctagcattacccacattcatgtctagatttattaacatctaaataaatatgggtaatgctagaataaatgaatgtagacaatgctaaaaagtcagtacattataaaacggagggagtaataaaaccaggaatttacacttggcgcgtacaaaacggggaaagccatgctggcaaattcattccttccttgcatacacccacagccaaaaggagttacatgtaaatcttatccccttgggagtatttttttcccccttacaaactggtcccctgcagcaaatgcaaaaggccacccagtccaggagtccaggcaggcaaggcagaggcacacacacctcacctatccccttcccttccgccgccgccgccgccgccgccgccaccacgcaatgcagcgcctctccgtgggatcggcaggcggcaagccccgcctcctcgagggcggcgcggcggcgggggaggaggaggaggaggaggagaaggccgggaaggcggggcgggcggcgccggacaggtccatccacatcatccccgtgctcacgctcctctgcttcctcgtcctcttccttctctcccacgacccggcttcctcctccctcgnnnnnnnnnnnnnnnnnnnnnnnnnnnnnnnnnnnnnnnnnnnnnnnnnnnnnnn

SEQ ID NO: 7418 - DNA, 6580 bp, Oryza sativa
cgctcgcaccctggaggccacaggtgattactcgtctctactctactcgcatggattgattcagtcgcgcttgcctctctctctgctcctttgcctctcatcaaatgcaagtgctggtctgttactgcagcggaaacgacggcgtccatcgcccgcagcggcggcgtccaccgccggttaaagcaggagccgaggctggcccgcggccgaaggatggggatggcgctgcggcggcggcgctgacggctaaggctaaggctgtatgtgacgtcagcgcagcgcagctagccgttggattcgttgttggaatcgaaggtgccaaaaagtcagagaagccgacgagggaggagtctctcatctttctcttttcctcctctcttttcttccttgggatctctccaactccaaccatagcaccacaagattacgttcctgcagttcgactctcagtgctactatatgtattatatcttgtgatcttcttcttatcttggccatgagaattggattagccatatgttcatacttcgattcgattccatccacttttggtttggttcatgctattggagtactcctatttgctgatgtactatttcttgtgccctgtgagtgactgaccgactgacactgttgatcagagccagatggacagctccagctgatcgcctctagtttgatggagtaattaattaggcagagtctccattatccactgtacaacctttgattaattgattgatgttgctattggctgttgtagacccttctcactttttcttttttggcgaggaagctgatttcgaccgttctggttagagcttttagatcatagacgtagagtcctccgtctatcgtcagatttgcagtagaacgaacgggtgaaccgataaagaaagacagaaagaaagcgtgcccagtgttgtggagaatggcgcctggtacatcacacaacagaagcaagggggtcatcactcataactctgttgttggttggttccagctgctacctgggtggctcatggtcatggctgggtgggcacagtttgtttacattgctgctcatcacaaagaaattttttgtcccctgtactgcctgcctttgtcttcaacactgtatactactctctccgtctcataatataaaaaatttcctccatctcataatataaaaaattttagagttagacacagccattaaaaaagtagataaaaataaatagtggaaaaagtgaatggtggaggattgtgattagttgtgaagagaatgtcggtggagaagttgtattttgagaacgaatggtcaaagatgtcaacggtgccatacattaaaatacggagggagtatattatgggatggagggagtaacaaacactgggcacaagacaacacagcatggatgtgtaattcatacaggacacccctcttctgtcatgtgtaattaccatcacagaaatgtgtaattaacaaaaaatcaaccctggttttaccatcagggaagacagcaggccggggtccacggatcatgcagcctcctgctcgacacgagtacatgacataactaacagtttcctcttaaaaatgaaacaaaaaatttactaaatggtgtcggcgagcacgggcaccataatgctgtataactgtagggcaatagccaggccttctttcacggtcgattcctccatgctatccaccgacaaggagcttaaacacacacacacagagtcacacacaactggagtatataactcgagtaaacagaaacttccagtccagggggtaaaaaaaaaaaaggatgatcgatgcaatacaagatccattcgcctctcgcgtctctgtattaaacatgttcattatccccacattcaaccttggctttttgaaaacgagggaacaaaaaaaaagaggaataaaacattgaagagaaactctttaccagattaaacagcacagcagaccaggatacatgatgtacatttcatatacgtgacacttataacacgaggcatgagatacaactaacaacatactccatggtacctcaaaggcaaccaaaagaatcacccggattttatttgccaattactttcactgcattcaaatccgaagtagtgcagcagacagcttacttgatattctaggccactatcatacatgataaaaacacagaaaaaaaatagtggcatggtaccaaattatcaaccaattctgtagttattgtccactatggcaaccaaactcacacaaagtcaatttcaggctcaagttgaagcatcattcttttagaggatatggccaggcactgaacattatctctggaaacaaaaaggaatggtgcaaaatcaaattcttttgcacgcaccagcatacgagctttttttctgaagtttcaatcattgcaatttggaaaaatattatagcataccctcagcctgtaccatcttgcactcctacaaactattatctaattaatcgaccatgataatatgatatagctacagataccattatctatataatttgcccaagacattttcctgctctaacctgaagaacaatatgggcttgtgttcaacatggcacaaaaaccgtagacaagtgtgggggtttcaccaggagcaggacaccggtagttcacaaataagcggaacaaaagcaaaaatatcaaaacctcgctaagttaaaccgtaatttcactgtgaaatgcattgctttgaggtggaaaatgaaaatccgcctacatttttcatttagataaacggtttataaggattgcatggtactgagctttaagcctagctgaacatgctggtgaagtgttttgatttttttcttgtctacattacaatggcatgaaaggattactcataccaaatttgggtgcaggacacaaccgcaatggattgacaccgggtcacagttccttgattcccttcaaacagatgcctggtagaattctggacttgtaaacttgcagaggcttccctggaagacacctagttcctagaaattcctcgtcttcttggatgcttgaccgaggtcagccaatttttcctgctgcttgcgtaggtaaccacctgaaattcttaagatcctgaatcaaccactaattcgcagcgggcgatggctctaactccaattaaataagggcaaagtaagctggtggtcaactactagacagtaagctatatcttattcgtaaaccacaagtaaactgagtgagctgagagctgtagtttcgtcgatgttaccagacatagagacgaggttgatgcgggagcggggcgcggcgaacatccagctgtcgtcatcgagcgacctgacctccttttgcagcgcctccatcacctccgacttgagctctgcggggaagcaaccacaaacatagccgattcagaatccaaaaggagaggaggagcggaaaagctagggcttgcgtgagggtttgcctgccatggcctcatccttgcggtagagcgcgtcgatggagtcggcgacgtcgtcggaggccgagatcgcgcccgcgctggccgccgacacggtcgacctcgccggagagctcatcggaatcacgcgatgcttttccccttttctgggtgaaatcgaattggagtcagtctctactgtttgagaaaagggagacgacgagaaattaatgggcccgcgttattgggccggcctgttaacgcgagatggagacggcccatttagtgtccactagttgcgtcttcgcagcggagatcgaacagaagcagaaatccccaacccaatcggaggaggaagagaagggcggcggcggcgagcggagatggtgaggaaggcgaaggtcgagttcgacgagagcccgccggatgacttcgacccgaagaacccgtacggggacccggtggcgatgctggagtacagggagcacctggtgagggagaagtggatccagatcgagaccgccaagatcatccgcgaccgcctccgctggtgctaccgcatcgagggcgtcaaccaccaccagaagtgccgccacctcgtcgaccagtacctcgaggccacccgcggcgtcggatggggcaaggacgcccgcccgccggagctgcacggtccgatgagatgatcccccagctctaccatttcgcttcctctagtttcgttttctctacttgattgatgataccattgccttgttggtgttgcgcagatcccaagaaggtggttgaggccgacgagtagctttgctgctgctgctgttcctgggctggagaggtgaggctatttcttgtctgatgaagcactccaattttatctattatgtgtcaattatgcagcttaaaatgaatgatttgttgttaatattaacttccatcattctacaatacttatctattttgtgtcaattatgcagcttaaaatgaatgatttgttgttaaacttaaccatcatcattctaacaatacttatcctagcatttagaggatgtttgcaattcagcacacacacttgagtaattaattagagctgcaataccctgttctatgttttgcgtggggcataacctgttgttcgatttgattggggattttgtgtgaatataggaagcgttttcgtttaggaaggttcggagtcttgagactgcctaccgtttccattgtatgtagttgtagggataccttctaatgaacaaattcagcatatgccataaaaaagaccattcctgctctcagggcatataacgtaaggaacaatgggtaaagggaaaagtggatacgtgtgaagggggcaccaatcttttttcctttggaataactctatatttaccattagtgctgtcagctatttagtttgtttaaatttatttctaaggacaattgaatggcttagaaacactccacatacattcaaaaaaaatcttaaaagcatcctctagcatgggattctccatatgtcatgatattctgctatcgctctttattgaagatccctctcaatctcttgaccttatctttgcttgcctcgtaagatcgaatagaagaatacatgtggaaatattttgtgcaaacataatctccagcctcttaatctgatgtgatcatgtgatattcccattccaagagggaaaaatgctgattataatatggtcattttgtgatgactctggaatctcttttgtttgattttaatatatcatatttctagtgcccgagtgtgatcgttcacagacatggcgcagttaagttcgctatttactccacatcacaaatcctgccttgtccatcatgcttgtgctactatatgtattgataattatttgcttgatatcttttgctacctctgaagcaccatataactagcatttgatttatcatctgttgaagaaaaatggaatgggaaaaggtacaactatatttatgttgtatagttatagatcatgacttgaatcgcttttatcttttgtgcaggttatctttctattggatttgaaaggagtaaaaatgaactgctgcagtccttattttgacctctctagttgctcatggatttacaataaatgatgatgtcgaagtaacattgttgtgtgttgcctgtatttttccctgcccgttctataagagccgagcaaatacatgcttgaatttatctgccttgttcttgtactcaacgatatgaatgatatttagttttcatttaccctgcgccatagtctcccgtgatgccaaatgcagtgcaagtttctttttggattaatgctctgtcgagcactagctgattgctgattccgagccgttgtcaagctctgactgatgattacatggcgtgttgcaaaccgatcgttatctagtttgctccagtgtatttgacacatataaacgtgtgacttgaaagagatagcctattttagttgctgtttgtgttaggtaacatgtccatgttgtgacgttgccaatgatcagttgatcaccacggtccatccatgaggtcgatgatgttagttctacacaacacaacccaaaatgcaacaaccaactctctaccactgcaattctctctttgacacagattctggcctgctacattgtttgtgatttcgcatctcgcaaaacacaaaaaagaagggcaaacaacagaaagacggtggtgagacagttgcattttctcgaatctttttataaccatttgaatggcatttgaactttttgaagaaaggatagtgctcagagagacatctttcgtggaaaatgtggagtaggagacgcacgggtatctgagaaaatcaaagcaaggcatctgatacgagagaacaagaaaaacattgggtgaataaacatggagcaaaaacaagaatcatgcagcaaaaaagcaagcaagttgcatccatgacctggataaacagaaaaagaaccaaacttttttcatatgagatgctcactctggataatgacccgtctcggccacaaacaaccaatcacatatcacattcccaggaaatgatgttgatgatacatacatccatccacaatccacggattaataagcagatcgatatgcacatccccagcagggggatcctctagagtcgacctgcaggca

SEQ ID NO: 7419 - DNA, 14597 bp, Oryza sativa
  unsure (1)..(14597): unsure at all n locations
nnnnnnnnnnnnnnnnnnnnnnnnnnnnnnnnnnnnnnnnnnnnnnnnnnnnnnnatctagcatgaaagaggggttatatactacacaaaaacataaacagcacccaccatgaaacattaggattattctttaaacttctaacatcaaggggcggtgttaaaaaaaaacatcagctgggatggagaatcctagtgtgactgatgtcatcgattgtacaaagcagcttatgcaaattaccatattgaacgacctgaaacttcttacatatgctgcgcacaagaaatactcacagcattgttctgtaataattcgagttcattaaccggtaccaattttgatgcaaagagagctatggacattctccttaccataaccaggccttacaatttaagatggaaactgaaaaggcctgaggtaacaatatgagaaactgcaaagctgttaaggctagtgtgtttagataacagtgttaatatttccatatttctttgccctaactactataaacagttaatgtgctgtttctcacaaattttaactccaaaactataccataaaaattactctctttacacacacacacacaaaaaaaaaactccctctgaagcaatcatgtgcacaaaccatgcaagtattgggataattgtggcatcagagaacaagataaatgaactaagcagttgaaaagaaacacatcagaggctacaaagctgaatgaaaataaagggtgcaccagaaggaaagagtcatatatatttttctaaaaaaatcgttttcaacagcagtccaccagatgaacaaaacattaacatatcatagtcacaacaacatcaagaagttcaaataacaatatcaaccaggtttataggccttatatgttgggatcctcgtattatatttgccaccaattacactcagaagtcagaaaaaaaatatgtactcttggaaatgtgagcattccatttttttcaccttttaaactgaagaggataaagggccgttgagacatattattaatgcaggatataaatgttcaatcatatcctaccatttccctttcaataaaatggataaactgcacgatgcaacttacgctacaaacaaaacaagatacatatagcttgccctggacataaaagggaactatccgtaggtcaatcaagtgatcaatggacactgaatattagacagtacagaacacagatagaacaaatttgagatgcgccaaacttaaaatatctcacagtatgaaggaataagaaaggggcagcctgtcattatgcaactttgacgcggcacagcttgtcgctacgccagttttggcgccgcagcgattcactgcccagcacttgctgggcaaggttccaaccaatggaagcactttaaattcagccaattagtgcagagacatgctcaaaagaaataagatggaaatgaccaggctcaaaccaacttaataaacaaagaatcaatcaggtagacataacaatatagcatcctttccgaagcatattcaaccttgttcactgatttaacaataatgatgataatagaactggtgacataaacagaataagaatctattctgcatgcaaatgaccaaaggatagaaggtatgcatcacccaagggtttcacatgtatcaatttttaatttaattgagaaacgttgatcatcgcagtactgttaaggatatccagaggaaagaaaggacccagtgattgatcaggggatgagattaaaccatttatcactactatgttattacttgcactaagagagtctttttttttctaaatttttctaaactagttcatctagttcacgctactaccagtctaccagcattctggtaggtaggtacataagagaaaaaaaatatgagcaaatttggcgactcaagaacaaaaattcatccagtactcaggaacaaaagttttgtgcaccgagcaaattttctttgagaacttcgttcttcatttcttttctctctcttggctgctctaactaaactagatgaagcaaattacgaagaacagaaggatacctaaaacaaccagtatgaaaggagttaggagaaaggatttacaccgcaggtagggtctgtgcatggcaccggtgaaaccccgacatggtcaggaatccgttaatcccgatctccccatcctaattgcttgctcgttattcccctcatcagattttctgcaaccagcatacctggtacctcgcgctgacatccaggcattgcacgtttgcgagcatggcagtcgaaattgatgtggctcatttgacatcctcgtcattggggttggggttgaggttgggcgtgtcgtcgtccttgtgaaccatctcccagaagaaatcggtgagcacagtctcgtatccgggcatcttggcatagccggggaagtagttgatgtcaatgacgaggtagcgatccccagcgcgggcgtcccggatcatgtcgaagttgaagaggtggaggccgagggcgcggcggagggcggcggcgatgtcgttgatgaaggcggtgggtggcatgatggcgtcctcgaggcgcatgtcgtcgtagtactcctgggcggtgcgctcgttggggaggttggagacctgggagaaggagagggagccctcggcggaggcgtcctggaggacgtcgctggagacgtcggggaggctgcggcgcttgacgcaggtgacgtgggcgccgacgacgtataccttgaagatgacgccgccgtggttgacgaactcctggaggacgagcggggggcggagcttgcggaggccctcgcggtggtagacgagggacatcttgtgggacttggcggtgccgtcggcgacgaggggcttggcgatgagggggaagcggagggcggcgaagaggccggagtcggagagggcggcggcgtcgtagacgacgacctgggaggggatgcccaaggtgtggtggtggtgggcgtggagcgggacgtcgagctcggagacgacctggagcatggagatgcggttgtggaggcggtcgatggcgtggggcgggtcgacgacggggacggctgggtgcgcggcggagaaggcgtccagctgaccgcgccactcctcgccgtagagcttgtggatgaggaggtggaagggcccctgctcggggaggggccgcgaggggtcgacggggacgaggtccatgccgcgccccgccgcgcgcgacaccagcgacggctggatgaagctctgctgcttcttcggcgccagggcgtagccgatgaggtagcgccgccgctgcccgtcgccggggaggggctcgtcgccggccatcgattcggttgagttgggttgggttgggttggttttgcttcgaatcgaatcaagcggaagcggctctctctcctccctcctcctcgcccacgcgatttcctttgttttttctttttttttctttcttttattttatcagaagagacgagacagataaaaagaaggtgggagtgggagagggggggctctcttctcctcgctttttgcttccatatgaaccaggttcctcgtggccttcccgtacacttcactgcaccactcttgtcacgtcacttatactagtagtacattttacaattatatatactactacatcatccctaaccatgtactgtatggcgttgattagttcatttttacatttgtagagagcactaccttatccatctacagatactagtactatctactggcatccttcgtatcaaattaacgtagttgcaaatgaaataatggatgagatttgccttcacaaaatactccctccatattttaatattttaatatatgacgcgttgacttttcgatcaacgtttgactattcgtttcattcaaattttttgtgtaaatataaaaatatttatgtcatactcaaagaacatttgatgacgaatcaagtcataataaaataaatgataattacataaattttttgaataagacgattggtcaaatgttggataaaaaatcaacgacgtcatagaggtagtacgtaatatagctcgagtgtcttcatcttataaaccttgaaccgcaatatatatctaacaaccattatttttaggtttagccgtaaccgttgtttttctttatttgtgcaggcatgcatactcctacacaaattttgccttaattttgtatcgtccatcccttcctcatctttggctattaccgacagcaccaccgccgttaagcctctagatctcaccttaatctccctctaaactcaccctctttatctaaccctcattttgtcccttctcaaccaaagatctaaatcaggaggggtcaccaccacattctctccatcagatattgctggagtcagaaggaagaaacatatagcataatcttgattcgaattggatagtagaaaatgtataagaactctcttttgattttttctatcgaacgagagtcagcaaataaagaagcaatgtttttatctagcataataatatgatccaatatattaaactttatcttgaaatgggtcatttttgtaatcttatgtgttttatcgtaattttatcttatctatggatatcattttctaggaggggcatagtgttccgttgtagctcctttagatcttgtttgtttgtttaattcttaatatggagggattcgagggtcgggattgagaaaaataatttaacaccataatagatataatagatatggaataaattttctttaaattttttcgtgagagggattaatcaaacaagtccttaaaacgcttctccctaatttggtaaatcttcgttgatacatttgattacatttttggatcacaatagcacgtaagcagaaaccatgtatatatgtgaggtcatagaggtggattgatgtgaatagaaagaaagaaaagcattaagaggaacattttgacgtaggttgaacatgtcatcacattagaaatttagtgcaataatataggtaagaaaagaagaacaaaagaaaaaagtcaaataaacagtactgggcctcgccgcaagtgagagattagttaatgacaaggtttgctagtaagaagggtgtaggggatgacacgatagtgagatgattaattagtagtagaaggttgaaggaggacgtgttgttagctagtgttaagagtggtgattagtcaactatagtcagtgaatctcacctggaggtgtttgttattgtgtggacatggtccatgagatccatgcatgcatggtataagtggcaccgcacctgatacggtttagaaggtataagtgctgtaatattcgtgttagcgctaggaccccgagcaaaattccgcggggatacaagaggtgccatgtgatgctatagaagttttttgtccgtctaggtccccgttcgaatacactaaaaattttggataaaaatggcacgcttttcaaactgataaatggtgtttcgtgcgaaaattttatatatgaaagttgttctaaaatatctgattaatctatttttcaagtttgtaataattaaaactcaattaatcacacattattaccacctcgttttacgtgaagcacttaatctttatctttatcttcatctcctccaaggagtcacgacacttaagcaaggggaggtgttagtatatgttgtgcgtggaatgtggatgtggtccatgagaagaaaggacccaccccgagcacatacatcatcggagcggagaatggtgatgaaagagaaattggacattctaccgctaccaaaagagggtttcgctataatgccattccgccgatttgatttgataaaatgccacccccaagcgatgcgaagcatttgttttgccatattcgccatttcattccattttcaccattttttgcacccgggctgaccaaaatacccctttaggtggcttcttctagctcaacccttctctctccttggccactcgtcgagctgaggaagcggccatgagaggtggatgcggcggcggagctcgatccggcgtcggtggtgccggccgcagcctccgtctcagggctctcgaagaggcagcccatacggcaaaggcgggcgcgatggtcacggtggacgagaggcagcggaggccgaagcaccatcggatgcggcggtggtgactgcggcgcttgagctggaaccccatggccaacgcggcggacgccatagtggcgggcgggtgtgttggggccgaggtgggcacgacggctgtgaggcgacaacaccacccttcgttgcagcggtagaaggggaggtggtgaccctaccgccagcggtggcatcgaggccgtgccggacgtaccggatgaggccgttgtccgtcatgctactcccctaccgccactggacgcgcatggatcccctttctagagctcgatgagtggccaaaagagaagagctgagctagaagaaagggtattttggtcaacccaggtgcaaaaattggtggaaatggagtaaaatggtgaatatggcaaaacaaatgcttggttgggggtagcattttaacgaatacaatcggcaaaatagcgaaactctctcttttggtagtggcagaatgtccaatttcttgtgatgaaatgagtgcgagggacacgactgttgtagaacggctacgtcaacggatcgcccagatccgctcccttccctcccacagaagatggggcgcgagaagatgtagaatcccgtatcccttcccaaacaatcataccataggagacaatggacacaggatataggggtggagctctctctttattaatcaatgattgtgtgtacaatgatgggcacccctgcccctctatttataggtagagggagtcttagagataagaacggttttatctctaaaaccgattcggattggtccacaagttagaatcttatctccccatggagataatattcgtaacactcccccttggacctatccacgaccaacttatgcctcgtcaaaactcctaccaaaaccctgtgggaaaaaggctaggagaaagagtacacagttgtcgccatgcatcacacaccgttgcctcattaaaaacctttgtgaggatcgcaagctccactcaactaaggaaaagagtacaacgttgtgaactcacctgtccactaactaggccaaattcaggggtttctctccccctaaaccctgcaagtctctaagtcttctcatcccaatgtctctaacgaatttttggaaagtacatgctgggagagacttagtaaacaaatctgccaaattgtcacatgacttggattgcaggatcttcacctcaccttgcttctgaagctcatgagaatagaagaatttaggagcaatatgcttcgtcatattgttcttaacatagcctagttgcatctgtgcgacacatgctgcattatcttcatagataatcgtgggggcattggagatactcaaaccacaagaccgttcaatatggtgagtcatccttctaagccatgcacactcacgtgtggcttcatatagtgcaatgatctctgagtggtttgtagacgtcgctaccaaggtctgtttactagaccgccacgaaatggctgtaccaccacagagaaatacaaaaccagtttgagatcgggcattatggggatcagacagatatcctgcatctgcatagcccaccatggttaagtctcgttgccttggaaagaagaggccgagatcttgcgtaccctggaggtacctgagtactgtcttaacgccaacccaatgtcttcttgtaggagacacactgtatcttgctagaagatttaccacgaacgcaatatcaggcctggtgcagttcgcaaggtacatcagtgctccaatggcgcttaagtatgggatttccggtcccaactcttcctcagtttcactcctaggacggaataggtctttatccttatcaagggatctcacaaccatgggtgtcttcaaaggatgagcctttgacatgttaaatctctcaaggacctttttagtataggtcgactggtgcactaaaatcccattagggagatgctcgacctgaaggaccaagcagaacttggtttgacccaagtctttcatctcaaactccgtcttgagataggcagtcgcctcctcaatgtcctctacgtggtcaatgatgttcaaatcatcaacatagactgagatgatacagaaatcactctgtgactttctgatgaacatgcagggacaatcctcactattgacatatcctttccccaaaaggaagtcactcagtcggttgtaccgcatacgaccagactgttttaacccatacagcgatctttctaatttcacactgtacatgttgcgatttgctttgtccgggaccttcaacccgtcagggactcgcatgtgaatctccatccaacgatccgtacagatatgcggtcaccacatccatcaactgcattttcaattccatgccagctgccatagacattaagtatcagaacgttatgccactcatcactggggagtaagtttcatcataatcgatgccgggtctctacgtgaacccttgtgctacaagcctcgctttatatctcaccacctcattgttttcgttctgcttctggacgaaaacccacttgtacccaacagggtgcacagtggggggtgtcaggcttaccggcccgaagacacgcctcttagcaagcgagcgtaattatgtctcaatcgcttctttccatttgacccaatctgagcgctttctgcactctgccatggacttaggttcaagatcatgatccactatttcagcgatcttggagacaaaatttatgtcgacatgtgtagtcttccgattatacaattctcccgtgatggcataatctgtggcaatttcttcactcatttcctcatcctggtttcccaaaacaggagagggttccgatgcaccagttggactaggtgcgcatgctagtctactgggcgttttgtcgttttggcgtccgtccccaggatggatctcctttgagactactgaatgggagcgtgatgcgagcggtactgtgttcagctcttgcggacgtctccgcttagcatgaatcagaccatccgggtctctcccccttttcctaggcttaggggctggagtaaagtctccctccatgggtatctctactctctccggtgcatttgccgcagggatatgcaactttgacactcctcttagatcagtaaaagcatctggtagatcattagctaagttctgaaggtgtatgatacgttgaacttcttgttcagcatctggcgaacgcgggtcaagagtatggatactacttgagttccattctatttcacggcattccttagagtcgaggtactttcctccccctaatgccggaaaatgctcttcatcaaagatgcaatcagcgtaccgagccgtaaacagatccccaattttaggctccaagtagtagattatggacggagactcataacccacatagacccccaccttacggtgcggtcccattgctgtacgctggggtggtgagatcggcacatacacagcacaactgaactttcgcagatgggaaaccaccggctcttgaccacgcgccagttgacggggtgaagcagagtgatatgcagacggtctatactggattagctttgcagcatgcaatactgcatggccccaacacgtagtgggtaaattgctaccctgcagcaacggtctagcaattaatttgatccttttaatcagtgactcagcaagtccattctgagtgtgaacatggggaactgaatgctctacattaatgcccaaggccatacaatagtcattgaatgcctttgatgtgaattcacccgcattatccatccaaatcgttttaatgcggttctcggggaactcggcacacagacggatgatctgtgcgatgaatttggcaaaagcgtgattcctcgtagacaacaagcatacatggctccaccttgtagaagcatctatcaacaccatgaaatatctgaatggccctgaccaagggttaataggcccacagatatccccttgaattctatccaagaacctcgaaggagggtcgaatgatcagctttcccgttgcacaagcgggacacacgaactccttagggaagtttttagtgtttatgctatgacctagtgagcttgtgactattttccgcatcatagtcaatccaggatgacctaatctctcatgccagattctgaaagactttgggttcttaaagatggtctgcatcgcaatgtattcatatgggggttttatcttagtgtagtacagtccatcgaagctccctggcattttctcaaccaccgtggtctcatcgccctcagacgatgtcatgaagagaaatttttctcctccttcacgggttgtggcaaggtggtaaccgcagcgacgaatatccttaaaggtaaggagtgtgcgttcagcacttgggtataggaatgcttcttcaatgaagatccttgtacccatagggaggacgactgtggctttccctgagccaactatgagaccattactcccagcaatggtgaggatgttctcatccctcttacgcagtgtcgtgaagtacttagtctcccgtagtatcgtgtgcgttgccgtgctatcaaccaagcacgtctcaggctccattggattgtactacgcttgttctatatgagagattgcattgtttcaagttaattgaaagaatgaaaagcaagaacatagaacaagacaaaggccaaacataactcaacgggaaaactttattaatgcaaaggaccatcctaaacacactgaccaggatgctttgctaaagcatcattattacatagatgactcaatgttctgaaaaataaatcacactgactcagtatgatgagctaaatcatactaacacatgatagcctagacttaagacacatatttgataacttgggaactactgcatgtccccatgtatgtcctcattcatgaggtcatcggtctcgccgtccccgtcgaattccccgaggtcaatatcgtcatccccaaggctgttatcagctgcagcagcagtcttgggatcaacctccatgggagcatcagcaggaggggtatcagttccagtcactttaacaaagtgattttccggcccctgcttcttcttccaatcctggtacatctcaatgaggtgaggttctgtgttgcaattgcgtgcccaatgcttctttgagccacaatggtagcaaccctcaccgccctgttgggatcctccactagcatcgtcagcagcgccactcgccgggttgcccttgcgacccttgcgactgcggggcttcttgcccctcttgacgaccctcttgaagtgtcttccattaggtagtgtgcggctaccggatcccttccccttggaggaaccttgtccagagttgttacccttctaatgaacaacgtgagcctctggaataggctgtgaaccaacataacgattgttgaagttggtcatcagaagtttactgtggacttcagcgtttaacaacgactgaatgagcttggagtacttagtgtacttagcctcacggtactgctcctgcatcatggaattcttggggtggaatgtgtcaagagtcttttcaatcatgtcttcgtctgtcacaacttggttacagaaacgaagtttgctgacgatgcgatgcacggcactgttgtagctttccacggtcttgaaatcacagaaccgaagctgagcccattctgctctagccttcgggagaatagcagtcttctccgcggtgtaccgttctctcagggcctccaacagcaggagaggcccacgcagctcgaggtactcaaccttgaggtcctcgtgaatgtgcttcctgatgaacgcaagtgcctttgcccgcttcggcatgggaagcggggcaacaccggctccttgtcgtcggatggattctgacagttccatcgcggtaaggttgatttcacagtccatggaccaggtctggtagttcccaccgttaacggtgaggatggggaactctttcttggcgtaatccgcatcagacatggcctgtttaacatgcaaaaaatcaacgccgggttaacttgcatgaaaacaaagtcacagaacaaagtagcatagtcatatgtaattactggtattttcccggagtttgtcttgcatttgttgattttctgtgattattattggccttatggcatttaatatcaagaattatgcccacagaaaacattacatatgcaagaaaataaacccaaataatgcttccggggaggggtcacttacactaggtgagcacaattttatggaagcattaatctagaaaccttatctagattttagttggagttgcatcagagttaaaagcaattaaattgcttaaaaacaccattacatggttgttaacgagtccagggactcacatgcaaaaaaaccaactagaacaaggcctaaactacaaagttgtagcctatgtacacaaagggaaaaaaatagggtccaaaaagtaaaaaaatactttcaacagtgaactttaggcgtaaaatcaaccatcccgaagggatttatacgcaaattttcagtagattagaataaccgggccgaaacgccgttcggtctacggtcttattgggtcggtttttaccgtagcggcccaaatatcctattggaccgaatgctacactctaggtccattagaatttctaatttactatttttagattcctttgtgtgggctgtctcgatctgatgggccattgcggttggtccgaggagagagcaggccggcccagccggcccaatgaggaaccgcaagaggaggggggtgagaggggattagggtttcccctctcccaccggcacctgtcacccagcaagccggccggagaggcacggtggcggcgacggaaggcgccgactgtcagtgtcggaggggattgaggcggcgcacggcgaggactccggccgacgacccatcttcgcccggcggcaagacggcgacggcggtgtcgctcccgagcggcgttcggtgcggcggtggttcggcgacgtccggcggagctccgccacgacccacacgtccagaagacggcggcggagcgtgctcgacgtcgacggccaaaacaccagcgacgacaaccgatcgcgtccggccatggcgtcccgacggaagctaatccgaagtcggcggccggtcgtcccatcctcctcccaccacggctcagggcgcgtcggcaagaggttgacggcggcggctgcccgtcctcggcattaggtcctgcggcggcggcgacatggggtgttggtctgcctcgtcgtaggcggtttcccgcaacggcgccgacgcgagggtcggtggcgttccatcagcgacggcgagcggcggccacccggcgcggcaccaaaacccatcgacgtgggtggtccggcggcggctcgcgtgctcccggcatggctccggcgaggtagatggctgagagagagagaaaaattgagggatgcggggggatttgggggcgtacgcgaggacgaccggttcggcccagccgaaccgggttcggtcccaaaacaggcatccggtcaattttccaattagaacacacggttttcttccggttttcatcataaagcaatagatgcaaatagatctaaaacatgaaattaatctactgctagatcatgtgcatgaaaaaccaatctactgctattattgcatcaaaaacatgatgaaaggcaagaaaacctaatcaatctactaattgcaaccaacaatttttaccgtagattgatcggcgcagtgggactcgaagcagtggcaagtcgattgcggtgacgagttagcagatcttgtcgtagcaacccgtcaacgtcagcccagtggtagagctgctgataacgtgttgtgaacggctacgacaacggatcgcccagatccgctcccttccctcccgcagaagatggggcgtgagaagatgtagaatcccgtatcccttcctaaacaatcactccacaggagacaatagacacaggatataggggtggagctctctctttattaattaatgattgtgtgtacaatgatgggcacccctgcccctctgataagaacggtattatctctaaatccgattcggatgttaaatctttatctccccatggagataatattcgtaacaacgacaacgcgtgcgtgagcgtggatctgtgcggtcgccaaccccgtccaggtgtcaatggaaggagaggacaggcgacacccgtgcgaccaacaccatggatccaacagtaggagtcatacatgggccgggctggaaggattaagggaagaggatgcacggcccataatggtcaacatgaacctcgttccgatccaggacgacgcctgggccgagtgtgtggcctgccctcacgtaagcccaacataaattcttgctcgatcgaaccaacaacttgaaagagtatgctgaatatggaattttttttatttataatttttcttattaaaagttttacaaaaataattttccattttgaaaattgacggaaatagtcgcctaccgccctctgggagggcgatttttaaaa

SEQ ID NO: 7420 - DNA, 9787 bp, Oryza sativa
aagggggggcatgaaaatttgcagggggcccccttgccgccctccgcgagggcgattttgcactgtgcggggggccgtctgcaaatgggcggcgagggggcatggaattttgcaggcggcccccttgccgccctgggggagggcgatttttgcctcccccctataaagcccagcccctcccctatgaaatttcattatattcactaaaaatccaaaaaaaacgaaagagagagagaggggagggcagcagaaggggagcggcgaagccctgctggttcgctcacttcatcacaggtatgctcccatacatcttttgcatttgtactaatatattacgtttgagtacatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaaatttagagaacaatattgtagagaatgtaacttagggcgtagtacagaaatgcgaggttaacgcagttattgttttcatcaggcacaatgtcaagtaaggtcacatttcagatagttcacggtgaagaaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtatctgttgtagtgagtcgtgcaatagaaggttatttttgggaactaatgccgatggacagcactgctgcttggagacggtatgtggaaatggcttttgaacggtcatggcccctcgttatatttgtgtcggtaccagagaaagatacaaatgtttcaatgcaaaccgaagatgtggagggtcctagcaatgcaggggatgttgttggaccatcgatgcaaaatgaggaaaatcaaccaagggaggagcaggccatgggcatggcggatgagggggagagagtcggtataattgttgatgaaatggagagggaagattcgtataatgagcaagcggaggacgacgcatcatccgatgaggaaggtgatgtaatggccactgatttgggcaaatgaggacttctctggtcttgttatatcagagggtgatcatgtaccctgggagtataaggagtacgaggtaattgagggtgccaggtatgctcataaggatgagatgaagaaggcggtgaagcattggcaagtttcattgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctgagagccaaacaaaagatcattgagatgaggtatggcacatttgaagcttcttatgataatttgcctcgtttgttagccaccattgcccagaggaataataatacttactatgacctacatacatttacatcggttgaagatagaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcggccatcagaaatttctctcagtggattgagaatgagcctaaggagaagtgggctctattgttcgacaccgatggatctcggtatggcataatgacaaccaatttggcagaggtgtacaactgggtaatgcgaggagttcgagtacttccattggttgctattgttgaattcatccttcacggcacgcaagcctactttagggatcgatacaagaaaattggtccgtccatggccgataacaacatagtgtttggcaacgtagtgacaaagtacatggaagataaaatcaaaaaggcacggagacatagagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttatattccagatccatctaagtttagggtgaaaaagggtcgacgccaaactagacgcatcagaaatgatatggatgagtcagaagcaggtgggaggactttacgctgcagcaagtgtgatctgcgcggccatacttacaagacatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctttcgatttaggaaataaaatgatgtaatgagtgttcggactaaatacttctatcgtgtaatttcaattcaatcttgttgtaatgagtacctccgactattgttgtactagtagtattgcgaactattcggtgttgtatcataatgttatcgtgatgagtgttcggactaaacacttttgtttgtttgtactcttgtttaatatgtgttagtaattcgcttatgaacatttattacttatgttgaactaattatttatatgtttctgatcaacctatttgatgcaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgttttatacttatgtttgaagtttgctctatacaggttgcgtgcggcaggccttctaccactttgtaggcttgttgaggcggcggcggacgaccgtgacccagcgaagcggtgggatgcagaccggtcactccttgccgctcttgtagaccgctggagacctgagacgcacacgttccaccttccctgtggggagatggctccgacactgcaggacgtgtcgtacctgctcgggctaccgctggcgggagcaccagttggtcccgtcgacggtgtttttgggtggaaggaggatatcactgcgcgcttcgagcaggtgatgcgccttccacacctaggaccgaccaccacccttcctccgtactctacagtcgggcctagcaaggcttggttgctccagttcactgtaagtaaataagttgttattatcatacgtgcttatttgcgaccggatcagtgttttgtactaacatttcattcttaactgtaggcggaccttctgcaccctgacgctgatgattactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgtcctatgttgcttcagctttgggcagccgagaggtttgccatagggcgaccagtggtggacagcgcaccctacggggttggtcgcagcgcgcagtggccagaggacggtcccacgatggggacttactggtgtcgacgtggggttagtgcaacttcgctgcgttataagtttatcagtcctcttcttttttttccttcacataacatgtctaattccgatcatgtttattgcagcgtcgttacgctcacgtccaggtgagacgtggttacccggacttcgtgttcgagtttgaccgtctccagccgagcgacgtcatctaggagccgtacacagaagaggccgtcgctgcgagagcaccgctaggactttcgtccttgtgcacacgcgaccaggcttactggctcaccatcctgccgatggtgttcgacattttcgttgagcctcactggccgcagcgtgtgatgagacagttcggacttaggcaggtgtttcccggcaacgtgcagccgaccgtcccccctgccgaccactcgtgagttcggattgttcatttctaaatttttatgataattacatcatcgagccatacaatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttccaacaattatgtcatttatcttgcataatataggacaactactgaattttttatttccatcttgcataggctgatgcggcacgggatatcagtgccgatatcaccgcagtccaggtgaggttgaacagaggtttgcacttgactgacgttgagcagaggtcgaccttcgaccggatgcaggagaagatgcgtgcggtcatgcgcgtcttctcctgtcgcagcgccgtggacgtcgtacctccagctggtccggtacacccacggcctcgcggtcctaccgtcggagcaggacctcgtttgtcttcgagcgcccctagcttcggagcagtgcgacctacagcaccggtttcgcacggtacagttcagcccagatattagttcatttttgtttcagcttttgcacgaatgtgtcaccatgttttaactgcacgtttcctcatcgcaggacctcgtatgccttcgagcgcgttcgcaggcacgaccggcgcttccgcgagctccgcaggggcgttcgccacctcttcaggcgcgttcgccagctcttcctctcacggagcgtcgatccctcgcccacacggtactttactttttattaatactgttaaatacctatacgaaactgatggtccttgtccagcaggatttgcagccgggatcttcggtactggggcctcttcgtctcacgccggtaggactggtcctactagccagttctacgacgatgacttgcacggtgcagaccaccaggacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacgtagttcttttcattcgtatggtgcttgaacaacttatgctcacaacaacacactttcggcgcttcacggtagtgccatatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactaccacaccacacacgaaaatggaagcctattaattggtaatacgtaatctagaattgagattatgtacaacattcttcactacaattttacattttggcagcaaaccaaatatgatcaaatgcaattttaccttaccaaatatttggtagtgccaaaacttgcttatattttggcattaacaaaatatttgtacggtaacattccaaatatgcctaaaaaataataaaattgtattttaccaatcttggagattttaatcttgtatagttttcaatataaaaagatttgataactattgatatttatataaaaaaatatagagcacagtacaaaatcgccctcccccagggcggcaagggggccgcctgcaaaattccatgccccctcgccgcccatttgcaggcgggcccccgcacagtgcaaaatcgccctcgcggagggcggcaagggggccgcctgcaaatttccatgccccccctcgcccgagagcgaacggccgtctgccacgtcattttcgccgccctctgggagggcgatttttaaaaatcgccctcccagagggcggtaggcgactatttccgtcaattttcaaaatggaaaattatttttgtaaaacttttaataaaaaaaattataaataaaaaaaattcctgaatatgctgtgttgtgcgatggatgatctcactcacaccaatgtcccaacggatggatgtattaatggatggacatggaaatagaaaacaaaagttgtattgtaggagtatacaatacaatacaattaggaaggaatacatcctggcagtgaggagggagatgaaatgaaactagcttgaaagaggtagtagtagctagcatttgactcgagtataattaattagcagagtgaatttattatgaggtgttacataaagaagcaacaagtctggttatccatgtgcaaagtgtggtacggtgtggatgaatcatccagccgtccgtccgcacttgaactgagctgctctgctctgctcggcggcctgatttgcatcttccaaattgctcgatctgctcgccgccgcgcgccctggcttgcactgcagttgaattgatctctggtgttcatcagtgtgtgtattgacgatggatgtagccaacgatccatcatcaagaaggcgctagctactggagtatgtacagaagaagcaaactgatggagcaaggatcgatgtgctagtaattaatttgtacaagcgcaggcaggcaggcaggcacaccaggatggatcgtgtctcgatctgcctttgacaaaagcaagctctcatatgtacacaagcaaaggcaaacgccgggttgggttagcaggacgccggcaccagcggcggtttcatctcatcctctgcttcgtcgtcttcatcctcttccgcgtcccacaggaaactcgcgtacgatccaagcacgtagctgcacgcacgcacgcacgcatcaaatccaaccgtttcgttaattgtttgattctctgtctttaatcaatcaatcagcaaatttagtagtaataattagtaccagtcatcgggcgcggcctggacggcgcgctccaggtaggcggcggcgcggtccttgtcctgactcgtctcccacagcagctggccgtagaggctgagcaggtcgccgtcgtcgggggaggccagcagcgccctggcgtagcactcctccgcgccgcccaggtcgccctccacctcctgcaggtacctcccgtagttgcgcagcaccagcgggttctccggctccaccctcagaacccgccggtagtactcccccatgtccatgtgcccgccgccgcctccgccgcgcccggacgtcttgtcgtcgtcgtcgttgcccttgccgcgcccggcgccgtccaccaccacgaccacgtcctcctccaggatgtcgcggaggaggaggggcagcggcgatgatgccgtcgcgggcgcggatctggcgatgtcggcgtcggaggtggcgcggcggaggctctgctgctgctgctgatgatgatgatgcatgctgcgcggggagacgcacaaggctgtgggggagcgccggaggcgtgggaagagggaggcggagcgcgtcacccgtgtgccggtggcttccatggatggatttggatctacttacttgtcgatcgctgaggctgagcttgagcttgagctcgccgccggggtgagtgagttttatagaggagaagaagcaggtgacggcgagattgacggcgtgaggcagtcggctgggggagcacgtgaagcggccgtcccgtagtacacgcggccgtcccatgccctcggttttgttggcctccgctgctggtttctttctactccacactggagtaccacctttctccaagtctccatccagccaaatgcacttgctgctgctgctgcttgtaatcactgcatctagccaattgtatgtaatgtatttctttccttgtttttttcttgtttcttgctaatgaaataattcatcctctccgtggacgcataaactttaacagttttatgtttttttctttttggttaaaaatacaaagacatatactatatagttatacattttaatggatatatctaacacggtctcataacatattaattggagtattaaaacatgttactcccatccttcttcaatagtaatagacattttgaccgtacgtaacatgtcatgtggaacaatgcaacaatttagctcaaaatttaggatcaatttgcccttgtcaattgttaggcaattcaattaatgaactaaataaagtggaggtgcaggaaagggctgaaccaaaatataagtatggggcaaaattgcaatttttattaatgaaagcatgttcacgataagtatatattttgaaacaattaattaatggtctggttaaattgtcaattattcacaacgaaggagttataaataggatatatatatacacacacacacacagatatcacttgggtatatacatttgctc

SEQ ID NO: 7421 - DNA, 2312 bp, Oryza sativa
cacgcagctttgcatgccttcctgcgacaattgagcgaggcagagttctctccctttcctttaccaagctaggtatcggacggagctcaacgtacgagaataatattggtggtggattgagagcgagctcaagaatgatcgatggctgtgtgggagctcgatagatgatggtgcttaattcccagttgacgtacggttggatctatatatagcaccgaccaagcgtgaggaggagctacagcctacaggccagggacacagcaggctgccacacatgagctcgccggtgatggccacaaagctaaggagagggagagacagaaagagaaaaaaagatgaaatccagatcgaggggtattttgatcggctcgcgcgctaagaaaaagaaatgcaaaaattcatttaatgatcaagaagaaacggtgttgtaacgtgttgacgcccttcttataataatgaagttttaacgaaacccggcctatctgtgagatggcgtttcagcaaacctcacttttaacaatatatatatagcagaatataccaattattttctcctttcatttcgattaggattgcaggtgaattaattggtgatcgaatgcaatatctcgatcatacggatggacggttgctgtgtgcgctagctagctgtgcacagaccacagtacaggcaggcgggcagatactagacagacaggcaattttggttatggttttccgccgatcgaatcaaattaaaccaccttatataatttcctcgtttaatttcatgtgcaatagtatactagtaggccgatcgactgaatatattcaacggagtgagtacttatttcatttataaagtgaggaagaaattaaaagaaggagaggtactccagcggccagcgagcaactgtatctccggtgctgcacgcacgcacgacactgtttaattaatgcacctccctcgcaaccgaaatgcgagtgcatccttgaacgatcgcctggcctgtttaatttgctccatcactgaatggcacaccaacagcttgatatagccaggaaagttgacttactgctgtctgctggtgaggtgggatcatccatgacttatctgatcacacacgattttcttttagaaaaggaagaacatcgtgataatatttgagaaaatgaagagctagctaggaaacatccagttggagggtgaggaacctgatcaaattgtgcatgggcattactccagcatcgtcagtctaccaggcacagtgccgtctaggggcaacaaagcacgggcttcgattcactgattcggaaaacatggacgccagggaaatacaaattctgcacgtggttggtcattcaaaatatggtttagacttgggatcggctcgcaaccagagaatgacaaaatgtcactaaccttctttgctgtagagaagtcaaaatgactctccacctcttggccaattgcatatacacgaaaagaaaagaatatgaaacccggtaaccacttggatggcctatcatcagctcgatcttgagctttgggaagcaacccaaaaagggcaagactaatgagagacactagtaaacatgacaagtgtttcaaaatggggattgcgcactttaatcctcgtcgtcgtttgggtgatctgaaatgagaggaagcgatgaatcttagcacaaggagaccatgacagccaacctctttgataaaattaagaaagaagctaggacgtacttgggctctggcatgagcaaagtgatttcgggagttcttaccaaacagtgtatatgacttataaggtgcttttccccttttcacatccttaagggttgtattttctcccaatatatatttaatgaaagagcacaatcttatgctaattaattataatctaggaaaagaaagagctaggaaagaggtcacatgttttgttatcctaatgagcaaaaaaacacatccttttgttaaagctagtatgtccatgggcgatcctagatgcatgatacgtacatactcgtagagtcaaggagtagcaatgaactggtggctacagaagaggagatttacaattggttgaatggcgatggaatggtggatgtgcagatgcgtcgtccatatatgcatgatcacgtggaagtggagactggccagtgggtaatttaagtgtatacgtggccaccttaattacatggtggcttaagctccaggtggcccgactgatgctgatgggcacaaaattaagtgtataagcttttactccagttgatgataagtaattattaagagtaagaaatagttaattaaacatttaaagaagcagtta

SEQ ID NO: 7422 - DNA, 822 bp, Oryza sativa
aaaattaagtgtataagcttttactccagttgatgataagtaattattaagagtaagaaatagttaattaaacatttaaagaagcagttaagcggatggatcggtataggttagtgatcgaatgatccaacgggtagaattaatcgaagaaaggaaggcgatgaatcggccaactaactgatatctgcccgtcatcctcccaactaacaacggccgcagcccgcaggcaggttgatcgatgagagtcgagagtcgtcgtacgtcttgttgattagtactccctccgtttcgaaatgcttgacgccgttgacttttttaaacatgtttgaccgttcgtcttattcaaaaaatttaagtaattattaattctttttctattatttgattcattattaaatatatttttatgtaggcatataattttacatattttataaaagtttttgaataagacgaacggtcaaacatgtgctagaaagtcaatggtgtcaaacatttcgaaatggagggagtatttttttctctttcaattcttctcttgtatggatggtttggtttgttggcggccacagcacagcgcagcttagcttagctacacaacacaccctttgaatgaagcaacaagctagtagaattgaagacacctccgaatccggccggctccaattccgattccaacccccacatccccatccgtgctctctctttgtttctttctagatactctctctcagagaggcagagtacaagtgtatatataaggttgctggagttggatgggtagtgcaataggccgctttatcatcatctatctcttcttcc

SEQ ID NO: 7423 - DNA, 1311 bp, Oryza sativa
  unsure (1)..(1311): unsure at all n locations
gggtgcgccagcctcacacacgcaaggacgtggcacgccccggtgtagatcccgttagacgtctcctctccgatcctggctggatacttggaggggatctcctccatcgccgtcaccagctccgcaagagaagacatcagcgagaactcatcgggattcgccgggatggtagacttgataccgcactccccggcgagctggtgcagaccagtatatgtgacccacaacgagccacggatttccgacaagttgttctcaagctccgaaatgcggtgctcgagcccctgctgttgtcgctcattgccggccaccagttccctcatcttctggaggtcctcgcgaacctccgctagatcacgcgccagccgattggcgcgctcattcgccgacgacgcagccgccgccctcgccttcgcgatctcgtggctaacaccgtgaccaccagcctcgaggaggcgccccatctcaacctagagctcctcccaggtgaggacggcatccggcgaaccacgaccagccacgagatcgctggctgggccgctaggtgtcgcctcatggctcctgggcacgaccacgacatccgtcgaggccacggcaggagatgcgctggaggtccctccagacccatcttacgccgccttcgcccgcgccgccctgggaaaggctgcgattgagacagagtttgacgaaatcacgaaacctcaaatttattcacttacttctcgctgagcgtcacaagccgctgtcgtcgcggaggcgggggagacgcgtccgaggcctggagtacaatcgatatgatgtgaggtggaagttttccgactacgtgatcaaataacgggtgaacttactgagggagtgggtatcttccgacgatgtccgactatagaggagaatttcctcccctttttcggaacgtcgccgccactcgtcgtggtagtggcaacagcagcgtcagacccctccttggcgaccttctctttcagcgacgccgccacctgatggtccacgagcgacccgatgatatcagtcagagggagagccaacgtttcatgaagtcataatgtgatcccggaagaaagatgcaaaaggacagctaagtacacttatattgatggcagcgtcgcgctcggctacccctttctcgcaaaggaggacggggacgttgctcgccgttgtcgggccgctgattatcagttggcggacgcggcgctccacggttgcgctattcaagcctgtagattgagaacagaatnnnnnnnnnnnnnnnnnnnnnnnnnnnnnnnnnnnnnnnnnnnnnnnnnnnnnnnnnnn

SEQ ID NO: 7424 - DNA, 838 bp, Oryza sativa
  unsure (1)..(838): unsure at all n locations
tatcgtcggaggttgtcgaacgtttcccgcagatcgtcaatcaaggagtcgcttgccttggtcttgacaacaatgtcatcgacgtaggcctcgacattgtttctgagctagtcactaagtgcaccttagaccgtgcgctggaaagtgtttcctgcggttattagtccgaacggcatcttaacatagcagaataccccgaacggcgtgatgaatgctgtcttctcctcatcctcttttgccatgcttatttggtggtaaccggagtaagcgtcgaggaaactcaacaactcgcaaccggctattgagtccaccagttggtctattcgaggaagaggaaagtgatccttgggacacgccttgttgaggtcggtgaaatcgacacacattctccacttcccgttggccttccgtaccatgactgggttggctagccactctggatggagtacctctctgatgaaaccggctttgagaagcttgtcgagctcttctcgtatggcttgttttcgatctggtgaaaatctccgcagtttttatattactggcttggcatcgggtcgcaccatgagtttgtgctcaatcacctccctgggtaccccaggcatgtcggacggctgccaagcgaacacgtcagcattgtcgcgggagaaggtgatgagcgcgagttcctatttctcgcctagtgaagccccgatcttgatggtcttgtcggggttggcactggatagtggaacgatcttgattgcgccgtctggtttcggcgtcttgtttgnnnnnnnnnnnnnnnnnnnnnnnnnnnnnnnnnnnnnnnnnnnnnnnnnnnnnnnnnnnnnnnnnn

SEQ ID NO: 7425 - DNA, 1085 bp, Oryza sativa
  unsure (1)..(1085): unsure at all n locations
ccatgaacgtgcaaagcctttaaatgcgggtggcaagtaattcactaacgcgttgtcgtccgctccggcagcgcagaataccgtggagtaaacctaaaggaactcttctgggtcggcgctcccatcgtatttctctattgctccaggtcagaatcttttaggccatcggacattccgaagtgaacaaccgaaagctctacacccaacgctgggggcggtgggttgttggcgatcatgcgtccttcgtggatgtctatccgatgatgaagatgacgaggatgatgacgatgacgatgggtcgtctagttccggcgtacgattacggggacgtcggccgggttctcgagaatcctgtcgtcgtctcccgctgttatctcggtgccgatctccatcatcaccgtcattattgcgacgtcctcgaccagtatcgcccagtacccgccgttcgcgatcgttgtgatcgtggcggttgtggcggttatcatggtctcggtcttcgcttgaatgacctcctcgatcttcgttatcgtgacgccgtgaagagatatgacgccgggaacggttctcgttgtctcgtgtgcgtcgtgcctctcggcggccattcaggtgatcgcggagatcgccggtgccgcgaggtggaggggttgctcgatgaggtgattccgccgttcagggtcttcaccatttgcatcgcaagttggtggctgtttcgggtgcgctgcagcagcggcctcttcgaacgcgttgctgaggttggtcactaattgcgttgacggctctgatgtgttgggccggagtagtcacttgattctccgcttccgcattggtgcgtgctgacgtgccgacatcgtcgatagccaatacctcacgaggcgtactcgttgtcgatgatccatagtcttcgagtaggtgcaagactgatggttcatggggatcgatgtcgattaccccaacaaatcgatctgaaaccggcgtcgctccttgttccttgtcctcatccctgatggggatgcgtgactgctggannnnnnnnnnnnnnnnnnnnnnnnnnnnnnnnnnnnnnnnnnnnnnnnnnnnnnnnnnnn

SEQ ID NO: 7426 - DNA, 977 bp, Oryza sativa
  unsure (1)..(977): unsure at all n locations
nnnnnnnnnnnnnnnnnnnnnnnnnnnnnnnnnnnnnnnnnnnnnnnnnnnnnnnnacgctgttgtcgacgaatctggatgtcaaagtagtagaaccttgagcaccaagtccccctacctggcgcgccactatcgacgggggatacccgtagaccggatatagagggtattggggtacgctggtacgaggatgtacgtagtacgacatcaagcaaacaggaaacagggattatactggttcaggccccttggtaggtaatagccctaatccagttgatatgggattatatgatggaaaccacatattacaaagggaatagtaaagctcgacgataccgacaggatcgtagtcgagttgatccgactagatctcccggcgacttggcttcgataagctctggcttcgtaggctgtggtagatgtgttggctctaagatttaatgccttaggtcctcccagggggtcccttttataccgtaggtcaactggtctccatgtcggactcagagacatcggacccgacacgatataatgacggccgatttctatccgagtaggactctttccatctgtagactccatgatggacttccttaacctatgctgagaacgtccgtatacgcgcaaacatactatatcgatacgtgacgtatatcgaagggtagagggtataccttacccgtaaccctgatagcgccgggagccggagccgctgtgaacgacaatatcaacggaggcagtttgcctcacaatccagcggagagacattcacagggtataaccttcgcatactgttaattcaatttttgatacttctgttagtcgtaattctattgcgttcgttgtatggtcatgatgcttattatatcttaagcatgcttctggttatgttagattttatcactagatcaccccactnnnnnnnnnnnnnnnnnnnnnnnnnnnnnnnnnnnnnnnnnnnnnnnnnnnnnnnnnnn

SEQ ID NO: 7427 - DNA, 608 bp, Oryza sativa
  unsure (1)..(608): unsure at all n locations
ttcatctgtgggttttagttgcttggagagtaagggatatacctggttaagtgagtatgtggctagtaatggtcgaagttgggctttggtagaagaatggctaggatttacttgttctcgagtcgatgctgaaataggatagcatatcggctcgtatttcatgtataggttatgagtagttggagggtaaatggttgggatgatattgtagctggcgtggagtctagatagcaagctgattgaggtaggataaatatcagttagggtttaggtgtttgctagtcgttgctagagttgggcagcatggcgactagacttagcatcttctctagccgatgtcaacagacagtataacggctagagggataggaggtttgtgtgggtttagtggggcggaagtgttactccgacaaccgtgagtggcggcggagcggctaggatcacacagagcccaagagctaactgtgcggcgtgctgtggaggtcgagggaatagtgaagctccgaccgctgtacgcatcaaggcgtggggtgccaggagcagcatttnnnnnnnnnnnnnnnnnnnnnnnnnnnnnnnnnnnnnnnnnnnnnnnnnnnnnnnnnnnn

SEQ ID NO: 7428 - DNA, 883 bp, Oryza sativa
  unsure (1)..(883): unsure at all n locations
nnnnnnnnnnnnnnnnnnnnnnnnnnnnnnnnnnnnnnnnnnnnnnnnnnnnnnnagtccatatagctaaagcataccactcctcctctaaatatatgatgctacttagttcgaaacaaaagaacacgaagggaattaagggagtagtaacataccttgggcgatatataggattattccacagagatttcagtatggtggatgcatggtgatggtcctgatcaacgccggcgccggcgatggctgacacgatcgacggacttatatatattagaggtacttctccggccggccggccggcagcgagctagcagctagcagcttcttctgatccctcctctctctctaatagctatagcttttcctttcttctgcagctagctagcaaagcaaaggaaacgaccttgagagattcaacgatacaatatttatctacctatggactagttttcttcgatcgatatctgtagtgtagcaaaggaaccttcagatttgaggatacaataatacttcagatataaggagtatttaattatctatagttggtactcaaattgaagagctgaccctgactttgcgcgcatcgaccgtctggcgcgagcgcgactggaatggaatcatccacgtggggcgtaaccagtcttcactctctttcagaatgtaaacgaaagcagctagtggtcgatactcgttttccgtaactatacttaagctgaacccctcctccggcatgtaaaacggagcacgcattattgcatgattaattaaatattagctattttttttaaaaaaaatggattaatttgatttttttaagcaactttcgtatagannnnnnnnnnnnnnnnnnnnnnnnnnnnnnnnnnnnnnnnnnnnnnnnnnn

SEQ ID NO: 7429 - DNA, 1834 bp, Oryza sativa
  unsure (1)..(1834): unsure at all n locations
nnnnnnnnnnnnnnnnnnnnnnnnnnnnnnnnnnnnnnnnnnnnnnnnnnnnnnnnnagtggttcttatttaagtcctcgcgcaggaggcaaacctatgccgcgaagggcaaatataacatttaccgaggcgcaggtaaatgatttgttgagctcaagtgtgtgtgtattgtgaaaacctggttgagatgacgggggtctctcaaccagttctctctctaaaaacctcgggaacgccagaactcctctcgctgctgataacgttacgttcagagcgcatgaggatgagagttcatggaacaggtgccactgatgttagtaaccgaaaagctttgccatgactaagctaatgaatattggcatgtcatggattgcgggtaaagcgtacatttactgcagtaaagtaaacctgaatctattcgaatagccgtgctcacggaattgagtatcgggactcatatggtactttggttagaaacctaattcaagattttactaaatgctgctacatttaaaacatcaggctttctatttctatattctctgccttctgcaagtaatcgtaatcctactcaaatattacctttttatacattcattattgaatataatagcttggtgagtacgttgtactcacccttgcttcaaacccctttttccagagttaaattgaagttcttgccgaagccaggagttcaatcatataagttagcattatttcaacctagttttcaaatctagattagttagatggtttaagtctatagcaaaatattagagttgagacactctatagcttctgctgtaatagttagccacaatcttgtaaattcccctattaatttatgtaataacatctgctttggagccttgttcaaatgtacgcaatgaaaatccagattgttgaagctgtatcaatctactgatccagggcttgatacagttaaacatgtcggtttccgaatatttagttttgggatccgacactgtgccaatgccaaaatttggtaaggtttttttttgcatcaaagtgaacatgccctatatatatatatggaaaattgtaccgtttatctagacttaaagttgattgttgccaagttacaatttatcaatgaaatgttggttgtttattgtcaaggagttagagtacggggcttctatacatcaagaaagcaagattaggatgtggtacaactcgctagtcatctaattaaccttccttggaaccaggaagcaaggtaattatgtaagcaattaatgagtaaatgatgtttatgctgtggagcaatgtgtgttgcgatggcatggagcccgggcagctgcctccgccactgctgccaatacacactttggggtcagtttgagtttggtacgtaaagctcctactcctgcttctgattttctgaaagaagcgtttctgcgactgaaagtgattcactaggttaatcagcagaagccactcttttttactagctccgaaaatcacttcaccgaatcagcctagagcccaacaatcactcctctgtaaaaatatcgtttggaagcagctcagcgagctgtgcaaaacatgccgcccaaatatttgccaatacactacaaattctcaaaacgcatgctaactgaataaggaatgtaaaactagtttcccctaaaaattctcttgaaaccaggtttattaaaaataaaaagtgactatcatttcagagccttaaaagtcttctttaagcccacaatttgtcctcatcggcatggggtagtcgcttcgcctcccaccctcaatgacacgtcggaccgcgattgccccagctgctgctcatcgcgttcagcacggc

SEQ ID NO: 7430 - DNA, 1177 bp, Oryza sativa
  unsure (1)..(1177): unsure at all n locations
nnnnnnnnnnnnnnnnnnnnnnnnnnnnnnnnnnnnnnnnnntagggtttgggttcggattttttgattttattttttttgggatttttattttacgtgcaggtgatataagcacccgcacgtggaaatcagatttttccgtgcggtccacttaacctgaccacacggaaagatgtattttttcatgtggttgatcgcccgcatggaaaaatatttattttcccagacacctgatgcagacgggtaagatctctgtagaaaaaacactttttgaacccacggaaaaatgcttttcgtagttgtgttttacgctagtcgccatgggatgcaacgaaccaggtaagcagccaacagttaggctgtgtgtgaggggaaggctgttttctccgataattccaaaaattggtggctagtggccccatctttttgacacacgacgggcaaagaatttgcatggaaagaagcaacaatattactgcatcagcacatatcttcgcgcctcattaaactttagtagcaccttaaatcctgggtttgatttttatgggagagaattttttagattttaacggttttgtgcttttagtggcatgtgatgcacccgtccacaacgagacgtctgtagtaacttcgtcagtctttaggatttatcagctcagtcttcaaagatgctcgtaggagtagggtttacgtgcgtgcgtttataggggtgagtgtacgtatgttgtgagtgtctgtgttgtactttataattattttaaaaaagcatatatcttcaagcggaacaatgtcatcagccatcagccacttgcctttctgtttctggtcaaccaaagtggccgccataagctagctctagctatagcatacttgaccaagagttatggagtatatagctgacatacatcctgacaaaagcaagagcatacatggatgcagggtcggataaagaaaacaattagggagagacatattttttaatcatagaatttattcccatcttttctttaaaaggctataatcaatcattatagagattacatggacaatgataacaagacatactagagagtgaagaatcaccaagtccaattccgtacattgtactggttgaattaaccattnnnnnnnnnnnnnnnnnnnnnnnnnnnnnnnnnnnnnnnnnnnnnnnnnnnnn

SEQ ID NO: 7431 - DNA, 798 bp, Oryza sativa
  unsure (1)..(798): unsure at all n locations
tacataaatgacttttccaactttaaacacatcagcagcccgtaacccggtaatattttccaacttacacaggcaattgtttacaatattatagagtagatgcagctaaagaaaatgacttgggcggtccaaagtgcaccaaagataatcttacctagtctaaagtaaaaatatgagctagaggatagcctaaagtgaaactttggcaataaaaggtggaccagagtgcaattaactcttgtttttttcctacatttaatacttcatatatatgtccaaacattcgatgtgacagcgtgaacaattttgttttgtgactaagggtgtgttcggacccaagggttcccaacacctctccatcgttttccgcgtgcacgcttttcaaactgctaaacggtgtgttttttgtaaaaagtttctatacaaaaattgctttaaaaaatcatattgattcatttttgaaaaaaaaagctaatttctaattaatcacgcgttaatggaccgctccgttttccgtgcgaagaagatttgttcccaacctccccaagcaaacacagcctaaacagggcctaaacctcgatgcgtttttatcatttctgaataaggtaactaatagatcgtcatagtcttcgtcagacttctatctcgatcgctttcaacggggcacatcagcctaggcggctttgggtcatggacatgtacaggtaggtgcaactaatcatacattttgcaagttttnnnnnnnnnnnnnnnnnnnnnnnnnnnnnnnnnnnnnnnnnnnnnnnnnnnnnnnnnnnn

SEQ ID NO: 7432 - DNA, 912 bp, Oryza sativa
  unsure (1)..(912): unsure at all n locations
nnnnnnnnnnnnnnnnnnnnnnnnnnnnnnnnnnnnnnnnnnnnnnnnnttattggtgaagacatataatgagaagagaatgaaggaaaatctggacattttcaactgggagctcacagatgaagagagggagaggatcagtcagctgccccaactgaggggcctgcctggattggaattcatctctgaccatgggccttacaaatcagttgaagatttgtgggatggtgacgtctagcaagctacttagatacagtggagtatatatctaaataatcatgatggatcatgatgtggatctatcttaattatgtgcggcaggcatgggcacggcaccattcccgtacacgttctgcgatcaattaatgtatggaccatacatgtatattaattgctgtatacctatccacttatttaaaacacgtcgacacgttcacgaaaaatggttactcccctggtatacatatataggtccatagatgatgcattgcaaatttaattagctacctagaaatttatttaggatgctaaatttaagatggtagatttagtttaaatgtatacgactcttgatctatttttgttggatttcactccacccgtggttgggaactattaattaattccctgggtctataatgattttggatgcattcccgacgagctaatttcatttcactatttttgttgtgattttagatacatgtttaaaattttgggtttatttttaaaccacctatctcctttacttgcagttatttatcattcaattagtgaagcataaactcattcgatattctgatattaatcaaaattaatattatttaatttcctttagaaagaaaacatttnnnnnnnnnnnnnnnnnnnnnnnnnnnnnnnnnnnnnnnnnnnnnnnnnnnnnnnnnnnnn

SEQ ID NO: 7433 - DNA, 664 bp, Oryza sativa
cagataaataatttagaaaacagttgttcacagaatttaaggtaagagattaaatggtcataccatgttaattgagacttcaatatttaatttgcggtgcagatttgtttgaggtggatgtacgagcagggtgatgttttgttagtgaagacatacaatgaaaataggatgaaggagaatcttgatattttcgactgggagctcactgaggaagagagagacaaaatcagcaaactcccccagcagaggggtctgactggaatgcagttcgtctgtgacaatgggccttacaagtgcgtcgaagatttgtgggatggtgcttaacatgtcgcaggctggccctatgcaccaataatctggatggatcatgcttgctggggatctagcaaaataatttgtaattcaatattaatcttctgtcttctcgcaaaataattgtgtgaaatggagcgccagatgtgctcaattgttatctttcttctattcgtaatcgataaatatggtattttccaaaataatattgaaatttcgagatattgataccgaacatgaatacttttttatctagcatttcttaaaaagtcatcaatagatatcatcttggtcacagcctaagatggtcgtttcaggttgatgtatgagtattgctgcaacgattttacct

SEQ ID NO: 7434 - DNA, 431 bp, Oryza sativa
ttcgaggatcaagctccagatctcgagcaaggcaagccacctttgaacatcttgagcctatatttgaatttaattatgttgcttgaaaaatattatgcattgataggatcgcacttaatctgtttgtcccgtctgcaaggcagattggcgaacctacctagtttgttgcatttgatccttcctttgttaattggtatcccatgttcccttgtaaccacccaattgcgcctcggaaatcgtgcactctgcacgagtatcgacggccgccttcaaacttaaaatctgaaaaacatcttgggtaaaacttgggtcttacaaaaaacttggaaaacccgacacctgggtcggtgcttgcgaactaaatgaatttccgtaaccgcggaacggggaacataccgggtgtacggtttcccgctcttgcacttaaggac

SEQ ID NO: 7435 - DNA, 328 bp, Oryza sativa
cggcgagggatctcgccggtgaggcggttgctgttgaggtccaaccacatgaggctgctgcagttgccgagctccctggggatctcgccggcgaggctgttgttcgccagctgcagcacggcgaggcgggacagccgcccgaactccggccggatggtgccggtgatctggttgctcgtcagcgacacccactcgaggccggtgcagttgaagagctcgacggggatgtcgcccccgatgaagttgttgttcaggatcagcgtccggagattccggcattgcccgagatccgccggaatccggccgtcgaggccattgaaccacatca

SEQ ID NO: 7436 - DNA, 559 bp, Oryza sativa
cgggatattttctcggcttctgcgtcgtcctcgggcaactcttcgctgcttatgaatttaatgagtggggtgcgccagtcgtcggtggtctcgatatcggcaacggcgcgctctgcccctgtagcccccgaggtggtgtcgggggcgaccgggctatcttcgccgcttgcctctttcactgatggcctcgtcaggacgtccagaaaggtgccaggttcaagtggttctcgtctggacgcacatcatgctagatcatccggttcgatgttgtctttacggtacacatgtcggacctcgatcccatcgaaccttttttctagcttcatgacttctgtgagatacttggataactcggggttagagcacttgtaatctttatgcacctggttcgtgactagtttggaatcccctttcacgattagtcgcttgactctgagtgcagctgcagctcttatcccggcgagtagtccttcgtattcggctgtgttattggttgccctgaagttgaggtgaattgcatgcttgaattgatctcccgaaggtgatgtcaagatgaatc

SEQ ID NO: 7437 - DNA, 489 bp, Oryza sativa
tgatgcattttgcactagttagcctgcctccctgagcagtttacatcgaatgcgtattgttttgttgtacaaaagattattatttattagtattgtatagaagaaataaacaaaagcagctctaatcaggtgaactatagctgcggctaaaactgggcaagtttttgcattttaacttatggaaaatcttgtttgtgcaactctccaaggaccaaagggatctgtattggccatgtttcagcacacggcaatgaggttcagacttcagaagtccaaactgatttgtgtcttcccttcccaccatgtactatactgattgctatcttgcaacttgaaactcatcattgaccaacagtttcatcgatcagagcctattaacatgcagagatataatatctaatagcatttgtgttcaagttggctcacatcttaagctatacttatatttctagagcataaacagtaataaattcataagatgaagaatgg

SEQ ID NO: 7438 - DNA, 816 bp, Oryza sativa
  unsure (1)..(816): unsure at all n locations
cgttttccgtcggtggtgatttgctgcccaacatgccaaacatctgccatacttttggtggtgtatgtatctagggactaaatttcatatagaatgtttatactaattagaagtattaaacgtaaactaataataaaactaattgcataaatgagagttaatttgctagataatttttttaagtctaattaatctataattagcacatgtttactgtagtatcacataaactaatcatagattaattaggctcaatagattcgtatcgtgcattagtacagagttatagaatgagttttatcattagtctacgtttaatacttctaattagtttcaataatccgacaggggttaaaaattagtccctacatccaaaacaggatcttaccttcatgtaccttcgtgtataagatcaatgtgccttacataatataaacgattggttggatgagatttaacatttactcgctccatctcattgtaaatgtaagtttagaagtgagatgagaaaataaaatagaaggaaaattatccaaaataccccctattaaatgacaaatggtacggagtgagatggtagctgactgtaagacgaacagaaatttgaattaaatgtgattaatgtcacaataataagtagtatagttggattgtccttattttgagacaaaatttaaatatagaattgtatttatttaaatatatgacccgcacctacatggataatacctatcgatttatagtgactatgagtaatgcaaatatgtcttgttttctnnnnnnnnnnnnnnnnnnnnnnnnnnnnnnnnnnnnnnn

SEQ ID NO: 7439 - DNA, 1350 bp, Oryza sativa
  unsure (1)..(1350): unsure at all n locations
nnnnnnnnnnnnnnnnnnnnnnnnnnnnnnnnnnnnnnnnnnnnnnnnnnnnnnnnnnnnnaaaggaggtatagtccaacacatatttttcatttgctgatatatacatcacatgtactgctagtgtgagagtactccatccggttagaataacatcacacgctgctacttctaatattacgcaatttataactgtgagcaggcagatcaagcaacgcatatattagattacttaaacccgtgggatctttggaaggttagggacgccacgtcatcggttttttcaaaaacaccactcacctctgattaatcacgttttgggttaatcacgttttgaaaagtaagtgtgccacgtcattgtatttttttgcaaaaaaacgcctgcacttcctgttaattgtgcgttggttcctgccgctatggtccgttcgatcacgcgcgagggactagcgtgtcccagcgtggctgctcttccaccatcgtgagatcgttggatcagaaacggacggcctagatttggcaagaaccctagccacctcgcgctcgcctctcttctcgctcgtgctgccccaccctcctccctcgtgcgggtcgccgcctcgttatattataaaccaataggtatatagttaatttaggctgtgttcttcccccaattttcccaactcatctctcttgtttaccgcgcgcatgcttttcaaactgttaaacggtgtgttttttgaaaaaaaattctatacgaaggttgctttaaaaaatcatattaatctattttttcttttaaaaaatagctgatacttaattaatcatgcaataacacagctagttttatttttaaacttgtaatatttattcatttaaaataaaacgagtatcaaaagttctacgggaagcaaacataataggtttgtctatttgcacagaactttcgagcaaggacgaatagtcaaacgtactaaaaaataactgcatcatattctaataacatttaaaaggcggtatagtacaacacatacttttcatttgctgatatatacatcagatgtacagctagtgtgagagttactccatccggttagaatgacatgacacgctgctacttctaatattatgcaattttataactgtgagcaggcaaccaacgagatcaagcaacacagattttatttgaaactagcaggtatagagttaatttacgctgtgttattccctagtttttccaactcatctctcccttttttcggcgcacgcttttcaaaccgctaatcggtgtgttttttgtaaaaaannnnnnnnnnnnnnnnnnnnnnnnnnnnnnnnnnnnnnnnnnnnnnnnnnnnnnnnnnnnnn

SEQ ID NO: 7440 - DNA, 858 bp, Oryza sativa
  unsure (1)..(858): unsure at all n locations
gtcttgaacatcttggggtgtgttttgggagtcgttttttagcagcggtagcagctgnagcagttcaaagtggctgcagtntgcagcaattttgacctgcgccagcctcagcagctgtggcaggtatggctgctgaacagagcccctatttgttcaattatcaccctgtgacaggactttctgaaggcaagcttctgcatctagaatttctattttggtacttatagttcttgcgtgacatttgttctggcacaatgtaccaacaattttgatagtgaataactgagtacaatttaaaagatgaactttcaagatgattgttttgacggattctggatgacctcttatatataaactaggccactttgtaggatctgattacttgcaatttcaaacgttccccatttctccatttactaaccatgagcatccattttacatccaggaattttaataaagaagtaactatgaaatataaggaagttactccccaatgccttgaaccacgtggcccatgctgttggcctgttgtttgtgtaggcagagttctgttgtatgcgtagattaggagttctggtcgagtataattgctggatcttagactaggttcatggcaaatttgcaatgtgctacacgggactgtattcgtatgtggtgatttgatccatttaggcaatcaatcttcgttatggcgaactggtgtctgtttagttagtattgcaaagtcgcaaactggctaccattggatgactttctttatgatttcctttttaaaatcaaaatttccatggtaaatttgatttaactaggaaaaatgcctgtgtgttgcaatgggtgaaaaataaaagtacaccaaat

SEQ ID NO: 7441 - DNA, 4802 bp, Oryza sativa
  unsure (1)..(4802): unsure at all n locations
gaaaatctggatgaggatgtgtacatgacgcaatccaagggatttgttgatccacaatcagctaaaaagatatgcaagttgcataaatccatttatgggttgaagcaagcatctcggaggtggaatattcattttgatgaagtagtcaaggcgctgggctttgtcaaaaacgaagaagagccttgtgtatacaagaagattagtaggagcgcactggtgtttctaatcctacatgtagatgacaaattgttgattgagaatgatattcctatgcttgaatccgttaagacatcgttgaaaaatagtttttcaatgaaggacttaggggaagcagcatatattctgggcataaggatctatggagatagatcaaagaggctaattggattaagccatagcacatagattgacaaggtgttgaagaggttgaacatgcaagactctaagaaaggtttcttgccgatgtcacatggtattaatcttggcaagaatcagtgtcctcaaacgactgatgagcaaaacaagatgagtgtgattccatatgctttggcaattggatccataatgtatgccatgttatgtacacgtccagatgtttcatatgtatttagtgcaacaagccgatactaatcagatccaggtgagagtcactggattgttgtaaggaatatcctaaagtacttgagaagaactaagaatatgttcttagtctacggaggataggaagaactcgttgtaaatggttacaccgatgcaagcttccaaatcgacaaagatgattttagatcgtagtttggatttgtgttctgcctaaatggatgcgttgtgagttggaagagttccaagcaagatacagtcgccgactctacagcagaagccgaatacattgctgcttctgaagcagcaaaggagtttgtttggataaagaaatttgtttctcaactgggtgtgatggctagtgttcctagccctgtggaccactattaggataatagtggtgctattgcgcaagccaaggagcttagatcgcatcaaaaatccaaacacattttacggcagtatcaccacattcacgagatattgggtagaggagatgtgaagatatacaaaattcatacggatttgaacgttgcagatccgctgacaaagccactccctcagcctaagcaggcacacactagggcaatgggtattagatacgtgcatggttgactctagtgcaagtgggagactgttggttatatgtcctagaggcaatcataaagatgaatgtatcacatactatgtttacatatttatccgacattgtttgttgaaatagataactcattattggttatttaatatgtgattctttcatgagactctttatgttgtatattgctatttctaaaggatccctgatcaaataccatatgtggaacaaatatgtttagctgatcaatgcatgtattaattgatgatcatgtctcatggatcatggtatagagatactaaattaataatgtggacacatgttggggaacatgttggatagacccaacatgagacaccgcaagagccgtatgtgttgtgtcattagtgatctcatttagtcttcgtattaaatctttagacctgagattatcatggttctncacatgtatagtagcttacttagggactgctaaatgctactctgtaattgggtaagtttattttaaaaaaaaaaattaagggggggttctcggtatgctataaaacatatagtgggatatgaataatcaagatgagatttgcccttctatggagagatatatctgggccccctcgatcttatagattatagaagtgcatggccatgcaaaaggtgattgaggtgtcaatcacaagtaatataatctatcacaagtacgagtgaatggttgagctattagaggatgacacatatctagccttgagcttaatctatattgtgaggccaaggggtttatacaagtttacactagaggttcaaccgatatgatctttatgtatgctcggtgggtcaatacgttctgctaggggccgctgttgacacgtggaccgaaaaggagctttcgggttgcagccgagtatatatatgaacctacagggtcgcacgcttaaagggccggaataaagggattggatagagttccaatatgcactcaatcggatagggatccgagtaggactcatatgggcctcaaaggcccaatcgtggatccgatatatttgtgaggggtgtgaccgccggaatcaacacaccatgtgaaaccctagccgtcactccccttcccgagaaaaccctagccacgcgcgggtgctagcacatctgcgcgtggtgttccttccctggattgtggataccagtaaaggcgccgctgctttgtggtgctgatcggcttgggagcacggtgaggagaacgcatgcggaggaaaaggtcgagccggtgcgatcgactacttcctctacatcgacgcacactacatcgcgaggattccttagccttcttagcgcttacttccgctgcacagcacgtcgagtggtaacgatatatgatctaatactcgcatggttcttggtttacgcgctagaaaattttgatttatgctatcgtagcctgcgcgcattccaacatggtgctacactggtgtgtgcattgttgacaggatcttatataaatgagttgattgatgaagtgtctcaagaagataagaaccgatagaagattatagagggagaacgtcaagcgccacatgatagctttgtagatactggcgtgggcgtaattcaccgcacgattgatctgacgataaaaagtcgactcggctggggtggtttttgtgcagtaatttgcatgcacccacccgtgcgtatcgtgggagagggagagacggtaattggaccaattaggatggaagggcttggcttacaaacatactcttgtatattgtgctcttcattgcacattagcaattagtgaatctgaaacctcaattgtagatctaatggctagattaatttgaggtgatgtggcacactgtgggatgagagaattagagttagtggggatgaactatataagtatatagcattaactcaccataagtaaaactgttatttaattcaccataagtatatagcattaattcaccatgagtatctaagcaaacaaattacttatgctgatatgacaaatatcatacgcttattttctatcatatgataattttaaggtttgcaatgtatattttcccttgaaactcctccctagtattcacaactacgaaaatgatttcaggacccatctcaaattggccggggaccttactaggaatcagtgtgttgggggaagtggaggagtgccctcgcctcctcattttttttttacatctaataacctaatctcttctttctataaagctaatacggtaatacccactaaacaattaaagcttaacatgtaagcataatatttattagcactcctgaaacatacataccacatcaacccattaataacacaaagctcaacatgcaagcatataataattattatatctacgatttatttcattctaaaactaaacgtacatatgctaaatcatcattctcaaatcacttttataatatttcaattcaaataatttcatcatttctccattatctatttatctaacatacttcccgtagaaagcacgtcacttcatctagttagataattaacctaataacagtgtattaaactctctccaacccttagttctctcctatgtctaaatcgcgattcccccactgtcggcaatgctatcgctgtcggttttattagctgacactcactacgccagatcctcacacctctgacgggatacctgtgacgggcaaacgaattggtcagtattgaccattacctttgacgggttatacgggatgccgtcaccggtgaggcatctggccgcggcccgtcacaggtatcccctcacctgtgacgggccgaaaggaaaacccgtcagaggtataccagtgacgagtttttcttccaacccgtcactggtatcccctcacctgtgacgggccgatacattagaagccgtcagaggtgatgggccgccacctgtgacggctttcatttctggcccgtcacaggtgagcggataccagtgacgggccgttgaatagaagcccgtcaaaggtatgagcaatacctttgacgggcttttttttatctaacccgtttgaggtgtgttgggtctataaatacccccaaactgccaactgctttccatcccgaccattgtactgttcacaaatcggttgggagggcaaggggggcgattttttactaaaattcaaggtaaaaaacacattattctccattcattctcaacatatcgatcatcatttatttttcttcgtatgttgttgatttcagatggatcgtagatggatgtactatgcgcatcgttcgtctaccgagtatagagagggggtcactgaatttgtcacatttgcggataatgacagaaaaagtaggatgagcatgcacatgttgtgcccatgtagggactgtaagaatgaacagatgatcgaagacaaggatgaagtgcatgctcatttgataatgaatggattcatgaagaaatatacctgctggaccaagcatggagagcaagaggcgcctgatgtcgcagctgaagaagtgttggatcagggtgtagagaacaccgccgcagctcgagaaggcatgttcgtaccttctcctttaggtggagaccatagatttggacactcaatgtct

SEQ ID NO: 7442 - DNA, 630 bp, Oryza sativa
ctagaaacatttgacaaggtgcagcttggctcgtgcttgtttttttcttgaactgaaaacttctgtactttttatctggcaagcttatttacagctgaggaagtgctccagtgctgtcaaaaaaaatagtgaaatggcttctttggatctaactgatcgatgaaatgtttagttcatattctgtttactactagtctattacattgtgttcgaggagtgattaagctcacattccatgcaacacatggttttatttttgtcttttttgcaggaagttataatgttcaattgttatgatacaattttattgacgatggtcagtatgttgacaattaaatgctgcaaactatgaagcaagattatagtataccttatgctgatcacctatatattcatttcagcaatgtactcttgcttcctgtttaaaagaactctagcatttccatttagatgcttaccatttgaagtgagctttctattatgtatgggtcactgggcctcatgatagcatcagtcggtgtgatattctcagtcataaaattctagaaaaggtaacttgcagtatgcttgatagaagttatttttgtcctggtttcagtccacactggccctgcaactgattcagtatgc

SEQ ID NO: 7443 - DNA, 8575 bp, Oryza sativa
cgatattaagattttttatgccgtaaaaaatctcgcatgtacccacatgcttcttcacaagcgttcttttcttgataaatatttgtgtaggaacttatgtcacaagaatagaaaattttgtcatcgaagtaaaaggttttagtcttttagacaataaagttattacagtagaaagcttgatcatttgagtagaaaatttcaggaaagtttgagtagactactttttgaattcaagcaaaaacactacaaatcaagcataagttttcatcactaatagaaaaaaggttttcgctgatggtggcgtaagccgcctcagtaaaggccagtaaaaatgaagacaactgaccgcctgcgaaatacatttccacaggcggcatgcttaagatagcaacatatgaaaattatatatcttcccaagtagctccattaggccagcatctaggaaaaaggatttccggtgacaaaaaagtgaattataaaagtactatttgtaaaaattcacaaatcaacaggtcaaaattcacggggcatataccaaacatcctcaaattttataaaattcacaatgcaattccaccaccccaaatttcacaaatgcaattccaccattccaaaattcacaacataaactcaagctttccacacatcccaaattcgcgagccctatccgctgtcgctgagctgccaccactgagcctcgtccaccgccggcttcgtgccctttggcagatttagactggagtggaggagagggagatagttgaggcgaagcagagggatttaaggacgactgattataaagcggtgatacggttttttttactggtggacctctttaggctccgcctgcaaaaaatatattttcagatgcgggtctagaacaataggaactctagttattttaacatttatggttcgcctgaaaaaaatcaaacctaagtgctttgaaaattcgttttatagtagtgtttttgaatgttttggattaaaaatattggtattttgaaaaaaaaatttctagaatagaaagtttcgataaatcttatgcactatcagaatgtatatttattaaaaaagatatggcataactaacatacaagattgatcccatcttccaatagacattatgcgctgcacgcagctaggacggcagcgaaggaggggtttgggcctttgggggtggggcggtaagccgtaccaggatcttccagatgacgacccacggctcggcggcagtgctgatcatgccgccgcacggagttgtcgcggctccgtacggcggcggtgagcactgagcagtgtgtcctttgctttttctggtgccggcaggattttcaatgggcctgcctttgctcttgggcttaacgtttgccaccacaagggcccatttacaggagtaatttggacaattgagatgacaacggatttggatctcaattgaatttctctaatctactgatttatcttcccatttcttctaccctatatctaccctataattcaccaactcactcttacacctatctaccctataattcaccaactcacttttatacctatctatctaccctataatttactaactcacttttacacctacattactcattcatcgaatccgacaatccgtactcatccatgtggaatccatccgatgatccacagtgctcattcggccccacccccaccaccacccccacccccacgcctcccggttccccgatccacgcacgcccgactcggcgactcgcacccccacctcaaaacctagctcctcctctctctcgcatcaacacaagcgccaccatcactatgccgatggaaggggagtcccgtgcgcccgaccaatgcttcgcatcctggtgagagaaaaagaggtaacctttctattccacgaccacggcgaaagtttggatcttgattcgaaaaaataggacacttttctctcccttgtttctgagctacaagaaatcctgttccgattacaaaattttcatcttttctgagaaccgtgagatactgattcttggagatgttcaatagtaaattagtccatagattatactctagactaaaattaggtttaggagaccctccccggattgatggatcaattgatctcgtgtgatgttaatttcagaggagggaaaatggaggtacagtcatctggggggggtccattgaagtgctcatggagaaggtcctgtcagtgaacatcctctcctcggactacttcaagagctgtacaggctcatgacgtaccacgaggtcatcgacgagatctacaactaggctgaccacgttgagccatggatgactggcaactgccgcagcccctccagcgtcctctgcctcctctatggattgggacccctgacgtgaagtcagagggatatggtgactgacatgtggggtccaccacttgtgggcccacatgttagtgaccacgtcacgtggcagtttaagtcagaggagcggcgttcgtcctctcttcaccatgaagctcacggttaagcaatggtgcgccatgttgtcatggcgggattatccccattgacgcctatgggtagtgtcactgccgcactccgggtcgcaatgatacctttgtgtcatcggtcatgctgctaatccattatataattaaaaatttaattctttgtattttccttcttatgactcttaaatatatattttatttcatgctttcttgtcaaaacagatcatgccttttgtttgttccatttgggctattatgtcgtcataatgtttattaggagttgttcatttttcgtgctatattaacattcttgttgcaagtaatttacagtcattgactgtttagcatcatttgagccactgtggttttaaattgatatataatttttttcccttttacaacgcacgggcacccaactagtatttaataaatacaaccagtgctgtctcgaaaagaatttgttcgtcactcaaacttcgataggaagataaatcagttgatttctcaaattcaattgagtcccaaattgctcatctaaattgggccttgtgtgtcaggcccattgaaaatgcagcgggcaccaggaaaataaaaggaaacgtcacacgcagctccgccgcaaccgtccactccgccgccgcgacaactccctgcggcgaccatggcgacaagatcagcgctaccgccgcgccgccgcggcctcccggaggagctcgtggtctgggagatcctggtacggcttccccctaaacccctcctccgctgccgcttggtctgccgcgcatggcgccgcctcacctccacccgcggcttcctcctcgcccaccaccgccatcaaccctccctcccgctcgtcgtcggctacggctgcgacggtgggagcctcctcgacatcctcacccttgaccgccgggacgccgctcggccgcggctccatcccgtggtgcggctcaagaacgccgctcacttcgtgagtgcatcctgcgacggcatccttatcctcaacatgaccaactgcggcgaattttactactcggtctgtaacccgaccactcgtcaattcgctgatctgccgatgctcactggtttcttcgtcatggggttttaccagcaccgccccaccggtgaataccggcttctactctactaccagtttcggccggaaggttctgaggatagatatgcctgctacgtctacacattgggctccagcgaaatgccgaggtgcattgggtggatggaggaggttgcaacctgcacagctgttgtgctgctccatggtagcctgcattggtataattacaaaacagacaagattttgattttcaacaccgcatccgagtcgttctggtcgatgcgtcaggctgacaagatgaatgggaatgatctgtttgagattgatggtacacttggcatctacttctgtaatgatgatgcgacgatcgtagatatttgggtactgcaggattacaagacagaattctggtctctcaagcaccggattgaattgccagtcccagatataaaggggaagcttgatgatggtgatgattggagtgcgatggtattgtctgaggacggggatgtgcttgtgctggtttactacagacaatggctgctttacattggtactgatggcaagctgttggcgagttttcaacatgatgttgggtgccactacaatactcctctgaagcttaagcaaagccttgttccacatgcattctttccattgttaaagggttatgtcgtgaatgctcgacctttcatctgatgctggagcggctttgctagttgttggactcgtcttgagatggtttcttttcatcctggtgggtagcaacttttggtgctgtcttttagaggttgtggacactgttatcttgtgggatgtcaccttgctaaaatgtactcaaaccctgctgaactatgtaatatgcagtagctggtttgccaatctttttcacaaaaagagaaaaaattctgatgtctgttggataaggtggagcttcctgttaacatttgtttccgattccctgagtgcttttctattttataccatagaatctctctgaactggacagattgaagtttgagcaaaggaactatttttttttttacttcttagcagaactgatggaaaatattatccggtcaggaagctaagtttggtttatgatatcctgattggatatatgaaatatacatctcgtattttggtctgaggtggctactactcttattgacgagtggtgacgctgtaatgctccaacgttttcatgtacataatttacaattaatttggtgctacactagaaacatttgacaaggtgcagcttggctcgtgcttgtttttttcttgaactgaaaacttctgtactttttatctggcaagcttatttacagctgaggaagtgctccagtgctgtcaaaaaaaatagtgaaatggcttctttggatctaactgatcgatgaaatgtttagttcatattctgtttactactagtctattacattgtgttcgaggagtgattaagctcacattccatgcaacacatggttttatttttgtcttttttgcaggaagttataatgttcaattgttatgatacaattttattgacgatggtcagtatgttgacaattaaatgctgcaaactatgaagcaagattatagtataccttatgctgatcacctatatattcatttcagcaatgtactcttgcttcctgtttaaaagaactctagcatttccatttagatgcttaccatttgaagtgagctttctattatgtatgggtcactgggcctcatgatagcatcagtcggtgtgatattctcagtcataaaattctagaaaaggtaacttgcagtatgcttgatagaagttatttttgtcctggttcagtccacactgccctgcaactgattcagtatgctttttttttcacaggcacaaacgctctctactgctatgatctctcaaacaaggtaaacttatgtacagcatataaatatttagctcctcacagttgtttctctggtgcatttcccttgctggaatctctagtaatggaaatgaaatataggacaaatagtttgggatatctgattatattacaactttcactttccaccatactcattgtgcatttatttaaaactccagatcgatatgattgcgatatgaacctgggacctgttccctcaatcaattcgtatgtggatttctggttgaaggtttcagcattttcatgaaaattgtaagaaaccgagtagcaaaaaatgctcttgtctggttacatttgaagaagcagtggttaggacctctttttgttggataatcacattccaatgtgcctttgcatgaatttggtgaaagtttttaaagtacttcacttgcggcgctttggtccaagtctaatgttgtatttcagcttttgctgtagtgcctatgaagtgggatgcatgtcaatttacttcattgacagttacctatataatcaaacccacaatctgcccttctatgtctagagtacctacacacatgcatcccctgttctttgaatttctttagaaccaaagggaagagcctgagtttcaagttttcttatcgaaaaccagaagccacagctgcttatcaacaggttatctcaaatgcaaagttccaaggctgacagctcatttagaacaaactgaaaacccaagtagcaaattccttaccaatgtctctacttacaatagaagcccagtcgtcctccttcccatccctcactcattgcacacagcgcaacatccctagaaaaattgctagaaaaaaaaaacagaaggaaaagccggttgtgcactctgaaaaaaaaccgcaaaaaaggaaaagaaaaaggaaaggtggttgtagtgcgctttgaacaaaaacataaaatttgctaataaaaaagtaaaaaaaaatggtggggtgatagaaaatttgctaaggaataataataaaaaattggttggataaagaaaaatcctcattttaatggtataaatcaattgtaatgtacgggtatataactagtatgaacaaacaccactgtgacagcaaaacaccctagcttatctccttcactgtggcctgtgggtgtcgaaaccaccacatagcaaatacgtggatggatatttttgctcaacaactggacaaagcaactttgtttgctgtgatggagaatacataacacatgtcaagcagcgctatgccgcctctgttcttggaatgcacaattaaacctgaaatactcaagatattgtacagatggcctaaaatctcccattatattgccatgaatattctaattacttgcttttattattgtcttcttcatcttcggttcattcacataaattgtcagtttcaatttctagagtgggctggtttggatgtgcttctaccatgcacctgaaagcatcctctacggcttccacatatccaagctttgcacccaaacgatttgtactgacactgaccatagtgaggcaggacaggtgctggatgcctagacaaaaaccaccatatgttgacttgaaattagctacattgattccaaacgaaagttgtccaagccttggcatagatccagcttcaaacatcagacccgtatgcgtagattggaaagtgaaaggctccaactgttggaatccatggatgtcgctgatggcaatagatctttcattttggtctgggtctaaacataggtacaaatttgtcaaactgggtatacttccaaggacctgaagatcatcttgatctatgtccttaatagtaagagccaatcgccggatgctcacaagggagctctgccatatgttaaccatggaaatgctttctcctctgagtacaaaacttttaatgctatttagaggtagtaacaaggaagagaaatcatcgttgtttctcaagtgaacatgaatgctcagatcatggagattgcaggcttctagtttgcagagagaagatgctattatttccttgtatctcactttattaccttctagcctgtcaatatcccaatttatgctcaacctccacaggtttttcagctcacacagtccctccagaaattccatcgagtgtctgaatacatctatgcctactacctcttctaacatttgcatatttttgaattgatcaggcaactttgttccatcattgacatacagaacagctaatcgctgcagctgagtagtagatttaggcagttcttttaccgatgtagctatgacatctagcacctctagacatttgagatctccaaattttcttggaagttcagttatcttcttcccttggattgtcaggtacctcaactgagaaagtcttgtcacagtctcaagatgatggttttctaatccacattcagcacaaaaccacaagtccagcacacgcaaggtgctgaagttggagaaagtgggtagttgctttgcaccccaaaaaatagtagggatctaagctgcgataaattccagcttggagaaataattatgtctgattgctcgtgtccctgtatcagagatagtcgacgaaccttcatatctggagttgacaaacatgtaagctgtggatagttgattgtagcagcaaagttctcttcaatagacttggacaagaggaaatcgtggatggtgtcatggactcgacaactccgcgcttggccatcaatgcgtatttccaatggctggactaagcttctgttaataagttaatagaaataagaatttcccaatttatataggttttgtcgactatctccttgaatgaatccttcagctatccatctatctatcaaatgcattcgaggaatcctaaaatcttctgggaatatagtcagaaacaacaagcaagttctgagatgttgaggtaggtcgaaatagctgagagataatatcttatgccttaaaatctgaattctctgcaagtgcataaccaatggatctttgtatccgatcccattgatctgttttgttcttgttagccaacaggctagatgtggtaatgattgccaatggcaaaccaccacatttcctcaatattgcattcg

SEQ ID NO: 7444 - DNA, 549 bp, Oryza sativa
cgtatataagatctatcttttcatacaaacataataatgaagaacgaaggtgaaattttctgttataaaaaattgaaaaggacaaatgtgtttgatagaacaacatttaaaattttcaaataaattgcaatgacatttcaaaagggggaattgcaactatattttattcttcttctccttagaaacaaatttaaatatttttttaatacacatcaaacaaaattcaagatattttcatggaaagagagaaaggtgaaattgcctctaaaattttcatcaaacttcatttcaaattttatcttctcttttaacactggtggctagatcagttgattggtgcatgtgcgtgcctagtgttcgaatcttcttcctggcaatgtttttctcttgataataaataaaattgggttggactgattgggacatggggtggagacattaaggagttcttccagaattatttcagaaattattcgaccaaaacagattccaataagggaatatcttaaaaacctacattattaaaaaaataatgttttaataaaaact

SEQ ID NO: 7445 - DNA, 4121 bp, Oryza sativa
aggcggcttacgccaccatcagcgaaaaccttttttctattagtgatgaaaacttatgcttgatttgtagtgtttttgcttgaattcaaaaagtagtctactcaaactttcctgaaattttctactcaaatgatcaagctttctactgtaataactttattgtctaaaagactaaaaccttttacttcgatgacaaaattttctattcttgtgacataagttcctacacaaatatttatcaagaaaagaacgcttgtgaagaagcatgtgggtacatgcgagattttttacggcataaaaaatcttaatatcgatgtctatttttttaaaaaaaaatgaggcagcagcttaaatgatgtaaactttcctttctatacaaattaatcggagcatcctcaaaattgatcaaaattatctgtaattaaacatgtgtttggctcttatatcaaacgcaagcgacatcggttgcctgcagcggccaccgtccactactactaggtggatgacactgccatcgtctggaaaatgggattaaattgatgggcaacgtcaaagcatgatgttcaaccaaaagctatatgcatggtactctggaaggaatctccttgtgccacacgtggtaaacacagctcatcctttttggcaacaaaagtacactacagcagtgacattttctcttgttactctttccttaatctgctggacttaaacatcattcaaatttgacttaaaaaggttttgagttgatctgtacggtacatagggggaaaacattagcacactaatttctagaaccgtcaaatcgtcaattaggaaaagatactgctgatgcgtttatctccttcgacatatagtttcaaccgtagtgtttgacaatgcactgactaactacgctgtcagtatgtgtatcttaagtcaattagaagcaatggcgtattaattgttttcttttttgcaccaaccgtcaaggaagtggaagaagacctcttcttaactgaacagttagactgaaaaatggtttccagcagaatcggctacgagaaaaaaaaatagccagggaaatttcagctcgtttatattgagaactttcaattgggaaaagttgcatcagcttaattggtaagtttccacttgaaagtaattaactaatgatgcataatgtgttggtccatgttaataagttcagaattgcaaatcttcaaaatttagcgaggatttctgtcgaattttggaccatctaaactcctccaagattcgggtcggcttccttttccatctcgggcgagtagtgacggttcttgcaatgtggccttgactagttagggttctgggttgggttggaattgaaggggctaagggaaaaggggaagacgtgctttccgggggcttagagggatgaccatgggtggtggaggacatagtggatggtgcactcggaccggcagcaaggtggaagtggtgcaacaggagtcgtactgatggaggagggtggtgggccggtgtcaatggcaggggcaaaacagaacgcatggttaggaggtagatctagtggtgaaaagccgccggagacaggaaagacggtaggagggggggcaccttgccgccgctggcttgacgaggaggctatccggggaggaaggggggtagactcgccgacgctgtttgtgccatccgcccaggtggcggcggccactactaaaaaaagatttttctggacgagcaccccaatagattacaaacggaccataagtatccgcgtctgcaaaaatcgaccctcttttttccatatggctccgtaacatatccatatgctaaaatccatttttccagatggcccgcttaacctatccacacacaaaaataagggtattttcgtatgcggggctcttaactcacccacatgcaaaatacctaaagattcccactcccattttttatatctccactcctctttctctctctctctcccataactctctcccccactcccccacttatccccatgccgtcggcggcggtggtggagggcaaaagaaggcgtgtgacggcgtggatctgatcgacgtgagcggatggacccggctgccccttgctccctacggtcccacgactacgaggacgcaaggaggctggtggtggcggcttctaggagttaagtttcgtgattttggggattttttttttttggatttttatttttatgtgcaggcaacataagcatccacacgcgaaaatcatatttttgcagaccatttagcacgtgcggctagccctaccgcacgtgaaaaccccttccgggccatttgcaaaaatcttttttagtagtgggcgagctcgcctcgtgctcggctgcatgctatggggagaaagcgaaggggtatgaaaatgaggatatggttactattgcacacaaatcctaaattaaatctagttgtccaaaatttgcttgatattaggtgggattttctgtcataaattggatagccactccctaaaaagtgcatagcttaaggtctaaggagtggcaaatagcaacggcactagttttctgcaccatcaaatggaggcagtggaagagaaagccatgcatgcatggcatcggtgaaaagaactaaaaattccttatgtgcacataagttcttgcgccccctacacgcccttgaatttttaatttattttgatctccactgttaatcactcccctctcgtatataagatctatcttttcatacaaacataataatgaagaacgaaggtgaaattttctgttataaaaaattgaaaaggacaaatgtgtttgatagaacaacatttaaaattttcaaataaattgcaatgacatttcaaaagggggaattgcaactatattttattcttcttctccttagaaacaaatttaaatatttttttaatacacatcaaacaaaattcaagatattttcatggaaagagagaaaggtgaaattgcctctaaaattttcatcaaacttcatttcaaattttatcttctcttttaacactggtggctagttcagttgattggtgcatgtgcgtgcctagtgttcgaatctccttcctggcaatgtttttctcttgataataaataaattgggttggcctgattgggacatggggtggagacattaaggagttttcccagaattatttcagaaattattgtaccaaaacagattccaataagggaatatcttaaaaacctacattattaaaaaaataatgtcttattaaaaactacattattagaaaattaagatttgtgctatactagatacatgtacatataggaaacatggtaattacagtatggttagtaattataactatattgtaaccatataaataattataactacataattaagtaattaactacttagagctcgaacctagactcgttgatagccctactccattgggtctttaacaatttctcaagcgtggatagaagatacatactgaaatgtatccatatatctctataatctctgtggaaagaaagaagagaagagagaagcagtcatttggattattttccgttcacaaactcacacagccacattgctttacgcggaaactagcttgcggaaactaattcgcaagacgacacaactttatactacgtcgctagtcttcatgcatcccatcaacacgcgtccacttctgatcatggaaaaaaatgggaatacggccacacggttgtccctttgcttttcttccatattaataataaattaaaaaactatgatttgaaaaaagcttcggatcggtcgactcagcaattagaatctcatgcaaccacgtgcttcctattacgcaaattttgctataggatatcgtaacttcacggttgttatagtataccgcacaaagtaacttttagagaagatattttataaacgtgataatttgtcaatagacaccataccgattaaaataataattcgcggttaaggaggaaagaaaaatcgtgtgaaatgtcagaaatacccatggtcccacctatcagggctctcatctctcttatttcgttctaccctccgacagtgccataggggtcatcgctgccgataggaagcagcacgcactgcacgggcaggata

SEQ ID NO: 7446 - DNA, 3924 bp, Oryza sativa
gtgttgcacgagcgtgacgatggcattttagcgaagcaacttggcggaattgcattacagcgaaacccatcctacaaagtgactaaatgtcaattttctcgtcatcaacacattcgaggacatcatgggtgccttcgtcaaggctacgtagcagcgctcaacccagaatgcgtgggggcatcaagacaacatgcgccggtgccggcacggatgccgacgtgagggccagcccaggcaacctaaccgacgtagacgctgaccgtatccttgcctagctcgacgcccatctaccggcgtccatgctgtacataagcttcggcaatatctcgcatctggcggcgaagcagacgctactacgaaaaccttttttcatgcgggcgggaaggatctttgcatgcggacatgcggttacgccaaccgcatgggcgagaaagtctgcgaaaatcacgcttttcacatgcggtcgcttataccgtccgcatgcgaaaataaattcggcaaacaaaaaaaataaaaaacaaaaaacccgaaccctagccccccgccgaccgccgtcgtcgccggcgccagatctgtcgcccccgctgcccaccatcgttgccaacgctggatcggcctcccccgccacccgctgtccacaccggcaccggatcggctacctcatcatccgccatcaaagtcgatgctggatccgctgcgagggaggagcgcccttggcgctggatccgctcggagcggcaccgcccgaggctgccgaaccgcccccaccgcagcggcggtgaggagaggagagggttgcctcgtcgtcgtcatcgtcggtggtggcggtgagaagggcatggcggtggcgccgctgcccactcgccggatccgccgcccgtcgacgccatcgccgcccctgctcacccctgctcacggccgccggcacatgctcttggagaggagagaaagagagagagacaggggaggagagaaagagagagaggggagagtaaaataatagagggggagagatagaggagatgggttgcaaaaaaaaatttgaaatcgtgggagggaaaagagagtggagggagataaaaaaaaatagggtggcatttttgcatgcggtcctcttaaggggccgcatgcaaaaatatgagaaatttgaatcgaattttatggtactaaatcacaattcatgtgaaaaaattgtcaaaaacaaagttatagaattcattgagatctaccaattttcttttggttatttctccatccgagattgattgaactatctaaaatttaattttaaaatataagaaatttaaacaattttttgggtagtaaatgatttcaaatgaaaaaattatcaataccaaagttgtataacttatcaagatctacaactttcgttttgaacatttttctatatgactctgtttcaacaatttgaatttgaatttcaaattaggagtacttcaaacaagattttgaaataataaatgatttcagctgaaaaagtcatcaacaacaaagttatataactcatcaagatctttaacttttattttagtcatttcttcatccgacaaagtgataataacatagttcacaaaatttacatatctcttatatggttttctaagctataagagagatatgtaaattttgtgaaaatgttactatcactttgtcggatgaagaaatgaccaaaataaaagttatagatcttgataagttatacaacttttgttgttgatgactttttcaactgaaattatttactgcttcaaaatattatttgaagttttgaaattcaaatttttaatggataaaacgaagtcacaagaaaaaatggccaaaataatagtagaaagaacacaataacatgatagagcatgatttaagaaacatttaggtaaaagaatcatccaatttggagttcatatgagtgagataaattagtttcatattttcaaattttattttctcatacggctccttaagacacccgtatggaaaaatcgatttttccatgcgggctcttaagcggtccgcatgcaaaattgagctcatttttgcatgcgtacctcttaagtggcccgtatagaaaaatcgattttcccttacgggcgtcttaaggagctgtatgtgaaaatgccgcttgatttttccagatgcggcaagttatggtccatttgcaaaaattatggggtctcatacagaaaaatcatttgtgtagtagtgagatcattgagctcactcgcgacatcgaggcatcgacccagctattcatctgggccatcaaggaggccaagccaccaccgccgccgccggtgtcaagggagagtggctcgatggcaagggatatgaggagcacatcacggataggggtctcctggtgcgtggtgggcgccataggtgagcatccttgtgacatcctggaacaattaggatgaggtctgtgtggcccataaaaactgtgtgcatgtttaatatcatcttgctagttttgcaagagtggaaccaacttataaggacttctactccaaacatatcactcccaggttaacacttttacatgaagcgagcacgaaagtttaagtggagtggtgtgtgtaagtgggccggtccgtccaacggcctggctacacggttttggaacgtgggttgttagcggttgcgcgtacgggtcagtatgcgggcatatggcgcatggcgcatgtgggtctatgcgaggcacattttttgttcttggacatttgcctatatgattgtgtcgctatgtgggtgagttggaccgatgaggacatcgggtcctttcagggaggtgtatgtgacatcctggcccaattaggatgaggactgtgtggtccataagagctgtgtgcatgtttagtaccatcttactagtttagcaacaatagaaccaacttataagtgcttctccctccaaccatatcactcctgggttaacccttttgcactaagtgaggatgaaagtgtaagtggagtggtatgtataagtgggcctgcccgtcggttgagctggattgcgtggttctggagggagggatgttacaatcctctagcacccagccacgggcgggttcctaacccactatgggtagaacgccgtgctggagggccatcaaccatgtcctgccggcactgacatggccaaccatcctcgactagttcagcgagcggttgctcgtttatgtgcttggcgttggtgtcaggtcgggtgtcaccacaccactcatgttcctccccaatgaggccgaggaagtgcaggttgctagcaccagcgtggaaaagtctgtggccaagctgatggatggcgacacggacaacacggctaggagggcacctggtagagagctcgctgtgagggccagggcggcagtaggtcgggcgtcaccaagccgctcatgtacctccccgtcgaggccgagggcatgcaggtcgccagctccgacgtggagatggcatggccaagctgaatggatggcagcacagacgatgcagctaggagggcacacgctagagaactcgttgtgagggcgagggtgatggttgtctgcgtcaacccctctcttgtatgcacgtgctgctttccgtcagatgctatgacctccacggcgccaacagaggggatataaagagaaaacagttcactagtggagaaaacatctttgcccggtcgaccaaaaaccacaatagtctcggatgcagtaaaaaccgggactaaagatggtttttagtcccagtttataagtagaacgagactacatgatctttagtcccggttcacatgctgtcaggtgttgtcaagcccctccagcatctttagtcgcggttgcagttacgaaccgggagtaaagatcggatctttaatcccggttcgtaacagcaaccgcgaccaaagatgctggaggggct

SEQ ID NO: 7447 - DNA, 6976 bp, Oryza sativa
  unsure (1)..(6976): unsure at all n locations
cacccactcctctctccctccatctctaatcttatctcttcccttcctccttatctctttttcttcttatcccttcccaactccccttcccaactcgatccagtgtgcgcagcaggagggggtgggcggcccggccggcggagggcagcgcggcggcggcgcggagggccgtggcgacggtgcggcggcggccggggaggaggggaggcggcagccggctcagccggccggcggctttacttcgtttttttttattttttttcaaagaatttgtgatccatgtgtagattgagatgaagaatctgtggttcattgtatggattgagatgtataattatttttttggaatctcattgtatggatctgagatgtacatgatttgtgtatgatttgtatatttgggatgtttctttgatttggggtttgatttgggatgtataatctgtagtgtatatgattgatttgtgtatttgggatggtatgcatcccacctaatttgggagaaaataaattagagattaaatagtaagtaaatgaaaaaaaaactattgcccactcccatctttagtcccggttggtaacaccaaccaggactaaagatcgatctttagtcccgggtatttgaaccgggactaaagatagggatctttagtcccgggttcgtagtcccgatttaaaaaccgggactataggggggttacgaaccgggactaaaaacgatttcttgtcacaccctgattttcgtgttaggatttataaattatttaataaattattaatagaatttatatgaaatgttcattaatttacaagtgaagttaaatgtgggaaataaaatttcctaaatataaagcatgggtggatttaatttttattaaattctccatggttaattatactctctggaattttctcggatttttcggagctcaattcctaaatgtaaatgatacagagaacagttcagtaattatttgatcaataatgatctaattataattgttaagtgcttttcttgtttaaaatccttaaattataaattgttgtttaaaaggaattattagaaatgattttaaaagcttaaaagagaagatctaattttaatgtgctaaatctcaatataaaattgggttagataaaattttattaaatactttgcttgttcctctattttctagaattttctgggaattgtttgagcaagggaagtatttttaataaataaaacatcatttcacgaattatttttaattgaaaaagttcaaaaaccctttccctctaggcaccgacatgtggggcccacatgtcaggcccttcttcttcctctagcagccggccggccgagcccaagccgtcgcccgagccgccccttttctccctcaaatccgctccaatccggctctttttcttccgggtttttgaggggattttatcctctcgtcctcctctatctttcccctcaagaatcggagcaaatggttgagtatcttgcccgaatcaaactcgttttcgagtttatctccaaaaccgagttttctcggatcgatttcttgcgggaggagtccgatctcttcaatccaaggctataaataggaccccctagttcccctccttcgtttgccccatctcccgtggtctcccgtgctccgtagagtcgccgccgcgcgcacttagttcgccgccgccgccggccgtcttcagccacgccgcgccgtcgcttgcgtcgtcgccgccgcttgccgccgccgccgttaggtgcgccgtggtgaggagaacctcggccgcccgtcccctttcgccgccgaccaccggagctccgccgtcgccgtcaagccgagccgccgccgccgtcctcttcgtcgccggccatcatcgttcgtcgtttgtcgttgtggtgagtaccgttgggttcgcctcgtcgtcctctacgcgtaggtgtcctccaatcacccggccaaggtccctagctccggcgaggtcgccaaccctagccggcctccgtgggtgatgtcatgctgacatcatcatcctttctttttttcctttttttctaatagatgaaatcttcggaaaatcataactaaataaccatagatccgtttcaggtggttcaagttgctaaatttttctaaaataaagatctacatattaaaattatccataaattgaattaaatttatttaagtctttttaaatggactttaattagatttaatcttgtaaaattcataataaattcatttgaagtcggaatgaggccgttcaagtctcataattcatctaaaattatgatctacatgtttgtttactttttatgtactgtttatttggtttttattagtctttttcttcgttttgcgtgttagcttgtcgtttccgtcgttgcgaaggttcgtgagtgcgtcggaagtgatcaagaaggttaattgaagatcgattattgcaaggcaagtcacacagatcctaaacacaatcctttgagcatgttgatcctatatttaaattctctatttatttcaactatgcatttattttcgaatgtcaccgggtggtgtgaacctattcctttgttatggccaatttgcattgaatgccctattccttgataccttgggtaataaattgattagcttgaaccttatgtattggtttggttcagctaaaagttatatatataattgcttagcaatgcttagaaacattagctcactaatgggatgaatcatatatactacattattatttatggttatatttaatggtagctcacgatggttaatcgtgtgatgttaattaattgataattaaaacctggttaaggtgggttgtgagcatatggttttgatggttgtgctcatgacaattaaggaccggttcgcgagctactgttgtgagacattaaccgtaccaaccacaagccagcgtgggcaacggctttatcctttgtatagcatggttcattatagtgcgccagactgagaagtggcgagaagtccacgggggtcgctggggagtccatgccttgtttataagggggtgattatgatccaggaacggtgcactgttttgagttgtgttgtgcaaagggtattgtcacgatttccccctttgcaatgccgtggtggtatttcggggcatggcaacatgtgtggaatcgtgtcttgtgggtacagtggtacacctctggccagagtaaaactattcgaatagccgtgcccgcggttatgggcgggttgagcaatgtttttcgtgattagtctcacacctttcacaataattatggatgtaataactggtaataatttgcttagctcctggtttggagttagatctgttcagccgggtatggttgttcaggatggttgggcctgtacagcatgggtgtgctgttcagtgttgattaaaacttctgattaattaatctactgttttactactcttaactctttgctaaatgctgctttcgcaaatgagcctatattatgccatcctttggaatccttgtgcacttgcatatttgctgtgtggcttgttgagtatgtcatatgctcattcttgcaataatcatcaaacctcagttgaagataaaggatccagaaggagaagacgtttggcttataccccagttgagctgcctatgggagtggagctgaagccatcgctagaccgttaattccgctgctgtttttcttttcttttgtaagtatgtaacgttattattatgatggatttgtatattaaattatcagtttgtgtacctcggctgattcctggacgaggattttatgcacaaattagttcggaaattattagtgaatttccgggcgtgacatttctccactagtagttagtagagttgacatgtgggttcaggggtatttcttaacatttcacacgatttttctctcctcttcaacttgaaattatcattttaatgggtgtggtgtccactggcaaattaccatattaatagagtgttttccccccaaaaagtcacttctctgtctcctacaactaaaactacgaagtcacgatgtccctttacaaaatttgcctttctattgtcttgctctcccttcactttatctatgcttgtatgcatctagcaagatttaaaatatttttttcttcattatccgaccttattgtattcatcgtaattaaatctttataacaaaatattgcatgattatattccaatgaaagaaaaacatatgttttaaacggttaaaactcattgtttcatatgtgatacgacatgtttcaacatgtgttttcactatgtttcacaaaatttttaaatgtttcaacaactgatttttttttatcattataacttaatgtttcactcggtagccaccttcaaatttttttagaaatcaggtgaccgatctgtagtttcgtcagaataatttataagctaaacaacataaatcattttatgtgaaacaaatgtcactaagtagagaaataagaacattctatgtattaaaacattatatggaacaagaaattttgactattgaaaatgaataagttaaattttgaaattttgactattgaaaatgtttcctttggaatgaattcctctacttctccaacaaatcttctctattccaaagaagcccttaggcacattattattccatgggtcatataacaacgtcagtttacttgtgttcgaagtttttgattttaactgcacacgtgtctaaaagcacgtctatttaaacagggcgatatatcagttctcgcaacattaaattttagtgctaattactgtagtaatgagttacatcgtgaacaaatcctcgccggagctcgtcggcccgccgacaaccaagccggtggcgccgaccgtcgctgacgtcatcaacctatcctccttcgacaaagccattggttcctacctcttcacgtcgttccacgtcttcgacaatggcatcgtcgagccggccatgacgatcaagggggcactgtcccaagctctggtctactactaccccatcgccggccgactcgtcatcaccggagcggccgacggcggcggcgaccagctctgtgtctcctgcaccggcgagggcgtggcgttcgtctccgcgacggcgagctgcgctctcgacgacgtcaagctgttcgacccgccgttcgcggcgctgttgaaggagctcgccgtggcgcacccggcggcgggagaggccgaggccgacccgctgctgctcatgcaggtgacggagttcgcctgcggcgggttcgtcgtcggcatgacgtggaaccacgtcgtcgccgacggcaagggcatagctcagttcctgcgtgccgtcggcgagctcgcgcgggggctgccgcggccgtccgtcctgccggtgagctgcggcgacgactccctcccggagctcccgccgctggtcgccgccatggagaaggcgatgctgacgcaggagagcaagcagttcgcgtacctcgacgtcaccatcccttcgagcgtgatcggacgcgtcaaggcggcgttcgacgacgtcggcgacgtcgcacgctccggcggcgagccgtgcaccgtgttcgaggcggtggccgccgtgctgtggcgcagccgcacgcgcgcggtcttgatctccggcgactccgacgccgacacgcccgcgccgctcgtcttcgcggccaacgtgcacaagcacgtcggcgccaagcacggctactacggcaactgcgtcacctcccaggtggtcgccgcgacgagcggcgaggtggcgaacggcgacgccaacgacgtggtgaagctgatccggcgagccaaggagctgatcccggctcagttcgagaacggcggtgtcgccatgaacggggcggcggcgcgcgtggagaggcagctgatgagcgcgctgttcgggtacaacgcattctacgtggcgagctggcggaacatcgggttcgaggcggtggacttcggcggcgggaggccggcgcgggtgatgtgccatgtcgggccgacggcggtgccgagctgcgtggcgtgcctgcctcgcgacagcggcggcgccagcgttctgctgctgtgcgtaaaggaggagcacgtcgacgcgttcctcgcagagctggaaagtttcaaatgaatatatatactgtcttactggttgcttggtcgcctctgacgatgaagatacttctataaaaataaatgtaacgtcaaatgctagtactttctctagtttaataataattgttgttttggatggagatacagccttaggctgtgtttagattcaaagtttggatccaaacttcagttctttaccatcacatcaacctgtcatacacacacaacttttcagtcacatcatctccaatttcaaccaaaattcaaactttgcgctgaactaaacacagccttaaaaaaatgaaacatggagtattggtttctattacagtatatatagaaatatatgagatataattttattgaaaaacattttaagattaatctaattatatatggtcttcatgtttctaaggcaaatatttaaaaagttatttatagttaaagttttgaaggtatgacgtcagtcttgttcaaaactacaaatattttctactggaagaattacttaagattgtacaattgtgagtttcattctcgtctctcgaatgtgatgttgctactaataactatataattattcaaagagtaaattacgctcacggtacgtgaacttgtttggtgggtgcaaataggtacaacaacttaaaattgctcgttttggtataataacttgactagtttgtgcgaacataggcaaaaacaacccacgcaagcaaaattgatataacgtggtgcatcttggtgacacctttgcgggctagtagtttctttgttttgaaaaaataaattgcatagcagttgttttgtttgaaaaataaaatnnnnnnnnnnnnnnnnnnnnnnnnnnnnnnnnnnnnnnnnnnnnnnnnnnnnnnn

SEQ ID NO: 7448 - DNA, 21619 bp, Oryza sativa
attgctcgttttggtataataacttgactagtttgtgcgaacataggcaaaaacaacccacgcaagcaaaattgatataacgtggtgcatcttggtgacacctttgcgggctagtagtttctttgttttgaaaaaataaattgcatagcagttgttttgtttgaaaaataaaatccgtactgcaaaaactgaaggtaagttagtgtactcaggtctgcacaactacaaacaatagctagcgtgcatatgtttcattatggtactacacattatatcaattttgcatgtttgtgttgttttgtactaggtttgcacgagctatgcaagttattgtactggaacgagcactttacaagttgttctacctatttgcacccacatcacaagttcatgtatcaggagtgcaatttactcttattcaaataaatgaaactgtatgtatcattgctcagttaattcaaatggcaaaactttctactcagttaattgtcttatcaacttaaaaaatacctattaaattaatttccatattaagtgtagagtaaattgtatccacgttataattaaataagttagcagatgggtgcaatttaacacaagaacttgataatagaacattcaagtgcaataacctgacaagatagtgcgctttaatatagaaacttggtaatttatggtcttttagtgcaataacttggctagacatgtgctattttggttaagagtgctatgtactcctaagttttttcacgatgtcagcgtatcttcacataataatcctgtagatattatcttacaatctttgatgtagtctgcaagaattgtgttgctcatggtttaattttttcttcaccatctcaaatctcaaccaaaaaagtttcaacacagtaaaatttcattgacttttaattactagaataaccaaaataagtatgcctatacaaatatgcataagtatattaacaaaataagtacttaaaaactgaatgagtatagccgaaaatgcttgaaataattaatttgttacaccacttcttataagttattgtaccataatcacccccacctttcaagttgctatatctgtacgctcacttattcttgtactagttgtgtccacttgttaagttgttgtactggcacgctcagttctcaaattcttagcactaaattacacccaattgccaagttaatgtaatgtgaatgtaacttacttagaaaagcattgaatttgtatcaacgaactaaggtaaaatataggtccataacaaagcactgatttttacatgtaaccagttagtttgcacgtgcaatgcatatttgtgtgatatttttgcggggatgttcgtgcagtataatgtgacaacatatataatcatactgaaaatatgaaatccttgcgttatatacctaacattcaacgaattgcctattgccttactaaaaccaatttggggatgtttttatacggtaggtaccgttcagtcaatctcatataacatatgttcaacattagttttttaacgactataacatattcaaaacttctgcatttgtatcatttttcttttatgatcaggacacgcaagtgaagtattctctatatttcatctgtagtatcaaaactgatttacaactgtacaaaataatgaaagaatcaaatgtgaaaagttggtgcaattgccctctgctcatctcttcttcactaaaatcaaggccacaaatgcaacaattctgaagaacagaccatacataaacagaaccaaaatacagagcatgtaatgatgaatgtcgaaacgacttctgaacaacaacccacagcgagttataagccaaactccaggatacctgaaatagaaaagaaaaacgcattaactcgagctgctaatttacaaatgaatattttggcagatgtgatgatgattgtgtatctagatatgatcatgcaacatgcaagcatgatgagtaagtaatacctttttgcatttacaattatgaaaccctctaatgcccactttggatagcataatctattgagaattgcaggggtattattttgagtggataacaaagtcagaacaactgggatcaatgcagaacactgcaaaagtttcagggttagtctccaaatatattattaatcagaagaaactgcaaaagttgaacaatctttatgatacataccagttgtgcagaaccagggttgaagcagatagcaaaagtgtatcctataccggttacgcagtacacaagtgcgaggagaatgatatagttatcggtaattgtagatcttggattattgaagtagtagaacatggagaggtaaacgatcggcttcacaatcgtgctgaaatgatcaattgtatccctagcaagaaagtatgccaatgagctcatccctgactctctttccctcaagtattgcaatctttcaagtgaaaacgaccttagtgctgcaatcttgcacaacagagctgcagaagtagtaatttatgtcagtcaaataatcaagttcgtactgcaatgacagtataatctgaatactctgaacttacaaactgcaattatggtgtaaatgtagccaggcatcccaaaatttggatcactgagctttgcaatagtacccagacagatcccagcaaggcctagtatcagaaaatcaactgcaagcaacctagcttcgcgcaacctctgttttgtgaccctgtgatgtcacacatgaaagaataacttttaatctttcgaaaattttatcattggaacaatgaaaatttgatcacatggttgttcaagatttcataaaaagattatatgcattgaattgaacataccttcctaggtagtacttgtactgtctaatcacccctggtgttcttctgctggacaaatcctttggtttagacaaatggtgctcgatacgatcacgctcttcagcaaaagcattcctgacatgaggaaggcaatgaggtgttgatccagctgaagggctggaccccaaatgtggtctctgttcacctattgccttgagatcatctttcatgtcatttggcacttcatagccattgtagagcatccagtgcaatggaaaatgcttcgcattgatgcctgactcaggcttcacaatgccctcaagaatgtcaatgtagtgatctggtgggttaactctttcagggacagtgatcccaagagttgagaagtaatcctccacactcttgaccggaccattgtaaacaattagacctccttttgccagaagtatcagatcatcaaacatgttgtacaatgtgtagctgaataacacaaacaagaaaatattagaaatctttcagaaagatgagtactatcttcagaaaaagatggtctgagagtaacctcggttgatgaacaactgcgcaaacatttacgccttcgagcgcctcatgacgtagtgctcggaggagcagttgtgaagaggagctgtccaggccagaggttggttcatccaggatcagaagtgatggctccatcaccatttcaatacccacattgacacgcttcctctgtccaccagagatcccgcgcttctccacagttccaaccaatgaacttctgactccctgaaggtccagggagtctatgaccctctccacagtgaggaccttgtggcggtgtgccgttgtcgcagagagcctgaagatagtagaaatgataagaatatgctgagctaattactgaaatggcaatctgatataaatacttcctccgtttcaattgttttgttttgttaggacaaggatttgaccagcaattactttattatgatatgacttatgtgatacaaacgcataatcgtaagtaagtacttttgaacacaaatctaacaaatccaattttgtgtcacaaaatcatatcccagtagagtaattgttggtcaaagaattgtcctaacgaaacaaaatatgtcttatattttgaaacagagatagtaattgtcaagtaaacttttttatattaataattttacctgcactttgcactgaaccaaaggttctcttccactgttaaattcccatgaacaacatcatcttgaggaacaaatccaatgatcttcttgtaagaacggatgttgtcatgcctcccattgacaagaactgaacctgacaccttatagccagctaccttccctgtaacagcattgaggaatgtggtcttgccggccccggatgggcccatgacggcagtgacacggccaggccggagttcgccattgatagacctcaacagcttcttctttccaagtgacagggtcaggtctttgaactcaaccttgagcagaggccttgttatctccttctgctgctctgacaccatggagagcactccagtgaaggtcaggttcttgttctcctgttgcctgaccttctccttctcgatctcaccatatgcgtacttgaagatctgcgtgtgtgttgatctgtgcttgccttttggtgcagatctatccttgccggcaacaatttctccatcatcgctaacatccacaacgactgaaggcatgacttcagatatctcaccagtgctctgatgagctgaaaatgcagcagaatccgacaactcctggttcataaacagtggtgcttcctgcaacctatggccagaattctccgagtccagatgctgacggaatgatctcctacgagagaatgtacgtgagagatgactctgcatgtcattgacatgcttcctcgccagtcgtttcgccgccttccatccctcatgcgctttgagctgctgacgtgccaactgaatagcattctccctcgatctcgctttccgtttctcgcggatagtcaggaactggcctgaacagttgtatatgatcagaagaaatacaaacaacatgccctgcaccaagtgttcaacctgaattaggcacattttccagtacagtctgcagtccattgcactcactggatcttaaaagaggcaaccatcaagctagcaagatagtgaaatgatgactttgttgatggaatttaccactaaacaaccaccaagaatgacaatgttttcattctctgtcttctccttgcaggatccctttatgatacattctgcagattttgaataaattcagcttgctggatggtagatactataactgcatgattcaataagaaaatgaagtatcaatctattttaatgatgcttactgtcttgagtggtggaacccagtctgcaatagtgcctgaaggggaggaaaaaaacaagaatcatcagtcacctagtgtttaaaatcaaataatctttgtaatatatgtcaaataagtcatacaaggagtatgattggatcagtacccttcgctacaaggttccttttttgttggtgttggacagtagtaaccggctggacagaacatctcttcagtgctcccaaaatcagcccatgtgtcagcacccccgcagccagttgtatttggagttatctgatacttgtatctaatcaaagttcagaaaattcaccttgtaagcattgtgtttatattttcaagaaggcaaatgcagaacaataagaacagaattttttttaaaaaaaaatcttacggatcacaaagaccagtggttgtgttcacagtggcacgcggacagtatgatcccaatggacaagctaaagcaaaaaaacaaacatgaaactcaagtcattcagcaagataaatatatggtctccacacaaattaattgacaataagaacagccatgcgggaaatgtagaaatcactcacgcaacatgcatgtaagaccacggggacagaagaagccttcgcaacacggctgacaacttgcagttcttggtggaatattgccttgggggttagggcctgaacctacagagcaagcccaccctggctcacagccctgaacccaagatgatctgttgcagtttatgttggttttcagaaagaggtttttttcgccttttcgatcatacaaactcgagaagtagaatttcacttcgttcggtgtgcacagacgccctcccaaatcacctgaatgaatatctttttcacattagagaatgccaaaactagacatgttcatgggcagcctgacctgccttggtaaggaaaatgatgttgtaaatcattttttttaaggagaaaatgttgcaaactagacatgttcagtgttcaagcctcgcatttcagcgtggaagcgtggtagtcacttctatgatataatgcgaaaataaaacatgcgacttcagacttaatcataatgattatttttgccacaatcaacggatcagaggcataatcataatcataatgattttgtcacagtaccataaggaaaatgatactgtaaattattttttcaggctttgtgcttggcattgccacaccaatcagtgttcaagcctcgcctttcagtgtggaagcatggtagtcggaattagtcacttctatgatacaatgtgaaaatgagatatttgacttcaaacttaatcataatggttacttttgtcacattcaacagatttgtcgaattgaaacaagttactatactatatcagaagtccagaactgaatctaactaccgaattggattgttgtgacatgtaaaataaataataagtgcaggataattagagataggaacaggtcaaactgtctagcttcttaagactaaacaaacgaatagaaaatattagttagagttgatcacgtcaaacaccatagtcccgtgtcacactcagctaacattaacaagttataatgttagtctttccctactaaattacggaatggatgattattatagggttgcatgctccacttgtcctccatcagatcgtttcatcctctgctaagcactcctactaaacaatgttcaggaaatgcatgtgcaggtgaacaattccaaagaaccaaatctcaatcagcatatcccaatgtcgcatctaggacataactatgaatattataagaggtgaatattagaaactagattccaaaccaaaattaaaaaaaaaagaaaccgggatgcttacaaagcaagcacaaacagtatacgacgacaaaatatttgcgagtcggcttagacaaccttgaattaggatctccgaatagaaaaccatttctaagaatttgaagtgcatttatgctaatgactgaattctaatataattatctgaattggcaccaccgcaccatcgaaaaaagtagtgttatctgaaaaccaatcacttgaaattacaaaaagaaaaagtaaaccatgtgcttataaataaaaataagttcaaaactcaggttggttcagttcattagattggagcatacacggataaatattcgattaaaaaatgtgtaagcatggccgtcacattcaatccgctaaattcagatgggaaacaaataaaaaaggagaaaccgcttcaacgatgaagaaagcaacacacgaaccaatcaaacaagcaatcgaacaggaaatctaactgaatttaaatttaattaattacctcttgtctccgcgaggcagttctgcacgaatccaagatccgaggtgtaattgaaggcctcattccaatcctccgtcctgaagcgaacacacaccaaaaccaaccaaaaatcatcaacaattccattgaaatcaagaaagctaaaggaaaaaagttttaagaggtcggcggcgaagaacggcgccgccgaaatgaacggggggtggggggagaagagaaagaagagcgtacgggtcggcgacgcagaagctgaagcggtgggagatgtagtcggcgacgtctctggtgaggttgttgagcgcatccggcaccaccggcggcgccgtcgtctgctggccgcgcgcgacgccggcagcaagaaggagcagcagaagcagcggcggaggtagccgccgaaaggcctcgccatcgcgcattccggtgcagacaggatcacacagagctatagctagtctcgcacagcagatggcgctgcctgtagctcgccgaggcaacaggggatggatggagatggatggaggaagcaacggcaaaagccgagatttatccgcgagaggagaaagaaatctccgcggtgcgtttgaagttgaaggattccaaggcggagcacgtttgctggttgggaggtgggggccgttgatgcgttgggtatttgagactgccggccgtgggagctagctgctgcagcttgcactaccttcggccaatttttatctacctagtgctatgcccatatgctttacaataggattaagaaaagtacgaacggatggtggttttatggttcagatttatctgtttttgtttttttttctcaaattttggtacgtggtttttttggtggtcttttcgacgtgatggtttttagaccgatgttttttttctctagtggagactggagaagtacgaaggtggagggagaatgacaattactaccactccgattttacagtagtagatatttcacctcaccatttctagttcgcactactctaccgttttacccaacggcttataagcagctatcaaattttgaatttttaaaatttaacttttgaagttgatttttcgtttttttttcaatgtaatttatttttcagcattaatttttaaattgggaagaacacatataaaaatgttttctcttaaattattttttattgatgataagtcttacggactgatagttacgactccctccatcctaaaatatatgatttttttttcattatagatgtaataagataagttaaatgggaatggtcgtgatgggttgacatgagtatgtggagaaattgttgagacaatgtaatactagttggataagttgttatattctatgataaattttaaattataaaaattattatattttgagtagtaagttaacgataaatccgtaaacctcttacttttttataaaaataaaatcatatgtacataacaacacggagggggtatgtaaaaaatcactcttttttttaattttactgtactttaaaatctaagaaaattccttcatgttgccattttgatcgattacgttgccatattaaagttataatatagatggatggaagtattgagagtcgatatcacctcgttgtagtttaccagttgcatgtcactttcaccgaattggagatttttatataatgaggcactagagtagtgaaaacccaacgataaggatggcaggcaggggaagaagcaaccgtggtgcgccccattttgtgataaccacgacagaaacgttcaacgatgcatgatttggtgattgtttgctttgtctctgttctccaattgtcgaaacaaccattcagctacaatgtggctcccgcgtgttgccttattctcttgtgtacgctcgtgatcgatgcttgacttggccacaggtcaacccaaactgcctcaggattattcccttcacaaaataaatgataaattaacaagtacgcgcgtcaggactgacgatgagaatttttcttgtatttttaatctttaaaatttgcaaaaataaattccgtaaggaaaaataacccgtgtggcacaaagctggcggcaaagcccgcaacaatttgatcatactatagacagtaattatctcacgatactagtccccgacctataaaaatgacgagcaatattattactgacactatacactaaatttctattattgtttttagaattcaaattatcctaaaatagttgttacaatatagtactaagtgtcacatcaatcacttcttattcaaatttcttcctattcttccctcaaccatcctctcacttttatttatataatatctaatgaggggcatcatagcctttcttcttaaatcttaatatatgctaaacagtttagaattataattattttgagacggaggtagtaatagctacattaaaagaagagtctactttagttataacttcataattattaattaaaaatttagaatcattcattttttatccttcatccaaattcaaatatttaaaagaataaagaaagtgaactttttatccctcaactaggacctttggtccggctttcatcccctagctaaaagactggttactattggtccttcgactcttaaaatcagtcacatttcatccttaggctaaaaacaaaattggttttcgatgatgtcgtgccatgtggcatcctagttggcaaatgaaaatttaaaaaataaaatatgaggtggaaagaaaggagggagctgaggtgatgatgccatgtggattctatttcttaatttgtttcgttatgttgttattcattattgattagtatagctattttccaatgtggtaccacatcataaaaacatatttgtttaaggccagggatgaaatatcaacggttttgtgaaagttgaaggtcaatagtaaccaagagcatagttgaggacctcttttcatttcatttctctctctctctttttttgcaaaactttttttttctatttgagaaaagtccaatgtaaatcgatgcatgtggctctaaatgatcgtttaaacacctattaaggaaataagccaaatggcatgtttgcaatcgaaaaataatttgtgagtaaaaatttttcatacttgtttttagtgatttaaaagtaaaagctgaaaaataaacttcgacgaaaaaaacttcaaaatcaactccaaatttaagattgaaaatttatttttttttcttgataagtataagcgaaaagataaggctgtatgcttgcttaggaagacatgtcgtatttttcctgtattttttaatcatgtgcgttactatgtttatcctaatccaaagttttctattcctacattcaaaagagataattgtgtgcccaaacactatttctggatgaaattcaaaagagatatctgtatgccctttggtacttaattgtcttttttagaaaaaaaaaaaccaatggagtactttattgccaatatagactatagtaaggttcaacatgtagacgtagcacgtggactttcaaacatatcaggcggatatgcagaataatgcttcaaaatcacgcggatatgcagaataatgcttcaaaatcacatctgcaactgcaagtactacacggtgctacctccttcgaagtaattaacaaggatcgcagataattcaacacggtgtcgatcgattgcatcatcgttattaccggacattaattgtaaagatcggtcaatcacacaatgttattttattggacaaatatgtataaaaaaagatccagctatctccttatcagcacaataggataaaataaaggcattgcagcgagcaatctggcagcttctgtggtgtagctttctgcggtgtacgtagtcgattgtctagttcagttcagacatgtatgggatctcccaagcaattgtgtcactgtgaatccgtccatgtggcatcactgtatatatgtgcgtacaacctgtcatgcacgcatttttttcacttgccaaattgttgaaacatttatgctttctaaattttgtgcaattgactgaagaattttcatacgcaaggcaaattcctacggttttttattattattttaaaactttttaaatttgttttattttaaaaacagacaaacttattttcaaaactaaacttttggtcacgccaacctgcttggcttggtaaaataccagtgtcacgctacctctaacaagtgtgacagttttattatgtcacgccaactagatcagcgtggccaaatggtgtcacaccatctagatcggcacgcaagtattgttttaccacatcagcctagctagtatggctaaaaagttcatatctttaaaataagtcttggaaagattttttaattaaaaattaaaaagttcaaaaatgaaaaaaatccattcctatctgcaaatatatttaactttttaataccacatttcaggttttgtttttttcttctgcaattgtccaggctcttttttcattacacaaaagacccgcatacatacaccactatacacgtacacaccacacgcctatacctatgcaaacacacactgaaaaaactacattaatggtagatcattagtctcattaaatttctgatgcgtatatcatatttgtagacgcaatagtagtaaattccaaactacttcttttgttcatattatatattttacgttttgaatagattcatgcatggatttatatatgtgtttcatatgtatccaaatccaaatttatatggacagtgtagtgaatctagacgaaagatgaagccaaaacatgtaacgcagggagtagaatgttacgctatattaatccgtgcagctacgaaaattaaggacatctttggtttgtctattgaattggcactactaaattttttgtatgacaataaactaaatatgctcatttattaccctattaaaaaatttggtagttctggtaatactgcaaatcaaacatgccctaatctcttatcaaattttgatagagttagttcggacaacaagccaaacaaagtcctaagttgctgcaaatctaataataataagaagtttaatactagagccaacttactacagtctatatcatttatagccgttttgtttgatgctaaaatgtaccgtaccaattttttgggagtttaaataataaatataatagtcttgtttgcagctaaatggatagtaatgcccacgcttaatttgctataactttcttcaccataacccatttggcttccaattagcatcaacccaaactaccctactttttaatctggatctatccaaatataaaagctagtaggacatggtagactaatcagagcgcgcgcatgtgagctccaatatttgtctaatttgttaattttggatcagatccatcacgttgagaaagctgtatcgatgactattatattaattataattgcaggcataacgtaacagacgcaaatcttcaaaggttgaacgaagaccatatatggaccatggatagttcaagatattattagagttcttctgccaagaatatgtatatatattttcttgaagtaatgatgtagtacgtatatatatagagaaggatattatgggcctaggttcctagcattgtgccgtgcattgggtttatgattaactgttaagggttaattatattgattcggtatggtcgatctcttgcaagtgattcgttaattgggttaattattgattcgcatgtaaatcatatggtattatttgttacttcctccatttcacaatataagtcattatagtatttctcacatttatattgatgttaattaatctatatagatacagatgttaatgaatatgaatgtgggaactgatagaataacttacattctgaaacggagggagtagaccaatatgtttttacaatcgagtgtctcagcaccacctaggtatacaaatggttaggacaccgctaaattaataaatgctgccaccgtttgtgctacaacgaattagtcgctgttaaattttgaattttaaaacttaattttgaagatgatttagggtattttaacgtagctttttttcaatacgacttaagtcacaacacgtatgttatgcacaaattaatttttatcgttaataagctatttggtacataatcagctctttgatcaactgatggctattttgtccagctccaccattaggagaatataacagccgaataagattttatgacaattcttcgagagcaagaacgaacgagttaaatattataaaattataagttaattttaagataattttttagtgctgaagattatttataaaaaatctgtatattgtgtataagttgagaaagcgtgtccatgataactccgcggtgaccatgatcagaaaagaatggggcaggtaatgctttggtcaatcagtaaacggaaacacgcttgcaagcaagcggagaagccagtgtcgcagtgtcagtgaacatgtttagggtgtgtttggttggggaaaagaaaatttttgggtgtcacatcgcatgtttgaccggatgtcggaaggggttttcggacacgaataaaaaaactaatttcagaactcgccgggaaaccgcgagacgaatcttttgagcctaattaagccgccattagcacatgtgggttactgtagcacttatggctaatcatggactaattaggcttaaaagattcgtctcgctatttctcctataactgtgcaattagtttttctttttatttatatttaatacttcgtgcatgtatccaaagattcgatgtgatatttttgggaaaaaaaattttaggaactaaacggacccttagtttattagttaaggtcaaacatgatcgaagtggagcgtaccttgacttgatcctgctgtcctggatgcggttgccacgaaactcctgcagcgacaaaacgtgatcctttgtgtcacttttcaaagtagcggctagtccaattctatcactttcataatacggagatataagttcaactagtaaattagagttgctttggattagccgctacttcatacccaacaaaggacgcaagatatatattttacctatgttagcacacttttaaactacttcctccatcccaaaatataacaacttttaactctcttgatttgttccaaaatataacaacttatccaccaacattctcttcccaaccaatcacaatcctccaccattcacttttactatctacctccattacttatccaataacaaccctccacgactcacttctactaactttcttactaaccgtatctaaccctaaaagttcaaaagttcttatattatgggatggagtgagtactaaacagttcatttcatacactaatatcatataaatctattttttaatatttaaaataatttaaaatataactaatcatacgctaataaatttctcgttttgtgtgcccatacttaaatcttcatcttcgtcgcttcatcggtcatcactaccggacagagccaaattggcttgttggccaagggcccttcatgtgaagcccacataaccctgtgcatgggccaaggaaacctgcgcaagttggccaggaccttgaggctgtggcccttagttcacatcaaacttccctaaactcctaacttcccattacatcatatcatatctaaaatttttctactcatgtaaactctcaatttttttttaaactaccaactttccccaaacttcttcccaatttcagaaactaaacacagcatgtgtgcgaaaccctcttttcccaacctttgtgtgctggtcccaacacagcctagcgagaccagctagcaatctcgagaatcccaacaaaggatttttagggtatgtttagactaatgctaaaatgaacatttacaaagtttggtaatactaaaattttgacaaattagtaacattagtaaaatttggtaacaaactaaatatattcacataattatcaattttaccaaataatggtatggattaaaatgtcatcagtctgaacaagctcttaattgttgctttagatcaccattgaataacgatgacaaaatctctaaattgaaatatgtaggtttttttttttgcaatgttggggtcaaatctaaagtatagtaaaatttagagctttaaattcccttgagccaattaatagtcttacaaaagaaaattcaagtaatatctataagcaaattttaactacttacaaaatttgtatcttttcgttcgtcacctcttttttgtcttttttgtccacgtttttatccttcaacgcgctaattttgttgaattggactcgagttcgccagagagataaaaattaggattcgccggagagataaactcgacttcgagctcgatacatgagcgatttcgatgggattttcttcaatttcttgagagaaaagatagagcaggagatatagatcaaaagccctcaactaagttgagattatctggttgaatcggacgcgggattgaggtggcgtggggtataggcaggttgaatcggacgccggattgaggtgtcgtcgggtacaggcagggctctggtttggctggaacctgaagaagctactgtagcgacaggaaggtaaattagacttatgctgggacttcttttccatattcagcccaaccttgaaagggaggattttcttttccatattctgcccaaactagaaagtgacgattttgattctttttctaattaaataattgttgatttataatctatcatttattttgtgttcatgttccctgaccccagttgtatcccatgtgtgctagccgatatgagatcatttggattaaatctaattctaattataaagatatagcttataattgataaatctacatcattatatctaaacatggaccaaaactttttctagatccactatgatcaacagcgtatatttttctttcaattaatgtgttgatttctaagccacaattgtgaataaatatttctttattaccgtagtaaattaatttataaatatgtaaaaaaaacatatagtgcttctacacggaaagaaaacatatctcactaggttatgaaaaaaatgtcatttagttatttaatatttggtgtacttttatttttcacccattgcaacacacaggcatttttcctagttaaatcaaatttaccatggaaattttgattttaaaaaggaaatcataaagaaagtcatccaatggtagccagtttgcgactttgcaatactaactaaacagacaccagttcgccataacgaagattgattgcctaaatggatcaaatcaccacatacgaatacagtcccgtgtagcacattgcaaatttgccatgaacctagtctaagatccagcaattatactcgaccagaactcctaatctacgcatacaacagaactctgcctacacaaacaacaggccaacagcatgggccacgtggttcaaggcattggggagtaacttccttatatttcatagttacttctttattaaaattcctggatgtaaaatggatgctcatggttagtaaatggagaaatggggaacgtttgaaattgcaagtaatcagatcctacaaagtggcctagtttatatataagaggtcatccagaatccgtcaaaacaatcatcttgaaagttcatcttttaaattgtactcagttattcactatcaaaattgttggtacattgtgccagaacaaatgtcacgcaagaactataagtaccaaaatagaaattctagatgcagaagcttgccttcagaaagtcctgtcacagggtgataattgaacaataagggctctgttcagcagccatacctgccacagctgctgaggctgcggcagttcaaaattgctgcaaactgcagccactttgaactgctccagctgctaccgctgctaaaaaacgactcccaaaacacacccaagatgttcaagaccataaatgtttgggcacaaaaaatgctttattttttagatgtatacttcctggtccttgcttgggagccatcctaggtcagtgtacttctctgcaagttggatttgtggtcaaggaacagagctggtacaatgggtttcagatgaagattaaaacacattgaaatacagattggttttcagatgataacactaatcagatgatgacaaaagtgcattggtcagtaacaaggaaaagaaactgtacctgtagaattcaatggagaaaataccatgttctgatccatgatcaaagtccatttcaacaatcaagaaataaccagtgacctgacataactgactttttcccaatcaagaaagatcatttcttgttcatattgaagacttaaagatgtaatatgcagatgcaaaaggagaagcccataggaatggcccacattatctacaaattcgtgatttctttatcgtctagaagtgaaacaatatgtcaatatacataaacaatacgctcacttgtgagcacccacagaactcagatatgttaaccagtaaatgttacagaagaaagaaatcttacttagaaacagtccatgctctaaccagtgacaattgactttagtcactcttaccattttgttatgagctatgctctggccacgcattctccacaaaggtaagaagtcaaatattctcagtgcaaaatttgtttatgatgcagtttcaacaattaacggcaatacatatgcagaaacaggatgttgcgtaggtatgaatgtgcgaagagggaactacacctggaatccatgattagacttaaccaaattgaaaaatgagtgacatgcacagttgcacacacaacaatcagaagcatttccttcaagtatcagctgcaaagaacatagaaaaatgaaaatatatcaaaatgaactgcaaattgagaactctacattatttatacttaatggtcaacatgtttgcaataatctaaagcatgcagttcagagaacatagattcatatatcatcccaaagagcaattggaaagcagtagtcaggttcataacctcattcatgatcagaccaggtgcaatataagcaatcactcgactgaatatagagaaatcgtaacatggttcaattaatgccccagttgcataatctatcggcatggagcatggtcaaaaggaaataatgaactgctaaatactgaaatggcaggataactggactcccctttgacatgaaatcccacaacccctagactccacctttgacgttaaatggaattaccacgtcactctcacaagcactacagtttatccaacagaaggacagagtacatgcacaaatggttcaaagtttaagaagtcaatcattttgtcaagcaactggcaagtatgacagtttgtgatgcacctaattagcatatctgcaccgctcaacagggattagagccatgttggaggctgcaaggcaaggaaatgtgtggcagctaggtggcaatctgcctatggcagtgtggtaacaacctgattgtaggggagaggtacaagttgcatgataggctaggcttgagtcgattgattccatgttgagctgtttgaccaagacccaagtgcacaatagtagatggggcaaagataaagacacaaggggaggagcgtggagcatatggcgctaggacaagcggtggcacagcggcaaacacaggagatatgaagcttatgtggtggtatttaaataaaagatttaatgtcgtcagtagaaaagatgcaagtttttttatgcaatgataggttgtttttgaaaagaactgatgaatttctgagaaaatatggcaggtttctcaaatcttaccgggtggaagagagaaacaatacaaagatattgaggcgaacaagagatactgggaaaaaaaggtgacatggggctggagagcatgggaatcaaacccacagccagaatgatgcatccaaggcctaaccaatagagcaaaattcaccttcttcactatatacatagatacagaaaatatatgaaccaatagagcaaaactccattttatcccgatataacatagacacaaaataaatgggtattcagctacccatcaaaattggtgcaccagccctgcgtgaggccttctttggatataaaaattccacgttaataaacaaaaattgattgtacagggtactaatttagaacaaggatccagttaccatatcagccccctgatcaaaatagtggattacagtgttctaaaaaaacatttacaaggccgcatacaaggaacaggtgccccaaccttgtaccgcttaagccacataagcggccaatccaccgcataagcggccaattatgccgcataagcgctacgaggtgtggtgaccacatgaaaccgcgtaccgcttttaaaagaattgatggattatcaagatgttctggaacatccaacccaaaaatttccttacacgactcagttttgatctgatgtttgcttgttagtatacatataacattactcaataacatttaaatgcccaacaattataaaattccaaaaaggtacatagcctgttacctgtaaatcgtgaaacgatcaagcattcttggggaaaatccatgcaaatttacatctaaataaaatggaaaatgatggcatatgagaataatgaaaattttaaatctatcactaaattccacatccacaaggctagctgtattattttaatttctgcagaagactaatgcttcggaagatcatgtgaagaagctaatttttagagaaaatactatagcatagcaaaagcaccatacctgaatctttgcagccatgccaagcattgaggtcaacaaactgtaggtcttcagtagcaagttgaatgcaccaacacattgctattgatataaatatgtccagaaagcaatgaaataaattaagcatcatataaagtcgtttcccaactcaaagacaaaaggtataattttttatgacaagggaaaccaaacagacaaaaaacattaaccactacaactatagttcttctacatgatttaagaataaacaaaagtaataaacaagaaatagagcaaacagttacaacaaaaggaaacctaatcctccaaatgagatgtgtatccacttgtggaagagcacatgcattttatttgacgtccaaaacaagcatagtaggaataaaagcatgtatttggcaatccagaaccgtcgtcttcagaatacgacaagatgcaaccgcagaacacatgtcctgagcactaaaacccttccaagcaatttccaaataaaaccttttttgttaatctgcatctgaattctggttagattcaaaaataaccagctgacagtaacagccaagtcaatttggttatgtttccaacttccaagctcctctcatgatacaacccaaggctgttccttctgcggcacaaccaaaccatgttcctacttcctagtcaaggtaaacaccaaatggaatcatctactatagcacataaaaagcgcacacggagaataaatcagcagatctaaacattcacaataactcaggcattgtttcatcagaacatcagtaccactcactccagtcctcacccaccacttacagagagctctccatttttctgccctcctctctaagaaaccatctgaatcaccccctcatttgcttgcctgaataaggcatctaaataacctaaatccatgccgccgccgcaaccgccacaaggacaatgaggttaaattattgaggagggggagacctctcctaaataagccggggaaccctaaccctaacacgctccaagctcctaaacctaacagcggcagttctaaattaattattgttctcgtcggcggcggtggtgcccgaggcggaggcagcggatgccatggggggctcgtccgcgttaggcggctgcatgaggagcgcggtgtagtaaggcacatggacgaacgcgcccccatgcccgccggcggcggcggcggcggcgaccgaggaagaaccgatggcgacggcggcggggggcgcctcctccggggtgacgcccgtcccggtggcggcgatgatggagggctccgcctggcggagtagccactcgatggtctccccgtcggtgcggtggccgagctcgcgggtgagctggaaga

SEQ ID NO: 7449 - DNA, 3572 bp, Oryza sativa
tcattggtggtggtggtgttggggtgggggaattctaaaggtggggtcggcgtcggtcggggtggggtggctggtggtggggcaaggaccgatttatataccgcggtgatggccgttttctcttctcctgggcctactgggccttgtgggctggttcggttggactgtctgggccttttctaccgttgtacttgtttggaaaaggtacaccaaaggtccctcaacttatcatcgggataaaaaaacgtcctcaaaccgcaaaacgagatatacggagtcctttaactatacaaaaccggtcacccgaggtcctttggtggttttgaccccagttttggtctacgtggcggctgagtcagcgtgggatccatgcagaccccacatgtcagcttgccacatcatcaccctctcccctcctctccctttctcctctctctctctctcactcttctcttatctaccctataagagcacccgcaatggtaaagtaatgtgctatctataaaacatgtacatctcaacaatagactagattaatagtaaactatctcaatagtatgtctacatgggtatctatagctctttaatacattgtctcgtttttctctatagactatctccaggttagtaaatagctttgctctctctcttcatttaatatcttccaagtaggaaaatatactgacatggatcttttatagagagcctatagataaccattgcgggtgccctaatgcaccaactcattttactcatctttcactcctacactattacatttatcactcaacggttcagatcgtccagtgtaaaatcgaaggatcgagatcaatcctacctccacctccctgaattgcgcactccccccctctctttctcgccttccagatcctcatcccacacgcacatccctctccccgtctctttctctcgcactgccccatctccagtgtgtcgccgccgacgaatctcctcaccccgccgtcgccccttccctttcccccaccgccgatgaaactcctcgccccgccgtcgccccttcccttcccttcccccccaccgttcatcggcgacgatcccaccttcggacctaccggatccctctccaccaacggtagagaccctcatgccctaccggattgatttgataattacaagctccatccacacccagtgctccactcaggtttgatcctaattcgctgcctgctccactcctttgatccctgttccccccttttgtccagataatcgcacacttgggcaaactcaaccaaatttcgattttcagatatattgtcatatagtgttacacaatgagaattcctgctcacaactaaatagctggacgtgctcctattttcttgcaatgctatatgttagttttgagatgcagcggctaagcgagtagaatttgtgagctatctaagtaggatatgatttaattggtgcaaggttaatcgcaatagcagacattttgtagattattattctctaccctctgagtaaaaaactgaaaatagatgtcttagcaaattcttcagaagttcagcagaccagtgtgcgtgaccccgctgattggaaacctcctgtgcgcatatcctgctgtttccagtccatgtcctcagttcatgacctgaattgaaggtaaaagcagtttaccaatatttttactccttaaaaaacaaaggtttttactctgccaattgatttattccgtgatataaatcagcctctattgaaacctatagtgctgaagttatgctttatgaatcagtactattttctaccgccaaccattgcaagtattcattatggtctttatcatggtttatggtttattatgaccactagcaatgcagcgtgcacaatatatatatatatatatatatatatatatatatatatacacacacaccccaaatatatatactgattcctttagttgtctctcatatacaattaatggatatatctaaaaactgaacagtacggggcacaatgcagcaggaaaagggctttgaatgaaaagtatgaacataaatttatatcatgccaaaagcatatattcaagcctagctttcattaaaatacaaaagtactttcctctagaaaaatacgaaagtccttggatataacaatacacgtgcggtgtgtgtgaattaacatggtagatgtcatatcaattaactcatgtgtaatgtgttgcgatttaaaaaagccacttctgcatggttgtagcttttgtgatcttatatgcaaagagaaaggtaaaatgaaaatatcaaccttgctcacattattcatgtttgtgttgattctttttctaagtgtattttaatttgatctttgtttcaggctataggaaacaccgtacctcttatgaacagttatgctacagaagtcctttttgggaatttgggttcaatcacacttggaattaatatagaaatttattttgctataaaatatgaacattgcggccacaaagagtgttaattttcttccagttgattaaaggaaattctccatgaacccaagtttaaccactttgttcctttgctatagggtacagttctttaatttatcaggtgaaaccccgcgcattgttgcgggaattagtatgataacaataaaaaaataacgtgtaagatagctaaataacatcagattaagtaaattaatatgatttatgataatttaaatttaaatagtatgcagaatggtgattcaaacgtaaaaagtaaggtgatatgactttatggaagaagaaaagtagggagatagtttggaccgtagattaatcatctaaattctaaaaacaattgatgtgatatgacttaattagaggaaaaactaaaaaatataattcgaaccatagattaatcatttaagcaattactaagtgaggatgagctatataagtatatatgatatcataaaacataatgaagatatacattggaacattatgtgaattatgttagatgataatttaacatgtttgtatttgaaaagctcttaaattataaaaactataaagatatagcatgtttgcttgatgtttaaatgtgatgaagatatagcatgtttgcttgatgtttaaatgtgatgattgttagtggatgatgatgtgccatcttgttagtggatgatgatgtgacatctttgcatgttaagcttaaggagttagtgggggataactttatagtaagataggattagtgtatagtgaatgatactgtgtaaatgtttcatctttacatgagctaatttgtgtgtgtttttaaatgcatgcagcgtcttgtctcttcttgtacaatggtgaccacaaggttatatctatactaatataaaaaggaagagttgtacctctccaatcctactggtgaaatcacccggatcaatctctaccgtccatccgccatctgatctaatctcatacgtccgttatcctcctaactgtgcacagcgatgagcgattccacctattcagaaatcacgcgatgactacgccgcacaaatccccaccgtcttctccggcccctcgcttcttcccgccgggacaactt

SEQ ID NO: 7450 - DNA, 22483 bp, Oryza sativa
cgagctcggtaccccgcggcctgacccgccagcgcttgaatacactcaaccgatccaacatcctccacttgcgccggcgagagccttcctccactccagcgcctcaccgtacactccaccgtagctcggtcatccttagtcgcacaccgatacacgaaggcgaggtcggagcccctggtgccgccacgagcgagaggcaattcgccgttgcggccgcgctcgtcgcgcaaataccggaacgcaagtggtccctttcctaccgccgcaagcgaggagttgcgtcgctacatgcacccccaaggtcttcctccaccgatctgtcctgtaactacaacgattggctacaactcttgttcatcgcaatcccttttcttgttccttctagctttacaaattttgagggagattgaaggcgacctgtccgggttcaggttctgcttggcgcatatgttctgcatgaatacaatacgcagaacaaactcatgattggttcctcggccttgctaggaacatgcaaatgctgatgtgatgttttggttgctcagatccatcagtgggatttcatcaacgacaaacattgatagtggttctgacaaatattcatgtatagtggttcgatctacattaggtagtactctggatcaattgaatgctcaaaaaaatattttaatcaacatttgtgatctgaatgtaataaagtttatcacgactcacctttgcagctcggcccggtaatgcaggaagctttacatcaccatcgcttgcagtgacaagtaaataatacacatcatgttcgcttcttttgcaaagctattatgccgctgccagttaattgctaattgtatatctctgaaattaatttatacagatcgatggtatgtaacagcttttaagcttgtgatttcttcactatatatcatgtactgtttgagttaactaattctaatttactggcaaacaccgtagggaataccactaatttaagtgctctcgagttaaagaagatagcaagctcggatgaggtacgctttgctcaattgtaagcagtagcaagctaaggttcaacagaaccatgagtacaagcagcggaaggatgcatcaatctacaactgccacaggtgatgtaatgctctcaaattttttgcaaaagaaaaaaaaaacctgaagcggtgccacccgtaatgacatttgtgcaccaagtatttcactgcagttttactgcaatattcagggtttgcattctagaaattggggttttttccgtggggggagggggcgaaagaaccaaaatcactgaatttatttgaaaaattgatgaattttgaatgatttagaataagctttgaccaaattcacaaaaacatgaaaaaaggagaaatttcgggtgagatatatgcttgccggtggagagggggcaaaattttgaaaattttgttccgaaattgcaatcacgggcaagatttccctaatcgcaatttccccattgcaatgttgagcttgcttttagctgtcactctagctggtaatcacttaatttcggatttgtttcaacggttggtttgacatgagcctatcaggttgaaatgtcctcaagcttaaatgtaagcgtctctttcagtttgtatgtatgcacatataactccataggtcaagagagttttattctagcagacttaaatataagtgaatatcccctttgtatataccaatgatcaattttggagctcaggacaatggaactatggcttcatttccttaaaaagtgcatcagttgaatccagtgtatattctacaagttataagcatggattttgatgtttctcctctgataatttgcattgtttttgggaagtttgaatatttgctttgtgctgatgacttctaattactaatgatgtaattcataaattttatccatcagcatatgcttgcttggacggtttgttatttctttttatttggacatacgtagtttgcttgaaaattttgatgtggctaaaagagcatttggtttcttaggaagatgcctgatgctaatgtcttctcaagcttttggattgtaaggtgcttttcatgtttttaatccagtgctaatatccatgttttaaatccttttcatcaccattgtggatatattatttatttgtagcttcacgaaaaaagtgtggactccaggattaaattaaatcttaaaaagatatacgctattccaatttcagattatgccttttccatgatttgatatgtttccctttttccagtctaatagtggaaccctttccttgtgggaattccatgaaagatattggtctccagattttaagattggtagatcctttcgtggctgccacttcaactgcaggtgtgtgcatagtttagcaatatgaccactttagattaatattgtggtcaaggaaaatatagaggcgttttgacaaatgttagtgtttctggaatgttcacacttgctatctacttttttacttcaattaaggcaactatagacaatattctttttgaaattatatgtgatgaccatttcttacaagtgaaatggatgtaaatttgtgttttgtagatcacgtgaacttctgtggactcacggcaggagctgtatacacctcattggtgatcatgtaaatgctatttttagttgctggccatgagggatatatttgaagtattgttggtgaagatctgagttttttttcctgataagatattgtaggctgtggggtttaattcaataccataaatacaaatatcttgctttgagcttttcaagtgtttatcaagctatgacaaattatatgtttggtattgttagttgctttgcatttttttattgtttaaaggagtatgttaagttacattatagtacatatagttcttaaactttttagtatgttgtatattttgcctgacatatattacaggaaaatgcaagaaatttgaagtgtttttatatgattactatagttaatataggaaacgtgcattgcacgtgcacgattactagtgttagtataggtccccacatgttcaatgtgaaaactctgcgaaattttatagacccaactgcaattaatcaatgaaccgaggtcaatacgagtcatatcgtgctgatatcagcggtgttaacgggatagaaaacacgatcgaagatgattatgttcgtctgcctgatgaaattgtcattggttatgtaaacattgaagattcagtgaacgcactgattgaatatgtgaatatgtgtttccctcacttaatgatgagagatatacgacctccgcggaatatatgagcacacgggccattctctcaacagaaaatgatttcgtggataagctgaacaggaagatgatcgacaggtttcctggcgaggaaaagatttaccatagctttgattatgtcgatgatgattcccaaaataactaccctttggactttcttaacacgataactccaaatggcctccctccacatgagctgaaagttaaggttaactgccatgctattctcctccgcaaccttgatcctaacaatggattatgcaatggaacaagattaatgatcagggcattccaagacaatgcaattgatgctgaaatcgttggtggacatcatgcacgaaaaagggtgttcataccaaggatccctctatctccttcagatgatatttgctttctttcaagtttaagagaaagcaatttccaatacatctaagtttcgcaatgacaattaataaatcacaaggacaaaccatcccgaatgtcggtatctatcttccagagcctgtattctcgcatgggcaactttatgttgcattatcaagaggggtgtcgagaaaaacgacaaggattttggcaaagcctaaaaaagaagtgcaccccaaggaaggtgcacaagtcactatgatgttatatctttttcaatttgagttatcaaatgtcaccccatagcattagcatgggcatgtaatagaaaaataattataatatgaaaatgcactatattatataaaaaaaatatcacccactagtgatgcattataatgacgcagatatatacacacaagcacaccacatacagaaatgacgcttgtgagatgaataaatagatatcaacgccattgtaaattattttgcgtgtcacggatatatgcattatatatcatactattatgcattatgacttaagacacatatatgcgcattatcatatatctttaatataatattattatgcattatgacatggggcacagatatatgcattatatatctgcatcaattggtatatcatattattatactttatgttaaatatattttatgtacgaagtaaattgaattaaagctcaaatgtatagttcatatagtaatatcttttttgctaacatgaaaattttaaaaattattaaagacaaatagagttacaccgtaagcacgggcatattatagtcttctctgggcgactgggcgagcacggctgcggagaggcggcgtcggcgggcaagagcggtgcggcgtcggcggaagagagcggcggcggcggtgggcaaacgcggttgcggatggggagaggcggcgccgacgactctgcgccgctcggccttgtcgtcatcggcggctccgggcacggacctcatcgtcggcgttggcggcgggggtggcctctccggcggcggcagtggcggggaggggatggctcctccggctgcgacggcgcgggagaggccggcggtgagggcgcggagagggaggaggcggagaggccggcggcgagggcgtatgaggaggaaggcgccgtccgcggtttgctgctgctttcccttcaacgtcgtcgagctcgtcgtcctcgcggccgtccgcgttcccgccacactctgccgctacgccgtccgaggtggacgccgccgctgcgtccgctccgcgaagcggaaggccgccaaggccaggaaggtagaggccgagttcccgggcacgcccatggccgaacacctcgggtaggaggaggcggcacggcggaagtcgggactgcaggcggcgctgcaccgggtggcacgcttgctctctggcgccggggaagacacccccccccgggcgccgaccaccgcgtgctactctccgtcctcgcttgcccgctctcccccgtccccatcctccccccgccatgtatgttcttgatcatgttctctgcttcgtcttcgtcgtctatgcgaagcttggtttggtttgcttatggttggttggttgttgatggtgcgtgcaggtggcgtcgtcggcgcagtacatcgtgatgtggcagctggcgcccagcatgtggatcgtcgattattttgccgattattccattgtgccgattattttgttattttggtgctcgtcgtcgggatgccgattatctccattcctgatggcgccgtcgttcttggcgaggcccagcgggaggctcgtcgtgctccggccgggaagttgcctacgaaggagacggcgactagcagcagcaccagccattggcctcgtcgccggcgacaacctcaccgtcccgctccgctgcgcctgcccctcgctgccacagttcgccgtggtggtggccgcggcgctcgacgctcgtcacgacatggcctgcacaagaggagagaagtgagagagagagaaaaggagagagacgacgtggacacctgacacgtggggcccacgtgagtcccacgctgactcagccgccacgtagactaaaaccgaggtcaaaaccaccggaggatcctgggtgaccggttttgtatagttaagagatccaacatatatggttctgcggttcgaggatgattttgtatcccaatgacaagttgagagatcttcggtgcagtttttcctacttgttttaatatagcaagagtttattttgcctctctcacttataagctgagtcacctagtctgattcttgtccaccggatacagagactttctcagtggtttattacgaggtggttttggttgatgtagtgtctacgcggtacgttgatttggtatccatctaacgtgatatctacattgcatacgtacacgatatgctcaatgggcgtggatgtgggtctaatttttcgcccattgacacgtagccgagttttatatttgctggtggataacgcatacctgatctggtatatgtcatatgtgtatagctgtttttcccccaatctatcgtacctcttcctcattggcccatttaattagacattgttggcaacttttttgacaagttgataagcacgatcgtagcacctaatgccttgcatgatcctagagtcgccaaccacctcaatctagcaaaagctaaaccaagatgggttttgataactaaaccggctagtggagccgattctagataactacccgtctcgtgggcaaaacgaaaggttttcaggacaaacatacgaagaggtgtcgcactctcgcaacggcggcggacgatttacggcgcaaatcgacaaagatggataaactaagagaaaactaaaatcaatatgaaaaacgattcgattgattgattgtagattggatagttacaattgaaccggtcatgtcccttatataggggttggtcttgtcctctacaggccctcctccatgtccaactcaggatagaatccaaaggaaacttgaaatatgccttcccgagcaaggaaacccgagatccgacgaaaacagacccggactcagattctgcctgtctgaccggccacacaccgccggtctgactggccctcactcggcggtctgaccggccaacactcccaatcagaggaaaccagcagacttccaaactttgacaattttccctattttatctctaggtgtcaaatttgggtgtaaacagacatcgatgttgatccttggatgcttgaaaattaaagtgataactaaactagcttgttaattgtgttgctctttttgattgtactatatgaaacccagtgtgttacagaatgtaagattgtaagatggatttggttttgtagctaaaaaacgtagctatactagatgaaaccatgtgtattcatacgataatattgtggaataatgatggaagtagaatgtaagataattttggctttgtatagttatttgcatctttgaacaatcatttaaaaaactataaataattgagatgtgtgctctataacaatttagatcaaacatatattgatcatctaaaggcaaaactaaggtgatataatttaagtgaggtaaaaaggagacaaatcggatcataaattattgagtgaattgctctttggactagtaatttttatccaagtttcggtttggattaggtggttttacaaaagattcaaactggactagttttcttctccatctctcctcttcctactggttttttcttcattgagatggtgccatggatcaacccgtgcaagaacataactaggatttcttctctcagatctgttcctaagctcgaactcacaaaatcaagtcaaaaggcagctcactactgtagttattgcctgtgagctcacaatcaagtgatttttctcagctcacatgactttggtgggagaaaaggagccaaaaaaataaaatcaaggtgttggatggtcaagatagagtgtttgactggtgtgtttacttgctggtgagctaatgaaatcaaggagtgagtggcagcaaagtaggttaaaggcaaggaacacaattacacaaaggatggtccaatgtaaaaactttgacaataataaatctaaagtatagctacgtttagttatcactttgacaataatagatttttgtccaaagtaaaaacttcaaacatattataattcaaagtgaaactttgacaataataaatcacctaaagtattattcactctaaattattctttatcgaaatagctagcaagaaaagaaaatataattgactaaaattattagggatgtactatacataattatacgatacttatattattaaaacccattaggttgcccataaggggggtcgtcaggcatggtcatgttattggtttttgagtgcttagcctagcaccctattaatctgcttgtggaagggccaatattttggggaatggtccaagggagcattcgttctggtgacatagggtgagaaaggacatcgtattccgcgcgcacgcttcccaaactaaacagtacgttttttgcaaaaaaatttctataggaaagttgttttaaaaaatcatattaatctatttttaaaatttaaaatagttaatacgtaattaattatatgctaatggctcacctcgttttgcttatcttactaatcttcttattctcctcctcctcaaactcaccctaaggtcaaactcaccctaaggatgctatgtgtgggttggatacaccctgctctgctgtagccttgaagtggtgtgttgcaaataaatgtaagcagcgagcaaacatttatactccactctctatagggctattgtctccatatattcctagatagtacgcatgttgccacagaatgttagcgtgtaacgtgcagtataaaattacatgagaaacaactattcttgtaggtagagaaactatggtaatctgaactgttaaaatgccatcatgtcaaaaataataagttatgatgtaatttctagtgatggattctaaagtaatagttcaaatgcgttgttctttttagattacttcagattatatgttttctaaaaagttttttttcaactatattgcttattataccactacttttaatctatttaaagttttttcaaagaatatttagtttatccttacaatcaattgggaagatagtatgtgacaataattattacctgattatatttctatacgatttggaaaacatatctttaagctattttaagttattttaaaaaatatttaatttatccctataatcaagtagataatctgagccaacaattgaaattatcgattgggattatacaaaagataaagtctaggtgcacctaaactcttaccaacaccacatattatattgtgagtacatgtagatttttatatatttaaattaaacggttgagattattgttcggaagagttttataaagaaaaactttgtttgtacgtgtaccagtgcttttgatagatagattatgacatgccggttgaattttattgggtacatgagtccatccaacaaagggcggtgcctctccatgacgcgcgcacaccgtccagtgtgcgtgcgtgtccagtgtgggtgcgtgtctgcctgcgtgcaagttgctccgtagctgtgaagccccgaagcccctccgcggccggcgggagttagagatcgcgtgcagtgatggggatctgtgctttggactttgggaggctggccatgggccaagcacaagatgccaatcgaaacgcaaaaccgaaccataccgaccaccacccagtgataatgcgccattgtttcttttctttttttccccctcacaaacactgtgagaatttactatttgtcactgtactaaaataccggtgctcaaatatcactcttccaaatattcattcccaaataccactcgagtctttatgtcagcctcacttttatttgaatgtaaagtaaggctgacatgtggccctaggtgatatttgagaataaaaatctgagagaatggtatttgagcactactcccttcgtcccataatataaaagattttaagttttgtttgtactgtttgaccactcatcttattcaaaaaatttgtgcaaatgtagaatacgaaaagttgtacttaaagtactttgataataaagtaagtaacaaaaaataaataataattttaaaaatttttgaataagacgaatggtcaaacagtgcaaacaaaaacttaaaatctcttatattatggaacggagggagtagcattttggtagagtgacaaatagtaaattctccccacaaacacgggatgttgggtactactacatccgtcccaaaatacttgtcgctttgatttttttttaacttttgatcattcgtcttatttaaaaaattaaaaaaatattatttattttgtttgtgatttgctctattatcaaaaacactttaagtatgacttatcaatttttatatttggaccaattgttcaaataaaacgaatggtcaaacatcgtaagaaaaaagtcaaagtgaccattattttgggacggatgtagtagttaattgatggatttggttattggcaatgcgatctaaattcttatactcccttcctcttgtcattaatatatacttccttcattttaaaataaactagttcctggttacgaatctggatgtagacaaatttggacatagcctacatttaaattcgtagctaggaatttatttattttgagacaatatggtgtatagtgttctaagactattttacgaaacattttaaaactttaacaactaaaaatgtgtcctaatataacctagtatatactttaacaactaaggtcatgggcccacgtggccacagtgccacactccgcacgcaacaactcaacaagggttgtgtttagttcacactaaaattggaagtttcgttgaaattggaacgatgtgatggaaaagttggtagtttttgtgtgtagaaaagttttgatgtgatggaaaagttggaagtttgaagaattattttggaactaaacacggcgaagaagcatcaccatttttgaaacaaaagaaccatcaccatttactatttattttggggatggctaaataactgggtatagatttttagatcaaaatcatgcaaattacttacctttgaaattgctttgtgattcttgttctaactatcctagaaaatctcatacagctccgacgataccttttctaacttcggggacctctatgaaagtaatggagttaaggtttagggtctcggaattggggtaggggtgggacagggtagggagagggatgggggaggaggctgccagtttggggaaagagaagaggaagggagaggagcccgtttggagggcctcaacggcaccgttgagcccttccggccagccagcgagtccggactgcgatggtggaggcggtgcagattgggtgctagtgagcgtagggagcgcgagggggcatcaggagattgagaagaaggacaagggttttattgtttggttgttcattataaaatttaagcaatctgaaggtttataatttgcacaatttctatagggtttcagttaaatggtgtcccatttatatttacttcattgaagtttcgggcaatataaatgatctacaataaccatatttattattattattattattattttcttaaactatatattttacaaagaaataaaaatatagtacggagtaatatacaatagagtatttcggtcacactcacaaatcttctactaatactctccctgtcccatagtgcaaagcgcacacatgttctagattgaagtgttaaaacattgatttgatgttctatagttatagggtgatttgttttctataaacaatatataatttaataaatcataagctcgatattagttttggagtctacatgacgttttatgtttggcaacgccttaattaatgcgacatatgaaatatatttttttctaaaaaaaattaaatcctgatattttttataataaatcaataatttaagacctttatatttgactgtacaaatcaagaacatcatttcttttttcttgagatcgtattttctatagatcgaagttactccctccgtttcacaatgtaagtcattctagcatttcatatattcatattaatgttaatgaatctagacatatatttctatttaaattcattaatatcaatataaatatgagaaatgttagaataacttatattgtgaaacggagaaagtagcattattgattaattgatttatttctttctgctttacccggtcgccagaacagaacgggacgcgagagtacaccgaaagaaaccaactcgtgtccatccatccgtctcggtcgctcctctagcccaggcttcgcttccgtctcgcccaaatcggcgcaccaccaccgccccgccgtccacgaatcgaactgaccggagagatctcgcgatcccctccccaccccttcctgcgccggtggcgaccatgtccacggcggcgcggcgcggccacccgccgccgcacgagaacggcgtgggcgggcacgccgacgacgagccagacgaggacggcgaggaggaggaggagaaggggaagggggaggtgcaggatgatgagaaggaggagccgcggctcaagtaccagcggctgggcgggagcgtccccgcgatcgtctccaccgacgccgccgcggccatcgccgtcgccgaccgcatggtcgcgctcggcacgcacaacggcaccctccacatcctcgacttccagggtaatcaggtatcgtacccacctctttcccttcacgcatagctcgtagggcggtcgcttgctttgtgggattgggatttctggtaggataccgtggaattggatcgtctcgtctctgcgacctgtagcattggtctactgaattcgatttggttgtagaaaactgttaacctattgtttgtggaagagacgtcacaaaggtgaaattctgtttggggacacctgaaatatagattttgcagagaatatatattttaaggattgtgctagactgaggaatatggttcagtgtaaaatgttttcacgttgttggaggggattacctctggtgacctaaaaaatctaggaggactaggattgtctgctaaatatcggatataaccaagctgaggtggctgtgcatttaacaacattgacacagaaatttcaataaatggagattgcccatagcttccttcggcctgaaatcatgtgatggagcactatcagtaatgaccatggcctgcttagaaaataacattgtcatccattaattcaatacttttgcaggtaaaggaaattgctgctcacacagcaactatcaacgacatcagttttgatgcagacggtgaatatataggaagctgctctgatgatgggactgtagtaataagcagcctcttcactgatgaaaaactgaagtttgagtaccatcgacccatgaaagcaattgccttagaccctaattattacaacaactatagaaggttcgctacagggggtttagcaggtcaagtacttgtgctgacaaaaaagtcgtggggaggtggctaccataaaaaggtgcacttcttctcattgtcctacaagaaaatcaaattgatctggtgatttcaaatggttgtgtgagtctccttacatacaggttctgcgtgatggcgaaggaccaatccattctatgaaatggaggacagacctccttgcctgggctaacgatgcaggggtaaaagtgcatgatatgaagacagacaaaggaatcgcgtttatagagaggccaaaagggaattcctcggccagagtttttacttcctcagttggtctggcaggtaatacacatttatttatgcgaacactatacttttttataccaagtatggctcatttggaacatttcaatttggtcgacattaaaaatatgcacagttagggatcattttttttttcctttcagcaaatagttagtagaatacaaaggatattacagaaaagaaacatcatttcattctggcaaacatataccaaaagaatatatggtgcagcaggaaaaagtttcttgtacattgaaagctttaggattgattttttttcttccaatctagtttagtcagatataaggaactaatggttttaaacctaaaggaaaaggtatacgatagacatgttttcattgttagtcattcctgggagcattatatgtgttttatttgctgagaagtaagtttatagtcactttgctgttaatatatctgattcttttgggttctcattttcaatgaaattgtacatggcatactgactggtttgcatattcaggatgataccatcttagttattggatggggaacaagtgtcaagattgcagcaattcgaacagattcatctcaaggactcaatggcatacagaggagtatcactgcaagtaatgagaagtacgtggatattgtgggttcgttccaaacaggctatcacatatccgggattgctccatttggtgatcttttagttgtgcttgcatatattccagaggaggaagacagagaaaacagttttagcaattctgttccttcacgtcaggtaatcatgatggcttgtcctttgcactgcactctgtaaatctatttttctcctttattgtgtcatgacccgaggtcatgacaggataaacaccgccgggaagatagccgggcggcgtcatctcctggagaagggatgtagatttaggctagggagaagaacattattgggagagagagattagactaactgatattcattgcttaacttgagatgaatacaatccatcccttatatagagatgatatgacttgacccttaagaaactaactcaaactaactctatctaatcctatcctatctcctaaccaactgctacagtactcgtggtactgtttatccgctaggacttggcctcgtgggcctcggcctctctgcccaacgcctatgacatattgtgcaccagattccttttcttatgaagtgatgctgttcccacatttacctttttcgttatgtttaaacactttgtagggaactgcccagcgtccagaaatacatcttgtatcatggaaaaatgatgaacttaccacagatgctcttcctattcatggttatgagcattataaggcaaaggattatgctcttgctcatgctcctttctcaggtttaatgaaatgtgctttaacagtgaatgaacttctcttttcttcttcactgaaacttttctaatgaaggaattttattgttatatttttaccacccaggaagcagcaatgcaggtggacagtgggctgctggtgatgaacctttatattacattgtatctcctaaagatatagtggtcgcaaagccaaggtttgtaatgttgcaaaacaaaggattatattagcttctaagttctgcaattgcaaatgaaagaaggcaataattgattgagcaaaacttctctttttgaaaatgtgatcttccttcgtcatattttctctgattgtaatcttgaagaactccattagtccttcaattttctgcattatttaattgtgatacacatgtaagcttggctacttgcagtagatcacttcagttgcatatctgattctgtggcatttaattttcttctaactacaagtagcatacgtagaacaatactaagctagtttcttctgataatttccagcctatttgtgtttctgagctttctataaggacatggcaaaatttcatttcagaaaatgttgtatctttatatttctactgatataatatgtgctttcaaattagagatgctgaagaccatatttcttggcttcttcaacatggttggcatgaaaaggcattggctgcagttgaagcaggacaaggacgaaccgagcttcttgatgaggtaaagtagaaacagtttgagtttgaacagtaaatgaataatggtatgcattatctgcttgatgatgaggatgctacccttattgtttaggaaccttcaagtagacacctttaaggtccattatggcaactgaggtccccatccccttctatagttttgttggcgattatcacgttcacaatattgagcattttagctgaaaacaatgggacctgtatcatgtaccaataggtgtttatatttaagctggctcgtctttagactattgttgtcatgagttaaggtggtcctaacaatgtgaacaacaaatacattctgaaattctatgcatattttagaagtttgcttcctatcttatatatattatgctggtctgatgcatattttagaagttgacagcacttcaacaacataacccagtcagtatcttatgagcccatttttttaggaaggacgacctcagctattaagaaatctaaccacataatagctaggaacattattgaaattttgttcatgccatcttatgtcaggtgggttcgagataccttgatcatttgataattgaaagaaaatatgctgaagctgcacgcctctgtccaaaattgttgcgaggatctccttcagcatgggagaggtgagaaaaaaagaagtgttgatatacattgtatccttcatcatacgatctggaacaaacacaggagcattatgagattttgatgtgcattgtttgttttagttgatcactagtatatctactgaccataactttttttgtgccacaggtgggtctttcactttgcccatcttcgccaacttgctgtattagttccttacatacctacagagaatcctcagctgagtgatacagcttacgaggtgccattacttctttctattttgcttgcttgctctttacaacacctctgattctaatactaattctaattggtttatgtaggttgctcttgtagctttaactaccaatccttcttttcatgaacttctcttgacaactgtaaaaaaatggccacctacattatactccgcttcacctgtcatatctgcaattgagccacagctaaattcctcttcaatgactgattcattaaaagaggtatggaaacattttcttaatggatgtaagacttacacagtatttttgagctctttgacatcttggttctgtttgccatgtaggctttagctgaattgtatgtcatcaacagtcaatatgacaaggccctttctctgtatgctgaagtaagtattacctaacttgtagttaaaaggttcacattgcattaaattaatagaattttgttttattacctgtattgttgacccaacctcatttcattcagctcttgaagccagaagtattcgaatttattgagaagcacaacttgcatgatgccattcatgacaaggtatggttaaaattcccaaatgtaggataaaactgatctcacttgactttttttttcaagtttgcatttgtgaattgtcaagtgtcatggtagcaattgtctaataatggtacttacatatggttacaatgtagttgaacatgataatatattttagacagagacaggcttcaataacctccatatattcacttatgggccttgcgtatttcgcaggttgtcaatcttatgatattggatagtaaaagaactgtaaacctattgatccagcatcgtgatacgatccccccgaatgaagttgtaggacagttgttgcatgctagtaaaagttgtgacaaaagacatttgttgcatctgtatttacatgctctgtttgagacagacatgaatgctggaaaagactatcatgacatgcaggtatgctgattcttctgtgaacaagcagtctttatcatactgttcacctcctgcccatttgccctatttctgtagctctagtttttgtattagtataacagctaaccacattacactttgtgttgtaggtggagctttatgcagagtatgagccaaggatgctaatacccttcctccgtaccagtcagcattacaggcttgacaaggtcataaactcataattctcaaaagagaaaaaaaaagcattcattatcttgagaaggatgagtaatgaatgacatgtggttatttcaggcatatgaaatctttgcacaaaaagagcttgtacgggagcaagtttttgtgcttggtcgtatgggaaatgcaaaggaagctctctctacaattataaacaaattggaagatattcaggaggtcctaatgtggttatgatcattttgttaaaaatttggggctagactagcaattctagactgtggttggattgcaataacagtaaccttggatgcaggccgttgaatttgtgatggagcaacacgatgatgagttatgggaggaattgataagacagtgcctccaaaaacctgagatggtaattgagctgtgtattctgttcaatactcttgacactgatgttccttctgtttattcattgcatttttgtaaccgttgagcaggttggaatgctgttggaacatactgttggcaatcttgatcctttgtacattgttagtttggttcctgatgggctagaaataccaaggtaaatgtgccaaaatttgtttcgttcaaagataatgagaacctacccccaaaaaaaaaaacatcacatatacaccttacgaaacgaatttctatcatcagatgatcagaaattcagaatccaccaattacttatatacaaattattagctatgaccatcactcagtttattataataattatagggctatattgacactgtagaatagagatgctacaactttatttaatccaatccttctcttccctggttcaagtgttcattgaaatattacgcttttgataggttgcgggatcgccttgtgaaaattgtgacagactatcgaacagaaacttcattaagacatgggtgcaatgatatacttaaggttaatattcaagaaaaagatatacttaaggttagttgtctatttattaccccacatctatcttgacgtttgatgaccctgccatgtacaggctgattgcgtaaaccttttggtaaaatattatcacgaggctcggcgtggagtctacatggctagtatggacgaggaggtgacaggaactagggttgctgaaggatcttcacgagcaaacgagagatcatcaagtttacgagctttagagatcaaatccagaacaaggtgtggtgctcggtgttgcttgtgctttgatcctttgtcgattcaggacatctctgtcatcgtgttctactgctgccacgcatatcacacgtcttgcctcgaaggcgggttggacttgatgaaatcgaacagtagtactcaggacagcgacgaggatgatgaaggtaccccatcaggcgagtctcgaatgcgctgtgtattgtgtactacagctgctgcataataacttatttcgtaacgagtagtccatatccatgtgttgtgttgtaagtttgagccttgtaattagcgtgttattctggcgtgataaatatgtacaataggttaattctttggggggaagccatatcctcagcaagaggagttttgtgtagatttgacagatatgttgattacttgagcaaagttgtacggcatttttcttaatgccacgagtgccagaccatcggaagttcattccgattcttatccatgttctttgtttgccacgagtgcacgtgtaactatgtaaggaataattgtacctggtgctacaaagattaattgtttaaagttgcgttgtactcggttctattttgaaaaaaaaaggacattcaagtaataaacctcttaaatcgcaaattcgctagtaaggtcccttgaggtggaacctacctatccgttaggccggtggaacctacctatctgttgggctattgggctgtgttcttttcggtgagttttgctaaatggtggtttttttttaaaaaaatatatacgaaagttgttttacaaaaatcatactaacccttattaaaaaatttaagtacttaaattaattaattataagaaaatatgctgttccaatttacatgcatggaaggtgagtttccaacctcaactctcgaatacagccgattcaacgtccatccgtgttaagtctcagaaatattaaggccattaatctttggatgtggttatagagatagggttcagaaaaaagtaaacctcctaaatcacatgaaagtaacttgtcgagccatgggagctgtaagctgaacaaccaattctgatttgcgttgattccttttcgcgatctattgcaattttctacatttctctgatctcaaactactatagtgaaaataaaaaaaaaatccttcatatatttacacatgaatacatgattaacgcgggaactgctatacaacgggatctcatccaaacgggatgataccaagcaagtagccgatttcgatacctattggtgttggattttataccttatacgtatattaactaatacctcatcggtaccaaccgatacccgtatggtctctgcctgaccacttaaattattatctcctgtgactcctttgtatgagtttgatacattatcttcctcatttcatcttgattctggatatgatatgatagttcctactaaccgttcgaatgaaggaatttcagataaactaattcatttccggctttcggcaagaatttggaaaaaatatggcgtaccaatggaggccattgtaatatatttccaccgtcttcaaaattttgcatagctagaagaaatttcagctggctactagactattctcgatttgttatgatgacgctaaaaactggcttaactgcttcaacgcaccagaagaagtgaaaaaaatatattcaaaacttctaaagcaaatattttctcgtattagcactgttgtgaattgcgagtgcccgatctaacatttgctaacagtaacactatagagcctgttctggttcaacctacttacccctaattttatttttctaacagctttcagctgttttccaaatgtattgttgatttcatccacaaatatattttgtcactaattttaagaggtgcatttttgtggttgagacaatgtcagcattttgcaatcatcaaacacaatgaagtacggtgtacttaaagctctcttagtttgttctacaaatttgaatgttctcttcataagttctgcacgctcaacaaaatacgaaatgaattctgaagagaaaaggagcatatatagtagcccatgagcacagttttggtcctagcatgtgaatgaaaattatttgaacatagaatcaatcgacaacttaacagcatgtcaacattatgctcaagcttcttatatatttcaaattcaaaaggataacccatggttccctctattaaaccatggaaactatatgtctacatccaatcaactagttttcaaggcaggaactaaggcagcaggatatacattcgagttaattactagaagataaattcattgtagaatcagaaaatttagaccaatcaggctaagatgcggcacaccattacacccagaagatctacagctccagtcaccacataagacaatcattctttggtccgattaaaaattaccattgccaaatatctgcaaaatataaccccctactcaaactcctcaagtccttgtccccttctacactctgcaaaatagaccattgtataagacatggcaagcttcctaaaaatatttgttcagaaaaacaatctactactacttgcagataggaattggtttaaatagcctacatacttgcaggggtaagcaaaacaatgacggagcagcaccagcgtatgctacagaccacagaaaaactgtggctgtcccacatgagcaccaccatgcctcccgaagaacgcatggttgacaaggctttctttcaaacaatgcctcatagcacatggaagcatgttatccaaatggattttctcccgcaaattccccttggtgtcacacagaaacaagaacacagagctctgaatgtagaccagaatttccccacgatgacatacgattttccatgaaaagaaaccttcccttgcaatgctcctcattctcgccacgggcaatttaacgtggtacctcaacgaccagacctccgtctcatagtcctgaagaacccagagtttggccataccttgagtcacaatgccaatgccaagcataccaccatcaatctcaaccaaatgtgcaccataaccatcaacatttggagaaaccatccacctgaaggactcagccaccgtgtcgaaaacgagtattgcgtcttccggtttacggaggtgccagtgcaggcagccatggagcaacacgggtgggagaaagccgatctcatcaatccagaacacgggtgggagaaatgcctcaggtaatccaatgcgccgcggcttctccgacgagccgaccgcgaggatgcagacggcatcgggatacttccatttgaggacgcggtactcgccgtcgccggaagatgggtgcgggtacagggtgacctggctgccgccgccggtgagggctgggactggcgtcacctggcgcgtggccgggttgcagatgtagaaggcgcggccggagacgaagaggaggagcccgtcgcaggaggagtggatcttgaagctctggtgttggcggtagtcgctgaagccgaggacgcggcggcgctcggcggggtgccggatgaggtcgacggaatccacggcggcgtcggcgtcggcgggggcgccgctccttcacctcgcgcagccgaagacgagcgggcgcggcggctggtggcggtggtgggcgaggagga

SEQ ID NO: 7451 - DNA, 19038 bp, Oryza sativa
ccctactccgatgaagtcggcgactcgcgacggggaaattgtcttagggcaaactgacctagctaccgtgattgagagagacggagattgatcttgttttcgtgcagccgcattaaccttaattaatcctaatctcttcctcctcctcggtttcctcgcaaccaattccgccttggtctcctcccctgccgcgcccagcgcgccgatcgccggcccccccctcctcctcctcccacattatcttctccaagccgccggagacaccgccgctgtgtcatgtcgggagagatggcccaaccgcataggttgaagaacagaggaaggcgcattctggaaagacacgactcgtgaagaaggaaatggactccatggaatgtaagtactggcgtgagtgactggcaggtggggccctgaggacgagtgcgtgtgtgggaagaaaaaattttgaaataatactgtttatcgattgattgtgcaaaaatataccggatagcgaaggatttgtggaaataaaccagagcgataccaccgatgttcgctcctggaaagtgcgatagcgtggcgaaatcgctatatgaaagagcaatagcgaagttgagctggcgctctcgcgcaaacgagacgcgtgaccgcagcggtatcgcgcccgcgactacctcgggcggagccatcgctctcgcacttttgttgcgcgagaccgaggtcggtatcgtaatatgaaatcgcgagaccggttatgacgcgacgggggagacgtgggcacgcggtatcgcgctttgcgcgtgcgagactggtgacgcggcatgcgcgagagagagaaagcctgggggagggcagtgggcccgcggcgtcgcgctttgggagcacgagaccgatcgcggtgtcgctatacgcgtgcacgagagcgaggagcgcagtggggcagcattgtcgcgctttgcgggcgtgagaccgcgcgttgtcgcgctttgcacgcgcgagacagcgggcggtctcgctctacgcgtgcgcgagagcgagggtatcgagggagcggcagtgggctcggtctcgcggtccgcatgcgcgagaccgtcctcggtatcgcgctccacatgcgcgagagcgacgacgcttttcgcatccgacgccaccgacacctttatttcccatatgtatttctttttgctttttgcacgggttctagccatctaccttagctttttagggaggggtggaagatctctgtgcactctcttatcagtttactgttgtagtcacatcatgccggccatttctaaccgctgtagcgtttgaatccaatgcggtcacggggttaaattgagaggagaggagatggtcttcacagaggaagacagaagggagtgaactgaggaggagaggaagagcaagagaagagaggaggcagtgcaggcagtggagagaaggaaaaaaagacacgtaagttgattagttttctattagcacaaattcgtaagatgaggatttagaaaatattagttcacgtagttaatatttgtttttaattatgtcagagaaaaatttaggtatgtattagttactactattttatattttgttaggtcgtatgtaaaaatagaaatgtagaaagttaatagagtcgattcgggttaaaaaataggtagacgtaattaatttttaaggtacaaaagtataatataagttacaattaatttatacgtagcagtaattataatttataattaattagtagttcatatgatgtttaattttatatatacgaccaatattatatgtaacaaatgaaaaaaactgaaatattaatagttatatttgtagttattgatattgatattaatagtattgataattattaaatatggtacaaaaattaaattaaagttgtaattaatttgtagtaattttaagttacaattacttagtagttcatgcagttatttattttgtaagaaatggaaaaggtataaatattcgttaagtagctggaaatatatggtgtgcttaaacacatgcttaacatggtaggtagttacgaacgaacaaagaaatatagtactacgaagaactttgaaattgggacttttatatgagcaaattggttgaaaagaagaaggcaagacaaggtatggttctataacggaagaagatgtagtaaatttttactataattaatagacagtttgtaatttatttggtattgtaattaaagtgcagttaaataaatttatgtcgctgcaactagttttatactgttggaggcatgccatgaagcccttcggccggacctgccgaaactatagtactagcaaggattcaagccaaagacgtcaaggccattcaggcgaagccctatggcggaagccataagcgaagatggcgaaggctggaaagccgcgttggtattatgaaagtaaaggcatctcgggcgaactacaaagacttcgccatgacgagttcggcatcaaggaggcccaacaggccgcccccagccttttaggcccgtttgccatagaccaggcccagcctatcagcccatgcccatatgtgcaaatgacactgcatacccatataaatgtccctttcataagggcaaccatgtaaaatctcttgcaaccctaaaccctaggaggtgcaagcttgtgctaaggctataaatagacctctagggccatgtaatgggggatccccaaaaaaatatttcacgaatcaatacaattgcttttacattccaactactattgagagaaccacgcctttcgacgtggcatagttgtccattcgacaacagctggcgccgtccgtggggaacctagaccgaaagggcgaaatgggacccctttcgccacacccacacccttcaccacagtacccgtgaggtacggcgacaagggcttggggcaaaagtgagttaagtccaagctggggggctacgaagccaccccagcctctagacacctttcgccatacgccacgcccttcgccatagtgccaataaggcacggcgtcaagggctgcgggcgaacagggttcgccaaacgccacgcccttcgccatagtgccaataaggcacggcgtcaagggctgcgggcgaagagggttcgccaacccacgcccttcgccatagtgccaataaggcacgacgtcaagggctgcgggcgaacagggttcgccaaacgccacgcccttcgccatagtgccaataaggcacggcgtcaagggctgcgggcgaagagggttcgccaacccacgcccttcgccatagtgccgataaggcatggcgccaagggctgcgggcgaagagggttcgccacacgccacgcccttcaccatagtgcaaataaggcacggcgtcaagggctgcgggcgaagagggttcgccacacgccacgcccttcgccatagtgccaataaggcacggcgtcaagggctacgagcgaaacatgccacgcccttcgccatagtgccaataaggcacgacgtcaagggctgcgggcgaagagggttcgccaacccacgcccttcgctatagtgccaataaggcacgacatcaagggctgcgggcgaacaggtttcgcccatccacgcccttcgccatagtgccaataaggcacggcgtcaagggctgcgggcgaacaggtttcgccacacgccatacccttcgccaaagtaccaatgaggtacggcgtcaagggctgcgggcgaagagggttcgccaacccacgcccttcgccatagtaccaatgaggtatggcgtcaagggctgcaggcgaacaggtttcgccacacacccacgcccttcgccatagtaccaataaggtatggcgtcaagggctgcgggcgaacaggtttcgcccacccatgcccttcgccatagtgccaataaggcacggcgtcaagtgctgcgggcgaagaggtttcgccacacgccacgcccttcgccatagtactaataaggtacggcgtcatgggttgcgtgcgaagaggtttcgccacacccacgcccttctccatagttccaataaggtacggcgtcaagggctgcgggcgaacaggtttcgcccacccacgctcttcgccacagtaccagcgaggtacggtgacaagggctgggggcgaaaataagttaaggagttgctcccaagagcagccgaaagagatttatcatttttcaagatactccgaggggccggcaaactcaattggacacctgagtgtcaagctgccttcaatgggctaaggcagtaccttcggcactagtgtaaatatccgttcggaaaaacattttctgccgattcagtgtgccgaaagagttcattaccgacaataacaagtggtttgactccgagaagtccaaggaaatgtgcaaggggctaaaacttgaaatcaagttcgcattggttgcacacccgcagacgaacggggcagccgaaagggacgaacaacaaaaccctagcagcactaaagaaaagaccgaaagctggtaacagttaaaaaggttgaagtactaaaaagactgaaagccagcaacagtcaaaacgatcaaagtacctaaaaatacctttgccaaaggaaaaaaggggaaagtacgagccgaatagctgtaacacgcaccacaccccatttatttgccaaaaagcacaagttacagataaattccattgcccgccaaaaggcattcagactttatatccgattcatcagcaaaagcagtcctcaaaggcgaaggactacccccttagcatcttcttcatcgctagttgttaaatcaacacaaaaaatttttaagcggtgaagaaggaaaaacggggattatgctacgtcgacgctgggcaatggcaaactgacgctcagtcatataaaattcatgggtgtcttcgccttttttgtgtatgatatttcgtggaaaaatcccaaggcaaacatttgatcgacgaaaacgccaggggggcgatacgaatcggccgaagcatagctcgccgaacgttgaaaccgcgacagctcgttttcggaaaacataccgatcgtcgctacactcgacttatgcaaatacttaagcgtttctggacgcacatgccaaaatttgagagtgaatgatgagggctgaaaagtcaatgtgaattcctttcgctaacacgcaagggggccaacacgcctcgcccttccgaacgtacaagttacaaaatgtgatgatagcgaaaagaaacataaaaacatgcacaagctccatcgagcaaaagcacatacgtgttatgcaaaggagcaaaaaattatattatccatttcagaacatttttgcctcgcccctactaagtcccgcgaacacggttcgtcgtctatactgtacacgactctaaggggggaaggaagcgaaatacacaccgacgtcaagcgataacaacttgacgattagtcatttcgaagtctaaccaaagtgtggcaatgttatcacggcgctggatgtggcaccggtcataatcctctaaggttcgaccaggaggtcttcgcctctaattcgccattttgcaaccacatagctacataaaaggcgaacgcttgatcgacgaaaacgccaggggggcgaaacgaatcggccgaagcatcactcgccgaacgctgaaaccgcgacagcttgtttcggaataaagatacggaacgccgttgcattcaacttacgcaaaacacaagcgtttttcccagcgcaaaatgctacaagtcgaaaacggaagtcgaaagctgaaaagtcaacaaatcttttcgccaatccccaaaagggggccgaacgcatgactttcggtgaaatccccgctaaaacaatagggaaaaggggaaagaaaaaaaaaatacaagtcaagaatcgcgcaaagcagacaaacttggcaaaatataatcacccaatgtcataatagagcttcgccattctcgaaaggcgaacgccagtgttcatattttttctacagaagtctaaaaagaggtttcggcaggaacattggccgaaaggggacgcctcatgccataccatatagtttgcacggtctcggccgaagctccttactcacccttgcccgtgaggggcttgttggaggcatgccatgaagcccttcggccggacctgccgaaactatagtaccaccaaggattcaagccaaagacgtcaaggccattcaggcgaagccctatggcggaagccataagcgaagatggcgaaggctggaaagccgcgtcggtattccgaaagtaaaggcatctcgggcgaaggcatcttgggcgaactacaaagacttcgccatgacgagttcggcatcaaggaggcccaacaggccgcccccggccttttaggcccatttgccatagaccaggcccagcctatcagcccattaaaggcccatatgtgcaaatgacactgcatacccatgtaaatgtccctttcaaaagggcaaccatgtaaaatcccttgcaaccctaaaccctaggaggtgcaagcttgtgctaaggctataaatagacttctagggccatgtaatgggggatccccaaaaaaatatttcacgaatcaatacaattgcttttacattccaactactgttgagagaaccacgcctttcgacgtggcatagttgtccattcgacaacatatactataataaattggtagttatgattaatttgattatgtaagtaatcaagtgaagttgaacttagttctattaattttttatgttatgattaatttatagataattttgtactaactgatagttacaaatattttgtatttaagtaaagttacggtccgttagataatttatagttaaagttgtaatatattatatgtactcatccaaatttgcaatagtagtattgttttagaggtcatatctaaataggtacaaacagtccgtagcaaagaacatgatgcggctcaatgagtgtcattgtcctagataaagaatagaaagagctagccaaaatgatttttaacttagcttccgtcaatgtttcttcggtgcaagtagtcatttgttgtattaaaattaattgatatgtataattaatttgttagttaaacatatggattatgcagtgaaataaactttgaggcagcaattgttatacgagcaagatggttaaaaaggagtaggcggaatctgataaacgcaggtaaatattttgtcatatttatgtacgatatggtttggttgtattgttttaagtattacatactcttttacttaaattaattgccatagttatgtttaattacgtgttttaattaattaatatgtattaattttattgtcatgtgtttatttttttggtcaaagttgtagtaaaattataaataataaattgcgttgtcatgtattcataagtaaataatttatgtttacataattatttatttataaatttttttattacaagtacatgaattttttataaataatatggaaatataaataattagttattgataaagatttttttatcaaaaaaacagtatgcgtgtaaactaatttttgtcgtgaataggacacgtttgttctgtaagacttccttacggagtagtccgtgttgactgcaatggtaggaatgtcggcatttagagtgtatttcggtgaaggtgaaattatgaaaatgaaagtggtctcgatctgagcaactttaggcaatgcacgctataccatccaaatcctgacacccttactatgcccgaagtttggtactggttaacatgcacattttctttagatccgggtatatatagtgttaacgtgagggttatgtggagccgatcggctaacaacataagataggagttaaaaaatgtgacacggagtaaggcctggcaggattggctcgctggctgtaggagacggggatatgaatatgtcatgctggtgctagcatgtcaaggaagagtccctacggagagcgctgcagggcaatccagcaaccgtgaggtgttggggtctagttcacacgaagaagatgaagttgtagctccccatcgtggtggcgatgttggtcctgacattcaaaatctatccatacaaggagatgaagtggtcaaccgccatcctactggtgaagccgatgaaggggaggacatacctgctatagttgaagaaattgagagggtggaccgacatgcagtcgaagatgaggaaaacctcactgctgaagagaatgatgatgaagatgaacaagaagttgatgaactacctatgcctgcttcgtggaaccttgaagaccctggttatattgcagaaagctcttgtcatgattcaatatggttctacggggatggccaaatcaatctgggtgcaatgttccgtgacaaaactaggttgcaagacacagtgaagtcatggtcattccagatgcaaaggcagttcagggttgtgaagtctaacaagactgagtacacggtcgtctgtgagatggaaggttgcaccttccgtcttcatggtcacgtgccaaagtacgagtcttactggattgtgtccaaactgcaggaacactcctgtctgattcggaacactagggagtcgcatcgcaacctgaccgcggcatatgtcacgaacaagtactacaaggaaattattgaaggtgatgacctgcctgtgcggcacataataaaactggtggagaaaggtgaacaatacacaattagttaccacaaggcttggagggcgaagcagaaggccatggagaaaagatatgggacatttgaggaagcatatgacacactgccacagatgcttaacattctaaagagcaggaaccctgggacctatgttgctgtgcagaatcgggagtcaattcgtcctccaaattattttgtgatgcaatgggcattctttgcattcggagcatgcattcatgcgttccagtgctcgaggccgatgctgtgtgtcgacggtactttcctaactgggaagtacagaggctagatattaacagccgttggtgcggatccgaagataattccagtagcttttggttttgttgaaagcgagaactacgaaagctggttgtggttcttgcaacatctaaagtggggagtggtgcaaaaacacacattgatatgcatcatacatgaccagaatgctggtctgttgaaggcaatcaaagagctccaggaggatggtgatggtgcatactactggcctgacatgcacagccattggtgcatgcggcacatgggagccaagtttttcaaacaattcaatagccgacagctgatgaacatgttcaagcggttgtgcaaggcaaatcaacctacaaagttcgatgagctttggaaacaacttgacgaggggacaaggacacatatccggtcaaagcagaccaacaacaacccgcaggatgtacatgtcacccaggccctggaaccaatggatgatcttattccatcaaatggaaagaagcgtaggtcatcaaagaatatcaaatgttttacccattggattgagtgcgagccgaatgataagtgggcactcctgcatgacactaatggggctaggcatggcataatgaccactaatcttgcagaggcgtacaatgcggttcttcacaaattaaggcctttacctctaactgcttttgttgaaggcattatgcacaggacaacgatgtggatgaggacgaggcgggccgcggcgttgcaacaaatgtctaacgcacaaacacctttctgcaaaaagatggcagagtacctccaagagaaggctaacaaggcaagatttctcacggtcattaccaatgggaacgtcagacgaaggtgggaagtcacatgtcgcactaaggggggttttggatcttctactggggtcatcactcatgaagttactctagggcacgaatctgataacaaatgttcgtgctcttgcaataagccgaagcttcttcataagccatgtagccatgtccccggccgcgtgcgctaaaattaagcttgattcaacatcatacgtgttgacgttctacctaaaggatagagttctgaatgcatggagtgctgagatcctcgggtggaggtaccttcaacacctagtcgatactaggggtgataaaaggatctatgtgccagacttggatttgttgaaggctggtaagggtagaagacagacatgacgcttaagaaatgatatggatgcatccgaagcgggagggcctgtgaggcgatgtgaggactgtcttcagtacgggcaccgcactagagattgcaagaataacatggagggtacatcttcaagcatggaacctaggcaacaacgtgccaggaggaatagaaggggctctcagggtgctcacgatagggaggaaggaaacctgcagtagttgtaacatgagtgaagggtcatgttcaccggctcgcacgggaacactgtggatgccaggctaatcccccttgctcgccaaagtgctgaaggtaatatagcaccttctgcacagtttagttggggatcagccatccttgcagccacataccgtggattctgcgacgcttgtattaagaccggacaaagggaggcgattttcatggggtgtccacttttggtcatgttgtggtcgtacgagctcttctcgttcggacgtccatacatgagtgtggccgtggcccacaaggacgattacactgacgcagttgatgatcgtcctaccttcggtactcgctggtgctacggaccggtacgtatgcttgcattaaaggaatatttctatcatttcaatgatactgcattactaaatctacaatctctgatcgtgcagccatagtgggcgagaatctaggtgcacaatgtgtatgagtacttcaccgaggcgttcgaaagccttagggaaaacgaagttcgatggattccgtacacgaacgaagaggccattttgcgtgcaccacatggagtaagcatcttatgctaccgcgatgaagcgtactggatgacacgaaaaatactggtgtacgacatattcttcgaggggtataatgttcaaagggtaatgcgtcaaatgggattgtaccaacaagtcccagttcctgttgggcttcaccttctaccagatgtgcacacgtatgttgttatttcaatcctgtctaatttctgtgctctccaaaattgtcagatataactaacaactaattgttgtatttttgttgcagggaaaagaggcaagctgacaacaggtatcatcgatctatgcactcaaggatgatcccatggatagaggcgtggtcacaggccttgaatgatgtcgtccaggagaccaaggcatacgaccacaacacttacgaacaatacatggcctagtactcatcgcagactcgcatccggctgcttgcacccgaggatcccgacgagcgaggtccaccaacaattgatcaaatatatgatatgcagctagcaccccccgctcacttgacggtactactagcatttaaatattttgttgcatctgtgtgtccttatacatagggttccactttctaacattgttgctacgcttcatgcagaccgacattgcaggggagttagtaagggatgcgaaaactttgtgggagaagtttagagatggaatcgtgagtaccaaccaggaagttatggccgcggttgactccctccgtagaaaaggtaagcgaatcatgtggctcgcgtcgtgccgacattcctcggacgtctatactccggcaacatcaagaaggacgttcaagccaatgctggagcgtccctcttacctcttccctgccgtccacctcagcccgcccttcagcctccgcgcgacgatccagcgacggtcgtgctgcagtaaggtcaacttcgtttcgtgaggcacccactattccgactatcccagaaatcactgaaatttcggaacacttaggaggctttggttcaactcaaggtaaaatacgttattgcggaatgctaaaataagtgccatttatattaaagactaatttattcgttcgcagcacaaccggaacgagtacccccacatagctctacgcccatcacctctcaatggcagggtgggtttacgtcgtttgctggtacaggatagctcatcaatatgctaattttttcccaattgtttatgtgaaatgactaaatgatgttttccaattgatgacagagggaatgtgaatggtccgtcttgtgcctcatatgcctcctgcaaggccacatatgattcctcaaatggctcacgatgtgccaacctcactctggcaaggaggatttgcaccatttgcaggtccgtgtacattcagtaccatattggcatgcatatgtccactcgtaattttactttttgctaattaattgcatatacagggactagccaaggtatccctaccataccccaattgtctgcagattttatcagttaaggagggtttacgtcgttaggcggtcagtctccacttacatctaatttcatatttttattatttcaatttattaattttgcatgtatatgaatcttattgacaatttacttcctgatattaacagggcctactcagtcggttccactgcatgcacctacatatggcaccaacccatggcaaggacaatccatggattacggtggtacgctcagccatcattctccatacacatatatcgatggcactttcatgccatacatgactcccacttcaacttaagacaataactccgtgacattttatatggatgcaaggcacgtcgtttggtggtggagtacagggttatatggacttcttgcaacaaggtgattggctatttggtcaatattcctcgcatcctaatgaaattccatatatgcaagcactgtcaacaggtttggattttttttgtgttattgttgtgtgctccagctttgataatttcattgatatctacattgcttctgtagggtcatttcgccctaaactaatgtcagggtttaggccttacactgcatcataaggcgacatgtccagcttcggtggagggtcgtcatcggtacccaacgagcttcggacttcacaaattgatgatgcgccccatgtgacacagcccacacaacaagaggttggcgaaggaaacgacaatgacccgcgtagatctaaccgtgagctccatgagccaaaccgtctgtcactctcaggccctcgacatgccgcacgagcaagaaaaaaaactacaaaaaagcgagctggaacatctaggactacgactgaccatgatgatgatgacgagtagaagtgaacattacgtctttcagttcacctggcaaacctatctgaaccttgctgtgattttggctttctattactagcaatgaacattatttttttgtactgcttattcttcatgttatgtacgatgtttcgtagttcataaatatctcatatttttatgccctattttgtatccagttaacacatatgatttttggttaactaataatttttcgtacgagagctaacaaaaaataatagtctcacaaactaaattaatagtgcagtttcgatgttactcgtgcggttaaaattgcatattacttttactttttactaatatgacttaaattacccacttatgacttaaattacccagtaatttcttttcacagagatgcaatgatacgcacctaaaatggcatcctctctttccaatcacgggacatgccacagagaataaaatcattcacaattaaactttgaagattccgttgcgctgcgccgaaagtgacttcgtcgctttgtaattaataaagcaaacagttatgcagcatgtgccgccgaaagtgatgctgttgctttgtaattattaacttcacgagtgaaacagtccgacgctattgaattgattagtctgaagctagcagtccgacgcgccgtcgtctctttctaataattgagattgcgcagcttcttgccatcccctataaataacaaccaaacgtagcacacaactacatctcttcttcataaacgttctgctggttccaacttcgtgttgcatattcttaggcctggtcttgaggcaggaactgagtagttggtgaactcgctctatgttgttcgttcactcgcgacgcggttcctgtcccaagaccgagtctgtgaatatacaaatgtgatttttttaatacattcttacacccactctttttttcaagttctagcatccgtttgtgaatatgacctactcctgcaaattcataaactcggtgttgcatattcttaggcccggtcttgtggcaagaactgagtagttcgttaactcgctacgcggttcttgtcacaagaccgagtctgtgaatatgcaaaggtggttttctctgtgaatatgacatattctaaattcctattctttgtcaactttataaaaattgctcccgaatgatctctctactcctttatatatttttaataaatatattatcaatttatatttttctataggtaatatattgtttctttctctgatatcattattttgcaaattccaagatatttatttttcttctcgtagctgtgtacacaatctttgcctattttcaatataaacatatttctcatattcatttatgtatatatatgttgcacacataataaaaaaaatatgaaaaaaagttatactttctactccctccatcccaaaaaaaacgaatctagtactacgttggttttttatgggacggagggaaaaaaattatgaaaaaaattatactttttactctcttcgtcccgaaaaaaacaaatctagtacaaggttggttttttttgggacggagggagtacgtaccaatggcgacatgaaatattagcgatttgcacaatggattaatgtaattagctgatcgctctcgcgcgcggggagagccatatcgctcgcggtctcgctctttcaaagagcgagaccgaaggcgtcgctgtcgcactgccgtctcccaggattagcagatgaattaggggacgtgggccacgccgcaacggtatcgcggttggaaagagcgatatcgctggcgctctcattgacacgtaccgcgagactgactcgctctcgctatcgcgtagcgcgagaccgctcctgtcattcctcgggccccacatgtgtcagtcagcacacgccgctacggtctcgcgcagcccgactgtgataccgcacgcgctatcgcgcccttgaagagcgagaccgcttcgtgccccacgtacgtcaggcggcgtcggacggaccacggtatcgctttacaaaagcgcgagatcgcctcgctctcgtgctttcggagcgcgataccgatgcattagtgctccctcactccaaattagtgatagcgccaccgctttcgcgcacgcattacgcgatgccggtatatttccacaaatccgcccctaatcagcttattcttgcaattccattcaagaaaacgattactttcaaaaaattttctgtgtgggaagttgtcagctagggactaatgtcagctcatgcccagagtttttccatttaggccctgtttatatccactgagaaaattttacaccttgtcatgttgaatgtttggacatatgcatgaagtattaaatatagatgaaaaaatagctaattacatagattgcgtgtaaattgcgagacgaatcttttaagcctaattgcgccataatttgacaatgtggtgctacagtaaacatttgctaatgacggattaattaagcttaataaattcatctcgcggtttacaggaggattctgtaatttgttttgttattagactacgtttgatacttcaaatgtgtgtccatatatccgatatgacatgccaaaactttacacccctggatctaaacacagcctcagattgctataaatcggatgtctgatattttgcaaaacatcgaacaatgttgcattgtattgtttaaaatgtttcacatgttgcactcctcaatgaaaaatgtttcagatgtttcatcaatcagggaaaatgtttcaggtgtttcatcaatcagggaaaaatgtttcatcatttcaacaaaagtgtttcaatcaaatgcaatcgaaacatatcatttgcaagatgaagaatcaatatatgcaacatcgaatcaaaacaaaatgaaacaccttaatacaaaaaagtgcaacacaaagctaaacccacctctatcttatttttcaactccggtcgccgcccccggacgattagttgcacaaagtgggcgacctcagctaggactagccgcaacagcatcaaccccccatcggtggccatgtccagtgccatcgctaccgtgtcgctgggatgacgctaagtttttgtgtgggcaccagctgcaaggctgttggtatttcttaacgacattactagaaatataattcccagcaatggcgcataaatactcctggtatattatggttacagagttcatccgcaagcgcatagatataccattataacatttcacccgagagtactccaagggtatcgtatttatttaatcctgtgggaagatcatagtagagagaaccgtactaacaatttatatgttacttgtaataatcagtctaagcaggggttaagataaatcaaagggtagagtgacacacaagcatggagctactcgttctcatactaaaatatctaagctaagtggaaagaaaatagaaagagaatctactcctatacttctagtatacatattatacacacactctagttatatgattatctagctaataccctctatccgatgccctcctggtacttcaagaagccacccctggttgccgagttccttacaacagcccgtcatgaccatacaaccggggctaaatacggaggagtaccctccccaggaaattaacttatgattatatacacgcgcggagtaatacccatactaagctatcaccatcagcggcccacctctcatccacagcatataaccccaaataatgatatcccgtaatctagacaccacgcctaaactaccagatactactctaatatcatcatcatgacatagagtaattgcataagtaaacattatacccgtacctatgcatctcctagataagctagcagtataatcagtataacatgaatataatgtaaagttggtattcatatacttggaaagtatttcaatactagaaatgtataaagaagagtattctaaataaagtacaaaggttacaaaagaggaaatgaaagctactagagccatacccgaactcttccggactctgatttctattctattcctactcctctagcttaagaacactaaactaaatttgagagaatatgagagagctttgcttggagtgtgtgagtgaagtaagaaggtgaagtccttatatagaggtaggtatgaaggttgtgggaggggaaatgtccgaagtgccctccaaccatcattgggatgcaatcctggacgtccacgccaaaccctgacatcaacggtttagatgggggttcggccgaaccccctggttcggccgaaccatgggctggcccaatccagcccattttcggctggtgacctcctggactttttctctttacagacttgtgaattttggcccaattgatcatgacatttctaagttgtcggcccattctacataagtctaattctcgacatcgtccaattgatttatcgtttgatttgatgtcgattctccttcactttataattattctatgcaaaaaggttagtaaacctaatactagtggaatattattattctaacacaaatatgcattgcaagcataactagttctcctctattttggtaatattgacggtcgaaattgatcgccaatgaccgtcaacaaaggctagccacatgtcaaggatgtagaggccaaatcggtcgacgaggccgtccgccgccaggtcgatgctgatgagtgccttgcagaggaagcggaagatgcactactggagcgggataaggtagctggtggaggccggctgggtcagtcgccttgtcttcctcgacggcggcgcggagctcggtggcccagttgtgtgcggcacgatgaggaggttggtgctgaaggccttggtgcgcgtgtggtcaggctcctaggtatcgtggtagacaccgatgtgggtgccttgggtgaaggcgacgttgggaacgcatgggctgatgaggacgtcgcacttgtcgatgagcgtcgggtcaaagagcatgtgaaggcagcggtgccgaaggcggtgggtcaacgccgagaaagaaaaggaaggtgctcgggatagagataggagggagagatggaggagtttgcgtgagaggataaagttgatgtgtgcggtggataaatgctgactcgagacgcgtcgtccgatattaactcagcgtaagacgatcgatcataagcattttcgtttaaattagggttggcaactgggcaggtgggggtgggttagataggaacaaccctgccttcgatcctcgatttctccacctggccccggcctctaagcgacgaacatggcaaaatagccccctaccatgcccctgatacccgacgtcttactagggcctcgcatggtcagctggcctattgagaagactcagaattgggtggcttgggttgcagtgagaaggttccctatggacagtgacaacgaagaaggccaatgagtgttggtgccgcaagatggtgtaggccacctagatgcgtcgggccatcggcaaggagcagctcgtggtgctcctacatcgatgacgtcggccgctaagatgtgctagtgtgaggtcgcaaaaggagagtgaggataggtagagtagaggaggcagtggtatagggcaaggcgagacgggataggcggttgtggctaggccggggtcggccgatccctggctagctcccctggctgtggcctttctcctaggccttggcaaaatactccttggcccagtggtgtattgattgggcacaatttttggtattcgatgagtttgtgagcccaagactcaatgggtgaaattatccttcattttctatatgtatttcgtctcaactttggtagtttgtcacctg

SEQ ID NO: 7452 - DNA, 749 bp, Oryza sativa
  unsure (1)..(749): unsure at all n locations
nnnnnnnnnnnnnnnnnnnnnnnnnnnnnnnnnnnnnnnnnnnnnnnnnnnnnnnnnnnnnnctgtggcctttctcctaggccttggcaaaatactccttggcccagtggtgtattgattgggcacaatttttggtattcgatgagtttgtgagcccaagactcaatgggtgaaattatccttcattttctatatgtatttcgtctcaactttggtagtttgtcacctgcatacacatatagaccaacactcgtggaaattgttagaattaaaccctaccactatgttgggtgtttcatattttctgatttatgcaagtattggcggaataaaattggcatttaccagccgccaattctccactccgcgtaaatgaactagataagtcacgcataacttatgcagactccacgccgctctactcaccggattgtttggcaccaatgagctattggcactagtacatactgatgtatgtggaccaatgagctcaactgccagaggtggttttaggtactttattacctttaccgatgactttagtagatatggttatgtctacttaatgaggcataagtctgaatactttgaaaagttcaaggaatttcataatgaggtacaaaatcatttggacaagacaatcaagtatctacgatctgatcgtggtggagaatacttgacccttgaatttggcaatcatctaaaggagggtggaattgttccacaactcactccgccaggaatgcctc

SEQ ID NO: 7453 - DNA, 791 bp, Oryza sativa
  unsure (1)..(791): unsure at all n locations
ccactcgcgggatccgccgccggtggacgccatcgccgcccctgctcacccctgctcacggccgccggcacatgctcttggagaggagagaaagagagagagacaggggaggagagaaagagagagaggggagagtaaaataatagagggggagagatagaggagatgggttgcaaaaaaaaatttgaaatcgtgggagggaaaagagagtggagggagataaaaaaaaatagggtggcatttttgcatgcggtcctcttaaggggccgcatgcaaaaatatgagaaatttgaatcgaattttatggtactaaatcacaattcatgtgaaaaaattgtcaaaaacaaagttatagaattcattgagatctaccaattttcttttggttatttctccatccgagattgattgaactatctaaaatttaaattttaaaatataagaaatttaaacaattttttgggtagtaaatgatttcaaatgaaaaaattatcaataacaaagttgtataacttatcaagatctacaactttcgttttgaacatttttctatatgactctgtttcaacaatttgaatttgaatttcaaattaggactacttcaaacaagattttgaaataataaatgatttcagctgaaaaagtcatcaacaacaaagttatataactcatcaagatctttaacttttattttagtcatttcttcatccgacaaagtgataataacatagttcacaannnnnnnnnnnnnnnnnnnnnnnnnnnnnnnnnnnnnnnnnnnnnnnnnnnnn

SEQ ID NO: 7454 - DNA, 1296 bp, Oryza sativa
  unsure (1)..(1296): unsure at all n locations
nnnnnnnnnnnnnnnnnnnnnnnnnnnnnnnnnnnnnnnnnnnnnnnnnnnnnnnnnnnnncacaatgccgaaccatttctcttttgaccacgtcccattttgtgcatcacagccaccggaacgcgaccacgccgacgacgccctggagcacgcaccggagcgccgccgcttcaaccatcgtcgtcgtccggccattcttgaccacctcggagcaagccgttgtgccatcgtcatcgcctcaatctcctcttcaatacgcctcaagaaccccagccggagatttgaaggactcggagaacgcatcttttcttcaccggcgccgatctagaatcgcctccgccgtcatcgtcgattaccgctgcctcggtgagccattgttcgattcctcgcgcatacaccatctccttgacctcacaaacctcgtgcatgcttgcttgtagcagctcatcgtcccgttcgagccgtcgtcgttcacccgaggaggagcaccgtcgccgagccgttccacaagtcaccgctgccgccaagacctcgaaaaccctagctcgacccacggtgagcatcctgaaggctagaagaccacatgcatgcatcgttcggaatcgatttccatgcacacatgagctttcaccccaagaaccaccgccgctcacactcgccatcggcgctactccgatgtcctctgaccaagaaaactagaggaatggaatcgcaagaacatgctcttcattttatcttttaaccccaactccaaccgagccaccaatcgccgccggtgaacccgggatcgagctcagccatggctgctctgcctctgtgcgtgtgaaaaaggagtcagggacttcagtttgagaatttaaataactataaggttcattacgtaatgttcccaatcaatgacatatggacctaggactgcgggttgatttcctgaaaatcctaggggcctttttgcatattggcctgatactgacaggtggaccccatgagtttaaaatctgaaaatgtaaaaagataatactaaaagctttatattttcaacaggaaaacatgtaaacttataaaatccataaaaaattgaaaacaactcattttagagtaaatcaaatttctgtgaactcaccaaatcaagaactttagagttattgcataaaactagacattcactgtacaaactttgtctctaaaattggtctaagataaatcatacataaaccatacacaaatttataaannnnnnnnnnnnnnnnnnnnnnnnnnnnnnnnnnnnnnnnnnnnnnnnnnnnnnnnnnnnn

SEQ ID NO: 7455 - DNA, 849 bp, Oryza sativa
  unsure (1)..(849): unsure at all n locations
acaaggcagcgacacgaagaaagcatggtgccctatacacaagacggacagacattctctagaagattgcctcgtcttcaaaaagtcgctcgccaaacacatggcatcggaaaaaggcaagcgagtacgcgtggttgagaaggacgctaaggcgcctactcaggaatcagacttagcatacccagattacgatctccatgtctcacacatcttcggaggttccacggcatactcctcaaagcgagaatacaagaaagtggaacgtgaagtctgttcgacgtggcagggggccgcgcccaagatgaagtggtccgagcagtagatagaattctcagaagaggaccaccccaagactgctatcatcccagggcaatatccgatcatggtcgaacccactattcgtaatatcaaggtcgcccgagtactgatcgacggcggcagctcaatcaaccttctcttcgccagcaccttggacgcgatggggatcccacgaagcgagttgacacccaccgatcaacccttccatggaatcactcctcagtcatcgtccaaaccattgggcaaaattacgttgcctgtgactttcagccaagcaaacaacttccgaacggaacagatcacctttgatgtcgctgcattcgatacagcatacaatgccatcattgggagaactgcactcgtgaagctcatggccgcatctcactatgcgtatcaagtgctcaagatgccaggaccgaagggaacaatcactattcaagggaacgctaagctggcagtacaatgcgacaannnnnnnnnnnnnnnnnnnnnnnnnnnnnnnnnnnnnnnnnnnnnnnnnnnnnnnnnnnn

SEQ ID NO: 7456 - DNA, 552 bp, Oryza sativa
cggaccttcgtgaagccggtgcttccacaactagttcaacctgttgaacaacgtcttgctcaatttattgtgattgtgtggacgttgaagcgttttccggtgattcctgaatttcttcaagtcgcactatgctcccactatcctttcttgagataaactctttctccaagaaaacactgtcgggcgacaaacactttcgtttccttaggataccccacaaagaagcatttatcttatttaagtgtgagtttgaccgattgcaaacgttttacaaaagcctcacagccccaaatctttaggaaagacatactgggacggttccctgtccatatctcatatggtatcttatccacggattttgatggaaccctatttagtgtgaacacaactgtctctagagtgtaacaccagaagcttaacgggagatcagtttggctcatcattgatcgcaccatgtccaacaatgtacgattcctccgttcagacactccattccattgaggcattcctggcggagtgagttgtggaacaattccaccctcctttagatga

SEQ ID NO: 7457 - DNA, 601 bp, Oryza sativa
  unsure (1)..(601): unsure at all n locations
cnnnnnnnnnnnnnnnnnnnnnnnnnnnnnnnnnnnnnnnnnnnnnnnnnnnnnnnacgaacgaagaggccattttgcgtgcaccacatggagtaagcatcttatgctaccgcgatgaagcgtactggatgacacgaaaaatactggtgtacgacatattcttcgaggggtataatgttcaaagggtaatgcgtcaaatgggattgtaccaacaagtcccagttcctgttgggcttcaccttctaccagatgtgcacacgtatgttgttatttcaatcctgtctaatttctgtgctctccaaaattgtcagatataactaacaactaattgttgtatttttgttgcagggaaaagaggcaagctgacaacaggtatcatcgatctatgcactcaaggatgatcccatggatagaggcgtggtcacaggccttgaatgatgtcgtccaggagaccaaggcatacgaccacaacacttacgaacaatacatggcctagtactcatcgcagactcgcattcggctgcttgcacccgaggatcccgacgagcgaagttcaccaacaattgatcaaatatatgatatgcagctagcacccccccgt

SEQ ID NO: 7458 - DNA, 660 bp, Oryza sativa
  unsure (1)..(660): unsure at all n locations
ctatagggcgaattcgagctcggtacccgtgacatttgttctggcacaatgtaccaacaattttgatagtgaataactgagtacaatttaaaagatgaactttcaagatgattgttttgacggattctggatgacctcttatatataaactaggccactttgtaggatctgattacttgcaatttcaaacgttccccatttctccatttactaaccatgagcatccattttacatccaggaattttaataaagaagtaactatgaaatataaggaagttactccccaatgccttgaaccacgtggcccatgctgttggcctgttgtttgtgtaggcagagttctgttgtatgcgtagattaggagttctggtcgagtataattgctggatcttagactaggttcatggcaaatttgcaatgtgctacacgggactgtattcgtatgtggtgatttgatccatttaggcaatcaatcttcgttatggcgaactggtgtctgtttagttagtattgcaaagtcgcaaactggctaccattggatgactttctttatgatttcctttttaaaatcaaaatttccatggtaaatttgatttaactaggaaaaannnnnnnnnnnnnnnnnnnnnnnnnnnnnnnnnnnnnnnnnnnnnnnnnnn

SEQ ID NO: 7459 - DNA, 636 bp, Oryza sativa
ctgaattttaagttttttttatcatgtactcacaaagtcgcgagtcacaagctgggtggaatgccatcgagaagaagttggagtaggataaggggtctgtgtaacaatgccggtgaacggatggcggcggagctccggcggacggcggcggattccaggaaggacgtgagatggggccgttctgtgccgtcatgtcctgcaccgttagattgaaatcgtgtggttcagataaaggaggatgaccccgcagcagattcatgtgtgtttgggccgtgcaacgaatgggccgggccctttagtcgcgatgtctgcatatgtgggccacagcccacagccccagtttgagcactgcgcgcggcttctgttgttgcgctccggatcgattcggttgtggtcacaaacagaaattcagaattgatgcttcgccatgatatggtcgtcagattcattagcttgatcgatcgatcgatcttacgtgttcatagatcagaaagaacgatcatattaaaaatgaaaatatattaattgatgatgatcacaatgcattggttatacaacaacaaattacaagtgagtgattccaatggtacaacaaattaatgcggatgcaacaaattaattaaactaacacaaggg

SEQ ID NO: 7460 - DNA, 513 bp, Oryza sativa
acgtgagatggggccgttctgtgccgtcatgtcctgcaccgttagattgaaatcgtgtggttcagataaaggaggatgaccccgcaccagattcatgtgtgtttgggccgtgcaacgaatgggccgggccctttagtcgcgatgtctgcatatgtgggccacagcccacagccccagtttgagcactgcgcgcggcttctgttgttgcgctccggatcgattcggttgtggtcacaaacagaaattcagaattgatgcttcgccatgatatggtcgtcagattcattagcttgatcgatcgatcgatcttacgtgttcatagatcagaaagaacgatcatattaaaaatgaaaatatattaattgatgatgatcacaatgcattggttatacaacatcaaattacaagtgagtgattccaatggtacaacaaattaatgcggatgcaacaaattaattaaactaacacaaggggggataatgggtaccgagctcgaattcgccatatagtagt

SEQ ID NO: 7461 - DNA, 5130 bp, Oryza sativa
  unsure (1)..(5130): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttcatttccagtttgaatatgatgattggcttgcggagcaatgtggccatccaccaattgaacaatggaggaagctgatgtatgctgctaattcagagaacaaggctgctcgtccggagagttaccgcgatgagtgggacgatgatcatcttgtggcagaagcagcagaagatttcaagaaatacttgtaaaatctcaagaagatttcattcaatgtacatgattgcaaatttgcaatgcagaaaacatcagagaataattctgtacacccaaaatctcaattcatgtctggaatgggcacaaatgctcgtcatcagatagttggtttacttgtgtattatttgatcatttgatgcctgtagattgtaataataacctgaagcaaaaacaagagaataattctgtgcatgagaaaggagaaaccttgagtctggaacggatatgctggtcttttttatagtctcttgggaaatgaaattatcatttgagctttgtaggctgtgtaagatggcaaaaaaatggtannnnnnnnnnnnnnnnnnnnnnnnnnnnnnnnnnnnnnnnnnnnnnnnnnnnnnnnnngtcgccggcttccctgtcatcagttcaccaacttccttgnnnnnnnnnnnnnnnnnnnnnnnnnnnnnnnnnnnnnnnnnnnnnnnnnnnnnnnnnnnnnnnnnnnnnnnnnnnnnnncacccgggcctggtcattgcgaccctcttttgcgagggggcaccccttctcaatgtgcccatccaccanttgaccaatgaagnaagctgatgttatgctgctanttcagangacaaagnctgctcgtccgnaagagttaccgcgatgaagtnggacgatgatcatcttgtggcagaagcagcagaagatttcaagaaatacttgtanaatctcaagaagatttcattcaatgtacatgatgcnaantttcaatgcagaaacatcagagaataattctgtacaccaaaatctcanttcatgtctggaatgggcacaaatgctcgtcatcagatagttggttancttgtgtatatttgnatcatttgatgcctgtagattgtaataataacctgaagcaaaaccaagagaataattctgtgcatgagaaagaagaaaccttgagtctggaacggatatgctggtcttttttatagtctcttgggaaatgaaattatcatttgagctttgtaggctgtgtaagatggcaaaaaaatggtannnnnnnnnnnnnnnnnnnnnnnnnnnnnnnnnnnnnnnnnnnnnnnnnnnnnnnnnngtcgccggcttccctgtcatcagttcaccaacttccttgnnnnnnnnnnnnnnnnnnnnnnnnnnnnnnnnnnnnnnnnnnnnnnnnnnnnnnnnnnnnnnnnnnnnnnnnnnnnnnncacccgggcctggtcattgcgaccctcttttgcgagggggcaccccttctcccgaacccgggtctgtaccgtggcagggtactattctaccactagaccacaggtgcttgttgtgttagttagacaatttctcaattaaatagtctatattttccctgcaaagcgcaaacaaatggttactcccttcaatgtctcaagggaccaaggctgttctgctgcatgatttcatttaatcatctcatcaacgcatacaattattaggcaaatatcaatattacctttcattatagcagcaattcgccttgaaccatcaaaaaaacaacaagaggagcaatagaaaagaaaatgaaaatctaacaaaaccaatgtactccacatccatccgcccaagtgtgaaggatgattggatgaaacataaaactaactactcattcactacaggtgctcaaatccaaacttgagcatatgtcatcaaaaccatttcttgagttctagggtccaaaaaagatcgctgcgaagtgaaaactgatgcttgcctccctccatcatgctcaagattgtcaactgtttcatgatttcatttaatcacctcatcaatttatgcaagtataaggccaatatgaaggtcgctcaatttatctttttatcatagcagcaatttgctttgaaacatcacaaaaaacaagaagaggagcagcagagatgaaaatgaagatctaatgtacatccgcccaagtatgaatgatgattggaagaaagtaaaaaactactgcttcctccgtttcatcatgtaagatattctagcattgtgcacattcatatagatgttaataaatctaaatatgcatatatgtttttatttattaacatctatatgaatataagcgatactaaaaagtcttacattaggaaacggagaagtactaatcaaaatccaaactggagcaatatgtcatcaaaaaccatttcttgatcctaggactcgacggcgtcgtcctccagcgagtatatcctctccggctcgccgtcgtccagcgcgcggacccgcctccgtatcctgcggagcgcgccgtcgacggcgaggtcgacggcgtccttggccgtctcgctcagctccgccgtgctcccgtgccgccggtacagcaccctcggcgccatctccagcgcgcgctcccgcatcctcctcacctcgccctcgcccaccgccgccagcgtctcggcgatcttgacgccgccgaacaccaccgactcctttggtatgtacaccgagaactcgtcgtacctctccgggggcaggtgccacccgtactgccgcctcgccgccgcgtcctcgaagaacaccgggacgcagccggcgaggatggcgtcgaacgtggagcgccgcgtcggcgtgtcccccggcggctggaggcagaacctggagtgcagcatcggccgcatgtaccggatggggtcgtgcgagcacctgccgccggagcagtccacgacgacgcacgcgtcggtgcggttggcgcactcggcgaggatggagccgcggatgttgggcctggaggggcgcgacacgccgccggagaagagcatcagcgcggggcggcgggcgcggcgcgcgcgcgccagccacgcgcgcagccgcggcagcgacgccgggtggaacgacgtcgggtgcgggatcgcgtgctcctgccacggccacgcgcgggactccagcgtcaggaacgtgaggttgccgagcgccgggagccggagcagcgacgtggtgccccacagccttccctcggcggcggcggcggcggcggcgcgcaccggctgcgagtagtcccacgcggacccggcgagcaccaggaaatggtcgtggccatggcggcgcgccagggatctgcggctgtcccgcgccagaaactcgnncagctcgcgccgtgctgcgcggaggagtcgaggagcgccgggtcgagcacgtaggggagcgagtcgaggcccgcgtagtaggggaggtagacggcgtcggcgagggcggggtcgncnacgagcaagccgcgctcggcgacgcggcggtggaagaagacctcgagaaggcgcgtgtcggtgcggtaccaggagcggctgctggagtgggtgcgcgggccgaggccgtggttgacgagcgactcgcagggcggggacgaggtggccggcgtcgacgggtcggcgagcgggaacccggcgtcgcagtggcggaggaggtgcgcgttgaatcgaggcgggaggcgacggatgtggatccgtcggccggcgcacgggtccttccgcgtggcgccgccttcgccggcgccggcggtggcggcggcggcggcggcaaggaggaggaggaagaagagaggattgggcattttgggaggagagagaatgtgtgggtggtcgtgtaactgaaactgcacggttatttcagcggatgtgtggctcagatttcacactttaatatttttctcctgtgcagttattttcagcggttaaattgcaccggttaaaactaactgccatcatgtcgtggattaagctttagtgcatgttttgggggtagtttttggcgagttgcaacttttcttagaatttttaggtgttagaatctctctcaaacagttcagatttttatctaaattttaaaaatttgtatgaaatagaacttagaagttaggaaacttagttttttccagattctcaccggtaacattttaaaaccttaacctccccaaacaagatcttagtctggcctacatacagttttctcttctgtggtcaaattgagtttgatatttttttcaaggaaaagcttgttcgcctaatctctacgagaaaggaattgttgaggaggattagagatgattaatttcacatcatccctctaattcctcttcaattttctcttgagggagggattaactgaacaagacaataaattattctttttctttctgggtgtaaagcactgaaagaataccgaacgagaagcagttttgcacttgttcagaagttcagacgctggacgaacatccggtcaaaaatattccaaactcacacgctgctactctatatatataatatattggatgatctgggcctagcaacttcttattgggccatacacagcatgttgttagctgggcctattttttccttggaataagttcatatgaggtcccttaactttacaccgagttcgattttcgtccctgaatcgcaataccagatacaacggatccctcaactgtcaaaatcggtgtagatgaggtccctcggcggtttagattgcggttttaactgatgtgtcgctgacgtggttagtttgacttactccttatcgtatgaagcggacgatgtggcacttggaagcaaaataaaaggcgtgacccaagtgacactcaattaaaaatagcgggacccaccctgctctcttgtcccttctccctcccggccattct

SEQ ID NO: 7462 - DNA, 35672 bp, Oryza sativa
accccccccccacccccggcaccgccgcatcgatctgcacgagttgcggcgacggcgagctcacagccgcgggacacggacagcgtggtgttgacggggcccgggactcgagctcgtagccgccgctgcccacttccccaaccccctccacctgcgtcaaagtttttgatattcatggcattctgctcttgttctggtggattgattgattggtgtgcttgtgcggatgatttgtgcgaaggcgacgccaagaacgcccacctgatgtctctggacggcgtcgcggagaggctgcggctgttcaaggccgacctgctcgactacggtagcgtggcggtggccatcgccggctgcaacaacgtcttccatgtggcctaccccgtgctcctctccgcccctaacccaggggcacacctctctcttttttcagcaaaataattccttttcttctccattgacttgttcaaactgtagactgcagttactgaaaatcgacaaaatcaacagtttctactaaaaatgatttgtcgaaactgttgatttctcaacaagcagtagtagctgaagtctgcagagttgtaattaaatcgtcatgttcttgtagctaaatgaattgatgttgttgtaggttcatacacatgctgctgctgtaacgggcacgacgaatgtgcggaaggcttgttcagaagcaaggttgggacttgggagggttgtggtggtgtcatatgtatctgctgcgatggtgaatcctaactggcctgaaggcaaggccgtagatgaagattgcaactcgtgcagatcgatgcggcggcgcagcaggagtcttcgtcggcggcggggccgaggtcgtgcagcttcggccgccgctccctcctctcccgtcgcgcgcatgccggcctaccctccccgcccaatggctggcgccctccgcacttcttcccgccggcgcccttctccctctccgcgctttctccggccggcgagggagctcgaggaaggatgaagaatggccaggagggagaagggattaggacgacggcgcgatgaagatagagagcagggtgggtcctactattttttaagactgacacatgggtctcaccttttattttgcttccaagtgccacctcaccgccacataggaccaggactaagttaaactagccacgtcagcgccacatcagttaaaaccgccatctaaaccgctgagggacctcatctacaccggttgtgattcagggacgaaaatcgaacttagcgtaaagttaagggaacttatatgaacttattcctttttccttcgctgataagctgctgggccagattgccacaggccatagaagagaagcccatttaaatccagcacttgcgagccgccacggcggctggctctctactctagtcccatccaacgtgctgtactagcagtttcatccaaaaatatactacccctatgtttccgtccgtcccaaagaaatccaattctaaaattgaatctggacatagtgtatgccgtatgcccagattcaaaatctaggattgagtgttttttaagaatggaggaaatagtatagaaaattaacaccagatgagacacatcatatattgtcctaaattaaactctacggaaaagacattcaggtagcactccgaaatcagaaaggagaaaaacaaaaggaggcggcgatcttgttgaacacgtgcgtgcaacgcaattggttaagagtacattcactagtagtgacaagtgagtgagttgattcgtgaacaaacgatatgatgatgtacaggtcggatacacgtgtgtatcgtacgcacgtcgatgcgacgttgcacacgttaattaggagtattctgtcttgtgcgtacgtagctgctggctgctgctgctgctgctgctgcgtcagcacatcgttggatcgatcgagacgcgctgggtttaatttcgtcgcgttggtctcacacgaacgccggcataatctatcgctagatattactcctccgtattaacgtttggcaaccttagcattttatttttggcaaaagaaagtgttgcgccacaggttaccatcaaatcgtgtgacaaattaatgttgcggtgaagttagctactctctccatttaacagtgtaagactttctaacattacccatattcatacatatatgaatgaatctagacgcatatatgtgtctagattcattaacatcaatataaatattgacgatgctagaaaatcttacatcgtgaaagtagctagcagcaatcggttttaaattttacgacctctcgtttcgaagctagtttaccagtgtgctggtcgctttcaatactatcgttaacttttggaaaaaatatataaaagtaccaaaagtcttacctcaaattggttttgttcacatacccttggttaataaaccgtagctaaaaacaacacgcaatgcattatgagtttatttttcatccatactacacataccaatacaaaagaaaaaaaaactagaattctcatatactttattaaatctcaataaaactattatccaccttatctaattctaatacaattatttcttgttttaaaaaaacttagatgcaataattactctaaaaataaatttatttttgaacaaatggaaggagcttaaaacgaacgtattactaggacggagggagtatgagtatgtcttacaagtcaaatcatgaacagtgaaaacaagagttccagtaaaagaaaacacaagtggacgccaagactgttagatcacactctattgtgtcatgtggcacggcgaaaacgtcaagactgttgttatgtacacatgatcacactctattatgtcaccagcattgtcatgtacacatcaacacatgtatgatctcgcttgtcactagcacatatatagacatagacatgtacactactagatgcaaatagatttgggaataattttgtattgccatataagaactttgaagtcgctggcatgacacagtgggagaaaatatatattaatattggtaatcgttagggttagaattgtttgaccgcccaatcagcagtagctaataagcaatatcttgatccaacaccatcggggtaccatgtgcaaccattgccccaattggttaaacggttgcctaattaaacctgtgggatcgtgaccagactagtattgttattgtaccgctgggaggaacatctcgatcaagtgaggtgtaccattttctgttaaaaaaatgcaaggagctaatatatatagttgctatagtagtatagtttaggagacaagttgttggaacgatgcagagacatcatccaagaaatacctttgtgacccttgtctcgaagcttgattaatctggcctcgatcgtgaagatgtactattgtattcatcatatttcccttgttgtgtagttagcatcgtttcgtggttatattatcttaattggaatgcattgatcttttttaggtaagccctactttttttagaaaacgggattacatgccaaattacataaaacttcctttttttggcttcagcactgttttcaataagaaaaataacgaacttcctgtctctgcactcacttatagatacaagcaaccatccaaactttttaccttaatttacgcatgcattattcatagttgtataggcaaaatcaatatcattaatgagaagtactctactccatgatatctccaataaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggcctaatatcatccacatggcaagtacaattgtactactagtgattggcaaatttcataagcctgtccgaaggaagtactaaagaattaatctgcaccatctctagggacagacaaaaaaacattattgagtactcacaaacaagaaaaatatgaaaaatatgtagtgaaaatcatatatgtactagaaacttgaaaaccacactgaaaaatggagggcatatgcaataggtactggtactagctagctatcagcgtgtaggtgtgtttgaactgtattaacagtttgagtacgcagattaatgcaaaaccatacatactaatacggtgggcatatatgcttagtttcattgatgctagctactgctcctaattaatcctagttcaactcacaaatcaaggaagaaacatcatttgattaattgaaacagagcaggtacttgtactccctgctagtacaattcattcttggaggacaagacatgcaagctttgctagcttccttcgttttgtcaaaggacacagcgtctctagaaattaaacgtgtcacctgtagaagttaaatctccacgcaataatcaacctgtccagttagtccctgtccggcaaaagattcagaaaatttttaattagcccctgtcaatgtctgaatcgatcagcgtacacacacagtatgagtcatggcgatgtggacgtacatacttcacgacatccctccgaagtttccgtacaatttcatgagcttgacactccccgttaatctcttgtttaatgactatacttgtagttgtaccacgcgattccatgaccttgactctttcgttaattaacctcttgtttaatgactacactgtacaacgtattactggtaggtagcttgtgtcgagaaggaatttttcgttggtccatctgttcatgatctgcctgcttctgcttgacctagttaaggccccgtttagtttcccaaaaatttttttaaaaaaacatcacatcgaatatttggaagtatgcgtggagtattaaatatagattaaaagaaaaattaattgcacagttaagaggaaatcgtgagacaaatcttttgagtctaattagtttatgattagccataagtactacagtaacctacaggtgctaatgacggattaattaggctcaaaagattcgtctcgcgattttcatgcgagttatgaaattagttttttcattcatgtccgaaaatcccttcctacatccggtcaaatatacgatatgacacgcaagttgctgctgaaattgccaagcaatgcatgactcggacatatgtgcgcaccgaccatgaatttttctctgaattttccttgcgattctctgaagattcgacaggtatctcgcacacaaatacattcgtatgcgtcgtcgtcgtcagcgcctcgtctgcagagagagagagagagagagagagagagattacgtttcgccgccgccgctgcatagctgcagctaaattgcaccgacaaaatcaaaacgtctcgatcatgatctgacgcgtgatcgatgtggctgccgtctcgatcgctctacacacgcaatcgatctggactctaaattaaccaactcgatcgatcgttcgcgattaatttagccgccaaattgggcataattaaacaagagcgttattaattagcacacagggttttgggggtcgtcgtaatcgaagaatctgcagggtatcttcttcttcgtcgtcgtcttccatgccctcacgcaaattaagcgaggtagctaaaattttcgattactaattagtaaaagagtcttagaatctgtttgggagaacttaaaattataagatgtagctagatggtagtcaacttttgagaagaaaaagcttaaatttcaagaaacagttgggtggtaactagcttctaacaatttggagaggggctggcctagttccccagcttcagaattcttgttcattttcctggattctataatacatttttttcaaaatctgagagcctgttcacttttgatgccattttttcaaccataccattttttagtaaagttgtcaaaaaatgtctatgtttagtttattgtcaaatttagtcaatacacaagaaatcctgttaaaattttgataatattaccatcttgctaaaatttgggcattgccaaaatttagtaaggtttattttggctacgatctgaacaggcactgaacgaaaactgaactatttagggagtttttgattacgagagaaagtagtatttagaagctctccaaataaaccattagttcttgaccaaaagattaattagttacacgcgggtgatagctagctaggtgatcgagatggtggtggtatagctagtagtagcaggcatgttcctgtcccgacaattttgccgctgtttcctccccatcggtttgattttgccttgggaaaccaagctagtttgcaacgcgtggagccatttgtataatcgcgtgcttaatagtttaattatcgtgaggaacgaactaactaactatagtactagctgatccctgtctctacatataataatcttagcaccagctattccagattttaccagctccatcgtgcagatcgatctcacgttaatttttgctgaccttcgaaattgctgaaacttgttcggtacattatattaattgacttggctagatgtataacttaaaaaaaacaagagatttgttttgttccagtaaaaaatatcttggggtacgagtacagagtatctcacgatactgaattgtactatcatgaggtaccagtaccctcaggtatttttttctggaccggagcgaatcgtaaagtatttttagaacggaggtaacaatacaatgtttatctacagctagcggtaagtatatatataatgcgttaggtaattaattggttgtatacattgctatggccttgcacgcaaaacacattgccgattgcatgacgtgcaatttcaggctttcagctgggctgatgaaacgacgggctactaactggaaagctctgatataagttaggacatgcagctgtctcgcatggccgacgctagcttagctgttagcgtcacatgaatactgtgatcgactgacccctgcattactagtagaaattaaactagcttagctagccaatgcgagcgaagtaacgcacatgtctgaaaatccggacgtctcaactgtgagattgatcatatatgcagctagctgaattagcagccggtatagctttgagagaaaagtcctataaatacaataattgacctcaccttgcatctactagcatttgttattgaagtcagtcaattggcttttgctgctaagatagaacatgttaaaggggtgtttaatttggtttatggtcacattttgttacaccatattttttgctgacacaatttattagatatgagtttggttcgtggctcgtcacactttttcaatagcatgtcctatatattatagactcaatttttttgtcaactttatcataattgtgactattaattcgttcattatacttttgtgactgtcacaacttagctaatcttagttatggtaaaatgtgatcggtaaccaaacacattccaattttaccattgttggtttgggcacacctaccatgcgtaaagtataggttgaattaaacaaagtgagaaaagcatcatggggatgagtgccccgtgcgggcatccaatcaacggatgcagcagttggtccgacaagatccgagcaacactgcaaattgaccacaaatggcaagaattaatctccccttgttttctttccccttctccaatctatacctggtcttctcgtgccactgtacggccgcgaaaaattttaagaaaaagaaaatccatgacgacttaagccggccccttgttgtctgctttagtagcttctcagccacagctaaaaatttaaacttaaatatttaagaccttttcattatattgtatcgctagctaattatataggtatagaaatttacttaaaaatattttttatttgtttttcatggcttattatcttaacatttctaagcagagatgctgactatcgtcatgtttaagagaccttgagattccgagaaatgagaatatgcaaaaacattggtcgggtgccctagcttctactttcttaatatatttttcgaattttacagctacaaacccctcacaattcagataatcttttttttaatatttaagcaactacagattctttcattttcaaacaatacctgtagcgctcggctttgatgaagctgtttccccatgtttggcggatccacgtcattgccagctcatcatctatacactgctcgtgctagctagcttgccccggcggttgcggctcctcctcccaaagggcaacgccggccgtaccacctacccccaccagaaaaggcgaagaaaattagtacagtaaaagttttttagtagtgtttgagtttgtcaccgtcaagcataatataaaataaaacaccacattttaaaaaggacgcttcacattgctcccacaaacacgcagaagaatttaaccaccgcctcctcatcattcacacgattgattttagtttggtgtagttgttgacatttttttcaaatatacccaaaaaaatgtatttcaaatttgactctaccgctaagcgttcaaaatctgatggccacaaatattagacgcatgtagctatatagatagactttcaacaggattttagcgagatcacggatatgtcgctcgcatggtgcacatttaaagtgtggtgttgtatatacagtgatgtgtgcacatgcttatagtaataaaaaaatatgtttggaagcaaaattaaccaaagagatgaagggcaaaagcgtcacgcgcgacgcacgagggcggtcgacttgtcccgggccgaatcatgggtggggttgggcggaagctggtcacgtggcgccactcgtggccacggtccgcccacgtggagatcccgtggagcccacgcaggcccacgcgtcgacgcgtcggcccatggtcgagccgagaaagtggcctcggccacggtcaaggaatcgaggcccgcacggatcccgggcccaccacgcccctccccccacaccccccccccacgaaccaccatcgccgtcgcttccgtcgacgtggcgcccccagatcatcccacgtcagcggaccacaccccgtgggccccatcgcctcgctttattaaaaaaaaatcaactaatcccgtgatgcagaaaacgaaacggaaacgcaccgaaacaaccgctaactacttttccctctcctcctcttctctctctagagagagaaaaaaagaaaaaaaaaagaaaagaaaaagaaagagaagctctagagagagaaacaagagagagagtcgccgcctattaatacacgcgctccgccatcttctctcctctcccctctcactcctcccaaatcccctccattgccttcctcgcttcgcatcgccgctcccgccgccgccgtcgggctgctcgccggcattggggtaaggccggcctctctctccgggatcagcttctgctcttcccgttgtttgattgattgattgattgattttttttttggttttttgggtggggtttctgacgcgcgtggtgatgcggtggtgtgggaggtctagattagatctcgggtggggaggattgctcgtcgtgatcgggttgtgtgtgtgtgccattttttggcgtgttcgatggttggatgctcggtccacgtctgcgacggcggccacgagtttgagctgtccaaacccgggacgaaaccgaaaaaaaatatatgcaaatttgtttttggttcaattggtgggaaggcggaggacgaggacgaagacgaacagtagcagtagcttctcttgccgttttcctcaatttttgtttggatgcattagcaaggagaggacaaaaggatcctcttgtttttttcctttcaagaatttcttttttttatttgattgatgattttcgcagtacatatgggcttgtcgtcgcatataatgcgcgctgaaagttctggttggttggggggtttcctttcactgccgccgtttcggggaggcatgttgcatctgcctggccacatgacgcgagagcagattgattgattgatgcactgctgatccaatcgatgtgttagcgtcgtcggaatagataatcacccatcaatgcaacgaatgaatgatggaagtttcgacttttttttctttttaggtgctcctgttgagtgctcaacataagccatgtgcccttgtcctaaatttagctcatttgcatgtgtttattagctgttaattgatgagatttacaaagggatttccttgtctaagtttctttggattgataatgatggatgatggatgaaaagtcgttttccgactagttttttttggtgctacctaaagtgaatcaggcatcaccggttgagggcgtgccccatttttcattgtcgctcgggaatcttcagaccaaaagttgtactaattaatttccttttttaacttgcaaagacaaaaacagtaaccgtactgtagggcaatcagatcggtgttgtcagctcttcctgcattaggttatctggtgttctgttacataataaaggtttgtcgtctttgttctattgcagtgttggttgtgaccgtatacaattattgtttttggagctgagcgatcagatgcatgagccttccttttaaatgatctgtgtccaccatggcgatgaaccagtaggaacctgagcagtatgttatcatttttcagttattgtctttttttttggtagttgaaattattttcattattgcagaatgcaggaacttcccgcttaatgggctggatgcgttgtatgcacgtttgcagtgacaagaagacattgaaacgttggttttttattgacaagagggttggttgagtgtctaactcttaaggaatcctatagtctacttgcttgctcttgtgttgttagtaactgttcttacaacaactctgcggagagttctgttgatggatttgaagacaagcaactctcctgttattgctgatcctctccctaaattagccttgccatctgctgtgatgacgtacactacacctacgagtttcccctctaccgggctgtacttgaacactccgaaaaagaagcctctgcctggaaagatcgaagaagtccgcgccgctggatggcttgatctcatgctggcctcctcgccacctcgcaagaggcagactaaggactttgccaatgatgttcaagctgacgagcttgatttgctataccgtaattgggtggtatgtttttgaatctatagttattgctgaagtacatcaaacatggcaaacaataaaattttccactgtttttcttttgtaggtgaaccatccatctgctttaacatcatttgaggatattgttaatcttgccagaggtaaaagattggcactgttccttgattatgatggaactctttcaccgattgtggacaatcctgaaaatgcagtaatgtctgacgaggtattctttttctcctcttatgttctttagtcctcattattatcagtgaaaatttatctggcagttttgtaaatattctattcgacagatgcgctctgctgtgaagcatgtggcatcactttttcccactgcgatcattagtggaagatctcgtgataaggtaaggaatttatgttcacatgtaaaatactccccctgctaaccttttgcatttttcactctttgttgactctctcttatgtgtgttttgttctttaggtttttgactttgtgaaactaactgaactgtattacgctggaagtcatggaatggatatcatggggcctgttaggaagtctgattcgagtggtcagcatgtggaatgtatcaggtccactgattcagaggtgcaacagctttgttgattttttccacagacaaatttctctcttgtgacaaaattctaattagttattgctttttggctcatagggtaaagaggtcaacctcttccaacctgcaagtgagtttttacctatgattagcgaggtatgtatttccatctcgaacttggtaattattaggataccattttgtgttgcacggttgaaaattattcatttttatacctgtaggtgtacaaaaagctcagtgaaagtattaaggacattgatggtgcaaggatggaagataacaaattctgtgtgtccgttcattaccgcaatgtagcaccacatgtaagcctgcattgaagattttaatttcacacaggaaatatgtggtgtaaaatgtttgctgaatattattctcattgttacatcttaggactacggagaagttcatcaacgtgtgactgccgtcctgaagaattacccttgtctaaggcttacccatgggagaaaggtaaggaatatacacaaccgcacagctgtttcgaagcactggttaagtaccattgttgtatttgtttttaattcaactgcgctcttgaattcaggttcttgaggttcgacctgtgatagactggaacaaggggaaagctgtggaatttttgctggagtcacttggactatgtgggaaagaagatgttcttcctatctatgttggagatgacaagactgatgaggatgcattcaaggtaagccataaactggtctgcttgctcttacctgcaaaatatcaattactacttccatgtcttgatgtataatattgctcacttggctcaaataggttctgaaggcaaacagcattggctttggaattttggtgtcatctgtgcccaaggatactgatgctttctattccgtacgggacccagctgaggtaattcgtcttctatctgcattaagtaatctgtcgacaatagattctgaacaatctgatttggttacaatcattgaatcaactgagtatgaaaacattctttgtgtatttaggtgatggaattcctgaagaaactggcatcttggaaggaggaatccacttaagcagaagggaggaacataacagaatcgttttttgaggatatggagaagtaccaactataaatacgagcaaaatatacactgctaacaaataagtctggccaaaatgtttttgatttggcatcctattatataagaggctccctaaaccacccttttttggtctcactttcatcttatgtttctgggattctgagacatttcattcttttattagttctgttcctttagtatatataaaatatatacacatgtatgctgaaaaattttggttcctgtccctgtcgtcttaggcaattatttattctaccggcaagttgtaaacaactggttgttcatttgttctttagtgtgctgcaacgttttgtagctgttattccagtgtgcccttctaaaagtcaacttgtgtgcattggccctgcaaactactgtaattagaacgataattgatgcaaccaattgtatatttgcctgaggctgtggaatcttctgcttgtttaacttgaaattaactggctaattgcttgtaaacgcactcatcaacgagagtgacttgcttgttcaaagcaaaggaaacccacttgcgctgaagcattcaagtcaaaatcttattcgaaaaaaataaatctgctccggacttgacgacagctaaactgcatacgacttcaacacggtaaaactgtcaatttcttatgagtctgtcgaaatttgatggaaagaaactaattttagaccaaatcctggcgtatgcgtaaattggcccaataataattcatcgtttgaattccggcccatatgggccataaatatgaacggaataagttcactttagctcccttaaaagtgacccgaatctaatccataaccctaaaccgcaaaacgggatatctcgacccccgaactatcgaaaccggtgcaatttgactcccttggcggttttggagggtggtttcggtgacgtggcgctgatgtggcggtgttgacctagtctgtggggttgacgtggcgcttaggtgtcatttgaattaaaaatggatatgtgggacccgtttgtcattcatacattaaaaaatgtggggcccactgacatgtgggacccattcttcttcctcccttctctctttgtttctctctctcccctttggccggctgggccgccgggggagcacgggctagagcggtggcgggtgggggccagagcggcggaagctgaaacggcggcggcggtgggagcggcggcagatggcgcttgccctgcaggccgactgcttcaccagcgacctgagctagctcatcgccgacatgatgtccgggtcggtgccgcttgacgcaacacgcaagcacaagtatccccgagagggtggccatcttgggcgtgttcaagcgagacaaaattaattgctcccctctgcctactcatcctattctttagtggatggtgaacgacctgctaacaatcaattttatctctggttagttgctaaatgaatcaattttatttttggatttttgtgatgcttgtggccttagcagcactagttcaaggagacgcaacgggggatgagatggtggcgatgatggggctggcgcgggagttgacggccacgcagcgagctcgagcaatgacttgacgacgtcgtcgttgcaatgctgaatggcgtagctcgatggcagccctcgcccctaaccagcttgacaggctcgatgtcggccgtgtcgtcagcttgtcgcatatgccagatgcccggatcttgttgttgcaatcggcggagaggccagagtgccggatcttgttatcacggacggcgggaggtggcagagggagcagggagcttgttccccggtgagggtgccgtgctggtggaggtgaggactggggttagggcgcttaggtgccgtgccgtcgaccaccgtccccccgctcgatgtcatcggcgtcggcgtcggcgctgctgtcctctcccgcctccttgccggtcatcgagctgcccgttgccgctctggaacccgccgtcgctgcttcagcttccgccgaccgccaccactctagccctgccgctccagccgtgctctagtccccgcggctggccaaaggagagagaaagagaaagaaagagagaagggaagaagaggggaggaagaataaagagagagagatgatgacatgtggtcccacatatgtgtttttaattcaaatgccacctaagcgccacgtcaaccctatagaccaggtcaacatcaccacgtcaccaaaaccgtcctccaaaaccatcaagggagtcaaattgcaccggtttcaatagttcgggggtcgacatacccagttttacggtttagggtcatggattagattcgggtcacttttaatgaagtcaaagtggacttattccaatatgaaccgactatggctcaacgggccggaaaatgtgcttccttcccaaacgaggcctaagatgactatatatgggccttgttgggccgtttcgacgaatcgaaatgaggccaagcccacattggcccattttgattcatctcggagtttttcacatgggccactcagctggtcacttccttctctcccacttttgcttactctctccgccctcctaaaccctacgaccatgccgaccctcgccgccgccgccgccgccgcccgccgcgccggcggggcactgcgatacgccgtgctgggcggggttcggtcgctctcatccctccagccgtcatcctcctcctccgccgcagccgccgccagcgaggaggtaacgcagcggttctggtttcgccgccgcttggccgcctccgactccgatcggaggtgtgaggttctctggctgacgtcgcgtgtctcggcaggtgctggtggaaggcaaggccagcgcgcgcgccgccgtgctcaaccgccccggccatctcaacgcgctcacgaccaccatggttcgtacgccttttcctgttcgataaaatgcgtgcgtggtatcaggtgatatgttcctgtgacgtttgttcacattcgtgctctccacactcctataaagggcctgcacgttctagtgagaatgtgctcttgctaccgatgcatgaaacacacctgattgtaagggcacaatatttttgtggctttcctatgtgatcatttattctttaatggtatactgcggttttcagtaaattgacttttattttgagtataatgcttgatgaaacatagacatttgtacatgtcttggtggctcattgatctgatttcctgtgactgactgtcttgacagggagctaggctcaataagttttatatgtcatgggaggacaaccctgatattggctttgtcatgatgaaggtatgctgcttcagcatttgcatggtatcgatgccactatataggtctaaattgatttttatattatatgaagggcagcggccgagcattctgtgctggtggggatgttgttaggttgcaccagcttataagtgaaggtgagtggctaggccctgcatggtttataattatcgtttccttgtttagaacaccagcctctggatcagagcctcagaggttgccatgcttgtattattgttgaaatataaattttttttgtgacacagcttagaatgatagtggtatccagttcttttgtgacatccttcacttgtataaaggttgtttacaacactgcaaaagaagagatttggttccaaatggacagttccactggaaccatatacatggccaactgatttattctttcttttgcatgtccaaaggtttcctttagtgataaccctgtctcttttttttttaatttttttttaaaaaataaaaccaggaaagttggacgagtgtaaggatttcttcaagactttgtacagttttatttatgttctgggcacatacttgaagccacatgtaagtgcatggacttcaacttataatcactaattttgtttttatttttcgctcgaaaatttatattaccttttgtgatgtaggttgccattcttgatggtgttaccatgggtggaggtggaggtgtttccattcccggaacatttcgcattgtcactgatagaacggtatgcaatttttttttgttgatttgtatttttgtgcttggggactaatagttattgtgcagtagcatttctgcctgggtgtgcccttatgttatgcatttatgagcatgcggagttcaacttaaacaaatatttatttacttaccatgactgtttccaggtatttgcaactccagaagtacatattggcttccatcctgatgctgctgcctccttttatttgtcccatctgactggtcatgttggttagtgttcagttttccctttcaattgaattctttaatatctgatatccccgttcatctcttctttgtaacccccagcccttttaagtaacctgtgcatttcaccgttggtcctctttaggtgaatatttggccttgactggtgaaaaactcaatggagtggatatgatcgcacttggccttgctacacactattccatgagtgatgtaagatccttttaattgaactatacattttggatttcttgtgttctatctcggtattagttttgctagttgattaactttataattcccatttccttttacagcggttgaatctggttgatgaacgccttgcaacattgttaactgatgatccatcagttattgatacttcccttacacattatggagatcttgtgtatccagataagagtagcattgttcataggtaagccgtacaaaaagtaaatataattctgaactgacaatgtcttattaaatgctttagcatgtcatactacagaagctgctggaattccagattatgttgtcttctagttgttttttttaaacatacaccctccatcccaaaatatagctagtagaatgggaattgaaagatgctttgctttccttgatgttttggactgcatttcagaattcagatcatcgtttgtttctttgtaatgccattactctgcagaaagacatgcagaagtatcctaaaagtggtacttttatatttagaatgtgtgtttattcttaatccttgaatcaagcagagtgtgatactgctgtgatttgtgaatctttgcattagctgtagaactgtgcttttatatttgttcgggaccaggattctcttggtaatataattggctgttaataataaatgatacaatgacatgcgttttgaatgtgcatgatttttcatgtggatgtctataatacaatgtttatgctttatggaatcaatgtatatctcatttgtgccctttgtgttactctaggctggaggttatagataaatgtttcagccttgaaacagtcgaggagattgtggatgccatggtgagtgatgtgtcagttgcttttactaccaaatctctgggaatggcttcttttcttattcatttgaacatgaataagatgctgttgattgataccacagcttgctgggctaccttctattcccatatcattatttactaaaaagaatctcttctagatgttaactgtttgtacagtagttattgttgttgttttggcattaatttcattcccttggttagcttactagatagttcatttcaaggtttttgtttcaacagcagaaattttgcttatgcttcagaacttaagggctatgctcttgtaaccaggaaattgaagcagctaggttaaatgaagattggtctaccttggccctgaaacggttgaaagaggcttctcctcttgcgttgaaagtttcactgcgatcggtaaataaaaaaaaaatctgaaaaacctcactctttgtgcctttgactgtcgatggttgacagattgtgtatggttatcctgtagatacgtgaaggtagataccagacacttgatgaatgccttgtgcgtgaataccgcatgtctatcaatggaatctcagagaaattttctcatgaatttcgtgaggtatgctgtactgcatttctttttggttctcacaggtttatcgaatattatttattgatgaccaagtaaccacggtgctaagtctttgaggtaattaggaatctgtctgtgacttgaaaatttatttaattatgttataaatgttgcttcaatcatgccagggtgtcagagcacgtcttgtggagaaggacctagctccaaaggtaaattacatagctggttgcacaatctatgctgttaaatcgcaaaaaatagaaaataaaagttgtgttctgcatttttttcataaaaaaaatgtggttcttgcagtgggatccacctgcccttgagtatgtatcagcggacatggtcgattcttactttgctcccctgggtgaatttgagcctgagttgacactgcctactgaatcgcgagaggcatttgtatgatgactctgcatgacaattccaagtagcgcttttgtttgaagccttatagatttttgagcccacactgtcgaccgttggcagcacataataacagataggattctcaatctattcttgtaccatatatgccttggtgtattgaaaggaactgatctccaaggtgaactcctaccattctcactttcataaattaatgccttcgcttcatttcatttatactattgcaaagcgtgtccaagtcgccttgtgattatgagtttgggactcatttgtattgttgttgtctttgagctcgtgtgctgtgctaccttgtattcctcatgtgaggtactgatattcaggccgagccagctatagtcgggggcggctgatacacgatcagccgcgcggggaggcgagcgcgcgatcagtcgcccccttcctctagtctctctgtatctaatctactacttctatacgtgtgtgtgtatatagtatatacatacatatatatatatataaatatatatttttaatgcataaaaacacacacacacacgtatacgaagtttatataggacatatacaaactttgtatacgataaatacaaactttatatacatacgtattaaaaataaaaaaactaaaaaatacacaacgtatacaaaatttatatacgcgtatacaaactttgcatccacgtatataaactttttatacgtgtatacaaactttgtatacgtacaaatacaaacttagtatacatacgaatacaaactttgcattcataaaaatttaaaaaaaccgagaaaaaaacagaagagaaaccggaataaaaagtaaaccaaccgaaccggaaaaaaaataaaggtaaaccaaccgtacagaaacggaaaaaaacaaaaaaaaaaaaaacggaaaactcgctcttcctcacccgcgcggcgcgtcgccacccaatctccgcgcgcgacacgtgcccagtcacgcggggaggggggcgcgcgactgaccgccaactagctttctcggctatagtcgtcctgagtcttcacaagtattcgggctgggcactgaataactggtctcatctggacctgggctggagcgtgataggccacgtacattgcagtgagtttcagccagaagatcggcccaatttcttggcaggtacactggttttaggcattgtaagttgtaagaaatctgtcataagtttaaacgaatggatggtgtattagggcttcttcggaatgcaaaatagaaaaaacgtaggaatagggaaaacataggaatacagtaagattgtatgtgtaaaatagagaaatggaaaacatgggaattttttgttcttcgtgtgcaggattcttacaaagagatgagtggattctttttttttttactatgaaaacatgggcagggaaaggtgttcctctgaaattcaaggtagcgaaccctttgaaacgaatgcatctacagtacccaattcaaagaatcatcaatcctccatttttccttcacatttcctctattccgaatgagcccttagtgtcatatctagattcttagactagagaaatatgactgatccaacctctgaatcttttgatcctagagtcagatggtggagatggtttttcatcccaagtaatgtcccctcgtatatattttttcatcactcaaatacaatacaaataacagtaaaaaaattctgagagcagtgaattgtaatttggatagctttttactaccaaagttttagtttgaactaattttattacttttttttagaaaacagccgacataagatttacctaatatattagagagaataaatggcctggccgaaggccttacaaaagatttgcctattatttttcatttggattggacaattgtcatttctaatttgtatcagccaactctcttttctatacatagataagatatggcctacatatagataagagagttgttatttgctcgaggttgttgatgtgtattgaaaaagtttaggtggtccaaactgcaatattgatttctaagagtaaatatcataaaactgcagatatttgatgaaactatcgcaaaactatagatttaaaaatgtgtatcacaaaaccacatatatatcgtcaaatttatcataatactacatatttaaggcatagtatcataaaaccgcatatttaatgataaagttatcaaataactacatattttagagtttatatccatagaacttttatataagtcatagtatcataaaaccacccatatttaaagatgaaatttactcattttctaatatactccatatacatgataccaatatacatcaaatatttttacaaattcccacagctattcatatgtagtagtttgggagaacgaaacatatatatctcctcaaggaatatgaaacccccccttagatggcatatagattatcgtaccacaaacacatggttaggccagtaatcagtactccgttatatcatcgaccgtattcgagctatctcctatttgcattatattgcatccctcacatgcatgttgaaccatacagtaagctagcaaacaaacacacaagaatatttgtgatctggacacaacgtgcagaggggtcacattctcagagtacaaagctcactgctcaccacagctaagggactgtttagttggcaaattttttttttacctatacatatcacatatatatcacataggatatacggatacacatttaaagtattaaacatagtctaataacaaaacaaactacatattctgccagtaaacgcgagatgaatttattaagcttaattaatccgttattataaaatatttattgtagcaccacattcttgaatcatggcgtaattaagtttaaaagatccgtctcgcaattttctggcgaactgtgtttttttttgtctacatttaatactgcatgcatgtgtctaaactctaaacattcgatgtgatagcgtgaaaaattttgtttggaaactaaacaggccctaactccacacactgatcaacactaatcagcatgtacatttggccccaggcacgtccaaatccaaaccgcatttatcaattagcgctatgattaattaatcacctcgatccgccagctcgatccacatgcattgcctcccctcccatctccggcgagctatatatacccccctcgccatgcacactccccaaccacagcaaccaagcagcagcaagctcgagctactagctagctacactagctcgattagttgcagcaatggcggcgaaggcggcgcttgtgctggcggtgagcctcctggtggtggccatggccgtggcctgcccggactgcccttcgccgaagccaccggcgccgaggccgaagccgccgacgcctcactacggcggcgggtcgtcgtgcccgcgcgacgcgctgaagctgcacgtgtgcgccaacgtgctgggcctcgtcaaggccaaggtcggcgccgtgtcgccgtacgagccctgctgctcgctgctcgacggcctcgtcgacctcgacgccgccgtctgcctctgcaccgccatcaaggccaacgtgctgggcatcaagctcaacctccccatcgacctcagcctcatcctcaacaactgcggcaagatctgcccatccgactaccagtgcgtgcactagatcgagatctagagagctagtgttgcacttgatcactccatggctgggagtaccgtatcttcatgttgtttttacccccaatatcttgatgtgttgttaatttcttgctttttttttcttttgattctatggttcgtgatccgttggtagcgctatgatcattgtatttttttttgtttctcatgatttgttatagtttcgtcaataaaatggaaatgtatttttttgtcgcatatatgcaatggtcagagattggaactctaagatttggaatatctgtcggatgaattaatttatgcatgcccaaacaagctcaagcaggacgcatgcaccatgcatgtcgaggaaaagttaactgtatacagtactccctccgtacaccgttaactttttagcacatgtttgaccattcgtcttatttaaaaaaattgtgaaatatgtaaaactatatgtgtacatgaaagtatatttaacaatgaatcaaatgatatgaaaataataaataattacttaaattttttaaataagacgaacggtcaaacacgtacttaaaaagtcaacggtgtcaaacattttgaaacggagggagtaagtactaagcattaagaagaataaaataagaacaaccatattagggtctaggaaattaccacgttaattagatatatatatatatatatatatatataatgggttatttcagattataagagtgtagattgattaatatggttgtgtaaaaaaatacatttatattcatagaaccttttggtggcttggtaggtgaagtgatgtatagcatcttcaccactgcacccacccgagagaagggggatctcaataggacatatggggcacagttatatccctaaatttattttttttgacaaaaaatatgcaatttaataggtataatatgtgtatatactattagtttagtcaaaacaagcaccaaaagtcatccttagcaagagagattaaatttttccttagctattttagtaatttttctgtacgagttatctttagttgcattagtatcaaaattatcgacacttcattttcgctattaggaagctttatttttttccccattagaccatgcttaagtactaactctgttttcgtattgccaaactcctgtgctcacgctaagttgtcccccccccccggcgcccaaaattgtgtatagttaatttgttcaacatgcaaatggaaggttttgggcccttaattatgtttgccatgattctagcaaaagagccaatgcaagctggtttattgccaatacatcttttgtgccgacgtgctgttaaatttgaggtgaacaagttgtccacatgaactatatttaaaaccttaggccttttttttcaacttaggcttttgaatggtctttatttttgctctttggcttctaaacatatatatctaaactaagtggcttacaacttccacaaaagcgttaatgataaagttacttaattgtttgtttgaagctcaggctttcagacagggacgaagctagaacgaaatgaaatagggtaccacttgtttaatttagggtgtgttctttatttccccatcttttccaactcacctctctcgttttccgtgtgtacgctttccaaactactaaatggtgtgtgttttgcaaaaaatttctatatgaaagttgtttaaaaaatcatattaattctttttttaaaaaataattaatatttaattaatcgtgtgctaatgagtcgtttcgttttccatgcgaaggaaatgagttcccaacacagggaaacaaacgcagtcttactctactttagatcaagtttaaattgacgtggatgtctaagtttgtattcagagggtgcacacaggtgaaaataactgaagtatagctaaacaattttcttgaccgggttcctggacacccccttgcccttgctttcagacttataaactggtataagcccaaacacaatgagaatgagagactaagcagagtgcctagatgatctggaagcataattatacacatatatgtatgtttcttttagaaaatggataatcaggccactacatccaactgaaacgatgtacacagcctattttacacatatatgtatacctgaggaaaaccctctgaacatctggaattaagaatatatgtcaactgggacagaaaacgctggagaatataaatcacaagcacacaacacagccaatcaatttcatgcacatccaaatctgaagaaaatataaaaaaccgggaataattgatccttattcgccagattggaccacatgcacgatcgtcgatctggcccccacacgacatatgcatccatacattctccttcatctcatctcttcttctccatggccactaatccctcgagggaatatcccctcgtatacctttttctttcaaattcgatgtaaatagttatgaaaaaatctgaaaaaaattgacaatgtagagtataatgatacctaccagtgcaccaaaattcaagttcaaattcgatctacacatcgagaaacaaaaaaacaaatttagatataaacagtacgctactattcatatgctgaatttgtcttttttatatctcgacgtgtgagttgagtttggacttaagattttgtggagttgtatatatgtgttgtatgaatgtgtcaaattttttcagaatttttcataaccgttttaatggtttttaaataaacgagggaacatcctctcaagaaattagaatagtttccctataaattcacctcgccatgcacactcccagccacacagcaagcagcagcagcaagctcgagctaaccagctacaagctacaagaagcagcctagcaaattaagctcgatcgatagcaatggcggcgaaggcggcgcttgttctggcggtgagcctcctcgccgtggccgtggcggcgagcgcctgcggcaccgactgcccgccggcaccgaggccgaggccgagcaccgggtcgtgcccgcgcgacgcgttgaagctgcgggtgtgcgccaacgtgctggggctcgtcaaggccaaggtcggcgcggtggcgccgtacgagccctgctgctcgctgctcgacggcctcgtcgacctcgacgccgccgtctgcctctgcaccgccgtcaaggccaacgtgctcggcatcaagctcgacctccccgtcgacctcagcctcatcctcaacaactgcggcaagatctgcccatccgacttcaagtgcgtgcactagagctggttgttgcacttgtttctccatgaccatggctgcgagcttgagagtactactgtatcttgatgttgtttggagtactttagttcttgatctatctcttggttccatgtgttgtttgattcccatgaatgattcgccaataaaatgaagctctacttttcatcgatcgtatgctttgagatcagctgaaagctagctcgcacattgctgtgataactgatagtgaacaatcaggatgaaatgttaatttttttaaaaaaaaaatcggcaagaataattagcaaatagctatatttagtggtactaaataattaagctagattatatatttatagcaattaatagggaacaataattgcacacaataaattgacacgcttgaggggagatatctaacgtctcttgttgtgtcatcatgaatgttaagcttttggtttgcaattatataaaaagataatttacgagagagggcgaaatggagtcaccatattcattctaaaagctattatactctcattccggccaatagctattattatgcaaatgtttggtcacggtagattggtagacttagattatgagtgattctaccgtacttgagcaggtaccttcggtactaggtgaaattttgcactaaagttattgtacctaaatatctcttaagttataagagtatactttgactggtacagttgtatataaaatatacctgtactcatgaaaagagatgcaagaattgtatatacattcaattttgctttcaaaatctagtttttttaatacttaattaattatgcactaattcatcgctatgtttcaagggttagtatattcagtacctcaaagaaaaatacatgcatgggattccaaggttagcatgttcaacacataaggcatgcatgggattcccttgctggcaagtagctatggtggatggcacagcttgcaacaagggaaggtccacccccaagggagagtatgactaggatgactcacatgccgcacgggtagtataagttttaagggaacgtatcctgtacacataacctttccatgtacacaccatgcatactaattaacaaaatttaaaaaatctagagaaagaaattgtacatatacttccaatagcattatattacacatatgtgtaaagtcttaatctcaaattcattatgctctagccgtaacaaaaaaaactataatttctggtagtttcaagggaataaatcggtcataattttgtcttatttggtgcttcatatatatagtgaatttgaagatgagactttacatataaatatgatactactgaaagcacatgtacaattttttttaaaaaaaattgatgaagttttgttagttgatatgcatgatgtatataaaagaaagctggcttgtgtgcatatgatacgtttccaagtttcaaagtctgtaatttgaaacgactctaagtgatgagcacaatgcatgacacctttcgagaatgcagaaatgagggaaatacacacccatgcacagtcccacaccatgtctcacactcatattaatagataggcccaaactaacatcatgcatgaataatcttataaaatattgaattgcattcaatatatgcaccctttggtggcttggcatgcaggtgaagtcatgtacaacaccacaaaccacacacacccaagaggtagttccccacctaacgtacctagcttgttcagcatgcaagtggaatggtttgggccctcatatatatctgccttattccagcaaaagagccaaacttcttgcctaccttttgtgctgatatataattaagctgttagattgagatgtgaattgaaccagttgtccatgctccatatatatatagaaacatagctaaaactttaggtctctttttttttggccttggcttttatggtagctctttggctagagcatgcggttttcaagtagcaagtttaaaagtcgagacgtaaatccaaatcaataaaaagttttttttttaaaaaaagctactcaaatctagttttcaacttcttagagagctacggttacttacaacaagtttaatagaaggttaatttaaaatctgcttttttgtttaagtttaggcattctaacttatatactttagctatgagacctaccttttgtgtgggtggtcttcaataaccacagtctttcgactgccaatgaaccaagccagcatacatgtggcagtgagaccctctggcaccttcaattcctggtgtttaagtctgcatgtgaagtggatgatgtcgatttagggttctagcattagtttgatttgaaatttgattgggtgtttttgcaggtggcaaacgtcaaagcttctcagtttatctctttgccgctgtgtgtgcgcatggtaggaaggttatgacgtgtttgtattctcttctctgtgtccccggccgtgtattttttcctattatcctctagggctcctgcgcttgcataggcgaaacccaccttgtgtaagatcgttggaagtaatatattcaggtgggtatttcgccctccggtgaccagtctaaaaaaaacttatatactgatcaatatataaacccaaacagaagttacggaccttagctagatgatctgaaaccataattgtacgagctctaattgtacagtacccatgtattacactagtattaattgatccgggaaaatctagcaatatattgtgatgaaaagaatatattgcaactaggacacacggagaatataaatcacaatcccaatacagttcatccaatcaatcatccatactcacggtcgatcgattcttgattcgccgattgggtaccacacgcatgatcatctaggcccccattcacgtactcatccatctacacatcttcttctcatcatctcctcctcctccatggccactataaataccactcgccatgcacactccaagcacacacaaagcaagaacctcgagctgatctactagctacctagtactctcatcttcttcactagcttttgcttgatcaattgcagcaatggcggcgaaggcagcgctcgttctagcggtgagcctcctggtggtggccgtggcgagcgcctgcacctactgcccggagccgccgacgccgaagccgaagccgccggcgccgaggccgccgacgcccggcggcggcgccgggtcgtgcccgcgcgacgcgctgaagctgcacgtgtgcgccaacgtgctcggcctcgtgaaggccaagatcggcgcggtggcgccgtacgagccctgctgctcgctgctcgacggcctcgtcgacctcgacgccgccgtctgcctctgcaccgccatcaaggccaacgtgctcggcctcaacctcaacatccccatcgacctcagcctcatcctcaacaactgcggcaagatctgcccatccgactaccagtgtgcttaatcacattgggacactgcaggggatcgatcgatcgatcgattgacagtgtgctacacgtcgtctacatgtttttgttggttggtttactgtgagcagtctgaactctctgaactttggaaactgtctgttttgtctttgtttatgcttgcaaagtttaattagttctgggaaaaaaccattggccagtatgtattattacatgtgtaagtgttggttgtgaccccgggtgatcagtttactggtcaatatatatgtattttttgtgcttatgatctgttatggttcagatgtcaatcgaagttgcaattagtattttcttttgtaaatttggagctctggaatttggatatgaactctacataggtaccaggtgattgctactcaaagtccaaactcaagctctgaggaccagaattatacattaactaggtgaaaccccgtgcgttactgtgggaattcagtatgataataataagtaaaaaataatatataaaatagctagacaacataaagttaacgtggtttatgataatttaaatttaaatagtatatggaataatgattcaaatgcaaaagtaaggttatatgactttatgagagaagaaaaaaaaaggagaaagttcaaaccatagattaatcatctaaagactaaaaataactgaggtgatatgacttaatgaagaagaaaaggtggagataatttggaccatagattaatcatttacacactaaaaacaattgatgtgttgtgtcttaatgagagagagaagagagaaataacattaactaattgaggttaaactatataagtacataggatattataaaaaaataatgaagatatatattgaaatattatgtgaattatgtaggatgatgatttaacatgcttgcattttcaaagctctaaaatttaataaattataaaattatagataatataacatatttgcatgatgtttaaatgtagtgattgttagtggatgatgatgtggcatctttgcatgttaagctttaggagtcattgggttataactttaagtaagaaaggatgtggtgtcacaccccaatctggcaccgccgtacaacggcacctgacaggagcgtgtcgtagggaaaacggcgtgaaccgcttcctacgaaaccacgatctcggtaccagtcccaggacatagtgctggtacccacagtgacaaatatgaatcatagcaatccttaaaataaatagaggacttatttaccttaacttaggttgcaactcagaacaacccgagaatgcaaccgacgacacggacgaggaaacaccaacaacagcagcagcagcggaaccaacgaactaacacccaacaccacaggcggcggctaggaaccaggacgaaaccctaatcttcacttcactttatcttctcttcagggcggaggaactatatatatatatatatttatatagagcaagggtgagtactttcgtactcagcaagtcacgggaatttaggtgtttaatgcaagcttggaagagaggcaaggttgttttgcaaatcttttatttgaagacctttttttgaaatcactaagtgatttatttctttttaagtttgggcgaaaagagacttgcgtctcgattcgactttaagagatgcttttcaacagctcatttagtaatgtaccgacctcccaggtcagatcattacttctcggctcccagagccattccacttgattaatcggctcccagagcctttttcattttctcggactcccagagtccagctgcccagcagcacaacaatccgcttccactcggaaagcctagtctatgatgcccgcagacatcccgaatcacacagattcgtttctgaccactcaggtcatccatctgccacataggctgattctggttacaattcccacaccacaacaacttttcacaaagcacaggcaaacaaatctatgcaacgggaaccacctcacatccgcccatgaccgtgggcacggctgttcgaacagttagttaacctctgcagaggggtacactttacccacaagacacaaacttactccagacactggccggtgtcagaggttcgcgacaaagcctttcccaagccgacccagggatacctcatgccacatagaaggatcaaatcctcacataaacataggccattttaggcgttcacaaatcaaactccaaccacctcgatcggtaattcagcaagcttctcgttcttgcattaccaggaacccggtttggctccaaccgaccccgccccggcgttcccaactattggcatgcgaggtttccctgaaccgactagctacttagccagggtgtcccattccaccttgtggttgtactttgattatgttcgatgagtttcccacaggaatcggtccttatatgcgaatacgggacagtgccacataggcacaaccccccgcatcgcgagttttcacaattcattttattttcaaacacaccgacaccacatgtcgggttttgaaggcttcacaaacccatttcccaagttttcgacaaacaacggtgtatgtgggatatttggtatacgtgctcagagagcacgaataccgaggtaccacaagggtggagcgacaaggattcagggtagtacgacctacgaaaattagtacgactactgggtaggtccgtcggtttggcacgcaaaccgaggccaagcaagttaagtgtgtgattctaataatgcaagttgcaaacaaaataataatgacttttcaattataggggcaattgatcaaagggtgacttgccttgctcaaggtcttcacgaagcttcacgaatcttcgagaaaacccgcgatcgacgaaaatccgataaccgcaactatacgcaaacaactgaaaacctaagcaaaagaccaaaagaaagatcctatttagactaattagtagtgccactaaatagatctcaattttacggaattactggaagtggaacggagttaatcggagttacggagtgggtgatatgaattttggaagtttaattggaatttctggaataagaggaatggtttatggaatttatagaaataatattctcaagaatattattgacagtcactgtcatgtgggaccaaagaaaatggtttatggaattttgtaacaaggaattgatttatgggacaaaggaaaaaggatttattaaatccctgaaaaagaaaaggatggagggatgtatattagactttttcgggcggcaagggcgcggcccaagggtcgaaggaggctcggccaagccatttgggccggcgcgggcgcgggaaaggcggcccattagggcgcgcggaagggggagggagcggtccggtggaccgggtgcacctcgcggggtcctgggtggggcccacatgtcggcggcaaggctcacggtggggagagcgcacgcgggtgcggtgctagggtttggtgggtgcggtgtgcgggcggtgcgccgggtggatcggatggcagcgggcccacatgcagccggttggcgcaccgtggaccgcgcgcacgggaggggggggaggaaggaggcggcaccggctcggctcggtcaaagccgaggtggcgccgacgtggcgcctacgtggcagccacgcgggccggcgggaggaggaagaaggggcggccgagatggacggcggacgacggccgagttcaccggagctcgtcgcgacgattcgagagagagggagtacaccggaacgatgggacggacgataggaagtgagccaccggatcggattcgccggagggaggccggcgttgacgaatcgcggcggcgcacgcccgcggcgagaaaaggggggggactttcaccggagcaacgggggttcgattaaaaggggtgggagcatatccgggattcaaggaatccgtttcgcgccggatgggacggaggagcaccgagggcagccggcgacgagagcggccctccgggggtgggcgccaatggcggcggggccatcccgggtggcgccggtccttggggcggcatctacgcgtgttcggcagggctaccgagctaccacacaagctagagggcacaagggtgagcgggaaaggggaacggaagggaggcactaccgagccgggacggcgtggtgacgagcagccaacggcgcggaagcgagttccccgtcgtcgggccggggaaggggaagaagaagggtggccggagccctcttcggctccgcgcgcacgccggcttcccggcacacgcgagggcggaggaaggcgaggacggcggcagcaaggcggcgatggcactgcagcggtggggactgaagtgggagggatttgagaggagggactcggctttatagtggaggcgaggtcagttcgcgcgggaggtcggttcaaaccgaccttagggcgatcaaggcggcagctggcggtcgtgctcggagctagcggccaagtggcggcagaggcggtcacgggcgtgacgccgatcggggaaaaagcaaaaaggggagggagaaaggagctcggctccttgccgattttggacgagctgagggaggagagagcgcatgggagagagaggcgctgcctccgcgtcttggacacgcgcgcgctgcggcgcagaggtgggggcagcggcagagtgggcgcgggcggctgcgcggcgcaggcgggaatggtgccggtcggggaaaaagcaaaaggggagggaggaaaagggggctctgcccacgtcattcagggagaaaggaggagggagagagggctctgcctccgggagttggacgcacgcggcttggagtggccgggcacgcgcgcggggccgtgcagctgtagcgcggcagggcagcggggccgggaggcgtaggcgcggcagggccgacgcggcggcgaccgggcggtcggccacgcacgagcgcgcgcgcggatgcgagggcgcggccggatttcgaacggcggcggcgggaaatcggcgccggtgggggagcctttacgggagagagaaacggagagagagagaaacggagagagagagagagcgaggatgggaagagagtgggcgctctctctctcgagcgcggcgcacgcgcaacgcacgtgcgagggggaggaggaggagcggctgagaggagatgggccgaggagaaaacggcccacaaaaatccgaggaaggcaaaatagactttttcggaggagattgattcgaagagaatttgaacttggaatttgacttagattttggaattgggatctcgatgagaggaaggagtagacggaggattcaagacggggttttggatattttggatctggggaagtatttggcgatgattcaaagagagggatagaatttcagagtttgatttggagacttgagtcggaagaggaatttcgatggggcaatttctgatggtgacgagagggatcaaggacggatttgaattgagatcttggcacaacttagactcacacacaaggaacgaaaattttcgcaattaggattttgccgaattagtttttaacgcctcacgaaaagcggagcgttacatgtggacacaaatacatatttaccgaactgagtgatattatacgtctgatccttgagaggtattaagagatatccctttattcattataaaattcggtaattcatacaacttttttatataatggaattaaaccaatctttacttcaaaggagctacaaccacttattacataatcctctcaaagagagcaaacatttaagtaacccataaagaa

SEQ ID NO: 7463 - DNA, 15892 bp, Oryza sativa
  unsure (1)..(15892): unsure at all n locations
tatgaatataagactgataacatgcaacctctgtaccaaaatgtaagaattcgtcacggccgaaagatcgatgcgccgatttggctcctagagacatagttgcaccactagttgtcgtcaacaatctcgtctaaccactgtgaagtgtgatgtctttttgtgctatggtctagccaactgttagtttcttccatgttaaattgctggtatgcatcccattggggaggcggcattccaagtgtgcgcaatcgcaaccacagccgatctaatagatattttaaaaaataataaaaaaggcaatatatttacatataacatatattgttttctcttgagaaatactcctatatagattcttgtgggggcaatgatgataaggaaatgcgagaacaatgtaagttgaaaccaaaatatattgtacatatataatgaaatatccactgcatatttggtatgtagctacatgtgtatacctagtatctgattagtgaagtacactatatagcaatgattttaatcagaaactatagagaaatgatttctgagaaagaaagacattgggtgtaattaagaaatcatattattgattgggaccttgtggggagccaaggcacagctgctagttcccctccatctgccactgtctgcaagctgatctagtatatatgtgcaacaaaccattggtcaaaaaaaaaagaaaaaaaagcgaaagcgattaattaaagttgaaacctaaatcgtcgtataacgaatggttgatatgatgtgtagtacatttgataaatctagtacaactatatgtatatcaatttatgtgatagtaactagctagctagtactgtaactgtaattaacaagagtgacacgaaaagatctatatatctcagatcgtacagttagctagatcaatgacgtcaattaactatatatataactagctgggttgtaactatagatagtagaagaactttcagctatatatccagacagtacggccactgcataatgagtagtgataaaatgccataatcttctccagcaggtgacaaaaaacgcatggctggcaccgatcgagagatcatgtcaaggctaaaaagctttagctcaacttggttcatggaatattcaggttcagacaaggcgagtcattgtcgcgtatcaaaaaccggagccctacacgatcaaaaccagcatcacggtggtcaccaccacgaagaatatgcatcagaacacaacagtacagtacagaagaagggagatagctagctaggttggaatggtcgaattagctagcaaagcaaattaacaagcaaatggcctgattaatcaagctcgtatccgatctcttttgccacccgtgaacccagataatccgcggctgatttgtcgcatgttatagctcgcttcctcgaactcgcttgatccgtgtggattactcggctcgatctgatcagctgtagtagtagcttaatttgttgactccatgctccatccatgcatgttcagacttgagaaattcttttctttttttcagtaaagttgttcagaagcaacaaaatgtgtgagaccgtccgtgtggctgtcaggctgtgctagctgctagctgatggtaggcagatcacggtatttctgaaatcaaatggtaattaaacatttaaacatatacgtgcacattgattgattgattgaacgtagattaattactaagcaggttcacatgcgtgcatgcttggccggcatgggtacccacgacgaacttaaaattatattatacaaacaatatgcaccgatcgatcgatgtcacctcctgtaatgcacatcatatcatcccgttgatctcacatgcatgctccttgattttttttttttgaggacagatcaaattgcattgcattgatccggcttttgggagaaagccaaaatgctccttgagatcatttcagcgatgcaattgagtgagtacttgaaagtctttaagtctgaaatcaagtggctaatgcaagttgacgatgaacacggcatggcaagccatggcagtactcgaattcgtcgtcgtcgctttgctctgtaatatgatatgtcgatatgatcgaccaacggatgctcgtggtagtgttccagccgagccctgctgctgaccacaaatgcatgcagttcttgacagcgaaaaaggagacttcttcttttgagttttgacgccttgcgccgacgggtgagccgccgccgccgccgccgccggagaagacaaggcgtccagcctcggggcccacgagggatagtacacgggaatcggattaaacgggccgaatccgccagtttgggccagagtaaagtgcgccaccgcgactccgcgagcgcgaggcctcgtttggacaatggcccaaatgctggcgcgtttgcttgtgtgggctgggaaatttcgagcaaaatctggcccatatactatgatgggctggggcttagacttttacctatcccgacgagaccagagttaggccgggcggaatatatgggccgtgttgcgtgggccgttgccagatttcacgggccgtgcagccatccggtatgctttgaacctggctgaactttttccaatttatagacccatagtttcgcttatgcttagacttgtaagctaaaatttaaattttagagttgaaatttttagttttcccatcttagtttgttttacagcattttaaaaaaaatcgctaagaatgtttatataaaacttttgcacgcaaattattttttatcggtaataagcggtatacataagcataaacataagcaaaacaagtactccagtaaaattgaaggtgaaggagcgcagcacaaaggattagacaaaatcaaagcattttctttctgcattctgtgagttgtgcagtttccgaactggctatactgtcatagtgatagctaagaaatttacaggaaataatggcacatatatatatatatatatgccaccaatacagttcgtaattaaaggttacatcaggaaaatgaatactgattcctccttgcatgatcttggatgacagaacggagagaaaggtttggaattagctgctggtgcacaatcggctgtcctgtaatgggagataccctccgtcctccatcaagccaggatctgatcgcatcggtttcgtaggtgaatccgtctgatgcaatgcaaggctccctcataacctcctgccattacaatgcaaatgatcaaatttctatttcaattcatcacaagtgacaagtatttgtgttaatctacacaaggagcagtgctaagttatgtgcagaacttttcattgaatacctgaaggattgggcagatgaagtatgaagggatgcagcagtcttcatcgaaaggcgactgcatcactgatgatggagaaaatgatgcagctagcttcctttgtatgagcaacgtctccggttctctgacacagttctcatcatgatcaagatactcttgcagcggcttaattatttgcccggaggcctctaagatcaaattgtctgaaatcacttctttctgttcctccatggttgtgttctgatcattcttgggtagatctctttcttgttttaactgtgcaatttcttcgcttgctctcagaagtgcttcttccagttctttcctctttttaacctcctccaagtacagctcctcgtattctttggcctgtaaggttcagagttctgatcaaaattctgaagaatatattcatatgaaatctggatgtttttttttctaagtggtctcgtttctgaataaaatagtcaaaggacaacgaattactttctgaagagatgaaactacttcttcgtctgctttctgccgtctgtaagattctcttaaagctctcatcattaagttgtcagctgctttgcatgcttctttgatctcatcgtaaaaacccagttccgattcattgttgtcatcctaaataattggaaaaggaaatcaccatattatgtcatcactcttacaagacaaaatattcgaaaccataagatggcattgcaagatcagaagaacctgttcctggtgaagtgtcaactgcagagcatcgtgaccagtatcaggaatgaaaggcgtatgtccaggtgcaatttctacttccacgccactatcatggaaaatgaatcagagatttttgagcttcactattcagtaatcatcataaatcgcaaaattactactaaaaggtttttaccttgtacagattaaccgttctttgcagacaaaccaaatcttgcatgatgggtcagctctctgcataatttctgttgctgtcctggatgcaggtttgtccatttttctgaaacagaaaacaacaattattggtcagctctctgcataatttattttgtcttcaattacaaaataaagctttgcatttcaagtgttatattttcttagaagaaatatttaccttgagtaattcctgtctggggcagctgaaattactagcttggtcactccatgcaagttgattagttcaacaagaccgtctacaacattttcgttctcaatgactagcttctcacatttcatctgaaatatacagacaatgaaaaaaaaactgtcaataagctgtagttctaaataaaaaacgggtgtcaataacaagccaaagccatcttgagataatgaattcacaggaattaacagaacccgtcacaccttcatcctcaggcattgattgacgtagtgatctaattgcttgtccaccttgtcacgctcagccattctgaacaagctcacttgctccggattcagtttactggcatggaacttgactcccactgcgaccaaaacagaatcaatacaacactagacagattatagccaaatttctcagtcttctgaattgaaagggctaagaggagtcacaaacccatgaactaatccatggtttccatgaatttttggccggacaaccatacatataaccatgaaatctttcagaaaaaaaagaagaagagaagaaaaacaatcggatgatgcagttacgtactgacggggatcatctgcggcggcacatgaacatgcgtgacgacgatggccgtggcccggaaatggccgagagcccacgacagcgtcgacctgccggacttcgcctccgccggcagcgccacgaacaccttctccggcgccgccatcgaccgaccttctcgtcaagcttagctccagttaatttaatgttcagttagcataagtacaaagctagcaagaacacgcggctttgggcgtacagaccggagactttggatggtgacaggcaccatatgcgaccgggaggaagaagaagaaggcaaaattaacagtgacacattaatttggacgacacggaaccgcatggagatttccaattttccaccaaaattaagtgatgattaattaactagcgccaatatcagcgtcatcgatagccttgtcattgaaaagaaaacttgcacatctcacagtcgcatcgttatataatttgtcttgtgccttgaccgtctccactgatcggttacatatactactaactccatattttaatgtatgacgccgttgactttttatctaacgtttaactattcgtcttattcaaaaaatttatgtaattattatttattttattgtgatttgattcatcatcaaatgttctttaagtatgacataaatatttttatatttgcacgaaatttttgaataaaacaaatggtcaaacgttgatcgaaaagtcaatgacgtcatacattaaaatgcggagggtgtacaaaattaatctgctgcttcggtttcaactaactgtttgaactcggaagggccgaagcacacggcaaggaaaggaaagggatttggcgggtggcaccgtgcacatcctgaacccccacagttcgttcaggtgtcttttcccggcaaattaattattaggattattactcatctgaataagtcccattgaataaactcctaatactttggtaatgacgttttgaaactttaatgaaatgatatcctccggcatcgtgaacatcgtgataacttcgctgattttttttttctttctttcttttcgctttttttttttaaaaaaaaagattatttgcacatgtgatgtgagaaaagatcagcggcccagatggcaagatgtgctaggcccataggaaacaaagtggcccatatagaacgtgtcacgtagcccaacattttcacggcccaaatttatatgggcctaattaggccgtcaggtttgtgcactatccggccgaaattgagtgggccaataccacagttccgtcatggttcgccggatgctccagcgtccaatcgccgccgccttcttccaggtcactattgcatatggagatacgaattttaatacgagtagttcagaaataaacatctaaacatcactgacttaaatttgtacattttatactgtaatcgagctgaaatacggatagaacgtacgtaatgcatggtgcgaataaactgtggaatgatgacgattcgacaggctagcattaataattaacttaatccatatatggttaaagaaatcagcatgcttatcacattaaatcatggagcctaaatcatgaatgtaagcatgttacgtcgctaccttaacttatctggtgcggactttgcagtttgcagtactctcttccagccattttgttcacacaacgatcgatctgtgtgtgttcatcatctctaatcgtattcacataaatggtagtctgatctgattaatattctgatggtgtgattaattaatataatcctgtaacgtgatcctggggatcagatctcagctcccgatgcaagcagctagctcaattaagcccataatttcttgtcttcttgtttctagctagaggcagtacgtggtatcgatcatcaagaacgtactcacagctggtgtactttcttcggaatcagaactcagtttttgttcgttagcgacctacttatatagagccaaaaggaaaatcggttgccacatgcatgtaagtgtgcaatccagctaggctacaattcatagatgtcagaccatctaagaactagttttaacagcagagtcaactattaagtataagctaatattacagataacgtttataatagatgaataataaggttatctctattttttctcctctctttctctcacctatgtatttaatttagttatcttaaattatgaatagttaactattacattagagctaacacaacttatttttccactatcctcccctccctgtaagttttatagttgacttatagcctactattaaactatttaaactagatcttgagcttatacttgctagttttacaattcttgttatttaaacaataacacaatcttcaaaatatatatttaactatatttttaatattatatataataaataaatatatttgtacttattttagcgccccacatccaacgttggcccactgcccctccatccccatggtatcggcaccgttttaattaggtgcctatttgcttgtctaggttcaccgtccaccgtcaaaccgtcatctctcacggccatccctctaaacccacccgatgatctgcctcctcctcccacccccaaccaatcctaacttgggaccctaaaccattactccactgccattcgtcgaggttatcggagatgtaggagaagggttgccagatctagtgaaggagttgtagtcattggagcacaaatcgtgtaggaaatataatcctgtggtaaaaaaaattgaaagattttgattgaagcaattccaattaaaattacaacatcaggcaagcaatataagaattttttttacaaatatacttattttttcaataatttacatttatatatatgcatacaaattttttgtaaaaatatacccatcccgcagaacgaaaatgcgggatcgcgacggtcccgcagcttcaaaacacgggaccgtcggtcccgcggacggccgcgcggcactgcaacggtcccgcagctccataacacgggactgtcgcggtcccgcagctccaatacgcggcaccgtgttgccagcgatttttatactgtgcgcactgttgaaacactgtttgggtactgttttgaaccgtgcgtggagcgcttccgcacattcaaactgcgggatcgcccatgaatattgccaaacagtacgaaaacagtactaaacagtgccgcgcagtataaattttctggtatatagcaggcgcgtggtagaggatgggaacgcgcggtcccgctcaacgactacgcgcgaccggtgcggttccgtgcatcggcgacgcgccgcgcaacggcgatgcgggaccgtctcgggaccacgcgttcccgcgctgcttctctccgagccacgagagcgagccggtgccgcgcttccgcgccgcgggagggagacggtgccgcacggccgtactgcgcaaccaccggtcccatggaatggcaaggcggcactgtctcggtcccgcatccttgtcatgcggtggaggtatatttatgcaaatattttttatgtagatatataaacgtaaaatatttttaaaagaggtatattttcagttttgtttcagcaatataatgtatcactttagagactcagaagaaatttttatcggcagatcaaacatttccacatatttcaacaaatgcaactggtcaactcgcttcaattccccgtgatgagtcggcgatcgatttccacgaatatctgttctctcctggcaaaatcttgtcctatctctcgcgaacacctggcccatgcacctacaacaaccaagcaatcattcatcatgcatgcaactagcaaccgcaaatacatccattctagccataatccggctataaataccagacgcccaaatcaaacgatgcaaagcaacacaagccgaccgaagcaaacatagctatagctagcacacaccactagctaattaagctcgctcgatcacttcatcagttagcaatggctatcaccaaggtcgctcccctcctcgccctcagcctcctcctcttcgccgtcgccgccgtgcacggctgcgagccctactgcggccacggtggcccggtcatcccgacgccgccggtggtggtgccgacgccgccgtcgtaccaccgccatggccgctgcccgatcgacgccctgaagctgagggtgtgcaccaacgtgctcaacgggctcgtcggcgtcaagatcggagccggccccgacgactgttgcccgctgctctccgggctcgccgacctcgacgccgccgtctgcctctgcaccgccgtcaaggccaacgtgctcggcatgaaactcaacctcgccgtcgatctaagcctcatcctcaacaagtgcggcaagatctgcccctccgacttcacctgctaattgagctcaaaccgtgcgtgcagcatgttggatatcatgattcatgagtttgatctttcatcccgattcccgacgcagcgttaaacattaatcttgaaataattctcttgtttactcgattcgccatttgcagctcgttctatattataatgtaaaattcttgaatcacttggttgttgtatattgtaacgcccattatatatagtagtattttttgttctcacaaagataactgccatatagcttacacgttcaccttaagttctttcttttctatccgtgcataaaaacactcgcacgatatgtgataatcatgggcgatgcggcaattcttgacctaactgttcctatttcctcaagccggtccacacatgttcctagccatgtgggtcctgcatcatggtagtctcttttggcccaacatgtcgcgtgcatctcgttttgtttgggatgttggcgggctgcttcctgttttggctgattagaagggttactaagttttgaatcctaataagggtaaagaagagatttgtacgtgacattgatgtgacatgtcatgctggcatagtcatgactgataaataggacccacttaaaatttttcatttttatttttttctttctcttttctctttttcctttttcttctcttgtttctctttttttccctttctcctccttcctctcaagaccatcgccgcatggggtgcttaggtcacaaagaaaggagaagaaaagaagaaaaaagagaagcagaagaaaaagagaagaaaagaaaaaaagaaaagaaaatgttttaagtggatcccgtttgtcagtcagatgactgccaatcacgtccatgtggcatgtcacatgagtgacatataggattttagatgggttgtgacgatctgggacttagatgacacacttcaataagttttgagatttatatttatattttaagagtttaggaatctgaatgacacaaaccatacaagtttaagaaccaggtgtggcaagatgtgcctacctaggtccacttcaaatagagcagctagcccatataacaatgtgtcataacccaaccaatatttccaaaacatatgaaaagagaaaaaaaacataaaagtagaatataatactcattcaattcctatgagattgaaacactggaaagtttcaaattgtttttgatgggcacacaggaaaaacacagaaaacatataggaaattgtaacatcccggcctaggacttaataggattaatagaatactcatatcaacaagttgcaacttcttttccggaagccaatctccaaaaaactccagggttaagcgtgcttggcctaaaattcttcccgggtgcacacgagtgaggacaaagtgtgcagaaaagacatgtgttggtctgtgagggcagtctatgacctatgaaagctatcagatataagcgggcctacctaggaaagctatcagatgtaagcgggcctggcctgggagaggcgggtcgttacagaaatagaaagaatgaattgagacttcaggctatttaatttcctccaaaatgtttctagaatagcacatttcatatgaattctgaaggaattattagtagaaatcaatccgttgttttaaaaggctttataggatttttatcatagaatacaaatcctgtaaaattcataagtttttctctcttttttttgaaagggccttcatgtctataccgtggagagcaaaaaaaaatttgagttaattgcactttggactaagaaaatttaacaaagttttactttggacaaggggtgaagttatattcactttggactagataaatttacaaaagttttaaattggaccacccttttttttgntttttttcccccccccaaaatttttccacttttttcccccctttctttgccttgttttctctattaagcagctgcgccatggatctgagggatgatcaagcaaagcaccaggattccttctctatgtgctctgttccccagcttgaagaaccatcaaaatcaagactggttttagctggttgctgtacctgtctcccgcaagctcgatgcaatgatttgttctaagctcagatgaacttttacggggaaaaaaggttgaagtcaagcagctaaatcaatgagtaaataaatcaagatcagatggaatattaattggtttgttgtgttgcgggtaagcccgccaatgaaatcaagaagtggcaaacaaaatagtggcccaatgtgcagtagaaggtaagaaaacctgaaccaaagtgaaaatgttagatataacctagtccaaaataaaacacaggcaataataatcggcccaaagtgcaattcactcaaaaaaaaaaatttatagctagcttagctcgatttgcagagcacttgacatactgactgagtgactgatgacgtaatggctcgaacaaactgtacacacgcatgtggaatgacgacgatgattcgacctgatgctagtattaattatttaattaaacccatactgttaaacaaattagcatgcttagcacattaatcatggagctagcctaataatgcatgttgccacctttctctgatgctggctagccattttgttcacatcgagtcagcctgttcatgtgatcgagtattcataatctgatccataatagtactattttgacggtgtgattaactaatataatcttgttcgtgatcctcgggatcagctccacaaagaaatatcagagtctaaactaaccagacaaagttataacgaccctcactttgcatgcatgtatgaaaaaaaaattagtgggaattcctcgcatggaattaagctcctatgatcatattgtcagtagcgaaggctaagacttagctgttctcaagctagatccatctttaggtacatccagctagccaatacaattcacggaggccatcccggctatgcgtgtacaaatggagcatattgactctgccagctcaagtacctaaaataatgcaggagagaggaatggatggatggttacgtatgacacgatgtatgcaaaattacaagtccatagcaagcatttcagaaagcattatattcagaacaagtattattcggcagatatataaagcacacatccatatattaatgtcaacaaatgcaactggtcaacttgcttcttccccatgaataatcgaattaattaaacgagaatatatgttctctctcctggcaaaatcttgtcctatctctcgtaaatacctggcccatgcagtacacaaccaagcaaataaatcatcacgtacatgcactacacaaccaaacaattaatcataacggatgcaaatattctactccctccttcaaaaaaaaaaacaaactctgggtttccatgtccaacgttgactatctattttatataaaaaattttataattaatatttttattgttgttagatgataaaacatgattaatattttatgcgtgacttgtctttttaatttttttaacaatttttttaaataagacggacggttaaacgttgaacacggaatcctaagatttgttttttttttgaacggagggagtaagcttcagctagttcagtacgtgtatagttccaaacagcaagctcgactcgatcggctataaatacctgacgccccaagcaaacgatgcaaagcaaacacaagctgaattgaagcagcctagctagctaattaacaccactagctaattaagctcgctcgatcacttcatcacttagcaatggcttccaccaaggtcgtcgctcccctcctcgccctcaccctcctgcttttcgccgtcgcggcgcacggctgtgagcccaactgctccggcggtggtccggtgatcccgacgccgacaacgccgtcgtacgaccgccatggccactgccccatcgacgccctgaagctgagggtgtgcgccaacgtgctcaatgggctcgtcggcgtcaagatcggagccggccccaacgagtgctgctcgctgctgcaggggatcgccgacctcgacgccgccgtctgcctctgcaccgccgtcaaggccaacgtgctgggcatcaacctgaatctccccgtcgatctgagcctcatcctcaacaagtgcagcaagatctacccatccggcttcacctgctaattgagctcgatcgtgcataattaatcttcatgcgatgacgaggattgatctgagttgcatgataaattaaagattaatcttgaaataattatattgttattcacttctacatttttgcagcccattctacattgtaccttactttatcattcttgaattacttaattgttgtaagttgtaacgcattatagcaatgttgttctccacatgataattgttatatagcttgtcctccttaatttctttctttttcatgtatgcaaaaaacgtgttcgtctcacagcgtttatctataccatctgtataattgacccacaaagtattaatactcaacaaagtaattattactactcttaaaacctaacatgcaagtatatcatatcaatccactaaataactaaagctcaagatgcaagcaagcatagcaattacatctataattttttacattctaaatcttaacattcaagcatgctaaatcatcatcccacatcactttcacaatatatcaacatataaatttatctatcatttatacaatgtttaacatatattcctctacatattccgtagcaaaacatgggacgtcatcgtatatttagtgataatggcgagtgaaaatgattgatctgtatctaacgatttcctcaaacaggcacacacatgtaagccatggggctaggcatgaatgcaggccttgcacgtaccatgctcgttttcggcctagtacctgtgtgcctcgtttcaacacaaagcacattcgacgtattggtgaacttctggttccgtcctattaaaatagtaactaagcttggtctgtctaaaaagggttagaaaagatgaatgacccaaatgacaagatgtgtctaactaggtccacttcaaatagagcaacccacagaacaatgtgtcataacccagtctttgcacaaaaaaaaaaacaattttatgtctgaagttaattgcttctaagccaactacaagaactagattataagctattaccgtccccagattctagggttaggggatcgtggctgggagagtggccttactctgtgttcccaacacagctgctgcgcacgaaaacgttaacggagcggtacattagaacgtgattaattaagtattagctaatttttgttcaaaaatagatcaatatgatctttttaagcaactttcgtataaaaactttttacaaaaaacacaccgttgagtagtttgaaaaatgtgcgcgcggaaaacaagaggagggagttgggaactcatggaaatgaacgcagccctgatcggctttacaagcatctgaccctaggaacaaattgtctttaattttctaaatgtttttcttcaattatatcgaaaataaaaaaaataatggttacattgtcgcacagctaattttcaatttttcagggtacgcaacatatgtcctacgggaaaaattataaactttagatgtcatgccgcaaatcttgcctacatgtttatagtggtaattgagcaaaattcctttgtatatgttcgtagactgcagaacacttgcatatgggatatgctgaaatactgacagagaacgtaatggttcgaataaacagtgtggaatgataacacgatcggagacctgctagcattaattaactaaaccgatatggctaaagaaacaagcatgcttagcacattaaatcatggagcccaaatcatgcatgtaagcatgttacgttgctagctacttaatttgtctggctcggacttactctcttccagcgattttgttcgatcaccgatctgtacgtgtgttcatctgtaaacatggataagcatggtagactgatctgataaattaatataatcctttaacgtggtcatggagatcacagctccgattccagtagccaaattaattaagcccataatttcttgtccaccatgtttctggaggcatagaggtcaagaattcacagctggtgtacttaatttgttcagaatcagaactccgttttaatttgttcattaaagacctaagagctaataaacggaagttaaaatcggtcgctacgtgcaggtaagtgcgcgtgcatggtcagctgggctacaaattttcatggaggtcactatgcgtgtatatatagagtatacattatagtgactctgcttaagctagctccgatccggccagtagtagattaatggtggaagaaattaaggaggctatgacactacgatatcgatgcacatttaggcaaaaataaaaactctccaaggcatgcaactatgtcagaaatgctcgatcagaacaagtattagtcagcagatacaaacacttccggccatatatt

SEQ ID NO: 7464 - DNA, 13148 bp, Oryza sativa
aacacttccggccatatatttcaacaaatgcaattcgtcaacttgcttgcttggccatgaatcgatcgacgatcgaactgaaagaatatcatttttccctccaggcaaaatcttttgtccaacctctcgcgaagtacaccagctggtccatgcagtacacaaccaagcaatcatatatatgtccatcatgcatgcctaacaacttagacagaacaaatatgtctttttacttgagagttaacggtcaacacacggttaaactgacggtagtggcatgaaagagtgcgcaaatttggaccaatggcatataagaaaagagccaatttccaatgatatataagagatccgaccaattttcagtggcatataaggatccgaccttattctagtcctctagctactactagttcagtacgcatagtttcccaacagagctagctcgatcggctcggctataaataccagatgccccaagcaaacgatacaaagcaaacacaatctgaaacagcctagctagctagctaacacaccactagctaattaagctcgctcgatcacttcatcagttagcattagcaatggcttccaccaccaaagtcgtagctcccctcctcgccttcaccctcctcatcctcgccgtcgcggcgcgcggctgtgagcccaactgctccggtggtccggtgatcccgacgccgacaacgccgtcgtacgaccgccatggccactggcccatcgacgccctgaagctgagggtgtgcgccaacgtgctcaatgggctcgttggcgtcaagatcggagccggccccaacgagtgctgctcgctgctgcaggggatcgccgacctcgacgccgccgtctgcctctgcaccgccgtcaaggccaatgtgctgggcatcaacctcaacctccccgtcgatctgagcctcatcctcaacaagtgcaacaagatctacccatccggcttcacctgctaattgagctcaaccatgcatgcataattagtcctcatgcaatgactggctctgaaggcttgagttgcatgattaaagattaattaatcttgaaataattatcttgtttactcgcttctgcatttgtggctagctcgttctatattgtattgtaccttactgtaccattaattctttaataatgattacttcattgttgtgagctaccttaatactccctctgtttcttataaggtgttttaactttgatcaaagtcaaactgtttgaccaaatttattaaaaaaagtaatatttttaacccatgataaatttattataaaaatatattttattattttttttataaaactaatttgttaatgtaaatattactatacttgtctataaacttagttaaatttgaagtagtttaactttgaccaaagtcaaaatatcttgtaacctaaaatggagggagtattgtttttcacgagatagctttcatatggcttgaaaaacgctctcacgacctatatatatttgatgttgatttattcacacatgtttaacacatataaagcggatcggaattttttgtattttttggaaaattcactggggggagagctttcccacctgaattcattaaaagggagcaaagggcagttttacaaagtccagagcattacatattgagagagcggagggaggaagaaaagagatctttccaggtcgaaattacatgtctgtcttctactttgatttccccccccccccaagagggaggcgtcctcgatacattgctgcagcaaacggcgcaaagagggagcctcgtgtctcaagacaaccccgtggtggtgattccacatgttccaaaagcatactccctccgtttcacaatgtaagtcattctaacatttcccatattcatattgatgttaatgaatctagatagatatatatgtatgtgggaaatactagaatgacttacattgtgaaacggaggaagtagcaagtagaacaccctaaagtgcttcaagggaacttgaggcggggtggggagagaagcaatctcagcaagcgtcgcaacattgaccggtatattcatcgcgccccataaggccacagcgaaggggcactggaagcatatataggtggagggctgtttcatcagcaaagttgcaaagatcacaggttggagccggcactatggttttcttatgcaagctgcgttttgttgggagacgatctttagtcaagagccaggcaaaaaaactgaactttccagttggggcacttctccatctcgtcgtattctgcaacaagataaagatgccttgtttttaagatcccaggggcgcctttcttggtgcgaacatcttgctgatcagtcactgagcactgcatcaagaagctgctaagatggttgaagtgccctggagcactgcggatcggaaatttggaatcgacctggagcatagctagtcgtaataacaaaaaagattttttttctcggtccgtattatgctcggactagctagctgtatgcgtttatccgcgtaacaaaaaaaataataatctgagatttccactagaacacaacgaatagagatcacgaaaataaacattatatatatatatatatatatatatatatatatatatatatatatatatattctttttgtcaaatttataatagcatgaatcaaattaatctctctgttttgaacaaccaactgatagagacaatcagatacaccatttcatacaaagtctgaaattaattaatcacaattcacaggtactgtacggattcggggtcgtcgtagtcccagtccccgaagatgacacggctcatgtcgatcttggtccactcctcctccatcgccgcctggatcgccgccgtctcagcgaagtagctctcgccgaccatgtagcagccgtcgttctcgacggcgcggcgaacctcctcctggaacgcctcgaactcgtcgcccagctcggcgtcctccacttccccctcgcgctcctccggcgagaggctctccatgtactcggggctccgccgtgggttcctcttcagtgtcaggatggaagcgacgtagttgtcaggcatccgcaccttcttcttcttcgcagcagcagcgcatggcttcttctgctagtcggcgacgacatacttggctgctccggcgatgacctgagcagcagcaggaggaggcgccgccgccgtcgctgccgagccggtgatcgccttcttctcctcctcttctgccatggtgtggatgtcgcgctcttgatccagcttactcgcgcgctccaccgccggcggtgctcgtcgtcgttaccctcgccggccgccgcgatgcgctcggtgattgccggcggcggtgggcggcgtcccgagctttatggggacaaatcccaattgatgagagatccgactcggattctgatctgatcttgctccggcctcaaaactaattgggccgggcctgcaggcctaacatattcccaaacgcagcatttttggtgggcttccctttcctgccggcccatgcttgaaatgattaatcagattaggcccgtttagaagaagacagcccaccttgctgcgttgccaccgtacgtagttcgacgccgtctccgtcgccggacgtccgccgcctgccagtgtacgatcctttgtcaatgcatgcacgtggttttcatacttaattcgattagatggccttaatttcatctaaaactgattcgagctactgaattattttaccgatcgattagctagctaaactggtaatataacaaacctagaaaatgagcatatatagcacagctcattatatcatggggataaaggtcgtagctctagctagttatacgttcgtcgtctggtgcagagacagcagacgacttccagctataagctagtttgttttcagttctcacttcagacttcagagttgtacagagttcagactttcagaccagtcggcaattagtcccacgcatccctgcattattcatcaaattgtccagccagtcgtacgtatttatttatatatatatatatatatatcttgcgtggatatacaatataatcctgtaaagctgttatgtaatctcctcgggataccagcttcaattcccatctttcaattaataatgccttagatatgcccatgcataatgcttctctgtacatttcttcagaattaactctgtttttcttttttctgtagagacctatacgtacaggctacagctaaagagaaaatcaaatcaacaggaaattatgcaaagttgcttaattggaaatgagtaatactttgccagaatacatccactgccacatgcatgcatgcatgaaaatgagcgacaaactggggtattaatcagagagctgaatatactatgtgcgtgtggagtatagcgtataccgtgcgcgcgcatatcctccagtgggctaagctccaaactcatcatcaagctgcagataataatctactccctccgtttcaggttacaagacattttaactttggttaatgtcaaactgttttaaatttaactaagtttataaataaatataataatatttataacactaaaatagtttcatcaaattaataattaaatatattttttctagaaacttggttaaatttaaagcagtttgattttgaccaaagtcaaaacgtcttataccctaaaactgaggaagtatcagttaactatacgcctatacctgctaatgaaccattatatgtgatattctgaatatatgtatatgtactgatatatgtgtgatttcagatattgtagttagttatcagcaagttcggcgcttgatctgagatatttactcgtatatatataaggtatataaacaacgtgacaggccacttagctgaaatatataaaactgtaagaaaaacaatagtcgatagatcgatcgtgaagttgtgtgatatatatatattgcgcaaatatattaggcttagatactggacatgattgataaattgctgctctgcacgtacgcctatgcatggctgaaataattaatcaacaaccaatctagctagccatttccttcacggaaaaatccttgtcgcatctgatctctagcaaaacaagcggcccatgcccatgcatgcaaatccatccatggacacaaacccagtgcacatgcatcgtgcatgcaactagctgcagtgttcatctataaataccagacgcctcagccccaatccaaaacacaagctaattaaagcagccttagctagctaattaactctactagctaagctcgatcacttcatcacacttgagcaatggcttattccaagatcgctcccctcctcgccctgaccatcctcctcttcgccgccgctgcgcacggctgcgcgccatactgccccggaggggcgccgccggtcatcccgacgccgccggtggtggtgtcgacgccggcgttgtaacaccaccacggcggccacgggcatgggcgctgcccgatcgacgccttgaagctgagggtgtgtgccaacgtgctcaacgggctcgtcggcgtcaagatcggagctggccccgacgactgctgcccgctgctgtccggcctagccgacctcgacgccgccgtctgcctctgcaccgccatcaaggccaacgttcttgggatcatcaacctcaacatccccgtcgatctcagcctcatcctcaacaactgcggcaagatctgtccctccgatttcacctgctaattaagctcagctgctcaagcttgcatacatggacaaatgcgcagaaacaatattcgtaattaagcttatctatttcattcgatgatggctagctagctagctgcatgcatgccgtggctatgtcatccagaataagatgtgttgttgttttactctgttcccttatatcaattttgtattgtgttgtattgtattcgaattgaatgagttaacgagttttgtaaaaccgatttgtgcttcatcaatgaaatatctgtggtgtaagattgttgtgacaacgattattaccagcaagatagtatagtagtactaatcatcattaacacattcgctttgtgcttcatgacaccatgaagcacaaaggcccatcctatacaaaataaatgcgattaggcggcccatggggccaaatccggctaacccaagcgatcgaaatttggatgggcctaacttctctccgcgcacatccgcgttaatgggccggggcgcgacgggatggcccatggctggctcgatccatcagcagccacgcgcgcatggtgatttctcgccggaacgccgccgccgtcgagcttgcgttcgtcgtccgtccaccgctgcagcctccgtccgattcttgcatgaatccgtacgacgtcttcttgtccagcaaaagatggagaatcactgcgccattgcgaccaacatgctagcagcgcgcacgcatatgcatgcaaaggagctttgaattaactaggagtagcattttctttcctccccaccgccatgaacatgaatgcttcttaggcactgttattttctctaacaaaaactggataaaagtggcgcgctttttaaactgctaaacggtgtgttttgtgtgaaaactttctatattaaagttgttctaaaatataagattgattcatttttcaagtttgtaataattaaaaactcaattaatcacatgttattaccacctcattttgcgtgaagcacttaatttttatcttcatctacatcttcaggagattcaaacactgtcttggtgtgactagataacggtataccattcaatcaatggaatattttacatgctgatgtcaccatgatattagcatgataccgtaggtaccaatactcacatgtattaggttatggcacctaagtagcattttaatgttagcagataccttaggtacgggtccgtccggtatcaagagtacccgacgtgatacccatataccagatctggtatctaggtaacatgatgacattaggatggtgtttacaaatgtaaactatatcggatagcattttatagtatttccgtagcatagtactctctctttcggaatgttagatattttggtgaaatttgactaaatttatagaaaaatataataacatccacaatagcaaattaattttattaaacctactattaaatatatttttataatatatttggttggtctaaaccatgttaattactacttttcttatataaatttgacttcagattaaaagctaaacatcttacgttctaaaacagagggattagataacactaaattatcatgattattacaacactgtggctgattttatccggtctatatatcctttaattttcagcctgtcggtgcgtgagaaccattttcgcatgcttgtattcgtgtttgtcttttggccgggcctcataatgttgactatatatgtatcgtgcatatgatacgtgtatataaattaaagaaaaaaaaaccctgaaaggctgcaatgcgtgtaaccgtatcgaaaagcttcaggcccggttgtcatgcccatgatttctgctttgtcgtccttctcacgtcgttgcagtttgcagattgtagagttagtatctacaagtcatctactcacacaagatgactctttaaagaactgttcattgttcaacactgtcacaataataatatatcatggacagtgtactccttttcagaactctcttttgttgtttagcaatcactggggcgaaaaaatagctggaataataatcaaactgtgcatatgtatatatattaattagtttgcttgcaatggagaacaaatgccttgtgtcaatgcgttgtacacaacacatcacgacatgcagaaaaagtgtgctgcaaaccagctgggtactggggctacacacacctatctattattcatcctgcaagctcacatatgctgcatgtactcgtcgatcgacatagatggtccggcacaaccaatggcagtgggtgttttcaacacctctcgatctgcagctgatctcaacagtttattttatatgatggtgtaaccatctaatataccatgttgctgataatttttaaccagagcaattaatcggagcatggccctagtgttgaacaatttgcactttcacagtcaggtgtaacattttgtacattcagcataatggtatgctctttgcgctttttcagcccttgtgtaacacagcaggatttcaaaaacacaaggataaaaaaacgtataaatagaatagcatgccacaacaaatcatacaggatttttttaaagaaatgttacaggaaatgaatccactgaatttttttttttaaaaaaaagtttggtaacaccataggagaagtaaaggaattaggagtcacgactcatgatgaagagaaaacatgagatttaggctcatgttaattttcctccaaaatttgttgaaatgagccattccatatgaatttcaaaggattttatatgagtcattcatttgttcgtaaggacaatataggaacatttttcaatgaattgtaatcctctataatttctacagttctcctttatcccaaaggaatctttacgtacgcacaggtaaaattgggactcccatgatcccatctttaccagaaggggcgagctagaggattgccgtgcgtaaatttgcacggtgctagctagctagattttgaaagtagatgaaccgatatataacactttgggtttcatactttcattagtccacatgaacatcgaaccctagcttagacacggcataaatcgatcgaggcatggacgcatgtatcagtatttgcatgattgctcgatcgagattatattaccctcttacacatgcatgcatgggggaataattcaacaacgtctgaatgtctgattcctcatggaaaattccttgtcacatctctttctctgagtactctaacgaacaactggccatgtatgcacatgcaccccagagacaacctagctacgtaccctgcatctgacacccccacatgcacgtaccattgcatctgcttacttcggattgataatacttacagtgaacaacacggtctcttaaaaaatagctttgattactatttctattataatatatatagaaatattaacaaatatataattttattagatcttaacaagcatttctccatattcatccctgaaagttggtttttataggacgagaggagtacatattttttaagaaaattattttataaattatttataatcaaatattttaaaattcgatcttaattttgtccgaaacaacgagtattataagagcttatttggtagagctccaactcctaaatttagcttcaagagttagatctgaagtagagttatatgaagctgcttaaacccaactttgcatgtctagttcattttggagatagctctacacagctcagctgaaattgtttggtgaagctagagctgtgccaaacagggcctccgtctggagagaaagtagcaacgcatccatgcaaaccactcttgctataggctcgatcggctataaatacaagacgccatgacaccccaagcaaaccaacccaaagcaacacaagccatagcagcagagccgagtagctgagctcactgttcgatcgatcactagctcgctagctgcatccatggctgcttccaaggtcgctcccgtcctggccctgagcctcctcctcctcgccgtcgcggcgcacggctgcgagccccactgctccggcggcggcgcgccggcggtcgtcataccgacgccgacggtggtggtgccactgccgtcgttcggcggcgcccatggcggctacggcggctacggccatggccgctgcccgatcgacgcgctgaagctgcgggtgtgcgccaacgtgctcaacggcgcgctcggcgtgaacgtcggccatggcccctacgactgctgcccgctgctcgccggcctcgccgacgccgacgccgccgtctgcctctgcaccgccgtgaaggccaacgtgctcggcgtcaacctcaacgtccccgtcgagctcaagctcatcctcaacaagtgcggcaagacctgcccctccgacttcacctgctaattaattgagcatggaaagtgctcaaaccatttgcgcaaaattaatgcatatttatattatatttaattgagtttgttttcatgcaatggccattggtaagttgcatgatgcatgagtaagccggcctgaataagctattatccccccttgtgttagtttaattaatttgttgcatccgcattaatttgttgtaccattggaatcactcacttgtaatttgttgttgtataaccaatgcattgtgatcatcatcaattaatatattttcatttttaatatgatcgttctttctgatctatgaacacgtaagatcgatcgatcgatcaagctaatgaatctgacgaccatatcatggcgaagcatcaattctgaatttctgtttgtgaccacaaccgaatcgatccggagcgcaacaacagaagccgcgcgcagtgctcaaactggggctgtgggctgtggcccacatatgcagacatcgcgactaaagggcccggcccattcgttgcacggcccaaacacacatgaatctgctgcggggtcatcctcctagagtcgaaccacaggatttcaatctaacggtgcaggacatgacggcacagaacggccccatctcacgtccttcctggaatccgccgccgtccgccggagctccgccgccatccgttcaccggcattgttacacagaccccttatcctactccaacttcttctcgatggcattccacccagcttgtgactcgcgactttgtgagtacatgataaaaaaaacttaaaattcagatagatattctgacatgaaaattgaatgatctcatcttttcgcttatgcttatacttgttagctaaaatttgaatttttaaccttaaatttgaagttgattttgaggtttttttcatcgaagtttatttttcaatcgactccactgctccagaagtgtgaagcacatgaaggtaaggttcagtcagtcatgggtgcatcacaactcacaagttcacacctcttacatcttgagatgcatcgatcacacggggcacagcaaaaatcagctagctagctcattggttcgggattaattgcatctcaagagttcagacttcagtcttcagaggcaatgaccgtccttccctctttggatcaatttcagatgaatattgagtgtggtccacaaattttggaccaaattaattaaaacgatcatttgggacttgggagcgcctttacaaaccaccgctagatcagaagcgaagaccacagattgaagatgaattaattcatttatttgtgtacaattaggttctacattgatcgagctgcataggtgcccgcaccaatcggacaaagccacacacatatatagtgatcccattaatttgcccatcgaatgatgacgcgacggcgccgaatctaataatgccctgaccctatggtctccggcacatacatgcctcgtcatatgagcttacttaattaagcaccgcaaacttgaaggtgaaggtgtacttcacatgaacattacagatcgatcgatgccacttcattcgtgcacggatatactgtatgcaccaatattgtcgaccacaagatcgtttaagagtacaggtagaatacccagatatatagcttagttaattattaagtccgtccaaaaatatactctctctgtttttctctctgttttaggttataagatttttgattttagtcaaaatcaaactgttttaaatttaatagataaatatagcaatatttatattatcaaattagttttattatattaataattaaatatattttataataattttatcttggattgaaaatattattatttttttctataaatttggttaaacttaaagcagtttgactttaaccaaagtcaaaaacatcttgtaacctgaaacggagagagtaacaacctaatttctatccagattcgtgatactaaaatgtatcagtatctagtattatgttgttatgtaattgccggaacaacaaatgccgggccgactcaagcaaatgcatgcctagctcactcactcagctcagctcaatcccctgctataaattcactagctagcttgtgcactgcacacaacacacacactgaactctcacataaacacttcaactcatcccttagctagagctatagctagtgtgtcaattagcaatggcggtggcgcacaagaacagtagtagaaacaagcttgcagtcgccgccattgtggcgctgatgagcctcctcgtgttcgccgcggcgccgtcggaggcatgcggcggccgctgcaacggcggcgcctgcagatcgcggtgcgccaaaccgacgccggcgccggcgcgccgcgccgccggcgccaagtgcccgttcgacgcgctgaagctggcggcgtgcgccgacgtgctgggcggcggcggcggaagaagaagggctgctgaacctgggccatctgctggggaactcgtcgccgtcgtcctccggcgagcagtgctgcgggctcctcgccggcctcgccgacgtggacgccgccgtgtgcctttgcacggcgctgcgcgccaacgtgctcggcctcgtcggcgtcgagccgcacgtccagctcagcgtcctcgtcaaccgctgcagcaggaagctccccaatggcttccagtgctccagcaactagctaattaagctagctaatttgattatatctgaattaattagtgcttgatgagcagctcatgcagctattgttattgttcgcttatttgatttgttgttaattgctttcggtgtcgtgtgtgatcgtgtagcgcatgcttactactttgatgaccgatgttgagttaattaattcctgtgcttgagtgagtgacattacatctacatgtacctcggagttgatttgtgcttttgcgtgctaaagttcgttataaaaatcttgtgttgaatatatgttgctcgagtaatataccgtatatgtgattctgaatctgagctgaatatggaatagtcagtgtttaatctgcatgcatggagcaagattccgagaaagggtaccgagctcgaattcgcca

SEQ ID NO: 7465 - DNA, 6981 bp, Oryza sativa
  unsure (1)..(6981): unsure at all n locations
cggtgtcgtgtgtgatcgtgtagcgcatgcttactactttgatgaccgatgttgagttaattaattcctgtgcttgagtgagtgacattacatctacatgtacctcggagttgatttgtgcttttgcgtgctaaagttcgttataaaaatcttgtgttgaatatatgttgctcgagtaatataccgtatatgtgattctgaatctgagctgaatatggaatagtcagtgtttaatctgcatgcatggagcaagattccgagaaacaaccggtgagtaaactagcgagaatctgaaaaggaatgagtttgccaacttttgaaattctgcaactacaaattatcagaatgcaagtcaaaatatggaatgtttagagcaaccggggattattctcaaagttaaagctgctataggcacccccaaaacagggccaagagctggtttggaaacaatgccagaatccataactcgtctcatttctacagcttaaagccaggttgcacctatagaacattgcccaacagatgaatggcgcaaaccgtggttcagactccagggcattctgtaagaagttacagggcaaatataggcacttgaaaattctaactttaaatcgtcaagagtcaattccttagcatgtgcaatagttgctcaaagacactcatcgcattattatagaacaaagccatgcttggcaggattcagcaaatcacaagattgtaacttataaaaatacagcgacaacaaagacaaccatcaggaacattggaattgtcctgtttttttctctgattaaagaaggcaagagaattcagtccatcacatcacttgaggaagtggggtcttcttctatggtctatcaccaagttcctctctcaaattgtcaaatgggtagacttttggagtctgcatgaagaaatataaaaaatcctcagtcaagttgttcataaaagcaaatcaaaagcagacaggcatcatttgtcgtgattaggatgaaccattatcttaacttgatccggtctatgctcagaaatagtatgcatatttctttgcccattggcgacaaaatatgcaacaggcttgctactgtaacaagtgttactttaatgactgatcgcacaatctaatagcattctggcaaatataaggagataaattgaaaatacagtattgccccctctcttttgtgaaccttcattcttcaattaagttacagacctggaacactgaagaggcaagttgcttaacatgtatagtaactctgctatctgctgacacttttaaggagcaaatcaactcttggggggatttcatctatggcagagaagcaacttagagaaagtaagagactgtgtagcctgtacggagtatcgaacacggataatatgtacaaataaaatcctacatgcttcaaagttcgcaacagtttagcctaccacaccatgtcaccatgatatctctatgaactatgaagctagaccaaacacctccctttttcccctaaaaaaaactcccttttcagaatcgaaattggataggtgctgagaaaggagactaataggtcagaaaattgaagggttaaagagttctacaaagaccacacaaagttattatcacagccccactccatgattcaactcaaactagtgcctagtatgatcacattgaggtaatatttagtgttacatatagaccaacagaacatgataatcaatactactacctccatttcacaatgtaagactttctaacattgtccatattcatatagatgttaatgaatttagacgcatatttgtgtttatattcattaacatctatatgaatatgggtaatgctagaaagtcttacattgtgaaacggagggagtacaattcaagtaatataaatcaaggcttttacatatgaggaaacacaatgaagttatatttacagaagatgctaaaatatagagtgcatggcctgatcaagaagtaaatttaggcatagtgagtaaaatgttccctaagaatatcacagattctataaaataacacctcatacaatatcctctcatccaaaaacatttgaaggcagctaataagggtgactaaattcagcttgctaacagagagtggcaatacgccatatatatttgtaactgtttgatacaagaggataagagcacatgactgattgcatttaggatttaaaatatacatccttcaaaaatgccatctattcatcatattttcttacagtacaactaggtctatgattgtttagtctagtgatgatttctttttatgaaaatggacaacaatgatctcaattccattaaatcattttcaaactcttttttttccctcttttgctgattctataaattggagggtaggaacaatataaaattactctttgctatatgactatatacctaggagcaatatagaattacttcccagtatatactatatagtagcaaggaacagatcgaacccaaggagctattgttcaacagaaaacttcaatgtgcattgttaattcaataatataattaatgcagatgatcagcatactcccttagtggcctaatcctcatagaagttatctggaggcaaaatcttctaacttgagaatgactagatataacatttagacatattaactgtgccacctagagaatcatgtgagcaaaatggaaggaaaggaatttgcagaaacaacggcaggtcctaatgggcgaaataaaggtttaactatgacacagggattgaatcacagtggccatttcccatcttaatgttttccccatccctgcaatgttttcttggctatttggtctaaccttacagtattactttgttcactcctactgttgttgaaatgctagcaattctactgtttgtccatccaacagaaagtaaaatatcacaatgaagtatttggcactcacataggggatcttggaggccttgtcgttcaaggtggcagccaagccaagagtagcgaagaatccgagcccaccgcaaagccaggccagcgcctcgtactgaccaaatagcatcacatcaaatcaaaccagatgagacccccacgaatccatgtgattcagtgcatgagggttgggaatcagaccttgccgatgtgcggcgcgaggcggtcgatgcagggctccgggaagggcgtgccgttgtcccacaccagctcgtcgttcgtcggcagctgcaaattccccaaatccccccgcaaatcgaatcgattagatggagaaatcgcatcggcggagagagaaatcggaggagcacaaggtcgatgagagggggggggagaggtgtggcgagagacggcttacgggcttgtcggggacgatgtgcctgccgacggggaggcccatgccggcgcggtggcggagcgcggacaccccggcgcgggcagcggcgccctggccgcccaggacgcgggatcccgccgcggtcagcctccctgccattcccacctcgctctcgctctcgcctctcggatctgcgcgtgcggttgtgggtgacgtcgtctcgtgtgcggttgtgctcgtcggcggcggcggcggagaggaggaagacgcaggagtgtaggtgggcttcagttcagccttcgcattgtgggcccgtgggccgagtggagaaggcaagtattgggtcaaccaaacggcctagtcgctgcatggcccaaacgcctcttttgggggttcggagaataaaaccacagcaatcatcacacgcgcatcagcgatatatattttttattttttttgttttttgttgccgttttggtttgatcggttgatccgaaaactggatatgagaaattgtcggacgaaatttgcactttctggctaggtgactgctgatggagtcacacgtacatattcagttcagttgttaaggctgtgtttagttcctaaaattgagaagaagtttaagaaaagttaatagttttaaaaaaaagttgagagtttatgtgagtagaaaaattttgtatttaatgcgatgtgatggaaagttggaagtttaggaaaagtttaatgtgaattaaacagggtctaaggtgatgagctgctagctactactcctaccttgcaaatgttgccaaaatgaactagctagggcatgaattatgggatcagcgatcagtataggtttcagaaagcgcacaaacatttccactcaacagtacagtacgcgcggttggacgagccataattaattcagatatacagtatgctgctccgtttggttaattccaggtcgccattattaaagtaggtcatgagataacagtccctccatctctgtcactaagagcacccacaatctatctaataaaacatgtacatctcagcaatagactagattaatagtaaaccacctcaatagtatgtctacatgggtatctatagctctctaatccattgtctcgtttttctctatagactatctctaggttagtagataattttgctctctctctttatttaatctctttcaagtaggaaaatatgctgacatggatctcttatagatagcctataaataaccattgtgggtgccctaacagctactccctccgtcccaaaaaaaaggcaaactctgggtttccgtgccaacgtttgactgtccgtcttatatgaaatttttttataattattatttttattgttgttagatgataaaacatgattaatactttatacgtgacttatctttttaattttttttataatttttttaaataaggcgaatgatcaaatgttagacacggaaactagggtttatcttttttttggacggatggagtaggagtattcaggtcatgactcatgagtgctatctgtctctacggtatttctgaagaaaaccacacggcaaatggcacaagtcaatcctacgtgctccactgtagaatctagtcctatagtcccatatactcttgacaagtactgttgcttattgtgatatcataatgcaattagtactttattacttattagtgagtactcctacgttcagaagcaacttattagttaactgactaactgcatatttaattaagcggctaagttgcgcgcggttctttacccatcaaattgcataatctgtaatgcggttccaagaacagcttgagtaaaatgagacagagatccagtctcactcgctcaccgaaaacatgaaaattcagaacgtacagtctgcaagaaatctcctcgcactcgccgacgtccgtgctatccgtacgtctccggcggcgacccctcctaggattgacacacagtgagaggggccgcgtggacccagtctctttttagcccaaatgtctccttggggattccacctccgacgaaccactgggcacttgcatttgttcggggtttagccttcatccgaaatctgaaaacgagtaattcggagatctcctctgacatccgagaattgatgcagatcatgcatcaccgtgtgtgtttagttcacgtcaaaattaaaaatttggttaaaatttgaacgatgtgatgaaaaagttagaagtttatgtgtgtagaaaagtttggatgtgatgaaaaagttaaaagtttgaagaaaaatgtcaggataagcaaggaagctgacgttaccaataggaggcgcgataaggactctgacgaaggcggaggagcagaagacggaggagcagaaggcgtctttgaaagagagaagcgccagagtattactaatcctagatatgttgggccggaatgggccgtgtaatagggtagagtgggctgagaccttgtggcacagctggagagagagagagagagattaaaaactactgtgtactgtctgaaacggcatcgatctggaactcggcggtcaaggcagcggcggcggctccgatcctgttggatcgtgagagaaatacaaagttccagctacctatcgtgttcttgagttcgtggtgaaatcgagtgctagggttctaacaatctggtatcagagccatctccaaccatatcctcttgactcggccgtagaatcacgaagcgcggattggaatctgctctcgagcagaatccgcaaaaagggaactcgcttcccttgctgcgtttgggttggctgagttcggagcggttgcgagtctttgatcctggagaaaccacggtacgttacgaagtaggctgcgcaaatcatggcgtaggaagggatgttggattggctgcttaaaaccctggaggatattgagaagatgcggactgagccggaagaaagaaccagagcagatctgaatgagttcatggcggcggtgaaagcgaggttgcctcaagtaaagaaacgagttggggatttgcattcgtcgctgggggatttgagtgctaaggtggaacaactggagagcgccatgcttcgtcaggccaaggcgaaaaaggcggtgggagacatcaaggaggaaccaacagctgcatcgccatcaccaactccatcgtttatccatggtatgagagatcctatgttgaattctatttcgccttttgtggtagaatcagcaggagtaccagaagggggtagtgaaagtactgaaattattgttgaaagtgttccacccatgacatgtcctcagttcaatggggataatccacagatgtggaaggctaattgtgaagtgtatttcaatgtttacggcattcctcctgggcagtgggttaaggtggctacgctgaattttgttggcaacgcagcattttggttgcaatctgtgcgaaaccagttgattggcattacttggtttgatttatgtgaaagagtctgtgctcgatttactcgagataggcatgaagctatggtgagacaatatatacacatcaggcaaaccaattcagtttcagaatatgtagagcgattcgactgtctaatgcatcggctgttggcatatgnnnnnnnnnnnnnnnnnnnnnnnnnnnnnnnnnnnnnnnnnnnnnnnnnnnnnnnnnnnnn

SEQ ID NO: 7466 - DNA, 10697 bp, Oryza sativa
  unsure (1)..(10697): unsure at all n locations
cgaaaccagttgattggcattacttggtttgatttatgtgaaagagtctgtgctcgatttactcgagataggcatgaagctatggtgagacaatatatacacatcaggcaaaccaattcagtttcagaatatgtagagcgattcgactgtctaatgcatcggctgttggcatatgaccagactgtgcctgcattgtactttgtcacaaaatttgttgatggccttaaggatgaggtgaggagatctgttatgatgatgaggccccaagatatggatgtggcctgttctctggctttgttacaggaagaagctatggaaggaagtagacccacaccttataagaggactgaaggcagcaattatgtcaagacatccagcaagctcacagccccaactctgtctatgacaagagaaccaaaccaaatcaacactgaagaaaggagaactgctgattctaacagaccaaaggaagataggctggcagcattaaaggcgtataggaggtcgaaaggcttatgtttcacttgtggggagagatgggggagagaccataagtgtgcaactgcagtacaattgcatgttgttcaagagttgttggaagttttacagggggattcaggggaggactcacctactgaaagttcaccagaaagggaagatatcattgttatggccatatctcagcaagcgttaaatggaactgagtcacgcaactccatcagacttagggggtggatacaagggactgaactattgatgttaattgattcgggaagctcccactcttttattgatgagaaaattgggaaatctatgtctggggtaaaattgttgactaaacccttgaaagtccaaattgctgatggaggagagttagtgtgctctcaggtaattcctaactgtagttggtggacacaggggcacaactttagtaatgatttcaagcttatcccactgggaggttatgacataattcttggaatggattggttagagcagtatagccccatgaaaatttattgggttaacaaatgggtggagtttcagtaccaaaatcagtggctcagagtattgggaatcagcagtagcactactagctatgcagaaatatctgtggaacaattgatgagtttggccaagatgggctctattatgtacatggtgaaaatcactgaccaccaaaacacagaagagcagtcctatccagatagcattaagcagattctcttggaatatcatgatgtctttgatgaaccatctgaactaccaccagaaaggtactgtgatcatcagattcccttgatagaaggtgccaaaccagtaagtcttaggccctacaagtataaccccgaactcaaagatgaaattgaacgtcaggtgaaggagatgttagactcaggggtaattcaaccaagtcagagtgcttggtcttcccctgctcttttggtgaggaagaaggatggtacctggcgcctttgtgtagattacagacacctgaatgccttaactgtcaagagcaagtacccagtgcctataatagaagaacttcttgatgaattgtcagggtccaaatggttcactaaactggaccttcgagcaggatatcatcaaattaggatgaaacctggagaggaacataagactgcattccagacacacttaggtcattatgaatacaaggtcatgtcctttggattaattggggcacctgctagttttcaaggggccatgaatgacacattgtcttcagtgctcaggaagtgtgctttggtattttttgacgacatcctgatatacagtcctgaccttcagtcacactgccagcacttaacacaagttttacaactccttagaagagatcactggcaagtcaaaatcagtaagtgtagttttgctcagcaacaagtatcatatttgggacatgtaattggggttcatggtgtgtctacagaacctagaaaaattttggatgttcagaattgggcagtacccactactgtcaagaagctcaggggatttctggggctggctggttattaccggaagtttgttaaggattttggtttgatctgtaaacctcttactcagttgttaaggaagggagtccctttcaaatggnnnnnnnnnnnnnnnnnnnnnnnnnnnnagatcaagcaagctctcattactgctcctgtcttagcattaccaactttaattttcctttcattgtggagacggatgctagtgatggaggcataggggcagtgttatctcaagaaggtcatccaattgcttacttgagtaaagctctaggaccaagatctaaagggttgtcaacttatgagaaggagtgcatggcaatactcttggcagtagaacactggagatcttatctacagcaccaagaattcatgattctcactgatcaccacagtttgactcatctgtctgatcaacggcttcatacaccttggcagcaaaaggcatttactaagctcctggggctccagtacagaattgtctatagaaagggcagtgctaattcagctgctgatgccctgtctagaaaagaccttggtgacagtgctcagattctggctgtatcttcttgttctccctcttggctccaagaggtaatacagggctatgagcaggacaagttctcttcccagctcttagctgaattgtctttgaatccgaaggctagggagcattatactctgcagcaaggcctcattaggtacaagggtcgaatatgggtgggtaataacacagatctgcagctgaaattgatcaaggaattacatgataatcctgctgggggccactctggttttcctgtcacttataggaggattaaacatctgtttgcttggttgggaatgaagcagcaaattcagcaacaactgaagcaatgtcagatctgtcaacaggccaaacctgagagggttaaatacccaggtctattgcaacctcttcctgttccaaagggtgcttggcaagtgatcagcatggatttcatagaaggattacccacttctgacaagtataactgcattctagtggtggtagacaaattctctaaatatgcccatttcttaccattgacccatccatttactgcattctctgtggccactgtctttatgaagaatgtttacaagctccatggtatgcctcaagtcattatctctgacagagatagggtattcacaagtcaactctgggaacatttattcaccaagtctggtactaagcttcacatgagctcttcttaccaccctcaaacagacggtcaaactgagcgggtgaatcggtgcttggaaatttttctgaggtgctttatacatgtaactccaactaagtgggccaattggttatatctcgctgagttttggtacaacacttcctatcactcttctgtgcataaaacaccttttgaggtcatttataggtaccagccgactcactttggcatctctatgcatgactgtgaaataccagatttggatttgtggttgaaggatagggatctcatcaatcagctaattcaacaacatttacatcaagctgagcaacaaatgaaagcttatgccgacaagaatcgtactttcagggagttccaggagggagactgggtttacttgaaactccaaccatatgtgcagtcttcagtagcacgcagagcaaaccataaactatctttcaagtactttggaccttttcaagtgttgcagcgggtgggattagttgcttataaactggctttacctccctcttgccacattcacctagttatccatgtctctcagctcaaggttgctcgtggctataatcctcatgttctgtctaccgaaccatttcagtggaaccattggcagagtccgcagcagttcctagacaggcgcattactaagaaaggcactggcttgggggcaagccggtttccaaggaagggagaatgtcaggataagcaaggaagctgacgttaccaagaggaggcgcgacaaggactctgacgaagtacaggatgaaggcggaggagcagaaggcgtctttgaaagagagaagcaccagcgtattactaatcctagatatgttgggccggaaggggccatgtaataggctagagtgggctgagaccttgtggtatggctgaagagagagagagagagagagagagagagagagagagagagagagagagagagagagagagatttaaaactactgtgtactgtctgaaacggcatcgatctggaactcggcggtgaaggcagcggcggctccgatcctgttggatcgtgagagaaatacaaagttccagctacctatcgtgttcttgagttcgtggtgaaatcgagtgctagggttctaacaaaaaagtttggaactaaagccactatttggttgattcgaggccgccattatccaagtcggtcacataataacaagagcaccctgagtcattgatgtctatatatatcagcatcagagtcatttaccgttgaatatctcccaaaatgtgatatcattcatcagatactgcgatatcgtcactcaattgcttagtggtacattcgaagcgagctaactcaactactctcttcctcctaaatatatgacgctgttgactcttggtataaagtttggacatttatcttatccataaaaaaatgtataaatatgttgtgatttgttttatcatccaagaaactacagtctaaaccttttttttacatatttatactagatttttaataagacgaatagtcaagtgttatgcaaaaagtcaacggtgtcatacatattgaaatgaaaattctacttaaccgaactatcactgcataattaagaaagccaggttgcagtgtaatgcagtccaacaacaagcctgaaatcattctgctctctagtctgtaatgcagtcgaagaacaagccgtgaacattcagctaggagaagtggaaaacctgacagataatcagtcttactgaacagggaagctgctgattctgataatatctgaacaacctttgcgcgaaatcggcgctgcctcgtcgcagctaccggcgactccccgcgctccataatccgtcgctcgtcgtcgccatcgccggcggcaacttttcttaggattgatggagagagacgggccagcgattggcccaaactcctcttgggattggcccctccgccactggtattatctgcaaaaaaaaaattcatgaatgacttatgtgcaaatcaataaatcatgccgaatattaggagaaaaaaagtttaatctgcatcagatccgtacaatccaatcacaagtactgctctttgttgaaattgaaattaaatccctagtaaacattgaaacccaagtttaaagcttcagaagaacacgacgtttaatttcaactaaggccttgtttagtttcaaactttttctttaaactttcaattctttcatcacatcaaaacttttctacacgtataaactttcaacttttccgccacgtcgttccaatttcaaccaaactttcaattttagcgtaaactaaacacaccttaaccacacctgctaatcgactggttccatgtcggaagagacagaattaatgcagaccatgcagcactgttttgtttaattccaggtcgctattttcgaagtcggtgagattacaacactgacgtctctttcagcatcagccctactgccataagtcaaccctatcagtacatactctccactgtagattcgagccagctaccattgaatttctccatacactgtcgttgcttactgtggtatcatcacgcaatttttcagtgcattcgaagcgagcagttaactgaactatcgctgcgtaattatgcagccaagtttgagcgttactgcagtaaaaaaaaaaacaaaaacaaggtttggagggagagttgtcccttgaaacattttttaagaagagattgtaaacctattgagaatcaaacatggaattataaattgaaatcacacacttcttatcaccgtattatcaaggacatcttataaccgcagtcgaagaacaagcctatctcgttctcccctgtaatgcatgctgtgcagatcaagaacaactgaacaagtcgtcaacttttagctaggaaaacgaaacacagattaagtcttattaaatctgattctgatttctcgttctcccctgtaaattaaatctgattctgatttctgaacagtctttgcatcaaatcggtgctggcttcgtcgcagctaccgcgtgtggtgggccagtgactgggccatttactgacgaaacggcccattctccttttggcccaaacgcctcttgacaggttcggaccccccgctcgcgcggcaaccggaaatcatgaacgacttgtgtgcaaatcataccgaaagattagggaaataatttaatttgcatcatggggtagtgtaattctcgttctcctcaaaaaattcgtaatcagaagtactgctcttaatttgtagaaattgagattagtcgctaatcacttgtcagcattgagattaaagcctttttctgaagaacacgatttctccctccacttaataaccacacctgctaatcgattggtttcatgtcgctattgtctaagtcggcgagataacaattctcccatctccatcaccgtcatctctagtctctaccacctatatcaacagtatctactctctctctctctctctctctctctctctctctctctggacaccgtaatcggcaccatgttcatgccaaatctagccaaaaatctcttgacagatacgtctgctgcttaattactccgataccatatcatcacgcaatttgtttgtttagtaccttgcaagcgagctttacttaactgaacatgaacatatataaactaaccccagctgaatgataatcaaataatttaatcgctcccaagttgcagttgttaacccatccatcgcacgagattaaacatagtaccgacatcagatgcagatgtttccacaagcatccacatcaaatatcatggtgccggagggtcctacatacgattggcacaaatcgagactgcaaaaatcataaaatttgtctcctgttgagggtcgccttctctgctgctgtcccaatttgcagcccagatccaatcagtttttagttttggtttccgagcaattagctcatgccatggaggtgtgaactctcgatggtgattagactaattgcagttctcaaagaagaaaaaaagattagactaaattaatttaattgctgctgcaatcagactactggcagctgcaccgacagggccatgtacgattaatcgagcggttagctaactgccccatggggggaagaacagggattaatcaatcgataatccgttttcttttttcggtctctgttaatcaatcatcagtctgtgtttgggattgcgaaataaagtattcaggggctcacatggcattcattgttcgatgtgtcatgtctcctctagctcctccaatctatgcaaaaaaaaatatagtatcttcaacaaaagcatccgtttttaaatcagctgancatcaggttcaagtgctgcaanttaaattcaagattgagcaccattctcctactacagaattcagattgctcaagcgagacggacatgtctgaatcctcgtttggtttatctgtcgcagctaaaatctaaattcttaaagttaattttaaagctgattttcctttcattattgtagtttaaacaacgctttttaaatcactaataacatacatatataaaagttttactcgtaagttatttttaagttggttcgtggctgttactgagattaacacggcctgtcaggctgtcagcatggtaatctaggtatgatagaagtaagttgagttcatcgatctgcagttggatatctgcgtcagttttgttgattggtgtggcgttgttagggccgcacaatgagagatttgaccgggacaaagggcagctaagatagatagggaggcaggcagagagtagacgtcgcacgctttgatcaaatcctggcttagaagcacctcaaaattgagacgtctcgtccgaataaaatggacgagaaccagatgccattttcctgtttcttgtggtcacctccatgcatgcatcaaatctttttgtttctttcatcccaaaaaaagagatctctcttcttcttctttttttataggaaactatattggtttgtagacaatggaagtttttattgatctcgattgtcaaaaatctacaattgtaactataacactgttgttttttttaagaaagcagtaattgatatggctgattaatttgagaattgtgtatgtgttttcattgttcttttagctataccaatgatatgggtatgttagttgcaattggcgtctaaaacaattctagctagctaagtagttcgaagaattaacacacaagcgataaattattgtgtgacgaaagactaagacgaagcatgtttaggtcaacgagtagtagcagcatgcagcatcctaatcgtagggtgacgaatcaagctgctatccgtgcacattcctgtggcgttgatcagtgagaggagcactgtcttgaggcattgaaccacgttttaatttgcaaatccaaattaggcgtgataatctgatggccctgttgatttagattgttgagctgattaatgttgcgggattacaacttaattttaagtatgaattaaatagttttaaaataaacataataaatagcttaaaacaaaccgtctaagttgaccagtaatacagtaaaagaaatgctttttgagaaatatatttttcgaagttagcaatgagcaaataatccctttaatatcccgtgaataagctgaaaagaacaaggccgatcgtctcatctaaaggctggattgattgctaacttgctactaatgattttccaaagcactgtaactgtgctttcatgtgtacttctcccatgggccatggttaggctgactaaacatagtggtaacattcgatttcaatatttatcttgggtcctagttaaatcctcaccaactctttcacatgtacacagtagtccaatgccccactaatgactgtgcacatgacagtttttacagtatcttgtagtagatcaacacaacaccaaacaattttactgacatcatcaaaaggaacagttttactgaaactgagaaagtactactactactaaccgcttactagtaattaacaaagtcttgaagattacactctctctgatagtctgatgagagaattaaatacagctatgaaagattgcaccttttgtcgataaaagcaaatggtgccttggcacgctgtcaagcaaagaaaattcagggagaggaaggcttcagattgaaatgttgctagccggcaagaagcagcatggggcctaataactgaagaaatggtgcattgattgattggagatcgaagaactctgaagcaagcagtgagctgctgcactgcagcagccgcttgagatcttcagagaagttcagagagttcattcaactggtggatcgtcagggtcaaaacccaaaagccgatcgaggcaggcaacaaatgatgacgcattttggatgagctgcagcagcagcagcacagctccagctttacactttactccatccttttggttgccaattgattatactcgtcgcctttgtgagagttgcagtcgtgaacatgctcatcgagatgcaagctcgcacgaacaggatgtagcatgtatagcagcaatggatgtaaaaaaaaaaaggctcatgatgcaaaatgaactgcaatggagtgtactacacatgatgacacttttattaagtgtctattatgctttctgatgagctgatgaaatttggtagtatggccatggaactgcattgatggcactggaagaacagtggatggaacttcacatggaagcgaattgaagtagtggtgtttcatttttagttctttctcttttcacatcttattactgctgtcgatgtgtagtgcttccattctaggagcagtagagtttcggcaaaatggcagtaaaattctcatgagtggcagcgtgggattctgaaagagaccggtcattttgttgccggtacaaagtgaaaaatgtactggagtactagtgaaacaacaaaatggcgagtcgagcttgaaatgaacagaagtttctggcaagcaaaacaacaatgaacaaagcagcaacagcagtagtagcagcagtgcacatgaattgcaaacagtattatgtctgaagaaattcagatatctcctttttactactaccactactcccctgcatcatcaggaatttttgcacagctagcctttcgtccctgttgtgttgccaccaaaatgctttgatagatacagtagccccaaagccgtgctccctttaagacaagtttttatgcagcattgttcagggagagagaaagtgatgttgctaaggcctgtttagatccatcttaacaaattttacactatgtcacatcgaacgtttgaacacctgcatgaagattaaatatagactaaaaataactaattacacaaattacgactactttgcgagacgaattttttaagcctaattgctccatgattcgataatgttgtgctgcagtaaacatgtactaatgatggattaattaggcttaatatattcatctcgcggttt

SEQ ID NO: 7467 - DNA, 945 bp, Oryza sativa
ttccgagcaattagctcatgccatggaggtgtgaactctcgatggtgattagactaattgcagttctcaaagaagaaaaaaagattagactaaattaatttaattgctgctgcaatcagactactgccagctgcaccgacagggccatgtacgattaatcgagcggttagctaactgccccatggggggaagaacagggattaatcaatcgataatccgttttcttttttcggtctctgttaatcaatcatcagtctgtgtttgggattgcgaaataaagtattcaggggctcacatggcattcattgttcgatgtgtcatgtctcctctagctcctccaatctctgcaaaaaaaaatatagtatacttcaaacaaagcatccgtttttaaatcagctgaacaatcagtttcagtgctgcaaattaaaattcagaatgagcaacaatctcctactacagaattcagattgctcaagcgagaacgacatgtctgaatcctcgtttggtttatctgtcgcagctaaaatctaaattcttaaagttaattttaaagctgattttcctttcattattgtagtttaaacaacgctttttaaatcactaataacatacatatataaaagttttactcgtaagttatttttaagttggttcgtggctgttactgagattaacacggcctgtcaggctgtcagcatggtaatctaggtatgatagaagtaagttgagttcatcgatctgcagttggatatctgcgtcagttttgttgattggtgtggcgttgttagggccgcacaatgagagatttgaccgggacaaagggcagctaagatagatagggaggcaggcagagagtagacgtcgcacgctttgatcaaatcctggcttagaagcacctcaaaattgagacgtctcgtccgaataaaatggacgagaaccagatgc

SEQ ID NO: 7468 - DNA, 997 bp, Oryza sativa
  unsure (1)..(997): unsure at all n locations
caaatcgatcttatgctaaaataccttacgtcttagtacctttggctgtttatatcttacaaaattcattccattgagtggtgtaaacaaaagaatgtgcaagttttatttaacatttaacatgttttgagaactaggtaaggaaacatgtcattgtctcatggatagatatgcaactaaggcgatgtcggctcggcaaatagccaatacactgaagctggcatagcgtggccacagtggcccatgtatgacaagtataaggaagagaaggagtagtgaagtaagagagattatacggttcctaagaaaatacctggagatactacaatttacactaaaaattttggtacctcgaggtacctagtacctagagataccacattttacactagaaaatatagtaccttgcttccggtagcttttcaaggatggtaaaaatttacccgtgaagtaatgattgtagaactctataatacaggtatgaatataagactgataacatgcaacctctgtaccaaaatgtaagaattcgtcacggccgaaagatcgatgcgccgatttggctcctagagacatagttgcaccactagttgtcgtcaacaatctcgtctaaccactgtgaagtgtgatgtctttttgtgctatggtctagccaactgttagtttcttccatgttaaattgctggtatgcatcccattggggaggcggcattccaagtgtgcgcaatcgcaaccacagccgatctaatagatattttaaaaaataataaaaaaggcaatatatttacatataacatatattgttttctcttgagaaatactcctatatagattcttgtgggggcaatgatgataaggaaatgcgagaacaatgtaagttgaaaccaaaatatattgtacatatataatgaaatatccactgcatatttggtatgnnnnnnnnnnnnnnnnnnnnnnnnnnnnnnnnnnnnnnnnnnnnnnnnnnnnnnnnnnnnnn

SEQ ID NO: 7469 - DNA, 719 bp, Oryza sativa
  unsure (1)..(719): unsure at all n locations
nnnnnnnnnnnnnnnnnnnnnnnnnnnnnnnnnnnnnnnnnnnnnnnnnnnnnnnnnnnnnnnnttttcaagaatttcttttttttatttgattgatgattttcgcagtacatatgggcttgtcgtcgcatataatgcgcgctgaaagttctggttggttggggggtttcctttcactgccgccgtttcggggaggcatgttgcatctgcctggccacatgacgcgagagcagattgattgattgatgcactgctgatccaatcgatgtgttagcgtcgtcggaatagataatcacccatcaatgcaacgaatgaatgatggaagtttcgacttttttttctttttaggtgctcctgttgagtgctcaacataagccatgtgcccttgtcctaaatttagctcatttgcatgtgtttattagctgttaattgatgagatttacaaagggatttccttgtctaagtttctttggattgataatgatggatgatggatgaaaagtcgttttccgactagttttttttggtgctacctaaagtgaatcaggcatcaccggttgagggcgtgccccatttttcattgtcgctcgggaatcttcagaccaaaagttgtactaattaatttccttttttaacttgcaaagacaaaaacagtaaccgtactgtaggccaatcagatcggtgttgtcagctcttcctgcattaggttatctggtgtt

SEQ ID NO: 7470 - DNA, 2344 bp, Oryza sativa
ctatagggcgaattcgagctcggtacccatcggcgtcgacgccgtacgacgtggtcgtcaagctcggcgcctacaaggccttctcggaggtgtccccggtgctccagttcgcgcacctcacctgcgtccaggcggtgctcgacgagctcggcggcgccggatgcatccacgtgctggacttcgacatcggcatgggcgagcagtgggcgtcgctgatgcaggagctcgcgcagctccgcccggccgccgcgctcaaggtgaccgcattggtgtccccggcgtcgcaccacccgctcgagctgcagctcatccacgagaacctctccggcttcgccgccgagctcggcgtcttcttccacttcaccgtcttcaacatcgacaccctggaccccgccgagctcctcgccaacgccaccgggggcgacgccgtggccgtgcacctccccgtcgggcccgcccacgccggcgggacgccggccgtgctccgcctcgtgaagcgcctcggcgccaaggtggtggtctccgtcgaccgcggctgcgaccgctccgacctccccttcgcggcgcacctctttcactccttccactccgccgtctacctcctcgagtccatcgacgccgtgggcacggacccggacaccgcgtccaagatcgagcggtacctcatccaccccgccatcgagcagtgcgtcgtggccagccaccgcgccgcctccgccatggacaaggcgccgccgccgccgtggcgcgcggcgttcgcggcggcggggttcgcgccggtgcaggcgacgacgttcgcggagtcgcaggcggagtcgctgctgagcaaggtgcacgtcagggggttccgcgtcgagaagcgcgccggctcgctctgcctctactggcagcgcggcgagctcgtgtccgtctcggcgtggaggtgctagaaagccctcgccgccgtcgccgtctccggcgagcggcgcagccgtggagccgacgtatcaaggagccgcggattttagttagggactaatgatcctgctacttcttcctctccaagtgaaagtcaagtgtttttttaccctttttgtgtaacttttttttactccttttttcttcttcttctttgtgttgctgtaatgatctcagctgagctgatcagtgagctgagtgtcctaagattgtcgtgtcaccttgcagcttggctctgcttctgcttctgcttgtgcagatgcagagtgccatgtcgcaatggtgttgtactggtacagtagctggcgcattctacttcaccatcatccatccatccatccccctgtgttactactcgattccccgtgaaaatcaatggctatggcatttgaaaatttgttcttccattttgatcaccagctttgacatgttttttgtgtcgtattctgaattcctgtttgtacaatttgtgcagccctcttatcaaagaaagagagagaaaacgatggaatgtacacctggttattgtattagttgtaaggactcctttgaaacataagaattttacgaaaaaatatgtagaaattatagttcagttcctacgattcttatacgaaaaaatatgtagaaattatagttcagttcctacgaaatcctcgcgaattcctctgtttataaaagagtgcaaaaggtattaaaaaacgaccgatttgtggccaattgacttacacttgatttagaaattccacgaggaatttcgcggaagtttcgtaaaatccattacattcccgtaaaaccgagagagaaaaaaatttcacgcaaaaatggaatacacgtttatgcttcactctccaagagtaataagacaactggaaaggtaactagatagatactagcaggcaggattagacaagaatttgcgtgtggttaggacgtaggagcacacgagaaacgttcaggttttccgaatagctctacaaggtggttttattcgaaaccacacttcttctatttatttgatattatgtttttctctaatattcgtgtctttttaagatatagcagcacacacagttgcaaacagcagcctccggaggtagcaatcgcgaggtagaactagaagaaacaaggattgggaataaagcggccatgggcgacccaagcaagcataaaggcgtcagacaatttcttttagctcctcttctacgagtgggattctgaactgcactcgcccagcaacaaacaagccccctatggggaacagactcgacctgcaaacatgcaaactagagtattctatagtgtccttgctccttacctgttaatcataattcatgctacatcatgggctcatggcttctgcagcaatgcatcttccatctactca

SEQ ID NO: 7471 - DNA, 8824 bp, Oryza sativa
aattctattataccctgtctgcctatgtagtgtagtagtagtagtagtatcgttatctatcaatatgttttggtatctgtcacttcttgttctgcataatagtatatattgtccatacttcagagatgtgtacagtttgttactgtaatgtattggtactatactagtattaatacatttattggattactgaaaatgattaccaataagactatagatattaattaaatattttaataaataaacttaacaaatactagtttaggacaagagatctaaacaatactacatccgtcccaaattagtggtcgctttgacttttttttattataacgtttgactattcatcttatttgaaaaattagtgcaaatatataaaatgataagttatacttaaaatgcttttgataataaagcaagtcacaaacaaaataaataataatttcataatttttttaataagacgaatgattaaaagttacaaataaaaactcaaagcaataagtattttgggacggaggtattacagcgtaagaaattatgttttaagaaaacgtatcatttatctattaatatgttttggtatctgtcacttcttgttctgcatagtatactgtccatgcttcagacatgtgtactgtttatacagtaatactatggtaacaagcctatgtaaaaaaaaatacagagattagccatgcaggcaatgtgtactgttgccattgtctgggcctcatggtggcttccttgttactcaaacgacataattaaaagcatacttaaacattggctcctttactgttaatcaatgcagctgaagcacaccaccatcctgttactgttattgctttatgctcctgccttgcacctctaattctgtttgcactggaccacaggggagtgatgatttgtcaatccgaactcaactgtttggacacatgacagcctaactaattaagctctctaatctgctccttccaaactggaaggccacatttaatttagattattgaacatattattgtgaaggactatcaatttaattatgaggataaattaaacattttcagagacaaaattaacaataacatgaaacaaacaaaaaaaatctaagcaatgtaatagataaagtttttcctttcaaaaactcatattttccgaaacatggaaaaataatccggtgaaccaaggccgtgtttagtttccccctattcccaacttttcatcacatcatatcacatcaaaaactttcctacacacataaacttccaacttttttttcaaactcccaactttcttcaaacttctaaatttttttaggaactaaacacaccccaagctgaaaagaaccaaagggaagtaggaggatatgggggagagaaaaataaaatcctgtcagaatataatgtcagtctaaaagcttcagataagggcattgcatttggcaagcactgttgcacattgaagaacatatggtgatggggtgccaacgcgttttgtcttggttttttccccatctatcatgacagaattcttcactgcaacatgaaccgaatccttgcttgttctccagctgctgcctctgcctgtgctggagatgcaaaggaaggggggcaatcatggtgtaaagcgtccatgctttactgaaatggcggcaaagcatcttagggtaaggtgattagggtaccgaattcgtccacgttttgtgcaccctggttaacgatggggaataaaacatcctctccaattagcctgaggttgagaataatattgtaacttgtaagatatagatggcatcatcactgagcgagtgagactggaaatcacctcattgggtttacaagagggcaatgtatgctcaaacttatggatgcaagtccttgttataccatatatacattttttgtggttttgaggacttgctataccatatataaattccatcgatgacatttacatcaacaaaaacatttataacacgagtttaaacaagcaaatatcattgtcatttcaagtaaaatcactatgaacagtgttatttgttcgatttcgaaaattaaggatgaaaatgtggtctttttagtttagagtgaaaatatactttgagcaaattttaaagaacaaatgaaaactttctctatctcctagcatatctcattgtctacttgttggcctaaatttggacccaaagttatttttagttactttcttttacggcttaagttaatgttctttttcatctcctgttctattaagtgaaaaggtactcctgtgctgtttttcgttcaaaaaaaaagttctctttcatgctactcaccgaattactgaaacggattatttactgcacactttgaaaagtacattttcttataaatctgtcacctaaccattgtttacaccacttatttcaatcatacacaataatccatccaatgatctaaatcacactactctattaggacaaaggaaaaaaaaacaatagcaccacaagaagcataacagagtggaagtcaggcagaagatctgtccaaactccaaagcttgcaatgcatttgcagccaggattggagttcaccaagagagcatggggctggaagacgaacatgtggggccattcccaaaaattttcatagaatccctgcattgtctctcgcagtcactgctgctcatcagcctctcacagacctgtttgcctgctgctgctctcttttcatgcagtgaacctgttgaccacacacacacacacactgactgggccccgggccccacccacgcctgcccagcatcggtcagtgaggacttgtcgatccgatgatccaatccgtgtcgggcggtgtggcgccaccaaactggcgtgtgggccccacctgccccaaccctttgccaccatggttttagggcacggatcctatgccgtaacgggcccacgtgtaagtggctgtcataaactgtgtgtggacagtcgtattgtagagaatccttattaccggtagtttcaaaatgcgaccataaccgcttggtaaagttgtgaacttgtcatgttcaaaataggctttgttcggcagcgattgctaaggcgcaagtccacgacaactaaatcaatatactcacccgtcttaaaatataaagattttagttggatgtgatatgtcctaattctacgaatttattaatgctttacgttcagattcataatactagaatatattatatccaatcaaaatcccttatattttagaacggatggagtaataaaagtactcctcagagctgtttgaagtctatttgtaattggatttcaaacatggctaatattgaaagtaaaattcaaatcgaaaaaaatgtttagtttcatctttttatctttcattattgaataatgaatggtaaccggggtttatgaacggagccgataggaagtggtaaacgtactccttccttctgtccaaattcataataattgaaacattatatcctgtattagatagttatattttaagatggacataatactttgtaaaacagtaacaagtcgcatttataaaccctgcttgccgctctactttttttttttaagtatacattgcttgctcatgctcggttgctaaggcatgtgctccataatttggcgtttgccatggctagatctggtttgatttcccctagtttgtttaacatccgaataaaaaacttaccagtctaaacaaatagcagtagtgttttgttttgtttaaaggctaaacaaatactttggttggcagaagtggccgatgcatgccatcgatgaactacgcataaacaaatctttctactactaacttagcttgtagccaccaacaagcagcctcagattacacaatacccacacatgccttcccccaaagtcccaaaccctaaggtacaggcacagccacaccgaactcccatgtgtagcgtgccaatgtgtcgacttgttgccaaacagctacacaagaatgcatgtggcttgcatcactcactcatggcatgttgcttcttggcctcgccgttttttgtcctctcctaatcctcactcaattaccttacctagttttagttactccatccgttccaaaatataaatatttttagctataaatctgaacaattgattcatagaaaaaaaatgttatattatgggacgggggagttactaccttacccccaactgctgcaacgatgaacagcaatcttttgtatcatgcaaaacaaaaccaaaatcctcaccgtgatacaatgaagtagtaggagctaaaatgctttgcctgcttccatcggttgagatggagcttttgcttgggatgagctcccagtttgagccacaccgtttgtcatctctcttctcgcaatgcaacgccagctcgtctcgtgaagatagggggacactgaacagaacttgactggacttcacttgtgatgtttcaggacaggcacatcaagaacagcagcagcaacattggatgggtacaccactttaacctgggactcagctccagaatggccatggcaccgcatgcacaaaccggataggttgagatgggctcactggagagtcactggagagccacagtgtgcagcaggagcagtagcaataggtcaggttaacatcatagccagcaacaaccagcctcactgttctcttgccaacactcttccagcttcccactgtaacaagaacaaccccaccgtgtgccgctgacgggtgggccagtgacggcgacggccggcgacgtacgagtgcccgtgacacacgggacgcgatggtgcaggccggccggcagtgtgcatccaatccaacaaaactatctgtcccggccatgctcacagtcccattctgggcacaaaccgcagcagggaccgcgtgcttgtcatcactcttaaaccggccgagcttgttgctgcactgcatgccttaacactgtttcctcttcatcgccactggcaggcaagtggccacactggagtacgggacactgcaggagcaaactggcaagagacctgcatagtagttacagagatggatgttaagcttgctgataaattcagaaaaaagtggtaccacagttcaaaacttcaaagtaagtgaggccaagatccagtctcagacacggtgcatctttcccaaggcgtatctgtactgccaaaatgtaccatttctgacgaggtatttcgtgaatcattattcctcagccatccaaattgctcgcaatacaaaaacaggctaaaatgtggtttgtgccggcgactcgcaaagcgcccagggacaagagttcgctttattcccccctccaacatctgcacattttagtcgtagcttggtttcacacctccaaccgttaaagtaccacgaatcaatcgcagaaagaaggtgcactgttggtttaattaagcaggacttgaaagttcaaaaccagggaggggaatcagaagccagtagacacaaaggcctccagatctcattcagacaggttcagatttcattgcggaagccaaataggaaatgcaagcatagtggccagtgagtagtagtagcacattgtgggctcgaagtaccccctcccttggaaagagctaaagatacgcaacttttaagagccaaaaggaaaagaaaaggcagtgagagatgaagcaaagagatggatgtgtcatggtgaagctgccttggagagtgggattcggtgccaactacaaggttgatgcatggggtcgcaccatgcattggccagcctttgtatcctcttttctctaaaatagagtttccgatgaggaaaagatagtatagggctgttaagccctcactgtagctagtaatagcctagcaatatccgtacgtgcaatgcctatgaattgagcttgcagaaaagaaaaggcagtaaaggagctaagcagtaaagaacgatagatttttatctacttttgatcaaaaggaaggaaagaatgaccagaatgatgcattttttttccctacggctgtttcctgggctctctacgatgaaaatcaacagctcgagtccctactcgctactccctaccacgtgaaatgatttcaggactgcaaagttgatcaatgagaattgctattacctctccactaaaataaacaacttaatgatttcaggactgtaaagttgatcaatgagaattgctattacctctccactaaaagaaacaacttaaagataaaagaggtaatagaaatctataatcaatattgggggggggggggggggttaatctgatacaacatatttgcaattcccctcgcccacctcctcctacagtttaaattcactaatgcaggcagttactatatttaagttttgtcgatgtggtgaaaacatggaaaatggttcatttgtcagaaagttcaagataggttttacagaacttcactaagacacataacttaagccaagctaagagtagcataacattgttagccaattgcctggctcctaaatggaagtcaagtcacagtattatacaagacatcacgaatcagttctttgatggtgatggaattgtgctcacaagcaatgtcattcatctgaagtaatagtcatggacagggcataaataatggcaacatggttcaatggttgtctggttgatattacaggtcaactacatatgctatatttatgctgaagaattgcatccactcaaagtcatgttcagaaatacacaagcaaagatatgccaaatagatgtccaaaaatcctagctcaagttggtgacaggattattgatccaccatgcaatagatgttttaaacagtcagttaccttggttatcttcattccaaaattcaatccaaactgtgcagataacttatgttttccccctgagccgacaagtattatatgtatgatctgcataaacactaactttatcacaagctgattaaacttgaatataccttagaaagctccgttgagggaaaacaggcagaaccttcactaatgtcacaaaaccaatgcagagaaacttgtatatgcaaaaaaggaactaggaaacaacatgacaaaatcatcaacgcagaagggaatcaaaggtattgctctcaaatccttcattgctaagagacttccgtgccagcaaagctcatgaagtaagcttttctccagaatataatgtccgtatcaaacatgcaaattttgtttctaatactaaatgcgcaacgccacttgcctatcactaaattgacaaatgaattgacattacaataatatccaataaaaaaaattctgcaaagcaggaatgtatcacaagaaattcgctaatgcgtcaataccgaaccacatgtctgccgtaaggcatctgatcaatgaaaaagaagatgaaagcagatgctctttcatcttcctgaagaaggttcttttgcgaaatataatttatagagaacctttgacacatactttccatgatggctaaagtatgataaatgtacctggaatgtttatcatgttgatgaaccggtcatgcagaatgaggctacatctagactgtgagtattggttatcccatagtttactgcaggatgacatgcatatccttcaggagtagatcatgaactttccagaccagatacaagtgtaaaaacagatgaatgacaaaaataatcatagtcattattttgtacccacgatagtaaatacatgtaacagtaaaggatatagtcaattgctacctgataaaaaatataagcaaatcgataaagctgttcaagagttgcagtgtagcataaacaataaagtaataaccaaggcaaaccaaaaattttaatcccattgaagtaaaatacatgaattatttaattctctctccctcacaacgaatgcatccaagcaagcagagacctgcataaactagtactatatattatagcgaactaaacagattacacttaaggtagcattgcaataagaaaaagtaggtgtaggtatgtacgtgtgcaactatatattgaaaaccttttgaaatatttgagctacaagatacagaaagagaaaatagcttatccttgtttacaattgcagaagagcaaaactaactaattcaatagcaacatatcgatttccctggaaattttaagtgtcttattacttgaaatagggtggtatgccatacaggctacttaataacacgaatactatatcatatttaagttcattgcataaagataatttaagtagtaaacatcggtaggtatgcatgacacacactgtgaaatatgtagctgctccagtaatgtaccatcaaatgcaaacagcttctgaccaaaacctgatgagaggacccttaagaatctcatcagcttgtttgtcaacacttatctccaggtgttcagagataacatatttgatctttttagggtttatcatgctctactaatgtatttgcctgggattataagcttggtctgttatctagaagttcatgttgtttagtcatctttggtttctacaaaacccttgcaaaaatttctttgtcgacttttattcttcatactatatatatttcaatagaactactgttctcctaaaaagtacaaacatgtagcaaaagctgatatttgacaaaactataaaacctgtgcggcttaagagtaacaatctgcatagatatacaaacaatgacataatcacaagggacaggtgctttttactttttgagtaagcccgatcactacagaatacaaccatcttcataggttaagtaatgctacagttaatctgataaagaagaaagagagaaaatccacattggacatggagatgatgaggtcacgagatctccaaagatt

SEQ ID NO: 7472 - DNA, 616 bp, Oryza sativa
  unsure (1)..(616): unsure at all n locations
actatagggcgaattcgagctcggtacccaaaaaacttatatactgatcaatatataaacccaaacagaagttacggaccttagctagatgatctgaaaccataattgtacgagctctaattgtacagtacccatgtattacactagtattaattgatccgggaaaatctagcaatatattgtgatgaaaagaatatattgcaactaggacacacggagaatataaatcacaatcccaatacagttcatccaatcaatcatccatactcacggtcgatcgattcttgattcgccgattgggtaccacacgcatgatcatctaggcccccattcacgtactcatccatctacacatcttcttctcatcatctcctcctcctccatggccactataaataccactcgccatgcacactccaagcacacacaaagcaagaacctcgagctgatctactagctacctagtactctcatcttcttcactagcttttgcttgatcaattgcagcaatggcggcgaaggcagcgctcgttctagcggtgagcctnnnnnnnnnnnnnnnnnnnnnnnnnnnnnnnnnnnnnnnnnnnnnnnnnnnnnnnnnnnnnnnnnnnnn

SEQ ID NO: 7473 - DNA, 880 bp, Oryza sativa
  unsure (1)..(880): unsure at all n locations
gatttttatcatagaaacaaatcctgtanaattcataagtttttctctctttttttgaaagggcccttcatgtctatacggtggaagagcaaaaaaaatttgagtttaattgcactttggactagaaaaatttacaaagttttactttggacaaggggtgaagttatattcactttggactagataaatttacaaaagttttaaattggaccacccttcttctccatctcctttctttcccttcttttctctattaagcagctgcgccatggatctgagggatgatcaagcaaagcaccaggattccttctctatgtgctctgttccccagcttgaagaaccatcaaaatcaagactggttttagctggttgctgtacctgtctcccgcaagctcgatgcaatgatttgttctaagctcagatgaacttttacggggaaaaaaggttgaagtcaagcagctaaatcaatgagtaaataaatcaagatcagatggaatattaattggtttgttgtgttgcgggtaagcccgccaatgaaatcaagaagtggcaaacaaaatagtggcccaatgtgcagtagaaggtaagaaaacctgaaccaaagtgaaaatgttagatataacctagtccaaaataaaacacaggcaataataatcggcccaaagtgcaattcactcaaaaaaaaaaatttatagctagcttagctcgatttgcagagcacttgacatactgactgagtgactgatgacgtaatggctcgaacaaactgtacacacgcatgtggaatgacgacgatgattcgacctgatgctagtattaattatttaattaaacccatactgttaaacaaattagcatgcttagcacattaatcatggag

SEQ ID NO: 7474 - DNA, 686 bp, Oryza sativa
  unsure (1)..(686): unsure at all n locations
nnnnnnnnnnnnnnnnnnnnnnnnnnnnnnnnnnnnnnnnnnnnnnnnnnnnnnnnnnnnnatccctgaaagttggtttttataggacgagaggagtacatattttttaagaaaattattttataaattatttataatcaaatattttaaaattcgatcttaattttgtccgaaacaacgagtattataagagcttatttggtagagctccaactcctaaatttagcttcaagagttagatctgaagtagagttatatgaagctgcttaaacccaactttgcatgtctagttcattttggagatagctctacacagctcagctgaaattgtttggtgaagctagagctgtgccaaacagggcctccgtctggagagaaagtagcaacgcatccatgcaaaccactcttgctataggctcgatcggctataaatacaagacgccatgacaccccaagcaaaccaacccaaagcaacacaagccatagcagcagagccgagtagctgagctcactgttcgatcgatcactagctcgctagctgcatccatggctgcttccaaggtcgctccgtgctggccctgagccttctcctcctcggcgtcgcggagcacgggtgcgagccccactgcttcggcggtggcgcgcccgcggtcgcataccgacgccgactgtggtggtgccactgc

SEQ ID NO: 7475 - DNA, 724 bp, Oryza sativa
  unsure (1)..(724): unsure at all n locations
gcaatttcttcgcttgctctcagaagtgcttcttccagttctttcctctttttaacctcctccaagtacagctcctcgtattctttggcctgtaaggttcagagttctgatcaaaattctgaagaatatattcatatgaaatctggatgtttttttttctaagtggtctcgtttctgaataaaatagtcaaaggacaacgaattactttctgaagagatgaaactacttcttcgtctgctttctgccgtctgtaagattctcttaaagctctcatcattaagttgtcagctgctttgcatgcttctttgatctcatcgtaaaaacccagttccgattcattgttgtcatcctaaataattggaaaaggaaatcaccatattatgtcatcactcttacaagacaaaatattcgaaaccataagatggcattgcaagatcagaagaacctgttcctggtgaagtgtcaactgcagagcatcgtgaccagtatcaggaatgaaaggcgtatgtccaggtgcaatttctacttccacgccactatcatggaaaatgaatcagagatttttgagcttcactattcagtaatcatcataaatcgcaaaattactactaaaaggtttttaccttgtacagattaaccgttctttgcagacaaaccaaatcttgcatnnnnnnnnnnnnnnnnnnnnnnnnnnnnnnnnnnnnnnnnnnnnnnnnnnnnnnn

SEQ ID NO: 7476 - DNA, 756 bp, Oryza sativa
  unsure (1)..(756): unsure at all n locations
ttattcaattttatacctgtaggtgtacaaaagctcaagtgaagtattaagnacattgatggtgcaagaatgaaagatacnaatttctgtgtgtccgttcattaccgcaatgtagcaccacatgtaagcntgcattaaaatctttaatttcacacagnaaatatgtggtgtanaatgtntgctgaatattattctcattgttacatcttaggactacgnagaagttcatcaacgtgtgctgccgtcctaagaattcccccccccttttttnggnttnntttttaaaagggcctttaccccaattgggaagaaaggttaaggaatatacacanccgcacagctgtttcgaagcactggttaagtaccattgttgtatttgtttttaattcaactgcgctcttgaattcaggttcttgaggttcgacctgtgatagactggaacaaggggaaagctgtggaatttttgctggagtcacttggactatgtggaaaagaaaatgttcttcctatctatgttgaagatgacaagactgatgagaatgcattcaaggtaacccataaactggtctgcttgctcttacctgcaaaatatcaattactacttccatgtcttgatgtataatattgctcacttggctcaaataggttctgaaggcaaacagcattggctttggaattttggtgtcatctgtgcccaaggatactgatgctttctattccgtacgggacccagctgaggtaattcgtcttctatct

SEQ ID NO: 7477 - DNA, 696 bp, Oryza sativa
  unsure (1)..(696): unsure at all n locations
nnnnnnnnnnnnnnnnnnnnnnnnnnnnnnnnnnnnnnnnnnnnnnnnnnnnnnntaaacggtgtgttttgtgtgaaaactttctatattaaagttgttctaaaatataagattgattcatttttcaagtttgtaataattaaaaactcaattaatcacatgttattaccacctcattttgcgtgaagcacttaatttttatcttcatctacatcttcaggagattcaaacactgtcttggtgtgactagataacggtataccattcaatcaatggaatattttacatgctgatgtcaccatgatattagcatgataccgtaggtaccaatactcacatgtattaggttatggcacctaagtagcattttaatgttagcagataccttaggtacgggtccgtccggtatcaagagtacccgacgtgatacccatataccagatctggtatctaggtaacatgatgacattaggatggtgtttacaaatgtaaactatatcggatagcattttatagtatttccgtagcatagtactctctctttcggaatgttagatattttggtgaaatttgactaaatttatagaaaaatatataacatccacaatagcaaattaattttattaaacctactattaaatatattttataatatatttggtggtctaaaccatgttaattactacttttcttata

SEQ ID NO: 7478 - DNA, 534 bp, Oryza sativa
gttagtacttaagcatggtctaatggggaaaaaaataaagcttcctaatagcgaaaatgaagtgtcgataattttgatactaatgcaactaaagataactcgtacagaaaaattactaaaatagctaaggaaaaatttaatctctcttgctaaggatgacttttggtgcttgttttgactaaactaatagtatatacacatattatacctattaaattgcatattttttgtcaaaaaaaataaatttagggatataactgtgccccatatgtcctattgagatcccccttctctcgggtgggtgcagtggtgaagatgctatacatcacttcacctaccaagccaccaaaaggttctatgaatataaatgtatttttttacacaaccatattaatcaatctacactcttataatctgaaaatacacattatatatatatatatatatatatatatatatatatatatatatatatatatatatatatatatatatatatatatatatatatatatagaggggtgtatatatata

SEQ ID NO: 7479 - DNA, 495 bp, Oryza sativa
  unsure (1)..(495): unsure at all n locations
nnnnnnnnnnnnnnnnnnnnnnnnnnnnnnnnnnnnnnnnnnnnnnnnnnnnnnnatccctgcattgtctctcgcagtcactgctgctcatcagcctctcacagacctgtttgcctgctgctgctctcttttcatgcagtgaacctgttgaccacacacacacacacactgactgggccccgggccccacccacgcctgcccagcatcggtcagtgaggacttgtcgatccgatgatccaatccgtgtcgggcggtgtggcgccaccaaactggcgtgtgggccccacctgccccaaccctttgccaccatggttttagggcacggatcctatgccgtaacgggcccacgtgtaagtggctgtcataaactgtgtgtggacagtcgtattgtagagaatccttattaccggtagtttcaaaatgcgaccataaccgcttggtaaagttgtgaacttgtcatgttcaaaataggctttggtcggcagcgattgcta

SEQ ID NO: 7480 - DNA, 597 bp, Oryza sativa
ttcaatcatacacaataatccatccaatgatctaaatcacactactctattaggacaaaggaaaaaaaaacaatagcaccacaagaagcataacagagtggaagtcaggcagaagatctgtccaaactccaaagcttgcaatgcatttgcagccaggattggagttcaccaagagagcatggggctggaagacgaacatgtggggccattcccaaaaattttcatagaatccctgcattgtctctcgcagtcactgctgctcatcagcctctcacagacctgtttgcctgctgctgctctcttttcatgcagtgaacctgttgaccacacacacacacacactgactgggccccgggccccacccacgcctgcccagcatcggtcagtgaggacttgtcgatccgatgatccaatccgtgtcgggcggtgtggcgccaccaaactggcgtgtgggccccacctgccccaaccctttgccaccatggttttagggcacggatcctatgccgtaacgggcccacgtgtaagtggctgtcataaactgtgtgtggacagtcgtattgtagagaatacttattaccggtagtttcaaaatg

SEQ ID NO: 7481 - DNA, 1103 bp, Oryza sativa
  unsure (1)..(1103): unsure at all n locations
gtgagtgattcgacttcttctgtaagtagctcatcaggtgaatagaaccttgtctactatgcttagggctgttttgaagaaaaatatcaagatgtgggaagaatgcttgcctcatattgaatttgcttataatcgttccttgcattctactacaaaaatgtgcccatttcagattgtgtatggtttgttgcctcgtgctccaattgatttgatgcctttaccatcttctgaaaaactgaattttgatgctaagcaacgtgctgagttgatgttaaaactgcatgagacaactaaagaaaacatagagcgcatgaatgctaagtataagtttgctggtgacaaaggtagaagggagttgaattttgaacctggagatatggtttggttgcatttgcgaaaagaacgatttcctgatttgagaaagtctaaattgatgcctagagctgatggaccatttaaagtgttagcaaagattaatgagaatgcatataagattgatttgcctgcagatttcagggttagtcccacatttaacgttgcagatttgaagccgtatttgggagaagaagatgagcttgagtcgaggacgactcaaatgcaagaaggggaggatgatgaggacatcaacaccatcgatacatcatgtccccccatatacagcatgatggtcctattacccgcgctcgtacacgtcaactaaattatcaggtgagttctttcttgagttcatattcctcgtctttatacctcggagacgcgtgcactcgtgttttactcaggaacgatggagaggatccaaagggaagaggattcgcgtggggtggattcggactgcagggcagcgccaacttctgacggccgncacgacttcatgcgaactccgatttgngcgtgcaagtacttcatggaaagattattaagtctactttcaaatggatccagccacatgttcatatctattcttgagccgccggcattgtcattttactcccgactattttttgtcatggtgcttcgtcacctctttttggccaatgggctgtgtattcatggttgggccaataaggggcccgtcctagggttgagcaccaccctatggtcgt

SEQ ID NO: 7482 - DNA, 1014 bp, Oryza sativa
  unsure (1)..(1014): unsure at all n locations
gtggttgttgncanntctgtagnagcccatcacaccttctcttcgctctcgcgacagggactcggaaaaaagcattcgccgctttgcttcgacccagccaagcctgggcgttgcgtagcgcgcttcaagccagcagctagctagcgcgagagccgtcagttcagtcatgcatcagctcgaccggctttgctacgccgtcgtcgtgctcgtcgtgatcggcgcgacggtcgccgaggcggccaccggcacgttcatctacgccgggtgctcgccgtccaagtaccagccgggcacgccgttcgagggcaacctcaactcgctcctcgcctccatcgccaacgcggcgcccaacggcgggtacaacagcttcacggccgggagcaacggcaccggggacggcgcggcggcgtacgggctgtaccagtgccgcggcgacctgggcaacgccgactgcgcggcgtgcgtgcgggacgccgtggggcagctcaacgaggtgtgcgccgccgcgtacgcggcgtcgctgcagctggaggggtgctacgtgcgctacgacagcagcaacttcgtcggccagcccgacaacgccatggtgtaccgcaagtgcagcaccagcaccagcggcgacggcgacttcctcaagaaccgggacgccgtcctcgccgcgctccagggcggcctcgccaacgggtacaaggtgagcagctccggcaacgtgcagggtgtgtcgcagtgcctcgacgacctcgccgccggcgactgcacgacgtgccttgcgcaggcggtcggccagctcaagggcacctgcggcacgtcgctggccgccgacgtgtacctcgcgcagtgctacgtcaggtactgggccaacggcttctacttccgcccgtcacaaggtacgcccaatagtgcaacacgaataagaatttttcagccttgcgtttcagagagcaagaacccgaaccaattctccagcaacctatcctgntgntnngtnacagggaattgcattcatcccgg

SEQ ID NO: 7483 - DNA, 1763 bp, Oryza sativa
cggttacccaataaaaagggtttctctcccaatatggcccttacacaaattccatccattctagccatacaattttattaagccgccaacggccgcttaataatttaatttaagcgcttaagcctctaaccaacttccaatgttgaaaaatccgcaataacaaacgcgaaaggggcctctccgcaagtgactctgctttttgtagtcctgtacatatgtgccgtgctactctaatctctggctgattttcttggattctggtgataatagtaggctttgtgctgcagattattcgcaagatgacgtcgggcggactgtggcaataatcgtaggcatcttggcagggctggcgatcctcgtggtgttcatctctttccttagaaaatcatgtaagccccttgacttggaaatcctctctgttttgttgtctttggagagaccactactagatcataaattagtaggagaatctctgtatctgctcctctggcacgttatctttcattccatatgcaagcttcactaacctgatataaacatgatgtatcactctaaactgcaggctagcttcgtttgatgtctggaaggagtttcagtttcagtcctcgcattctgtgtgagaaactgagaatgacttgtaaagagagcttcgcttgcatgacgttggcaagagcttcatatcgcttgtaatatcatttttccagcaatagatatgtaagcgagatcttggtagggctatcggagcagcactaccttactttgggtcatcgttttttcgtccactaataattggcctacttgtttattatcaagtctgaagacaacatcatgcacatatttggtcataatcattcttggatcgattgctaatcgagtaatttacagagggccacatcacacacaagccatattgttgggtacaacaagcatatgacacctactgattagccatcacacaaggggccatattgttgggtcgctagctatattgttgtctccatggtatatacagaagttcacacaaatgaggtctgcaaacctccggggcctttggtattcaattttacctgtatatagccggggatcaagcactgtgtcctccttcagtcattgggctccatctcgccgagttgtaacggccgcaagcgttgatacttgcttccatcattttggcctcagagacaccgttgttgcatatgtttgcaaatgctctcatgtatttcatgccatactgagtgagtgatccacattgagattcaaaaattcgcacctgacaattggtaaggaaccaaggatagcattgtgcaattaaggccaacaggcaacaagaagacaataactcaagaaatatttatagatggcttatatcagagttaaaaaaaagagccttgtactcaccatcttcttcaaacaatcccagttgtcgactaatggttgaccagagcttcttgcagcctcaagggctaaaggcccattttcaaaaccaaacacaagcttcccgatgaaatcgatactgctgtcaagatgcttcctgtgtgctatggtgtcttctatctccctaagagccctcagcttgtcttcagacaccccattcaactgctcatactgaaaaagtaaatacagacattagcatgaaactgtcatatgctctgaaaatatttctggcttaaaaattcagacatcttaacttagtcctgttctcggaaatggagctcacatagtattgatgaactactgtaccagtgttagtcgcacctggccac

SEQ ID NO: 7484 - DNA, 2578 bp, Oryza sativa
  unsure (1)..(2578): unsure at all n locations
cagagtgtgaccgctgatagtgacgtacncataaaggtgggagtatactcgcctcattgatctttttggtgtcagatgcccagatggccggcaatcaatcgacaaagcagcagcctgagcctgctatccgcagccggcagcaggttcatcgttctcggatcacccaggaggcatgaaccgaggtggcggctttggcacgcgtcacgcgaaggctggctcggcaagcactgcaagggctagctggatgcaggctaccaggatgaacggaggcgtggattgatgcacacatgcgtatcttggtgcaagcccgtgccaggacatctatagtagtcaggagtctcaggtgccgtgtagtattgttttcttttgataagagtacgtgtctcagtgggatagtggattagtggtgtggtacatctgaggtcgcctgaatccatcaaataaacaaaaatctcgctgtcgtttagtaccctctgaactcggaggccttcgacgaagccgtgcttatttggagtggagcaagtacaggacaaagcgtttccaactctccgtgcaactgggacaggatccacaactcgcgtgctttctgtccctgggtctgcccaacacacaagatgttgttggataaatttctggcagcacttcagattttgtcccgtgatacagtttcacccatcgtctagatcgacaaaactttctatatgtcgcgataaaataaggcgcatattctgtgaagctttgcagtgtacgtgatgagtaggctctcccagatttccggcgcttcaccccgagttgcatggctggtcacacctgtcaaaacaaagcaccgtgattttttcccaagtcgaactgatccaccgtcacagtctcagtttccgaatagtaatttattatctcgttgctgttgattttttttccatatgcgaccaaagcaacgcgtgttaagtcaacttgaagaaaattgacagcgcaggctaatgttatttcctttttgcgcgaacggatcgttcagtcgtacggagaagggatcaattttgaccaccagggtttaattatgtgatgtgtgaacggtctattttctatcgtggtgatatcacaaacggccgtttacaaggatctaacggattgtgtatggaatactactccagtcggaagaaataaaaacttccatggaaggaaaaatcgacttttaaattatcgtgtgctgctcgagattagagtcagaaatttagaagagcatatgtgtcagggactctcaagatcatacagaagatatctcgcaaggctcaactgcagaagaaccagaagaagaagaaggaagccgtcctgaagttgctgatgaagctggtagcagaaaagataaggaggaggtgatccagacttcaggtgacaatcaagcctgggttgcaactcggcgtccagtccgtgagagaaggcccaatccgaaggtccacggtccagagtgggtggcgtaaggtatcagctcgcttgtgagctggcgccggagagagagagtgggttggttgtaataaatcaaacgaacaacactagaacaattcgggaattggcatctggaggcgttggcggcggcggctcggtcctgttggatctgagaagtaacaaatattgccactaaattcgtgaattgtgaagcgtgttcttgagagcccctaacaatatgccagaatagtttcgtatcaatgcataacagtgtgccacgtacagccagtagcagctactacaatctaaactgcacggcagtatcgcgacattcctagacctaacctggaagcatttctctgttgttccgaaacaaacccgatattgtgggaacttcacagcaaagactgcttctaaaccccttcctgttggggactgacgtcgaccaggagctacgtatgctgaaatctcaaagacgcttttgtgctgggtgccaaactcttgctagattgcaaggagatatacaagttgaaggcatttatccaactcaatttttaagtacgtgagtctatcacgccagtagtcgcggaaagcgaagaaagcagcgtagccgaacgggtcgggcgggcgagctctcactgtccagcttagcccaaggaatcatggaccaccgcccgcgcgcagccacaccagccattaccgaacaaacgccgcctgaaccaccagaaaccccggtaaatcctagccaaaatcctcgcacgaatcttagcctgtggccaaacgccaaaaaacaagcggaacgcaaatggcatcagctttttttttttaattttttaatgctttttaaaaatttttaatcgagatcacacgctcagttgtgcgctccgcggtccgcgcccgtgccctataaaacactcgtttttttagccttaccgcgctcccactttctcccgttctggctcgccactcctcccaaagtccattcaactcacccacgtaggaaggtggaagcggtttcttggggtttggatatgctaaagcggtcgcatggagggttcccgcttggggcggagctgctcantgcctggcgatgggcgctctgctgccgcgcccgcgcccgnggngctacctgcgcctg

SEQ ID NO: 7485 - DNA, 1632 bp, Oryza sativa
  unsure (1)..(1632): unsure at all n locations
ttgaccgttaggttgattcacttggagggcaaccttgttccggcaaatccaattggaaggcgttcggcagcaccccggcgggtggagctccaggcaactccaagcaggatccagctgctgataattcgggggcatctgcgacgccaatgttttggtatgaaggacaatttctccattccccacattaattttggttctgaacctgaaaccccatctcctggtagtggatctgctagttttaatctgagtaattccatcccacctatgatttgcccccaatttagtggtgataacccccaaatgtggaaggctaattgcgagcaatattttgatgtttatggcatacagtcagtttattgggtgaaaattgctacattaaatttctgtggtaatgctgcattctggttgcaatctgtgaggaatcagatatgtggaatttcttggactggtctctgtgagttggtgtgtaccagattttctaaggatagacagcaggctctcatacgtcagtggattcatattagacaggagggttttgtttcggagtatgttgagaagtttgacagtttaatgcaccaactcttagcttatgacaattctctgttacctgtgtactttgttactaaatttgtggaaggccttagaagtgacatcagggttgtggtattagttcagagacctcaagatcttgactcagcttgtgcagtagccttactccaggaagaagctttggagggtataaagtttaaccaatacaggaaacctgccagctctattcctgttcgcagttttcagaaaactcctgcacttgctcatactgctacaccacagaagcaatttactccgcaccatacagaagacaagaggggtactgagtctgctcgagctagagaagagaaactagctgctctaaatcttatagacgatctaaggggctttgtttcacttgtgggnagagatgaagtagggatcacaagtgtggtccagctgtacaattgcatgttgtcaaggagttattgaatgcattacaggatgagacccctgatgaagaccctgaaactcctccagatagtaacagtgatctgatggctatttctcagcaagcattgtggggaactgagtcttctaaatccattcggctgagaggtttggtccaaggctctgaactactcatgctggtagattctggtagtacacattcttttatggatgctggaattggactgaaaatggctggagtgtaacccctgcaacaacaactttctgttaaattggctgatggtggatttttgacttgttctcatgaagttgctggctgtagatggtggatgcaaggacttaatttcatcagtaatttcagactgctccatctgggaagctatgatattatccttggtatggattggttggaacaatacagtcccatgcaagttaattgggtagacaaatggatggaaattacagttgatggtaatgttgtcagattgcagggcatagtaccacagaccactcactgttcagtcatatcaacagaacagtatctgggcatggtgaaacaggggtcaattatgcacatagtacagctttctgcatctgatccttgatgaggtacttcacaaggcgctatagctn

SEQ ID NO: 7486 - DNA, 1276 bp, Oryza sativa
aggtgaccggagagatacaagccgggctgtgccgccggtttcgccgttgtggcaaatttgaacggccgccgaaagaaatggacgacccccacaggtggggcccaccttgtagcgttcctgggaaaaaagggaagacagacggtcgggccggccggcttaagctgggcctgaactttcggctggccaacgggaagaaggggaaaaaaagaaggaatgggcggcggcccattcaaaggaaaaaaaaagaaaagaaaagaaataaaaagtaaaagaaaggaacagggatttttcctgggattaaaattgcatgtgctcaattttaattggttaaattatttcgagagctctgaaaattccactaaaaatcttgttagcgtattccagcatgtaaaactcaagaaaaattccacatgccaattcggattattatttgcattaatttattaaggttaactcttgcttgacacaggtattttcttgagaccatttaaaactccaatttaggcttgggaaggaacttcggggtgtgacaaacctaccccccctcttaaacggaatctcgaccccgagattcggaggagctggcgaagaggtgcggatgggcggccttcaactcatcttccctttcccaggttgcttcctcctctgaatggtgactccactgaaccctgcagaacctagtgaccttgtttctggttcttctttcactggtcttaagaattcgaagtggcctctccacatacgtcagatcttcttgaatatcaatgtgctccgaattggcttgttcctcgggtaccctcaagcacttctttaattgggatacatggaacacgtcatggatgccgatcatgttggaaggaagctctagctgataagcaacttctccccttcgttccaagattttgtatggtcccacgaaacgtggtgccaacttgcctttggtttgaaaacggtgcactccccggagcggagtaacacgaagatacacgtaatcccctgtttcaaaagtgagctcccttcggcggttgtccgcgtagttcttctgtcgagattgggcaattctcaacctttccctgatggttctgactttctcttctgcttcccttagcacctctgttccaaacactcgcctgtctgatcccagaagagaggggtgcgacacttccggccgtataatgcttcgaacggtgccatttgaagactagcctggtaactgttgttgtaagagaactccgcattgatgaactacttgcaaacgagccgaatcacgctcgcg

SEQ ID NO: 7487 - DNA, 4222 bp, Oryza sativa
  unsure (1)..(4222): unsure at all n locations
taattctgggccccaatgatgtccggggcagtcctgttataaaggccattccaatctcctcccatttccattccgggatttgaagaggttggagtaaacctgctggtctttggtgctctgccttcactcactggcaaacgtcgcaaagtgcgatgaattcagctatttcccttctcatgctgacccaccaaaacttttctttgaggtcttgatacattttgatgctgcctggatgaatggagtagtgagtctgatgagcctcggtgagtatcagatccttcagttctttgtcgtcaggtacacacaatctttctgccaaccagattgtgccgtgttcatcttcaaggaaatcccgagcctttccgactctcatgttctttttcagctctgctatttcaagatcattcactgctctaacttgatcgacgagcgtaggccgtgcttctagagcggctacgaatccgtgttcaacgactcccacattgagatgttcaagctcctgctgcaattcttcgcacatgccctcgatgcatagggcattgcagtagcttttcctgcttagcgcatctgccaccacattggctttacccgggtggtagtgaatgctcatgtcatagtctttgattagttccaaccatcttcgttgtcagagatttaggtccggttgggtgaagatgtatttcagactcttatggtccgtatatacttcgcagtggttgccaatcagatagtgtctccagatctttaaagcatgaaccactgctgccaattccaggtcatgagttggataattcccttcgtgtggatgcaactgccgcaaggcatacgcgaccactctgccctcttgcattagaacacatccaagcccgtggcgggatgcgtcgcaacagacttggaagtctttcatctggtcgggcagaatcaaaactggtgcggatactaatttctttttgagctcctcaaaactcttgtcgcactcagctgtccatttaaactctcatctttcttaagcaactaagtcatgggtcgggcgatccttgagaagttttcgatgaatcggcggtaataacccgcaagtccaagaaaactctgaatctgcgacacggtcttcggtggggtccatttggtaactgactccacgttcgatggatcaactgccacgccctgagctgtaataacgtgacccagaaatttaacttccgacaaccagaagtcacacttgctgaacttggcgtataacctgtgctccttcaacttctcgagtaccagacggagatgttgctcatgttcttcttcggactttgaatagataagtatgtcgtcgatgaagaccacaacaaacttgtccagaaattccatgaacactttgttcatcagattcatgaagaatgcgggtgtgttggtaagtccgaaagacataaccgtgcactcatacaacccataccgagtggtgaaggctgtctttggaatatcctcttcccgaattctcaactagtggtagcctgatcgcaggtctatcttagaaaacactttagctcctttcagctgatcaaacaaatcatcaatccgcggtaaaggatatttgttcttgattgtgacctcattgagtacgcgatagtcgacacacattctcttcgtcttgtccttcttctccacaaaaatgaccggagcaccccaaggtgaagtacttggtcgaatgtaccctttctgcagctactcatcaacttgcttcttgacctctgctagctcgttggccgtcattctgtacggtctcttgtaaataggggcagttcctggtgccaaatcaatccggaattcaatttctctcttgggtggcatggtagtgaggtctttggggaacacttctgggtactcgcagactatggggatatcgtccaatttccgcgaactcttctccccggtggtcacagggttttccaccttaatctgatttaaggagattccttgcttcggtgagactggtgacttgtacaccacggtttctcccttctcattggtcaaggtgactgtgtgattcgcacaatcaatgacgcccttaaacttggtcagccaatccatcccaagaatgacgtctagatccttggattcgagaaggatgaggttggctagaaatggtgatctttgaatttctattagcactgaagggctatacctgaccgaggttgaactatttcctggggtatgaaccttcattggtgtactaagctctttttttcttaacccatacatccccacaaatttctttgaaatgaaagaatgcgttgcaccagaatcaaaaagtactgtagcaggaactgagttgacagggaatgtacccagtacgacttctggtgctgcttgcgcctcctctgcggacgcgtggttgacacgggcctggacaaaccttggcccgacacgcctaggctttgggcatttgtcagcgaagtggccaagctcgccacagttgaagcaagaccctggctttgtcccagtctccttcttggcttgcgcggacggagctgactgtgctggagccattggtgggagtggagctgcactgcggttgggctgaccgccatggtggttctggctgccactggcgccctgatggaagttgctggcactgaaagggcggtgctggcggacgattagggtggtaggtccaccttgctgtccgggagtgaagcgcggtcgctggtggctcccttggttggaccggaactgcgctgccttcctcttcctttccatttagttgcgctgatcctctgacggattgccttgtcaaccaacctctcaaagtcggcgtaatctccagatatcaactggttggttagctcatcatccagacctgctaggaatttctcctgcttttcggcgtcagtacggacatcctccggtgcatatcgcgcgaggcgattgaactcatggagatactccgtcactgtcctgttgccctggtggagtgcccggaattccctcttcttttgtgccacgaccccatctggcacttgcgccttcctgaagctgcggcagaactccgcccaagtgacttccgtgcctggtgggcgggtagccatatgattgtcccaccaagctgacgcgggaccttggagctggtgtgtggcgaaggcgaccttctccagatcattgcactgcaggagattgagcttcttctctatggcatggagccagtcatttacctccatagggttggtggtgctggagaaggtgggtggtctaacgcgtagaaactccggcagtttggactgagggggagggggaccaaactactgctactcggcttgctgctgcatcctctggtacatctgctggtgctgctgctgcatctgctgcatcatagctgtcatcatctgcgtctgatgagccattacttgggcaagggtcggattctcggggagtggtggcggaccattgccggaatcacggttgggatgcacaccgttagtgcgttcttcgccgttgctgccctcgcctattgcacggttaccattcctggtgtagaccatcttgaggaagagcagacgggggaaaagaagaaaaacagatgctcaggaactaagctttattatataggaatttaaactgcaattgttctgatctgaattaaaacacttaaaaagcaagcaaaaatccttattaggacagccatatcataggcatatgatatcgaccgtcgactgacccccaagcgaacagacctaaacactcaaactaacaggcaaatgctaaacagtcgataaactaatggaaagcaagcctaatgctcggaacggctcctgcggtcggtggagtcgaaggcatcctcctgctcgtcaccagatccctcttagcggctcctggagtctggcagatacgtcttccctgctgcccgggtctgagccactggaactgctgctgctgtggtcgcggctgccactgggagtagcagacaaccaacctccgttgccactggctggacccctggcagctgacgctggagcgaagaagagagcgaacgcgggagctggcactggaactgaagctggggttggagctgaagctgccagaattgcgggcgcaggtgggtttgatgnnctnctgacgagctgtcaacaaacccattnnnnggnananngtataataaataacacaataatatattactcaaaattaaccattaaggatgtaaagagtaaataaatccaacaaacccgagtgacca

SEQ ID NO: 7488 - DNA, 789 bp, Oryza sativa
  unsure (1)..(789): unsure at all n locations
caggtgatgactgcttctccccttctgcacnnacctcatcagactcatgatcagaatgtatgacaaattccttgggccacaaataatgctgccatgtttctaaagttcgcacaagagcatacaattccttatcataagtagaataattccttatctaaagttcccactcaacttttcactaaaatatgcaacaggttttccttcttgtagcaaaacaccacccaatccaatcccactagcatcacattcaagttcaaaagtcttattaaaatcgggaagttggaggagaggtgcatgggtcaacttatctttcaacatgtggaaggcgttctcttgtgatgtgccccaagtgaaaggcactcccttctttgtaagcgcattcaatggtgcagcaatggtgctgaaatcctgcacaaagcggcgatagaaccccgcgagtcctagaaagctccgcacttgtgagaccgttttaggagtcggccaactctgaattgcctcaaccttggcttgatcaacctcaatcccctgcggagttacaacatagcccagaaaagaaactcgatctgtgcaaaaggtgcacttctcaaagttaccaaataaacgtgcatcacgaagagcattaaaaacagcacgtaaatgattaaaatgttcacccatagacttgctgtanatcaagatattatcaaagtcgaccaccacaaatttttcaatgaaaagacgcataaactcatttatcaacctcatgaaaggcttggttgcataattaaaaccaaaagcatcacttacccn

SEQ ID NO: 7489 - DNA, 1676 bp, Oryza sativa
  unsure (1)..(1676): unsure at all n locations
gcggtttgatttgcgtcttgtgtatcagctcatcatttctttggtaccaaaattaccggaaccgcacatggactaagagactcgcgtacataccctttatcaagcaactcatgaacttgacgctgaatctccttggtttcctcagggttggttcggtatggcgcacggttcggtagggaagcacctgggatcaagtcgatttgatgctcaatgccgcgcaccggtggcagccccggtggcacttccttgggaaacacatcagagtactcctgcaaaatgttagcaacagcagggggcaaagaatgctgcatatcgtgaagtgaaatcaaagcatctttgcataccaaagcataggcaactgaaggtgatgcaatcaactcagtaatatcagatttagtagcaagtaagcatttgggtttcaaattgattgtctcaggtttcttgccatcagattgggcttttttatcactctcacatttggatttggcagtcttagcaacatcatcacgcaaaatatcttcagaagacatgggatgcaacacaattttcttatcatggtacagaaaagagtactggttggacctaccatgatgcatagaatccctatcaaattgccatggtctacctagcagaatattacatgcttgcatgggcacaacatcacattcaacaacatcatggtaatttccaattgcaaaattaatgtgcaccagttttgttaccttcaccttaccactgttgttcagccattggatgtagtatggatgtgggtgcggtttggtgctaagtgcaagcttctccaccatctcgctgctagccaagttgttgcagctacctccatcaatgatcatgcggcaacaacgctctttgaggacacactttgtttggaacaacgtgtgtcgctgattttgctccgccttctccatttgtgcgctaaggacacgctgcacaatgaggctctcatagtgatccgcaaatgcagccccaatgtgctcttccggtggctcattatctgcatggtcagccgcaagcaaagcaagtgtatcatcatcgaaatcactagcagaggagtactcaccatcgtttttgactaccaaaactcgcttgctagggcagtcacgctgcacatgcccaaagcccttgcaacggtggcactgaacatctctcattcggcctgtggataccattgaagaagcactcggtgctggctgagcggcctttgtcacggacttgtcactagatggaggaggtgctgctcgactggttgtgggtgtggaagatggagaagcagtacggccgcccggaggagtggtgcgtgtctgccatgatgaagttttacctgcagaaaaattagccttggcactagcacgtcgtccttgcacttccctttcagccttacaagcaagatgaaacaatcgggtcatattagtgtaatctttatagtctacgatgtcataaatctcgcggtttaacccacccaaaaatctagccatggcagtgtcctcagtttcctctaaattacaacgaagcaagcccatttgtaactcctgataatattcctctacacttttcgcaccctgtctcaattgttgcaatctattcagcaagtcacgtgcatagtcggggggggcggataaatcaacaaancggtgggnngtatctgatncgattactct

SEQ ID NO: 7490 - DNA, 3224 bp, Oryza sativa
  unsure (1)..(3224): unsure at all n locations
taaatccggtggttcggttattctgacgactcatcctantatctntattcttcgtttcaatgtataattctttctgattgtcctgtgatnatttttcttcttcnnncccnnccaaggcgaggttagaagtcgaatcngccnctatgcaagnagttcatcaaggaagccgaagaggtcgccggctctaccccaactccggacgtggtttcgtgtaacgtcgctccgtgcaacgtcgtgctcacctacaacgacactacgggcgctagctctgatgacgtgttcaccacaagggagcaagaaacgctccatgccaagtcagatcagacgagagtagaagaagcccacatgaatctgcgagggggcaaaaccttgccagacccacataaggccaagccatcaaaggtagataagcctatcaaggaagcatctcctccaggagaagctccagaaacaaaggctaggagcaaggagaaacccgatattgactataatgtccttgcacatctcaagcggatcccagcactgttgagtgtttatgatgctcttatactggtaccagatctacgtgaagccctgataaaggcgttgcaaactcctgaagtctacgaagtcgacatggctaaacaccggctcttcaacaaccctttgtttgtgaatgaaatcacattcgctgatgaagataacatcattgaagggagcgatcacaaccgtcccctctacatcgaaggaaatatcggtcctgcgcatcttcgacgaattctaatcgatcccggatccgctgtgaacattctacctgtccgtagtctaactcgggctggtttcacaacaaaagacttggagccaactgacatggttatctgcggctttgacaaccaaggcaagtcaacactaggcgccataacagttaagatccagatgtccacattcagcttcaaggtgcacttctttgtgatcgaagccaacacttcatactctgctctcttgggacgaccgtggattcacaagtaccgtgttgtgccctctactcttcaccaatgcctgaagttccttgatggcaaaggggcacaacaacgcatcgtcggcaactcctcctcgtacactatccaagaatcgtaccatgctgacgccaagtactactttcctgtcgaagaaaacatgcaacagctcgggcgaacggcaccagcggctgatgttctaatccagcccggcaccgcaatgaccccggaggtgaggcgcctcatcatgtcatgttccccgatcatcagcaagtcttcgtcacggaaccgcaagtgcaaccgtaggggaaaatcgtccctaccagtcgatcttgattccaagcttccatcccccgctggagctagtgtttagacactgactactgcaccaatattactcaaagcaagacaccctacctcaacgcccataaatttgggagcgggtactcacaaaggcagcaagttgcctaaaagcgacgacaatgcgccaacaaccatcactctgcaggcaaggcggacaccaaacaaggaagccacgcctacgcgatcaggagtggtcaaaaagagagtagcagaaatagagaaagccaaagcgggtgttcaatgtatgcagcccccggcgctctacacttccgtctctaccccgctagaggtatgggcaattccagatccatctgcttgtacacctcggaccattctctacaaggtcccacaaattcaagaatgcgattctgtgattgaattccctaaacctcactctgatacagaggaagcatgcacaaccatgaaggctgagcctagaacggctcgcctactgcagaaggcgggcatcaacctacggtgaaactaccggctactaccacctccagcgatatgtgaggactggtgggcacaagcagaagactttatcaagagaaaatgtaaagagcaaccaaagtacgggctcggttacatcaacacagatgagaccgatgacgaagatgaagcacttgatgatcacacattccattgctgcactgcaagtgtcactacaatagctgacgctcaactaccacaacacccgttccaggtagcagcagctgaagtcgaagaagaactcgacaccatgcaagcacctcaacaactcgaggatggcggtcagccaactattgatgagttggtagagatgaatcttggacccgaggatgatccacgcccaatattcgttagcgccatgctaacagaagaagagcgagaggactatcgaagcttcttgatggaataccgggattgcttcacctggacatacaaagaaatgccaggacttgaccctcgtgtcgccacccataagctggcgattgaccctcaatttcggccagtaaagcagccgcctaggcgcttgaggccggaattccaggaccaagtcattgcagaagtcgatagactcattaacgtgggttttatcaaggagatacaatatcctcgttggctagccaacatcattccagttgagaagaagaatggacaagttcgagtctgtgtagactttcgcgacttgaaccgtgcctgtccaaaagatgacttccctttgctaaacacggagttggtggtcgcttcaacaacagggtatggtgcactatccttcatggatggatcatcaggctataagcaaatcaagatggatccccttgatgcttccgacacagcgtttagaacccccaaggggaatttctattacactgttatgcctttcgggttgaagaacgcaggtgccacttaccagcgtgccatgcagttcatcctcgacgacttaatccaccattcagttgagtgctatgttgacgacatggtggtcaagacccatgatcctaaacgtcaccaagaagacctacgcgtcgtctttgagcgactgcgccgacaccaactcaagatgaatccccttaagtgcgccttcgccgtacaatcgggtgtcttcctcggcttcgtcgttcgtcatcgagggagattgggaaagtgggctctactcatgatggaatatgatattaccttcgtactgcagaaagcaatcaagggccaagccttggcggaatttcttgctgcacatccggttccggatgattccccactcgtcaccgacttgccagacgaggaaattttcagcgtcgagcttggaacaccgggggagctttacttcgatggagcctcacgaggagatgtaaccctgacgacaccctcgacgagagccggaca

SEQ ID NO: 7491 - DNA, 2957 bp, Oryza sativa
  unsure (1)..(2957): unsure at all n locations
ctatagtgttatttatgtgtgatttttagtntctttatcttntttagtcttctcattcgttcatttctaactcccgtttgttactattgtacttcnnnntttncnnncnccnnnccnccaggtgatttcattgccaatcgntggtacagnagttcatacacaagttcgagcacgttgaagtcgtacatgtgccacgaagtagaaatgcaccagttgacgctctagcaaaactagctgcagcgctggtctttcaaggggatgatcccgcacgaattgttgttgaagaaaggtggctttttccagctgtcctagaactcatccccgaagaggttgaaaccaacaccatcaccacagatgctgttgacgaagaagattggcgtcaacccttttttgactacttcaagcatggcagcctacccaaagatgcagtcgagaggcgccagctacagcgacgactcccctcgtacatctacaaggtcggtgtcctctacaagcgatcttacgggcacgaagtcttacttcggtgtgtcaatcgaaatgaagccaatgaagttcttcaagaagttcaacacggagtctgcggtggacatcaaagcgggccaaagatgtatcatagtattcgattagtggggtactattggcccggcatcatggcggattgcctaaagctaaaacttgtcatggctgccaaatccacgacaacttcaagaacaaaccaccagttccactctacccgacagtcccttcttggccattcgacgcttggagaatcgatgtcatcggcctcatcaacccgccttcctcaagagggcaccatttcattctcgctgccacagactacttttccaagtgggcagaggccgtaccactccgagaagtgaaagccagaatgtcatcaacttcctcgagcgacacatcatctacggttttggcgtaccacatcgtattacctctgacaccccaaaagctttaaagtcccagaagatctacaaattcatgagagagtacaagattaaatggactactccaccggtattacccccaagcaaatgggatgggcgaggccttcaacaagaccctcggaagatcctcaagaagacggtggacaggcatcgaagagattagcatgatcgtctctatgaggcgttatgggcgtaccgtgtcacagtctgtaccccgacacaaaccaccccgtactcccttgtctatggaagtgaagctgtgttaccattggagatccagctaccatctgtacgagtggcaatccacgatgaacttactcgagatgaccaggttcgctttcgattccaagagctcgacgccgtagaagaggagcgcttgggcgccctacaaaaattggagctgtatcgccagaacatggtgagagcttatgacaagctcgtcaagcaacgggtctttgggaaaggcgagctcgtactcgttctaaggcgccccatcgtcatcacgcacaagacgaagggaaagtttgagccgaaatgggaagggccgtacatcatcgagcaagtgtatgatggaggtgcctatcaactgattgatcatcaagggtcgcggccaatgccgccaatcaatgggaggtttttgaaaaaatattttgtgtaaacttcgtgccttttgtttctaaaaaaatatatgggcttgccaacatgcactaaccattgcactgcttggcacccctttcttttcatttttacacggacatcgtgtccaacaaaaattcaaaaaatggctttccccatgtcacgctgagctggtatgtgaagacttggctacctcagaacctcttagcaagatccaatgggtgacatgactgactacgcctacgactaaacatcctccacaccaacacacaagtacaattggtgctcatcttcatggggcaacaaagacttgcttgggttacttctcagtaacaagttggtccacatgctctcgtgccctccggtgtgcttcagacccatggagatatcaagccccagggaagactataggagaagagcaagaaagggctacctacctcaacacaagttgtggcctagtgtgcagccacttgccattcctgtgaggtgtgtcaacaagggactttacaaaataaatcggcttgcgaggattacgtagcccacaaaggggaatggttatcctccaagttctaaggatgccaagatcctagatcaatctcaacgaagtcatgatgatctcaactcaagaaaacaatgcaatatcaatctcaatgaagctgcggtgttctgaagccacgaggcaaaaaaaaaaagaaacaaaaggagaaacaaaaatccaagcaaccagttatctccactgcattctgtcagaaggaggaggataaccattcaccatcctcagcaaaaggaaaaggccgctctcatagccattcccctaaaaccctctctcaatttagccatacctaaatctctcggttcgatgaagcacaataccgggggcatgaaactcgtgggtggtccagtgacaagaaaggctagagcatggattttcgctgccatccgaaaatatcaccgcgtatactactccaatgcacaaacacaacaggaagttaagttgtcagacggcaatcgtcatggtcattcagcggttctgatgactggttctttggcaatctcgtctgaaactacctcatagccagtgttcagtgggaaagccaacattttttttaaaaaaaaacaaaaacatcaaaacccttttcggtgttgggttccgctcttttaaacccgcctggttgcgcggctctagcaaccatgctcgatttcttttatgtgatgcaggattttcgcttcacatctctcagagacaacacttcgctctccaaggcaacacacgtccttttctggcaagtcggaatcgcagctgccattcggtcacatccggattaataaaggacactttcgggagcagtccggcgcacc

SEQ ID NO: 7492 - DNA, 846 bp, Oryza sativa
  unsure (1)..(846): unsure at all n locations
ggtanactccttgtgtaaaaataaagagggcttaatttttcttttatccaagcaagatgtaattttaagcattttaattcttgtttttttttcaggtcatcaaaagcaaacgatctagttaagagagtctatggcagcttggtacctgtgctagatggcgaaaacctgtcaataaggattttggtaagtctttctagcaatgttgagtgcatgcatattcatatgccacaacgcatatattttgatacgtcgtaacctaactctttgtgtgcaatttctttcaataggttgatcactccatagttgagggcttcgctcaaggagggaggacatgcattacctcgcgtgtgtatcccaccaaacccatctacgagttggccaaaatcttttttttcaacaatcccacaaatgttaaagtcactgccaaatcgctaaagatttgggagctgaactctgcttacatccgtccatatgtagactagatcatttttaatgtaatgggaatgaatgatttgtctacatttgttagttatgtttttataggctaatttatcttttttgcttccttctttatgtcaaactacaactatgacatattactagcaactgaaataaaacataatcaatcatattgttttgccacaattttgttattgtgtgtgcgcatgcgcacacgtacgtgcacatgtgcgtatgctatcactctacccctgatgttattattagccatcaccgtaatgttgtcgtaagccaattgtgtcatgtttatcctacataaacaatatacgactttgcgaacattcctcttctgttgggctacttgcagacgaagcatttcaccgcggc

SEQ ID NO: 7493 - DNA, 804 bp, Oryza sativa
  unsure (1)..(804): unsure at all n locations
cgagagttttgatggcctccttgcaagtagnccatcacaattgcttactgaattagctgttaatgccaccggcaggaaacattttacactcaattctggtctaatcagatttaagggcagagtctggattggtgataatcctacactacagtccaagcttttaactgaattacattccagtccaattggtggtcactctgggttcccagttacatacagaaaactgaagcagctatttgcatggcccaagatgaagaaaatgactaagacctttgtgcagcaatgtcagatatgcttacaagccaagcctgacagggcaagatacccagggcttttgcagcctctacctgtacctgagggtgcttggcaagttatttcactcgactttattgaagggttgccaaggtctgatcattctaactgtattctcgttgtggtagacaaattttctaagtatgctcatttcttcccttatcccatccatttactgcactaagtgttgctaagttgtttatgaagcacatttttaggttgcatggccctccttttgtaatcatttcggatagggataaaggtttcccaagtcagttattggagcatctctttgaaggggctggtactaaattacactttagctcagcttaccatcctcagtctgatggtcagaccgaacgtgtcaaccagtgcctggaaatttatcttcgatgttttgttcattcggttcccactaaatgggctgcttgggtgcatcttgctgagtatttggataacactctttttcatttcttagggcaaagctactcn

SEQ ID NO: 7494 - DNA, 6056 bp, Oryza sativa
acatcaatattactctaaaacggttcttcagtcgtaagaagagagagaccaatggctggttcacttgactgaggtgttaagccggtcggacttgactgaggtaaacgcgcaaccagtcctatatattacagttatcacccattttacccatgataaattcatcacataactgttaagctaaaactgattaaagaccagtgacgtcggcatctacaaaagatgatgcaccagatggcgtatagtccttttggttcacttctcccccaaagatacaccagaaccagttgcaatacggtccacccaaaatataaacatccgagaatgcatcgccatccaagcaaaagcacgggccggtatctataatatccacttgttctgctctttgtgtattcccaaaggctacggtctacgagctccccggtgcaacggcgtctgctccggcctgacgtcgctgtcggcctcactggccggacgcgtgtcgatcactaaaagctccggcaaatacaaggccgagacgatgagacgataaggtctatttgatttgaaggaaaaaatagaaattttagatgatttcaattttataggaaaatttcttatgaagccctttgaaacaaaggattggattatccaatcctttgaaattcctatggaatggacaatcctatagagattttggacgaaatttagcaagagttttaacctcttgctaattttcctttgagtctatctctctcatccagttcctgtgtttttcccgtggttcaatcaaacggttattcctgtgttttttatgcgttttgcaattctctgttttacacttacatttctatcaaaatcctacgtttttcctattcctatattttctcaatcctgcgattcaaaggggcccttaagtttgaggagatgtacagatccaagcaggttgcagaatctgttgcatacacgcgcacgtgaagtacgtgcgttgcacaatgcgactgatcgtttgcagagagatgaaaatgcgcatgtgtaaattgatctcaattagcagcaaacaaggccgggaaagctatacatcagctagctagctttcatttttgcgtgcggagaaagggcgtgcgtatcacactgtggaccacatgcaactcggatcctggactgtgcatgcatgctattgatcactgctgcttgcaaggggcttactaccaaaattgtgtactatgatctgcggctgcccggttggtttgcacgcttgctacagttcacttgttattgtcagccatcgatctgatagccatcctatttccagctcagatgggatttttaaatcagtccaagaggacgaatgtttcttcacaaattcgcaatttccagataaggtatcaataaccatatgcatatgcacggcgagtgtggagcccttggtccaaccggcgagagcaccgaaataaattaagaaaggataatactcctatagagataaagtagggatggctaatgatcagttcgagcccacgccggacaccagccgccgctgcctgcttgcacagcatctccggtcggtccccattccgcacagttaacttcattggttctacttgcctagttgcatcaaattttctctgcacatgctaatctgcttttaatcaggtttaacatagatcactccttggcacttcagtacctcatatatcactcccatatactatgtacgtaggtacggatgcagtactaaagtctaaacttagctactaatatctacagtactaaggttcagcaaaaaaagttttacttaattatgcagcagagaagcaaaggtgcaaattaattatcagaaaacccatgcatcagtctggagttcttggagttctaacatatgtagcccactaggcctgtagccctggtcctgtccaaatgtgacgtgtcttgaaaggcttgagatccttttgtccccgtttcagtaaggatgacatgagtagcatatttttggcttgtgtggcactggatctgtttccatttggaggagggtcgccatcgaaaatatacttaggtcggtcgagaaacggggtccagccgtggccgtcttgagagcgcccatccaggagcaaacaaacgcaactaaagcctataggcggctatctaagctagctacctgcgaagagcacatatggcggaatccttagaaagccagatagcgaacacgaccaaccaaagagagtttacatatagacagacttaaccgcatgcatgatcaaacctacacacactaagctaacacacatttacagtcatgcatgagggtaaaaacgcaacgaccgaccgcgcttgatgcgtcaccatgattacctggctttttgggccagacacgccggtgctcgttttcagttggggtcgatcaaatgttaccatttcagacgagagaaaggtttacacccactctatctgtgaatttttcagatgagggaaggtggcaactagcgctggcccgtgtccaccactgctagtctctgttgctacataagctgcacgcggcagtgaaagctccgtttcggggggtaggctgagcgtgatcgaaggaagctagctaggggtcgctgtcgttaacgggtccgggaagttgcaggttacgccaaaaaaggccaatagaaaaacgcggggctccgccgcgtcgctctccgcccccggtgttcgtggattgtagccacccttggcccgcaatccgtccgcgctttccgaccgagtccccttcccctgccctccgcgcgcgccacccacttcggtcgcgcccaggccatcacaaccaccgcgcgcgggatatatagaccccgccgcggcctggtccctcctcatgcgatcgatatagctgctccatccgtttgaaggctggctgctgctggccgagggaggcgctgcatgctgctgcaagctacgaagcagtagcaattgcaggcgcgcgcgcacaaggtaagagacggctcgtccatttccaacccgtggttttctgcttgatcaatgatgctagcttgtttaaccttttgtttgttaaccgcgcactgtgcgcgcgtgctgaactggggtacgtgctgcgtgattagcaatgtcttttcttccgtcttcgtgggtacaaggttcgcgagtccctagggcctaggtgtgtgcagtgtgctttgtcggatagaacggcgagcaactttagctctccctagtttgcgctcggtttgtttagctgaacaacttgaactcgatgctcctgtcctcctctatctcgtcttctttttcacacaaaccggcaaaggtttcatcatggatgcataaatggaagtggaagcaaggatacacctcctgttgatcaagctagtcttctataggagtgcagaagagcgagaatcagcctctggtcagagaaacttcactggatgaatttccgattcatcttcctacaaaaagaaagaaactcctcagaatcgttagagagaccagcctctggtcagagaaacttcactggatgaatttccgattcatcttcctacaaaaagaaagaaactcctcagaatcgttagagagaccaggtgcaaaccgatcgaatgctttctcaattaagaaaaggagtatttcctgtgagatttcctgattctagctagtactagtagacatgagctaacgagaagttggatgctatatgttcaaattcttccttggaattcgttacacatgcatatatgcatcgttatcaaactagcctgtaactgaaatatagcttcttatcgtgcatgcagttcatattaacttgctaccagttcgggagctatactttgatccgcggaagaagatggacgcattctcccatgtcccgccaggttttcgtttccaccctactgacgaggaactcgtggattactaccttaggaagaaggtagcactgaagaagatagacttggacgtcataaaagatattgatctgtacaaaattgagccttgggacctacaaggtaatcacaatttactccacttattctacaagcttgctgcttatctctaaccctggattatcataactagctaattaatcgacatctccaaaatgatgctcaaacagaacaatgcaagattggaaacgaggagcagaacgagtggtacttttttagccacaaggacaagaagtacccgacgggcacacgcaccaacagggcgacccctgccggcttttggaaagcaccgggagggacaagccgatctatgtcaagaactgccttgttgggatgagaaagacgtttggttttttacaggggccgggctcccaaacgacaaaaaatcggactggattaagccccaagttttgcttggagaccaacgaatacggagctccccaagtaagtttgtgtactagtgcatgcatgctaccgaggattcagacttcagacacctaacatgctccatgttcaggaggaaggatgggtggtctgcagggtgttcaagaagcgagtcgcggcggtgcaaagggcggccggcgacggcggcgactcacctttctggttcaacgagcacgtcgcgttcatggcgccggcgccaggcctcgactcgccgtaccatggccaccgccagagccacccttgcaagctggaggtagagtatcaccaccacctccttcctcaggaggcggcgccgttcatgcacctcccaaggctggagagccccaagctaccggccgccgacatcattgtcgccaccgcagcgtcgtccgctctccagccgtgcggccacacgacggcgcagcagctgcagctgcagatcgagccggtctacgtgacggccgatgcgtcggcagcagattggagggatcttgacaagctggtggcgtctcagttcggccacggcgactcgactgcgaaggagcccagttactgcaatccggtgcaggtgtttcaggtcgagggaaagcaggaggatagcttggattacgtgtccacgtctgcctcctgcggaggggaggaggatttgtggaaatagccgcgtgaatgatgcaaaacacatactaacatatacgccattgtatacagcctaataacattgcggtgtgatttgaaccagtgtataaaaagctagctttgtcatggtaattaccacctgcccatctatatatcccaatatagtataaccgaagtggttatacatgcatgcatgattaattaatttgccatcaaatcttccgtgtttgaactgtgaagtccgtaaggagttacttaaaggttcatgacgaaaaaaattgtcagctgtaagcctgtaacaagtgcctgcctgatagacagcagtctattatccgcattacggagttataaggactacatgtcgaattcgctatttctctttgatatatacggctatacgcacgtgcacctgaattttctgtgatgggaagtttaccggcagagacgagctagagaatattaccatacggtccataccgaagaaagaaaatatttaaacctgatcacaaacctgaagaaaaaaaaagaatactactacgcctgaacaaacctaattattattccgtctatgtaactatgtacctgagatttctaaaacccctcggaatccactaatgtaggataaagcaaatcatataacgacagataaagaaagaaaaacaaactgcagtacgtgtaggagcgttttgatctaaacctctcacaggagacgcgtcgagtgcttcagccttcagtacgagttggccgtgggggaagagcgggggcggagagatcagaaagcccggcggccgtcgcggcttcgttatctttggcgaagcggagggatgggcacacggcggcggagtgccgcgctcacgagtcgcattccccttgcggtcgatcgagctcgtcgaaggtcgaacccgtgtacggggaggagtcctaggcggagaaggaaaggggacgacccaggcaggcgttggactggggcgtggcctgcttagcgagtgaaatgcgattttgggctggctcataagtttgggcccggtgtaccaaaattgtaggtcatcggacctgaaatacggaaaaaggacatggcaaagtttgggg

SEQ ID NO: 7495 - DNA, 1019 bp, Oryza sativa
  unsure (1)..(1019): unsure at all n locations
tcctcagtaggttatgttaaatttaaatttatctccttatacttcgctcgaagaaaacattattcggttatattatttctccccccccccnncagggtttgattgacagctcgttggnacacttccncatcacggcgggcactgtttcggggtccacagcaactcctttagcagatatcacgtgccctaagaatttgacttcggacaaccagaactcacacttgctaagtttggcatacaattgatgttcccgcaactttcccaataccagacggagatggtgctgatggtcttcctctgattgtgagtatatcagaatgtcatcaatgaaaaccaccacaaacttatccaagtattccatgaacactttgttcattaagttcatgaagaaggcaggagcattggttaaaccgaacgacatcaccgtgaattcatacagtccgtatcgcgtggtgaatgcggtcttcggaatatcttcttcacgaatacgtatattggtgatatccggaacgaagatcaatcttggagaataccgtggcacctttaagctgatcgaacagatcatcgatccggggaagagggtccttgtttttgatggtgacttcattgagagctctgtagtcaacgcacatcctcttcatcttgtctttcttctccccaaaaatcacaggagcaccccagggggaagtactcggacgtatataccccttttctttcaactcttccaagctgttttttaacttcggccagttcatttgctgccatacggtaggctcgcttgtatagaggagtggttcctggagcaagatctatccagaactcaatctctcgcttgggcggcataccgggtagttcttccgcaaacacgtctccgaactctctgtgatgtgctaaaggggagtgcattcatctggggggnnngggggggngaaaannnatcnatgaaaccaagcctattattatatacagctccagtatatcatcccacggccgcacgtctaacatgtacattccgcggc

SEQ ID NO: 7496 - DNA, 974 bp, Oryza sativa
  unsure (1)..(974): unsure at all n locations
gtacgagtttaaattggaatgacgaanggtgtctggtattacgttactgtaaacgtcttggcgtaacgttatgggtattcgttatggtatgtgatggtgtataggtacgcgaatcgnnnancnnnncnttagagcgtgaaaggttggatggctnctcatgcagtagttcatcagatgatgtccgagatcttgttgcgttgctcggaaaaacgtcagatctaatctcgaagggattctccggacttctggacaacgttgtaaagatcaaactgggtgctagggcgttcaaaggtaccctagaaattagcgatgaagtggtcgcgaagttccgcccaagattcgattgtgccacggggtagcccgtgaagctaggaccgggcagaatccgctagggccacgggcagataatttgccatagctttgctgtctcctcctggtgcgcgaattgcgagactgtagacggtgagctaagactcagggttggtggagcagtcatacttctcgattccagtcagcttgaagctggctggccaatccactcgacgcaggtcacttgtgaaggcagcaactccatccacgtcgtcgtcgtagcgatctggtgaatggtggggaatgtagcctctcgccgcgcgcgctggttaatggtctcgcgaagatcgatgggacgcctatgatgtggggagtggggacgtttagctcgacgctccctttgccggtgaggaggcgagtagacagatcgtttgccgtgatccctgctcttgcgacttgacccagcgccgacgatgctgaggcttggatggtgatagtcttgagaacgaagaggaggaactcggctgccagtcggcgtgcggacgcttgcggaattaaccgggaccgaagctgcgatcatggtcttggtcttgttcaagatgtggaccacgtgattggcctggatgagtgcgtcttccttagggagggggtaaggagggtgatcc

SEQ ID NO: 7497 - DNA, 2110 bp, Oryza sativa
  unsure (1)..(2110): unsure at all n locations
ctgagggttaganggttggatttgacnnnnnnnnnnnnnnnnnnnnnnttcatccagtcctaaattgttatattatgggacagaaggagtatattttagacatattttctattgttcatccacattttaagtatgatactacctccataccaaattatatctatttctagcacagtaacttgtattaaaatgaaactatttctccacctaccctcttctttcaaccaatcacaaccattctcttcacctattttctcttctcaaccaatcataacccctccaattaatcatttctacatacttacttaatatacgtgcctaccttaaaatggttaggttatgggacggagtaagtattcggttgttcatccagattttctggatgattccagattttttttttaccacacacgtggaccacaaaactgttgtaatctctgtagcacatcgaaccttgcgctgcctttccctcaggagacaaaccccgccagctcatgctcggctcaccactccacacgtgcgcagctccccatggcccgcttgtacgccacactcatcgctcgacagctcactcatcagcggcaaagctgattaccaccaccactcgatcaatctctcaccggatcagcttgaaaattctggagtttatctgcactgcatctctcgtgcaccagtggttgatcaatgattcttgcatcaaatgtgccaaaggttcgagtttgtttactgcagtttctctgttggtagcaaaaacccgtgtggagacatgtctcgccgtccgagtcgttgccatcggttaatcgttaatcaggttccatacgggcagagcaagacagatttacaagcagaaacacgagaaacaaaacagtaacgtcgcaagaagaacaatcctacagatacatgcatggcagctaccactagtctgtactctgtacacctgagagcttaggacaaatcatactcgatcatcgtaagtccgcaccagcagctcaccggcgcgagagcgtgtcccacaggtccgtacaccggcggcgggcgaagccgacgcgaccggcgtccacgtcgtacaccacctcgaacccctgctgctggaagttgccaagcgtccctgccggaccaccaccgtcttcgccgtcgtcgttgttcccgccgacgttcatcagcatcaggcacccgacgcttcgccccttctcgctcttgaaccccatgaagtagtttctccgcggcagcgccaccgtcgcgttgccacggaagtggagcgccaccggcggcacggcgcggtccgacggggagtagtggtagcagggggcgagccctgtctgggcctccgcgccctcggcgcgcgtgaaccgcgccgcggtcatcgcgcgcgcgaactcgttggccacccgcgcgaacgtgtcgcttggcagcatggtgaacgtcgtgcccgagtccaccaccatcccgccgttggcgtcgcggttcacgttcccgagctcgggctgggcctgtatcctcttcccgcccaccgagcgggcttcgagcgccaccgagtacaagtaggggtgcttcgggttgtccagcagcggcgtgtacacgaagtccgtctcggaggcgccgatcgcggcggcgtccgtgctgcgaccaaggatcaccgggcttgaccggataacccggtcggcgcggaatgagtggcgacagaggcagtaggaaaacctgccggagagcgacggggcgagctgggccgggagcgagaccgggccgcgcccgaacccggccaccccgacgggctcggcgagcgccgtgtgcgcgcaggcgaaggtgaagttctccacggccatggacgcggccagcccgacgcgtccgcgcctcaggttcgcgacgaggctgccgtccccgtacgcgtagtacagcggcgggcacgcgtggcacgcgcacgagtcggtctcgatcgcgtcgagcgggcaccgcgccgcggcgcacaggtcgcaggtgggcgcggaggagtgcgcctcgtaacagagcgacgacgcgcagaagatgcggcgggagtcgatcggtggggggagcgggctgtagtggttcactccactaatgnggtntgtccaaggcgggagtcactcatagg

SEQ ID NO: 7498 - DNA, 2298 bp, Oryza sativa
  unsure (1)..(2298): unsure at all n locations
cgtgcgcattgagttcantcgctgtacanagnccaccaatttcgagcaaaatagtgaaaaaaaaatgggcttcctagagtccctactggccggaaaggtccggtcacagtaatgaaatcataagaatttaaaatatcttaagtaccaacagttgagaaataacatatggaacattcttgtaagttgtaacaaccaataatttagcaaatcctggaataacttcttgcatgggattttaacattcagtagactattaggatcagcatgtgatcataaaatggtcggcccagtaacaagggagcaaaagatacataactttagctggaaacttgggatataaggaaatattcaaacaatacattcgcacagcctccagtagcaccatttattcctcctcctcggcctcctccagccatttaacaaaaggttccagtgctttgacgaagattgctgacataaaatgcaaatattatagcagtttcaaacataactgaaactctacaacatctacatgaaacaaatattatccactagtgattgcaatctaaagttcgcattggtagttagtttctacttaacatgaagattgaagttagggcacggaaaacaagaaaaacagaaagccattagcgtatgactaatcaagttataattattattataaacttgaaaaatggatttttctgatattttaaagcaacttttatatagaaagtttccacataaaatgcgttgtttaacagcttgaaatcgtattaacaaaaacctaggtaaaatcagtatcttgtacaaaagtggacctacgtaaggcaattacctgccctttgggtttgaacccttgcggaaccaaaggaggatggtatcttcagctaggacatcttggtcatacagcgttctgattatttcaggaaatagcttcatcagcttagcatcctcatagcactgtgtctgaactttgtatatgagttcgagttcaagcctgccacttgtgcagaatgcattcaaaaggccagcccatgctttcacctgtaaagggaatatttttagatataataaatgatacccatcataacaaagagaacctagaaagatcaaaatggtctttagaggttaatcctaatctccacaagcataactaatagaacgtgcttcttcctatttgggatctagacaacgcagcatctagagttttccctttcagcaaactgcaaaattaataatacacttattcatggatatcttcaagtaatttgtccaaaatagacccattccaaagtagagttaaagctcttaaattggatacctaatagaccatccatcattgggaaatgtgacacttacacaactttagtgaacatacattatgaaagcagccctcatctaccaatttatttgaatgcattccacactattagagttcacacattcaaatactcacacatcacctaagcagttaaaaggtaatcttcccatcaagaggatatactgtccagtgtagtaatagttggaattcgtacaaccaagggaccaccaagtggttaattgacatgcaaataattgatcaggattatactgataatctggtagtcatattaatacatatatatacatttgattatgatctcctttttcttttgtgaggatagttgtgaaattttagggtgcgttcggcaccccaagttcccaacccctctccctcgttttccgcgcacatgcttttcaaactgctaaacggtgcgttttttgtaaaaagtttctatgcgaaagttgcttaaaaaaatcaaattaatccatttttgaaaaaaaaatttagctaatacttaattaatcacgtgctaatggaccgcttcgttttccgtgcacactgtttgggttgggatccggctggagtgaacacagccttaatctattttagaggcaacttaagacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 7499 - DNA, 1685 bp, Oryza sativa
  unsure (1)..(1685): unsure at all n locations
tttctcttggatgttgattttattggtgttgagatatttcttctgcttttataatgttagtaatgttcgatttggtatatattcttttnttctcnntnnnnncnnnnnggaaggtttgaaatgcanctctcgtgtagncncaccatgaacaccacaaaacaatgttgtacacttgctgactatcctcacctatgctagtaggcaaaagtagaatttcagaagctgaactaagatatacacattccaagtatcccacaactgctttaaaatcaatgccaaaataaaaagatttacctgccgaagtgctgaattagaattttgttgctggttcttcccagaccactgaacagcctccatcagcacatcccatagcatgcgaacaacctctatatcaggaaatttagcatctttcacctgttgcttgacagcttctgtgacttcagatatttcagcctcttcattgatcattgttgtcagtgttaactttatctccttaagtttaacctcaaacatcttcttttcattgtactcaacaagacttgtcagaccttctttactgaagagagcataatgaaacactagaactcagaatatcatttaactacttctgttcagcaaaaaatcatgataacaacttacgtgaaatgttcagataaagcctcggaggttctttttgccgatgggaaaaattccagcaaattgtcctccattttgcctttcttcaaaagtgcaataagatcatctaaagtgttctccttcagatattctttgaaaaactcagtaatgaacgaaagcactatccctttggaaacaagattatccttgagcagtggctggaagacagtttcaggtggaagacctgataacttctgagaaaaggcaagtgctgtgaaaatggcaaagttcttcttctcattttcttcgaagaactcaagtgactgaaggaatttgcgcataacattttcaagattctttatcaagaaaggccttctgcgcaatgttttctgaatgtagagaacagaaggcaaaattgcttcacgctgcgctgcacaatcaagtacagaataggggtgacgctctccttctttctcaggttttattgtgccaggctgagtgcgccctccaatgaatacaacctgcagtttttcaaatatttacatttaagtgttcgttgacaacaagggttattcaaggaaattgaaactccagtacttaattcattttgcacatctttcaaaggcacaatactatttgtagttttacttttgttcaaaataaacacaaaagaattaaatcacaaatagctcaaaaataactgtgtatctatactcttttaatcaggtagtggtggtggcacctactcccattttaaatgtttgcatgttacctcttcttgaacttcttaatattaaaaaggatcaaaactaaatggatagccacataaaaaaatagttcaagatgaatattccgtaacacattaatacattttgtttaatccattgcaaagcaccggcatttagctaatagtataaaaatagcttgacaaatggcagtttggtgccacagagtacagcatccaagcaagcaagcaagctaaaactccaaactaattacaatataagctagaagagaactggaataatatcttagttaactataaatatagatgtggaccttaaaaggct

SEQ ID NO: 7500 - DNA, 5378 bp, Oryza sativa
  unsure (1)..(5378): unsure at all n locations
gatganctcgctgtccgntgctcatacatttttggtgatcccggccgatttcgggataccgaacggggcggggacctggcctcttcccgactggttcgaatccgagtcgaggagagaaatcttgcccaagtcgttggtgatgaagtcgaggctgccaaaccgaaacgcctgcccaggtgggaagacgaagtcgtcaatgccggagacgaaacccatcgcactagtcggcgaagaacttgatgctacccctacctggcgcggcaactgtcgaaacaagatttcagcaatactaaaagggggtggctatcaagctagaaaagttgatgggttgaaagacaaggaattttatacaggttcaggccttcttaatcaagaagtaataccctactcctgtccggggattgatccgccgagtatattattgatcgtatgatctgggagaaaatcgtgcccctagaggcacccggacccctccttatataggggaagtggtccgtattacaaaacacaatccatatccctaacggaataggtagttacagataagatacaatcgtaaccgactaggatcacgcgcatttccttgacgtacaagtttggaatttaacccgagtccctttaaaaatattctatctacacatggcaccccatacctagtcggactatacatgccgtgtaagtatggggtatccataatctccatagtagcccctgagacttttacagtcgatgaaatagtcttctctcgtaatccaaaaggataatgcgagtgctccaacttttttctgctttggccctccgagtactaagatcaaagactgtgaaggctagaaatagaaacattcacgtgcatcaattagatgcacctaattaggtgtagcctccgattatgtgattagttaaaaactaagcatatagccaaggtgcaaataacatccaaccgagtggttttacaaccggatcatccatggtatcacacagccaagcatatgcgacgtttaataaaacatccagccgactgctttagctttgatacaccagaaaaggagatataaaaagtcccgagtgagaaacactctaaaggtttataaatcaacacatatgataagaatcctagtaaaaactctcgaaaaagatccatcaaatgtggtataaatcatgacaataggtgaatctaaattgcctaagctatgactcacaccatatcaaaataagcatataacatgccaagagaatgaccattcaaaaaccagtcatctcaacaaaacccgaacagcttttgcagcctaaaaaggcttacaaaattagtataacacttttccgttgggcacctttttatttgcatcgtagtaattccaaagaattatctaactacgtcaaaaaggattttaacagcattgggctatactgttgtgagcaagtgttgccgaagcaaaatgcctaagtccctaaggatcacaacttagacacgacgagatagcaaaattgggctgaagtactgtttaggcctaggcccattagtactcccgataccctaatgaaataacaccgaaagcaaagcgtcggttcgtcttccccgccgaaactcttgccactttcccaattctctgctacggtgtgaaaccgcgcccgcgaagctagggttcacagattcgctccaatccatcctccaaaactccacaagaatctcccacgcaaccaccgcatcaatctcccatccattcccagccacatttcgaaccaaatcacatcatccagttcgcatccatggcggaagagagagaaagctttgagagtcagtgggcgccctccgatgtaacggaggaaaacctgaaggagatggtggcgcacggcgttcttccggcaaaggagatcatcgggtggcgtccagcatgcggtgaaacatttccgacccccgacacacacgaggtggtgctgttctcccatttcttctacggcgggttttctgttccaacctcaagtttctttcgggcgattttggatttctatgggatcagtttgcatcacctaaaccccaactccatagtccacatcgccaatttcatccacgcttgcgaggcttttctggggattaggccacattttgctctatttcgccgcatcttcttcctcaagccccagccaaataagagcaaaccgtgcgtagttgggggagccggatttcaactgagggggaccttgagccaaaaatacttctccatgcccttcaagacctcgaacaaaggttggcacgcgaactggttctatgtgcaaaaccccaagccagcgcttcccggatactcctgtctgcctccagtatatcgcgatacctggaactcactttctatgggagaagaggctgcccaagcgcttgacttattggatcgcatgctgaagcttaaagaacagggtctgcaaggagagcaaatcacccggcactttatcaagagccggctggcgccaatcaaggagagatcccgcacagcttttgagtttgatggcaagcatgaccccaaccgagagaacccagagtctcttgagttcaaaattatgtaggagagaatgtacaaaatcttctcgaatgccattgtggtcagctattcacacttattgctagtcgtgccatacaatacgttcaaccctcctccaccggtatgtattatacaccttagcctttctcaaagcatgcttttatcttctgtaaggtcgactgaaaacttggaataccatgcacaggaattcgctttgatgaaatccgatactccaattgctcaacgccgctcacctcgccggcacactggccaagccagtggagggccgaagatccagtcggacgtccaacccaacacctcgaggtcaactaaccagtcagattctcgtaagaggaagttggtttcaagtgacgatgaaggtgatgacgcggaaaagacggacaacaaaggggtgattgggaaacagccaaagcaagccaatccgaagaagaaaacgtccagtcgtcccatgccaaaaataaggaagtcatccaggtatgtgtcatctagcaatttcccctgtttcgctagtcactcactattgaagcaaagctgatagcatgtctcaaatttgtaggaaaccatctgacatagatccctctggaaaagaccccatgccgactggcacagagactagtccttcagcagaaactgggccaactgctgaagaccgcccaggtaataatcaaccggcaaccggcaatatagatactagcaacgagcccccgactggaaaccagtcagccgaagctgaagtcggtgctgatcaagagcccccgactggaaaccagttgggtcagaacaaaatagagatatcccagaagtgaaggctccagccaacagccctcccaagacgaacgctgctgctgaccttgtatctaactctcctgttagggtgcaagtacctgctcgtccccgaccgaaaattataatgggtaaacaagtcctccaaatctgtcttgatccgacaaactttcttcaattgcttcgccattattcatgaatatataaggcccaatgttcggtaatgaagattaggtcctccaaatgcgatcaggtaagattctcgcccaccatattagtcaagtggtgggatcatgaaatgcaaccacagggaatcgtgataaataaacaaaaggaaaacgagcaagtatgtctgctgaaaaagacactcggccaatcgactcatcttgtaaatgtaactctccctatacgcagcctcaatcatcctgtcggccactttacttgaacaaagataaatttgcggtgcagagaatccatcttaggaatgaggcgaagaccgcaaccctcgaaaaattagttccccacctggaaacccttgaagcaaccagagaccagctgcgtgaagccaaagagcttgccaggaagactgagcatgacctcagagatcggactgccgagcttcaagactccaactttgagctgagcggttcattaaaaggtaaatctcatccttatctgacttgtttcgtaccgctatccatgtgcaactaaccaatgagaagcaatacagtgcaagctgccaagatatccgagctggaaaggcgaatcaaggctctagaaaaaaataagggcgaactaacgaagcagagggactcagctctaaaagatgtcgaagatacttgtagctggaacatcaaaaaaccactcttatcttcatgcccactcgttgatgtgaatctacttgtgcagatcgcaaaatcaaatcccaagctcagttcgacgtcttgcttaacaaaatcaagaggcttgagggagctagagatgaggtcgccaacgccgctacaccactcgtccaagccatgttttttataacaacaatggtccgagctcatttgttgctgccgaaatcttcgacaagctgagaattgctccggatacatattttaagaatatcaaggaagctggaagtatgggagcaggcctggcgttggcaatgaccaagtccttgtacccgaagattgatattgatgccattgatggctttgcagacgggacaagcgaagaagccactcttgacctcatcaatgacacgcagaaagctgccgacaagatagctgctgatgttgttgagagattccaggacaacgacctctggccgactagatctaataactctgacgatgaaaagactgaaactgattgatattgtattctgacaatgatgatgatgatggaggcacaatttgtacaatactgatgaatttatgttgtgcttgatgatttaaactcagctcctgatttcttaaaagtttttgtcaaaccttactgagcctagaacccgcaaaagctgttaaaaactttcagtcctcattaactaagccaaaaaatcaaacaaggcaatgataaatcaagtaagcaaattgaattgataaaaatcacactccattattattatagtagcccccgactgataactcaagtaagaacttgatgttaacagtcaaagaagaagatacaaaaaataatgcctaagcataaaaacgacgaagatgttcgatattccaagagttgtcgatatgagtaccgtcttcacgtttgagtcaataagaacctggccgagtaacttcagaaactatgaacagtccttcccacaagggagataacttgtgccgatctcgtgtagtttgaattttcctcagaaccaggtcgccgactaagaaagctcgtgatcgaacattgcgattgtgataacggcgcatcccttgtaaataccgagccgactgaattaaggttgcttcacgggcttcttccagtcggttgagatcatctactcggtcttctccatagctgatgagctacttgacagcgagcaaattcaccgcg

SEQ ID NO: 7501 - DNA, 1944 bp, Oryza sativa
  unsure (1)..(1944): unsure at all n locations
cgcgtttgatgacngtgtgtgnnacnaacannggccggacacagatgcgtggaccgcaccaaaccgtgccttgatcgtctatggagaaattggnggctttcttcttctgtattctttttattaactcttttatcctttcgacgtctttctgggcttcccggatttgcgactctagggtaggctgtactgtcaagctggcagggacacctgactgtaccacggtcagcctcaacttttttaattctctgcacaggcgatcttggtcaggccatatttgagctacgttgcaatagaccttgcgacttagcgcatcagcgaccacgttagctttaccggggtggtaatgaattccaagatcgtaatccttgattagttccaaccatcttctctgcctcatatttaactcggtctgagtgaagatgtacttaagacttttgtgatcggtgtatacttcacatctgttcccgattaaatagtgcctccagatcttaagagcatgaaccacggctgccaactcgagatcatgggtgggataattgacttcatgaggcctgagctgcctggatgcataggccacaacctttcgttcttgcattaggacacatcctaagccttgtcttgatgcatcacaaaagatctcgaaatcttttcggatatctggcaaggtgagaactgaggcagtggtcaaccttttcttcatttcttgaaagctgtcttcacaggctgcagaccattgaaatttcttttccttctttaacagctcggtcataggtctgactagcttagagaatccttcaatgaatcttcgataatatccagctaagccaaggaagctgcggatctctgacacattcttgggcgggttccaagcaagtacagcttcaaccttgctgggatctacttcgacaccgttggaggagatcacgtgtccaagaaatgctactcggtctaaccagaattcacatttcgagaatttagcgaatagttgatgatctctgagcttttccattatcagcctcaggtgttcagcatgttctttctcattcttggagtattattaggatgtcattgatgaacaccaccgacaaatgggccaagtattccattaagaattttggtatttaaggtcatgaaaaaacccttgaaccattggtaagttccaaagcaatttttttgaacttttttgacccataaccgcttagggaaagcgggctttggaaattttttaaaaccctgtttttaagttggggggaacccggttctaaggtcaattttagagaaaactcttgctcctttaagttgatcgaacaaatcgtcaatccgtggcaacgggtacttgttctttatagttacttcattcagggctctatagtcgattaccattctctcagagccatcctttttcttaaccagaagcactggggctccccaaggggatgagctaggtcgcacataacctttactctccagctcttcgatttgtcttttaacttctgctaactcattagctgccattcggtatggtctttttgcaattggtgcagtgcctggtgccagttctatggcgaactcaatctctcggtctggtggcatactcgttaattcttctgggaatacgtcgggatattcacagactatgggcaccgactccaaggaggtgacttgtaaacaggttaggatagaccgacttgcggtaggggtgttagaggtaaagcggacttgctttcctccaggtccttgcaaggtgatggacttttcggcacaatctatctgtcctttgtgcttagccaaccaatccatccctaggatgatgtccaagctttgcgagtctaggactatcggtttggctaggaagtcaacttcctcaattctaaggttaacttccgggcatacttgagttgcctgatgaactactgtacaagtgatatgccattcaatgcgctc

SEQ ID NO: 7502 - DNA, 5407 bp, Oryza sativa
  unsure (1)..(5407): unsure at all n locations
acggcttgagtgactttctactctgccgnacncatcatcctaagtagaagtgccttgttgatcatatgttgaaaagtggggaagtcatgagcaagcaactggagtctcattccaactgcgattcctttcaagaatttcctgatcttcttcttgtctgtgtccacttcctcaggggcgtaccgagccaacttgttgaactgacttaggtactcattgatactgctgttgccttgcttaagtctgttgaattcttctttcttcatgtcaatagtgctttcaggcacatgagctgcacggaaagccgtagcgaactcatcccaagcaatgttagtgggttcagggtgtgcattgcaataattcttccaccaatctgctgcaggtcctcttagctggtgagaggcgtagagcgtcttctcaaccggagtacactgcactaagttgagttttctatcaacatctttcagccaatcgtcagcctcgacgggctcgacggtctgagagaattctggcggacgagacctcagaaaatctgtcagcttggatctattgttgctcatgtgagggtggccatttccatgcgcattatgctgaaaaccggctacgactgcggctaatccttgcaagatttgtgtctgaactgccattaagtgttgcatgttgctttccacatgagggggggaagggaggcgttcttctccagaattgtgactggcagtgcggtgagagcggtgagactgttccatctctgcattacggaaaactgtgcgatgcgagcggttgctgcggcggggttgctcaacctctgcgttgcgggaaacagtacggtgcgaacggttgctgtggtgagactgctcattagctgattcatgattttcttctggctcagctctaccatcctcaaaaccaaagcgggctggtgcacgagctgcacggcgggggcggctagccatctaaactcccagaaaagggcgggggaagagtcagataagcacttaggagggcaaggagcaaagtaaatagcaactcagatagcacacactaggcataaactggatttttcaaatcataaaaacacctgatacaacgggtgtggacaagtcacagagctacgccgagcttgactgtgcgcacaccacctaggagaaccagactaccaaacaacacccacaacaaactcacgcacgcactacctcgcgacgactccaaaagagttggcggcggaacaaaagggcctaacacacggacggctgctgaagactgcctcctctactcctcgtcggcctggctacctccagtagtcggctcctcagtcgaagaaacgtcgatcggctgacgcgaagggatcggcggaacctgtcgagggccggcagcagcacgggccgctggcggtaggggagctgggtagtggaaacggaacacggtggaagaaccaacaacacgcttccgcgcagtgcggataaagcgtgggccacggcgggaggaagcaactggggtgtgtccgggggtgtaggaagggctaactgggtgcgggtagggggagtacactggtgagtacggcgcacgcgagctgggggagcgcgggccactgggagtacggcagaccgcgggagctgtgggaggacaggtggcttggcgtggcaaaggcgacctgagtcccaagagatagtgtcaactgaggtgacaccctccttggccagacgggcctccaaagcggcgtaccggcgggcaagggagcggtaagcctcaaggagtaggtcgtgctgagtggcctgagcctccgaaagctcaaccatgcgagtcagtactggctgagactcgctgtacggacaagggtacctggcgtctgagtggccagaggaaaggcgtgaaagctgccggaaggcggagcctccgagacggtggctgtagtcgtgggccaggcgacgaagcgcagtccaggagaggtcctggtacgcgatctggagagtgggcctggccacagtgaagtggtgggggcgaaggccagctccgtgtatacctccacgggggtaaaggtacatagagagctcacagtgagggggaacacggtccacggagtaccccgtgtactcgggacacgagaagccaaggaaacgggcgaggtcacgaagctgagcgacgtggtgaccctcaccaaaaccgtgggaactgaagctggcgttcactgccatctacaattttgaaagagggagaaagatcagtaaccattttagaaacaaactattgaaagtaaagaaacaaaagaatccttagcttttcgcaagtagttttgaacttagtatccttagggtcgtcctaaacgtcgggtttcgccctagggccaagcctgtgctctgataccatctcttgtcacgccccgaactagtaccgaccggaactagcccgtgacgccccaaattaacctgttaatcgataccagtcccaggaaacagtgctggtatcacagggagacagaatatcacagcaacagaggtctctttattatagagtagaagtacagtcatgttgggctgcggacagatcccgagctcacaactgcattacaaaaggaaagcggaagccaggacttggaccaatcaacacaggcgcgacttgggaactaggccgaaaccctaaaactcatcgtagccgacttgctcctggaagaactcctcatcagcaggatccgcttcatcttcttcagcaactgggggggattatttatatagagcaagggtgagtacgggagtactcagcaagccatgggaaataagtgtttaatgcaggcttcaaggaaaggctgatgtttttgcaattaattttatttgaactcttttctgaaacaactaagtgagtgcttctaaacgacacgatgaaacagtgcgtctcgtccggtcggagtatgtgcaatgtatcagtctttagaatttaaacaaggttggcacccggccaacagcttttacaacggccacccgggccaacaacttttcaaacggccacccgggcctagctgatcccatcagctacagatttttcaaacaccgaaccccttttcacacaacaatttcacaagcagtagtcaaaccaaactacgctaggaatcacctcacatccgcccatgactgtgggcacggctgttcgaacagtttgttaacctctgcagagggggtacactttacccacacgacattactaacccggatcacccagcccgaggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaaacggtccttaagtgcaagagcgggaaaccgtacacccggtacgtttcccggtccgcggttttggaaattcatttagttcgcaagcaccgacccaggtgtcgggttttccaagtcttttgtaaaactccagttttacccaagttgttactcagattttaagtttgaaggcgaccgtcgatactcgcacagggtgcacgaatatcgaggcgcaactggatggttacaaggggacatggtataccaattaacaaaggaaggatcaaatgcaacaaattaggtaggtctgccaatctgccttgcagacgggacaacagattatgtgcgatcctatcaatgcataatatttttcaagcaacataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggcgaaaatgaagccctaataatgacctctaagcgtgccattagatagatctcgagatttgaggaattttggaagttgaacggagtcaaatggatcgaaggttaggaagatattgaatttctaagattattagatttttgtctaaaggaaaaggatttaattaaatccttttttggaaaaaaaaagaaaagaaaagagggagggattatagacttttcctcgggcgggctaaggcgcggcccaagggaattggagcggcccgcccgagttaaatgggccggccggcccaaggcggcccaagtgcgcgcgcgcgcggagggaagaaaaaagagagccggtggactgggctcaccacgcgtggtcccgggtgggacccgcttgtcagcggctcggctcaccgtccggagggagcacgcggcgcggcgctagggtgaggtgtggggcgcggtgcacgcgcgcggttcgcggtgaacgcgaatgcggcgggcccacgtgcagcctcacggctcgcggtggaacgcgcgcacgggaagggactgaccggggtcggcccgaccctgtctcggctgagctggcgccgacgtggcgcctacgtggctgccacgcgggccggcgggaggtagacgacgacccggccgcgaatggacggcgggcggcggcggcgagcggcggagcgaaccacggcgatacgggcaaaagcgagcacaccgggcggttgcacgtgacgaggggggacgagccaacggctcggattcgccggaggttgctcgacggcggcggattgcggcggcggcaaccggcggcgggagaagagggaaacggcgacgaggtcacgaggggccgattcccggcggtgagagcatctacgcggcttcgggaactcgacgctagcgtcggattgggcggaactacgccgagcgaggccggcgacgagcgggtgctaccgagctcgggcggcgacggcggcgagcacacggcgagcgacggcaacggtcggggcggcgccggctaactacggggaggctactcgagctactaccgaaatctaaggggaggagatggagcggggaggaagaacggagggaggcactaccgtgcgggacggggcgctgtgacgagaggccgacggcgcgggagtaatctctccggcctcgggccggggaagaggaagaagagggcgcggccgaagtcctcttccgcgtccttgctcgtgccggctcctccgacacgcgcaacgacgatcggcgacggcgaaacagagggcggcaatggcgcggaggcgaaaatgagagagtttggagggggagggcttgggcttaaatgggcggcaatgtcggtttgggcgagggaaaccgacattgaacggtcaaggcgcgagctggcgtgatgtgcccatgcgatgtgcattcaatgcc

SEQ ID NO: 7503 - DNA, 795 bp, Oryza sativa
  unsure (1)..(795): unsure at all n locations
cgcgtttgattgctctccnctctgcacnagcncatgaagggtaggcgtacctaaaatatgttaattgtaagctaagttccatacaaaattaactaagaaaaatcttatctgctggagtatgcaccaagaactccaggacccccatgatctgagttatagatgaagatgtgatcctctggtgtgctgtctataaccttcccactccctccagtaactgcggttttattgcccaagagaacaggagagaagttctcagtggtgacctggtgaccagtgtagtcctgtaatgcatgttaagttgatcagccttgcatgaatacagacacattcaaattatatacaaaactagcattagagatccatacaacatgactagaaaaagaaatcgaatttgaagactgaaactagaactacttgcaccctctttttcttgaaactacaattaaaggaaaatgctacctttggaacaccagcataaacatctccacctttaggatggttgatgatggtcccaggccttggattgagaatgttatgggcaatgtcatcatacataaacaccacaatgttctcctccttcactcctcccttctgcagaatctggtacgcatggcacacatcggcctgcaatgcaccaggaaacaccaacgtccattaaacaagcactcatataattgttcagttatcttaagaactgttcgtatttgatcaatcacacactaaacaaacataaatctttttttctcgaacgcgcggaaggattgcacgtcaatatattagaagattaacanaact

SEQ ID NO: 7504 - DNA, 775 bp, Oryza sativa
  unsure (1)..(775): unsure at all n locations
gcatgactatcagatggcacagtagctatcaggaactggccgtcgtgagctgttccaactctatttttcgcacgctcttcggccttgttacatcataatgattttgccaggcactgaactctgcttctgtagcaaattttacagtcgagataccgttggtgtatagtcgcatagatcgacgcatactgtactgaacagctcactggcaatcccaaccaatctttcatgatcgatgagtctgttcttaagatcaatcgtcaattcctcatacagtacgtactactttactcaaggggttgattggatttggaaaccgacacttgaggcacatcggcacatgaaagaagagaacgtagcaatcttccgtttatttcaaccaagttctcttttttcttcgtctctctcttcagtctgaacatattttcgggcaaaatgcagccatcgtcgtcgcacaacacatggagaccaatagctagcttgggccgcctggctgaaataatctgtacatgacagcaattncgatatctaataagaatgaaaatattgccaaattcgtttggagtacagtaaaatgtgtgtttgattgtgaaatgccaaatgggatgcaaatttaatgggaccttggatgaagaaatttacccaaagacaataaagttgttaaatatgtgattcgaattttagatctgcaatgtatttgataagtttcttatagaacttactattacgataggttggatacgactcccgatcggcgcccgataacttgctaaaaaaa

SEQ ID NO: 7505 - DNA, 795 bp, Oryza sativa
gtgatgacttacattggcacaccagtctatcacaagaaaattgtgtcagaccgaggcactcagttcacctcaaggttctggaagcagttgcatgaagccctcggaaccgatctaaattttagtacagcctaccatccgcagaccgatggtcagacagaaagggtaaaccaaatcctagaagacatgctatgtgcgtgtgccctggatttcgaaggcacttgggatcgttgtttgccgtatgccgagttctcatacaacaacagttatcaggccagcattcagatgtcgccgaatggggcaatgttcgggagaaagtgccgcacccccttgtgctggaatgaggtgggcgaagcgctggtattcggtcctgacatactcaaggcagcagaagaacaagttaagctaatcgggaaacgtttaaagatagcgcagaaccgtcagaaaaattacgctgacaattcaaggcgtgaccttgagttcgaaaaaggagatcatgtgtacctgcgggtatcaccccttcgtggtatgaggaggtttgggatgtccggcaagttaacaccccgctacatcggcccctacctcataaccgccagacgtggcgaagtggcttatcaacttgagttaccctgaagtcttgcagatgtgcacaacgtgttccacgtatcccagttaaagaaatgtctccgagttccagaagagcaagttcccctgggtgatatcgagctggagaagaatctaacctacaaggaaagaccgatcaaggttcttgaagaggcagaacgtcaaactcgaggg

SEQ ID NO: 7506 - DNA, 780 bp, Oryza sativa
  unsure (1)..(780): unsure at all n locations
cggcttgcatnnnnnnnnnnnnnnnnnnnnnnnnnnnnnatggcgcgtatcctagctaggtgatccctgcccggccggccggcgcgcgcggtcttggctttcagctgggtgatttgatagtgcggtgttcaacgaggagagggagaaggagggatgagactagtggagatgaagctagcggatggggggaggaagagggagggatccgtgggggtatatatatgagtgtcaccgcgctatctagtgaatacactgtgtcgatgtcaaaatatttacattgacgaggtccttgaccacttaggtgattgtaggaggccgatcctgcagtacaaaattgactttagagatatgttaaacggacataacacactgtggcagaactgctgcccaaaatgaacctcagccgactaagggtagcgtggttcactactggctgtgtatctgtactctctccatgcggaattgaacccggtcgctactctaatttccagggaagcaaacccccttgctagcgcttctaatcctaataaggctcggagctcaatggtgtaccgcagtaaaccgatcctctttgataagagttggtgacacagtaagacatttggagacaggcattgcaaagggccccctattacctgatcgcattaaaagagcctgacaatgggagcttatgccacacagtacagtgttcataaagcaagcttctcttagcacgactccctacctttgagctataacagacttgtttaaatgggattaaactacaactggatgtagacg

SEQ ID NO: 7507 - DNA, 4375 bp, Oryza sativa
  unsure (1)..(4375): unsure at all n locations
naccggtttggacaacgacatcttgccagaagggccggattcgtcattgttcttacccgggcccccaagggagaagttggttgcaggttcaaaacccttgcacaaagccggccggaacccgaacaacccccttgttcaggaaatggaagaaagtggaaggcgaaacccggtgcttgttgcctcctgcggggcatcgggctgacggacttccgcgacccgacgacggcgtggcgcaacccggccgactcggcgtggcggatcaccatcgggtccaaggaccgcgaccacgcggggctggcgctcgtgtacaagacggaggacttcttgcactacgacctgctgcccacgatgctgcacgtcgtcaagggcaccggcatgtgggagtgcgtgaacttgtacccggtgtccacctcgccggccgtcgagaacgggctcgagacgtccaccccgccggggcccggcgtgaagcacgtactcaaggccagcctcgacgacgacagaaacgactattacgccatcggcacctacgacggcgagaccgatacctggacgccggacaacgccgacatcgacgtcgggatcgggctccggtacgactacggcaagttctacgcgtccaagacgttctacgaccccgtcgggcggcgtcgcgtgctatgggggtggatcggcgagaccgacagcgagcgggctgacatactcaagggctgggcctcccttcaggtaacgtacattgatcgacaacccccataaccttggtttcatatttctgataggctatagaattagtagtagttacgtataaacaaactttttttatttaattttgacaatggattgaacgagacacggatagagatacgaacccgtcaaatttctttgtgaagcatcataactgaacataattacaaaaatataaaaataacaagttatattaatctcaaatgacgtaggaaaactattataaagctgtctgaaaagccatattgatctgtgatataattcattgcaaaactaattagtcttttttttttgcgatgacatgaacaagatacttaattaagatttttaggtaactgggtatgtactatctcaattggcacagaacgagttactattaaaatctgaaaagccgtactgatttggtataattcatatatattgtaattaatttaacttgccgtatacatccctttttcccaatcatgtactgtactccattaattactgtgtcaaaaacatttagctcatactatttgaatcgctagagcaaaaaagtaaagtgactaggacgatataaactcatggaaatccattaaaaccttatgaaaataacgcccctagctaagccagctagctgctagccagctggatatgatgatcatgctgatctggctagttatccatggatggctagctaggacccggtcattatgtagttatacacttgcatataccatttctagaccacaattccgcccactaagatataatgcaaaacgtctttacctgtgcaccacgagaggcatgcaggcgtgcggctttcttgttgcgccggccggtcgatccagaagaaaacgtgcatgaacatagttggaccagtagtatatgcagtagtccaggtctgggcgggccccacggggatcacgtccttttttttattattttttgaaaaccggatcacgtccttctaccggtctacccaaacgagttgcacgatgccgacttgattaatcggtccgagtcacgcccgcccaaccaccagaggtagccgggcccggcgagatttgcaggctgccaatagactcgcggggatttgcatgcagcagcggcgccatgacatcggactggatcggccggcgttttctggtgcccgaccgtgacttgtctccggttggccgcgagagcacgagagccgtacgtctaagcaaactagttgtcaccacgtcttagtgtggagaagtattagtactctattaattagctaaggctagagttagattaatcctcaaattgcgaagggttttttttatgcgtccataacgtgtcttgcattggcgcatagctagagattagctaggacatttacttgacgaaagggggatttgagtaaatttctgatttgctagagtttggaattccaaacaggactattcaaaggggttgttccaacgaagcagcacgtggataatgacttgcttagcatcaggaaatttaataccctgacctgtcgctgcaatcgtgttgtttttttaataatccgtaatcatttgaataacttagtaatttcgcggtatatgtacatgtcattcttgtggcaagcgtgaaagtgagttcttgagtggccggttcgactcctaggggaattaacttcgtttttgagaaatttgttttacgttatttttggaactaaaatgtttggcaatttattttaatcgatgatgaaatcaatggtttttgtgaaatgaaaaaaaaaatccactcatagttattctaaagatgaaattgaggagttttcgatatttgtactatactataatataaaaaaggaaatcaacaaacgtctcctttctcagttggttaggcaagttgttgtgatgctaataggctacacaagtctaaccgtgttatctaagttgtaaagatacttgagatgtattttaaaaaatatatggaaatggtaattgagtgagtgtgttcaaacttgaacgcggtccactaggtttctaattctaaactttaccaactgcgcaaggtggagttatcgaaattaggtgatagattaataagtaaatgcactttcttggtggtaaagatacttgagatgtattttaaaaaatatatggaaagggtaattgagtgagtgtgttcaaactcgaacgcggtccactaggtttctaattctaaactttaccaactgcgctaggtggagttatcgaaattaggtgatagattaataagtaaatgcactttcttggtggccagttaagttgtaaaaatacttgagatgcatttgaaaaaaaaagcaccatggtggaaagggtggctgttggcgagtgttttaaaactcgaacgcggcccgctaggttcctaattctaacctttgccaactgcgctaggtggagttatcaaaattaggtgatacacaaatttataaatgcactttcttggtgaccagttatgcaaatacactagacttctattaaaaaattatggtggaaaaaggtgagcatgataatttttatattaaacgcaaacgaaaacaagggtgaaaaggtgagtgtgctaaaactcaaacacaataaacaagggtgaaaaggtgagctgctaaaactcgaacacggtccgctagtctgtctaactatagactttgccaactacactaggcagggcttcttaaaaaagcagtggactttgagtaaatatacttccttggttagatggccgggtatgaaaatatcctataattgtatcaaaaagaatttgggtgggaagtgagcgtgttaagactcgaacccgggctgttatattttacaactctactatttgccattggcgctaggcgagtttatcaaaattaagtgattggttaaccaataaatgcattggccttttgttaaattgcgaactatacaaacttactaaaattgcatctttttttaatcatgctaaaattatgtatttttatctgaatgactgtaaaaacttgctaaaattgtatatttttaaaatcatgctacaattttgtattttgtctgaatgactataaaaaaaactaaactgctactaccatctctaaataaatgtaattttaggtgatccactagaccattttaatactagtttatcttttttttttcgttttctccaccacaaggacatcgtagttttttaatctcttgcttaataatatatctttaactagttaaaactatacatttttagagtcggagggagtagatccttaactgtctctccttcaatcattcatgtcattgtccctttttctttaaatcttatttttttcctgttttaaattgttgttgaattcaatgtgcccttgatgggccttgaccgaggcccatccaaacaaggcatttccctttatttaaattaaccttttattattattattatttgcagtcaattccgaggacagttatgctggacacgaagactggcagcaacctgctccagtggccggtggtggaggtggagaacctccgtatgcgcggcaagagcttcgacggcctcgacgtctctcccggctccgtcgtgccgttggacgtcggcaaagcaacacaggtacgtacgcgtgattttgacacatgaacacaaaatgttgatgagctnctgacaggtgttctcactccgg

SEQ ID NO: 7508 - DNA, 2951 bp, Oryza sativa
  unsure (1)..(2951): unsure at all n locations
cccgtgccattattctggcactaagggttgtgtcttatgaggacggtgtttggactcagtcttgctcatttttttccaaacccaaaagaggagttcctggaagatgaaggctttggtgtctagctcgtgcctgccgtcaagcgcctgtggtcgtcgccctagtcttccgctgtttttcttttgtcttcttgtgtgctaggcctttgccgcccatgtaataaattaactatttacgcttccgcttgataaactctgaaatgtatcaacttttggtgtaccttgcctcctgggacaaggaataatacacgcacgtaaggaactcccgttgggttatttccggtcgtgacaagttggtatcagagcctccttgaccctaggatgagctttagatcccaagtcttagcaatattttcgaaataaaaatccttccttatttgttaaaatcctctagtctctctctgtcctgctgcttcatttatcgtcaaaatctgatctgtaaaatgttgcttttctcttttgtttttgtttgtagatggccggtagcatcaaccgtcgtggcctggacctgactggcttcgttttggagctgcggggcatgtgcgttgtcctggggtatccgcatggagtggactaccaaggcaagcagctcccggagcaagagggtgacgatgcagagccccacgctgcttgggaggtcactgcagtgatcctcactggctcacccgagaggacttcgttggcagtcaccgcgggtggagattctttctccgctgcttgccagaacgccgcactcctcgccattggcactcttcaccagtgctacccggacgagttgcagcactcgccctaccgctaccaccctcgtcgcggaggagcccgtgactacgccaccttcagggatgctagctcggaggatgacgctaccatcatgcacttggcgcgcatggtggaggcgtacgacgcagcccgtatcgacttccatcatatggtgcgccgtgggttggtcgagaacaacatgaagatcctggagctgcgtcaggagaatctgcagctgaagaaggacttggacacggtggaggcgcagctgtgtcagctcaagatcgcccagggagaggtctgtcgccccaagcgccgccgcgtctgccgcagtatgaagatcaccgcccgcaagagtacctccaggcccgagcttgttcgtcagtccttggcatggacctgcttcgtcgagacccctcgcgccgagcccgcaccctcggttcctcaggagaagggagcctctggcggttgcagcacgaaggatgcgctctgcttcaccttccgccctggctcgtcgcagaagtagacgagcagttagtaggctcgcgcgtgtgttcttttcgtttgttttcctgctagagtcgtgtggggcatggttataccggtgtgtggtataactgtgtcggagcctgtctttattttatttgcttaagcaacttgaaccttaatgaacgaatttaatagcagtaataaattcaagaattatggtagtcgtgggtggttagttttaatagtcagctctctctgtttgccggttctgtgtgggattttcagatggtgacaaccaggaaaagtgctgctaccggtgaaggcagtcaccccgaaggcagcaaccacaacaagcatggcaggccaccttcaccttctcccccgccaccaccaccaccaccagacaccaactccatcctcacccaaatcctcgcccagcaggccaacatgatggctgctttcctccatcacatccaaaatccgccacagcataatgctccacctccaccaccacccccgcaacattctaaactcgctgagttcctccgcatccgtccgcctaccttctctagttccaataaccccgtggatgccttggattggttgcatgccgtggggaaaaagttggataccgtgcagtgcaacgatgaggagaaagtcatctttgctgctcaccaacttgcaggacccgcatcttatggtgggaccacttccaggctacgcagccagagggacagcctattacatgggctcgcttcaccgccgcttttcgaagaacccatgtgcccgccggagtcgtggcccttaagaaaagggaattccgagagtggaagcaaggcaaccgctccgtgatggagtatttgcacgagttcaacaacctggcccgttacgctccggaggatgtgcgggaagatgaggagaagcaagagaagttcctggcaggaatggaccctgagctgtccgtccgtctagtctccggggattatccggatttccaacgtctggtggacaagagcatccgcttggaagccaagcacaagaaactggagtcgcacaagcgccgcttggcgaatttccgcaaccaacagggtgctaaccaaagggtccgctacaccaatccctatccagggggatcctcctcgcagcagcaacaacagcagcagcaacctcgctccgcgcctcgacctcaattcgtggtgcgcgtcccacagccgcagcagcagcagaatcaacaagggactcgtgcgccccgtcctcctccaccgactgtgcagcctggtcaaggccgcagggacgctcaaggtccgcagcgtctgtgcttcaactgcttcgagcccgggcactttgcggataaatgcccgaagccaaggcgtcagcaaggccaagcgcctccccgccccaacaacggtgttaaggacgtcattcggggtcgtgtgaaccatgtgacggccgaggacgtgctgacaactccagacgtcatcgttggtacgttcctcattcattccatccctgctaccattttgttcgactctggagcttcccactcgtttatatctgtgccattcgtggggagaaatcagttgggggtagaaaggcttagaaaccatgatgagnnnntgtcatggtggatgtgcatgtccaaccac

SEQ ID NO: 7509 - DNA, 4058 bp, Oryza sativa
ctgttttgacttgcactaccagatggtacagtacctcatcattatagccctgccgttcctatagaaatccagggaatcccttttcccttggatttgattcttctggacaccaataacttggatgtgatccttgggatgaattggttggctcaattccaaggagtagtggattgcgcaaggcgcactgtcactctgtatcgggggccggaacaaccggttgttttctttgcaccctcaacctctgtcggcagttcagaacttcatcagataggactgtcagaaatacccatcgtcagagagttcggagatgtgtttccggaagaactacccggtatgctgcccaagcgagagattgagttccggatagatcttgctccaggaaccactcctctatacaagcggccctaccgtatggccgcgaatgaactggccgaagtcaagaagtagttggaagagctgaaggaaaaggggtacatacggccgagcacttccccctagggtgctctcgtgatttttgtgggaaagaaggacaagacaaagaggatgtgtgttgactacagagctctcaatgaagttactataaaaaacaagtaccctcttccccggatcgatgatctgttcgatcagcttaaagctgccactatcttttctaaaatcaatcttcgctccggatatcaccaattgcgtattcgtgaagaagatatcccgaagaccgcattcaccacgcgttatgggctgtatgaattcacggtgatgtcgttcggtctgaccaatgctcctaccttggataagtttgttgtggttttcatcgacgacattctggtgtactcacaatcagaggaagaccatcagcagcatctccgtctagtgttgggaaagctgcgggaacatcaactttatgccaagtttagcaagtgtgagttctggttgtccgaagtcaagttcttagggcacgtgatatctgctaaaggagttgctgtggaccccgaaacagtgaccgccgtcactgattggaagcaacccaagacagtcactcaagtccgcagctttttgggtttggccgggtactatcggaggttcatcgagaacttctccaaaatcgctcgacccatgacacagttgttgaagaaagaagaaaaatttgtgtggagcccgcaatgcgagaaggcattccaaactctcaaggaaaagctggtttcctagccggttttaatcttgccggatactcacaaggacttcatggtgtactgtgacgcttcgcgccaaggattggggtgcgtgctcatgcaggaaggtcatgtggtagcctatgcctcacgccagctacggccccatgaaggcaactaccctacccatgatttggagttggccgctgtagttcatgctctaaagatctggcggcactatctcattgggaatcgctgtgaaatatatactgatcataagagtttgaaatacatcttcactcagtcggatctgaatcttcagcagaggagatagttagaactcatcaaggattatgatgtgggaattcactatcatcctggtaaggccaacgtggtcgccgacgctctaagtcgaaaaagccgttgcaacactctcggcgtctgtggcattccaccggaacttaatcaacagatggaagccctgaacctaagcatagttagtcgcggattcttggctgcgctggaagccaagcccaccttgctcgatcaaatccgcgaggctcagaagaatgatccagacatgcatggactcctcaagaatatgaaacagggtaaagccgctggtttcacagaggatgaacacggaaccctatggaacggaaatcgggtatgcgttccagacgacagggaacttaaacagttgatacttcaggaagctcacgaaagtccttattccatccaccctggctgtacgaagatgtacttggacttgaaagagaaatattggtgggttagtatgaagcgggagattgcagagttcgtggccctttgtgatgtgtgccagcgtgtcaaggcagagcaccaatgaccggccggacttctccaacctctccaagtaccagaatggaaatgggatgaaattgggatggatttcatcaccggacttccaaaaacccagggcggttatgattctatatgggtagtcgtggatcgactaaccaaggtagctcggtttattcctgtgaagaccacctatggagggaacaaactagccgaactctacttcgctaggatcgtaagtctccatggcattcctaagaaaattgtatctgatcggggaagccaattcacctctcatttctggaagaagctccaagaagagttgggtacccgattaaatttcagcaccgcgtatcacccgcagacagatggacagaccgagcgtctaaatcagatcctagaagatatgcttcgcgcatgtgtcctagatttcaggaagacctgggataagagtctcccctatgccgagttctcctacaataacagctaccaagccagcatacaaatggcaccctacgaagcgttgtatggccgcaaatgccggacaccgctattgtgggatcaagttggggaaagccaagtgttcgggactgatatcctgagagaagctgaagctaaagtcagaaccattcgggataatctaaaggtggcacagtcccggcaaaagagttatgcagataaccgacgccgtaacctagaattcacagtggacgattttgtgtacctacgggtcacgccattgcgaggagtacacaggtttcagacgaaagggaagctcgcacctcggttcatgggtcctttccgtatcattgctcgacgcggagaagtcgcttaccagttggagctgcccgcatccttgggcaacgtgcatgatgtgttccatgtgtcgcaactcaagaaatgtcttcgagtgccatcggagcaggccgattcagagcaaattgaagttcgcgaagacttgacctacgtggagaggccagtgaaaatcctggacaccatggagcgcaggaccaggaaccgggtaatccgtttttgcaaggtccagtggagcaaccacgccgaagaagaagctacctgggagcgtgaagacgagctgaaggcagcccatccagatctcttcgccagttcttccgaatctcggggtcgagattccgtttaaggggggtaggtttgtcgcgtcccaaatcgactctaaaatacatcctcgaaattatgcaaagaataagtaaaatccatgtgaaagcctccaacaattaaaatgtgcaaagctaaaagtcaaataaggcttggaggatttttgtatatttcctaaaagcctaaaatgtgtaaataaattttagtggaattttcatagcacaaaaaaaaataactaagaagaaataaacggagttaaaaaggttttataaaaaagaaaaaccctaaaagtcccccttccctcctttgggccggctcggcccatcttcctctcccccactctttctatctcctctcccccgcggcccattcggcctcccttcccgcgcgcgcgccgttgacgggcgggcccgaccgccaccctcgctgacgggtggggaccacccgcgatgccagtgctaccggcactccagccgtctcggcacgccaagtgttgtctttcgtcgaccgtgacgggttggacaccctcggacgcacccagcggatcccacttagggtccggacgaaaaggccccatgccctcactaatcgcttaagtgcgaaattaattgcacttacagaacttaatgtcacctgcccaacccaccttatttcactggcctaacaaacaagccactgaactaaaatgcctaggaagtgaacacttaaaaattaggccctagatttctgattaaaaaaaactacaatatttgggaaggacctaatatcacatcattacgagggggtgaggttttgaacccggctcgcctagcctcccaacttgttgagtaggccggaaaacccttcgacatttctctacactaaaaattatgttacaaggtacgttccatatccagcctctatctttgaacgatatcg

SEQ ID NO: 7510 - DNA, 1953 bp, Oryza sativa
  unsure (1)..(1953): unsure at all n locations
atactgttggtgtgggtgcgcgcgtcgctgcgtttaaatttaaactgtctgcctctcggtgtgtcagctagtgtgttcatatttacttgtcgcgtgggtgcctacttctcttttttcccncnnnnnncnncaagagttgaatgcgctcctgagtagcncatcatanataggncctcagaactcggagggggacccctcaaagctctaattcttccttgagaagccaacaacccatttttgtgctctgtttctgcttgctctacggaggtgagctaagtaaaagccttttcttttccggtggtcgtgaagacgctgcagcttcggaagatccgctcttcgtggaaggcgaagcccgcgtttgggaaagcgagcaaggcaagtcacatcatttttgaacatattgattgcccggttggaaaattatgttgatttaaattattgcatgatcgctttatttaaattcccgcgttatcactgtttatttatccatgcctatttacctttgttatgaccttattattggtattgttattattaccttaggcaccctagaataaacaaaaccccaactagtggacactctactcatggtaccactagcatgattttaggtagatgcttcgctattttaattaggtaactttaggtggttttacaactctagacttgggaatattcatatcacctggacactttggaattgttggagtattgtggaattggattcacaccgccccctctattcaaaatccccaaaaatgttttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggagatggatgaagtcgggggtcgatggacatctccagggcaaatgaaggctacacgagctgcggcccggtagtcgagatgtcatggcacagggccggtgtcctgctgctaggggctcagtcctgcctacctgtcccgggggttccggccgtaggtggggttgggtcggtactcttgtgtatggctaggatgggttggaaactatgtcacgtcttccgtccgtataccgtggtggtatgtggcacgtggttacacgtgaggaagatgtgtcttgtgggtaaagatgtacacctctgatcagagtaaaacctattcgaatagccgcgccctcggttatgggcaagccgagcaatgtacccaagttagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcactgccttgattaataatactgtgtagctctaggatcgtctttataaaatggctttgggcaactaagtgacttttaaatgctgtttactgcaaaacttaacccctatattattaccccttgtacccccttgcattaatcatgcatctgccggtgtgacttgctgagtactgtggttgtactcattcttgctctatctttctccccccttcagtaagagaagctttggagaagaagtcttaggtggagtcttggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggctttttctgggacggggattaatacactagcgttccggaaaatgcaattttctcgtcgcgacagtgcgcggcccggggagaaaaaggaggattggcccaaaggg

SEQ ID NO: 7511 - DNA, 743 bp, Oryza sativa
  unsure (1)..(743): unsure at all n locations
ctgggggtagatcacctntcgnacatagnccatcacaggcatggtgcgcatggctggtgtagaccgggagtggttacacagcatggcacatgcgctggcactggacacatggacgtggccaagagaggacgttcctggcctagggttgatcgacggggggggcgtcgatcaacaagttgcaacttctttttcggaagccaatctccaaagaacttcagggttaagcgtgcttggcctggagcaatttgggatgggtgaccgaccgggaaattcttcccgggtgcacacgagtgaggacaaagtgtgcagaaaagacatgtgttggtatgtgagggcagtctatgacctatgaaagctatcagatgtaagtgggcccggcctgggggaggcgggacgttacactttgggcggcgaaggcggtggatcggacggccgaattttgggttgtgagcgcgggctggcggtcagcgcccgtggtccatgcggtggcaggcggtgacaccgatggtggtcgcgaaagggaaaaagaacgggaaaaaagagaggctcgctccaagcccgatttggaaaggaagtcgagggagagggagaacttcgcctccgggttttgcaggacgcgcatggagcggcttgagcacactcgccgggccctgcggctgcgtggtgcaacgcggcaaggcagtcgggcttggtgcgggggacacccacccccaagcccgtgcgcgcggaccccaaggccccgc

SEQ ID NO: 7512 - DNA, 1724 bp, Oryza sativa
  unsure (1)..(1724): unsure at all n locations
cggcgattgttagatcgacctatctgatggcacacnagctcatcacagcctttctccagtcagggaaattagaacaacccccgctctggtgcctgaaagcctctttgacccgtcaaaatgcatagtccaatactccatcttctccacaggcatgtcttcttggcactcggtccactcggcgacgaagtctgctaaagcttgggacttgatcaaagttcgcggcttgaaggatagatctaaagacatcaactctaaggcccactttgcgatccacccatttgctttgcgattgtgaagtatatccctgagtggaaacgatgtaaccaccgtaaccgagtgaccttgaaaatactgagataatttcctaacagtaatcaaaacgccatacaacagcttttgaacctgaggatatcttgtcttggagtcggccaaaacttcgctaacgaaataaattggtcgttggactttttgaacgtggccttcctcctcacgctcaacaaccagaaccgtgctcacaacctgggaagttgccgacacgtataacaacagcggctcttgcgaatgtggcgaagctaagaccggtggagtggtgagaagtttcttgaagtcttcaaaggctttttgtgcttcgggtccccactggaaattgtcggttttctttagcagcttgaaaaagggcaacccccgctcgccgagtcgtgagacgaactggctgagcgccgccatgcaaccagttaacttttgaacgtctttctgggagctcggcggtttcatgttgaggatggcgttgattttctccgggttggcttgcatgcccatatgggataccataaagccaagcaacttccctgacggtactccgaaagtgcacttttcagggtttaatttcatcctgaaggcgcggatgctcgcaaaggtctcttctagatccgtaatcaaatcatccttctgcttggtcttgacgactacatcatcaacataagcttcaacgttacgacctatctaagttgaaaagcatctctggatcatgtgttgataagttgcccctgcattctttaatccaaaagggatggtgatgtagcaataggccccgaagggtgtaataaatgaagtctttaagcagtcggactcctttagtcggatctgatgatatcctgagtagcaatccaaaaaactgagtagctcgcagccggccgttgagtcaactacctggtcaatacgaggtaacccgaagggatccttgggacaagatttgttgaggtcggtgtaatcaacacacatgcgccattgtcccgtcttcttccgaactaggactgggttggccagccagtcaagnnnnnnnnnnnnnnnnnncgaactcgaatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 7513 - DNA, 788 bp, Oryza sativa
  unsure (1)..(788): unsure at all n locations
tgatgttgacctgtggtacagnagctcatcaaagaaaaaaatgttcaggtttacatgttttgctcatgcctctgccatctgcagcacgaaatgctattctgatgctactcctggcaccgtctggggttgctcacaggtgccttcttcatcaactagttcagtagatcgtatagacgaacaattatcagactgtgtgtaatcactcttgtacatacaaagtttttttttataatacagaaatatatgtctttacatttcctcggtgaaggctgaattgcattgcacatatgctattttctgtttcaaactttttttcacaaagcgcctggtggtattcatgtactacttgatactcctagtactacaaaccaagcaaacgtttgacaagcgatgtgtgtcactgtggttgtgtttagatggtggaaaagttgggaagttgagagaaaattgatagtttggagaaaaaattggtaatttatgtgtgtaggaaagttttcgatgtgatgtgatgtgatggaaagttaggaatttgggggaaattaaacactgcttatgttttcaagccaatccgacacggatataacaccaaatcacccaaacacacggatgtaagttaccgtgtctgttcacccacttgatggggagttgaaatcctcgtcccgaaatgtgacgctctgcctgcaatcatcaaatctgaatctgaaatgaagattgaagaacaccccaactgtcagaaagaaaaaagagccacgtgagcactacttttctttcttttgttttctcaaatt

SEQ ID NO: 7514 - DNA, 1303 bp, Oryza sativa
  unsure (1)..(1303): unsure at all n locations
aataaaggcctcgggagagaccggcgacaaaaggaaaaagatagaggggggtgcggaggacctttataggggctcggtaggagcgaacgtgaccggggggcacccgatttcgccgcaacgtggagcgngagaaanaaagagtaggggattcaaacgaatctcgccctttttgggtgcacggcgcggncgggaaggcnagnccgtggcgcnnacgtggcgtggggtggggcncggggtggagcgccagaggaacggcgaaagcggcgatgtggncggcggttttgcggcggttccccgggtgaggtaggaaaggactgacaggtgagccccacctgtcagagcccgggggagtgaggggaggcggcctggactttgggagggagcggtagagataggccggcggcccatgatgaaaggagagggagggaaaaaaaaggagaaaaagaaggggaaaaggaaaaaggggattttctggggattctttaatgcttgtgctcctttttaattggttaaaattatttcttgggctctgaaaattccactaaagatcctgttagcatattctgacatgtagaatccaagaaaaattcaacaagccaattccgattattatttgcatttattaatttagggattcaactctaggttaaattaaacaatttcttcggacgatttattttatgaactttaaagcaaggaggagaatttcagagcgtgacagatatgcctggcattcctagagaggtgattgaacactctttacatgttaaggaagatgctaaacctatcaagcaatgactccaccattttgcacaagataggaaggacgcgatcaaggaggaattgaccaagctgttagcagcaggcttcatcaaggaagtccttcatcttgactggctggccaacccagtcctagttcggaagaagacgggacaatggcgcatgtgtgttgattacaccgacctcaacaaatcttgtcccaaggatcccttcgggttacctcgtattgaccaggtagttgactcaacggccggctgcgagctactcagttttttggattgctactcaggatatcatcagatccgactaaaggagtccgactgcttaaagacttcatttattacacccttcggggcctattgctacatcaccatcccttttggattaaagaatgcaggggcaacttatcaacacatgatccagagatgcttttcaacttagataggtcgtaacgttgaagcttatgttgatggtgtggttgttcgacctgcagatggtgangtacttaagagtcggtctattt

SEQ ID NO: 7515 - DNA, 774 bp, Oryza sativa
  unsure (1)..(774): unsure at all n locations
tatgatcgcgcattaaaagtcctcatcaatctaattgntaaagtggaggaactatatatatatatatatatatatatatatatatatatatatatatatatattgagcaagggtgagtactctcgtactcagcaagtcacgggaacttaggtgtttaatgcaagcttggaagagaggcaaggttgttttgcaaatcttttatttgaagacattttgaaaacactaagtgatttatttctttctaagtttgggccgaaaagagacttgcgtctcgtttcgactttaagagatgtttttcaacagctcatttggtaatgtaccgacctcccgggtcagatcattacttctcggctcccagagccattccacttgattaatcggctcccagagcctttttcattttctcggactcccagagtccagctgcccagcagcacaacaatccgcttccactcgggaagcctagtctatgatgcccacagacatcccgaatcacatagattcgtttctgaccactcaggtcatccatctgccacataggctgattctggttacgaattccacaccacaacaacttttcacaaagcacaagcaaacaaatctacgcaacgggaaccaccttacattcgcccatgaccgtgggcacggcttgttcgacagttagttaacctctgcagaggggtacactttacccacaagacacgaacttacttcagacactggccngtgttagaggttcatgcaaagccttttccaagcgacccaggatacctn

SEQ ID NO: 7516 - DNA, 1111 bp, Oryza sativa
  unsure (1)..(1111): unsure at all n locations
ccgcttgagattctcttcgtgtgtatacaccccannaagattatcgtggtgccagcgcacccttttatatcttgcacaattgccggcgacaccgaagcactcgacgcttttttttatcacaccctgtccctatctcccaactggatatttcgacgccgttcgaatcgatccctatatttatatatattcaggtacctcttcgatcacgagtgcaatgaaaactattgattctttattttctatatatctatgtaattaaaaattggcttatttcattgcataccaccccttaggcaaatttggtaacaaattttctcaattggaatatggcacgtgatgatgatcatagttggatgctattgtctcagtcagattgtgtgtggcaagttggatttgaaaaattcatttaacatacatttgaaggtacccatccatgagggactgcgtcctgtccatgtactaggtgtcgttgcatggcatacagaacgaaaattgaggttcaacaacactttgcttggtagagggtttgataaggatttcataaaatagaaacattctgttagtaaacctatggttgtggatgatcaggagattagtgaagccgaagttgatgatggcggctctatcgataatcggctttcttcgctaatcagagatagtaatattgaggtgccaaatgagtcagcaaagaattttttcaaattaatggaagaagatcggaaagaattatacccagggtgcaaggaggctaccatggtatctttcattgtcaggctatttcagattaagtgcatgtatggtatcagtaacaatgccatggagcaaatacttcacttattctgtcttttgcttcctgagggacattgtgtcccaaatactttggataaagttcgtaaggtagtccaagatctcgggttggactaccaaaagattcatgcttgtgtcaatgattgtgtgttatttcgtggagagtatgctaatatgaacagatgtccaacatgtggaaagaagtaggtggaaaaatatatattctggagaactcggggaaggcagtggcatggaggagtaaaacaacaatctgatgagctagttcactacaagcggtcaatgg

SEQ ID NO: 7517 - DNA, 1516 bp, Oryza sativa
cggtattccgtttgtgaacagctatacatagttgcgataagcccacaccacaggtgtagaaagaacaaggttagcttcaataacaaggttgaaatgagggggactccagtggcactcagtggtgacgaagtattgaagcagtacgagagttttgagcaagtcaaatttggcatgatgtcaaggaagaggaagcaacgagatgaagatactagatggcacaactggaggaagaagagtattttttttatcttccttactggaaatcattgcttatacaccataatctagatgtgatgcgtattgagaataacatatgtgagagcttgctaggtactttgcttgatttaacaggtaaatctaacgacagtgagaaggctcgacttgatttgcaagaattgggtattaggaagaatcaacatctattggtccataaaggaaaatacactttgtcggcagccttgtacacgttaagttcaagtcagaaggaaattctatgcagatttctacaacatgtcaagatgccagatggttatgcctcaaatatcaagagatgtgttgatgaaaatggttggaaggttagtggacttaaaagtcatgactaccttgttttattacaaaaacttttaccattggtggtatgccatattttgcctgaagatgttgtgatcccattgatcgagctcagcaggttttttaacaaactatgttcaaaggagcttgaggtgactgaaattgaaaaactttgcaattcgattggagagaccctttgtcggcttgagatgatattccctccatcattttttgatattatgatgcacttactagttcatattgcttcggaggctagaattagaggccctgtttgttatagatggatgtatcccgttgagaggtacctacgtacccttaaaggctatgtgaggaacaaagcgtgcccagaaggttcaatagcagaggtatatatctcggaggagtgccttactttctgtgctcggttctttgaagatgttagtacaaaggtgaataggccagaacgtcaagaaatgtaacaccctgaaaattcaaggcaataaaaatcactaaatgtaacatacccgaattctaggattaaggaatttccatcaaaactagttgaaaggaaagttcttcaattttgtgaacgaaaaatttccattttaaaccctaggtgaagttaatctaacttgtctgagtaaattgaaacaaattaaaccttttcatctttaacctataccatagatgcaaaaacaagtgaaagcatgcatactcgtttacatcatgttttgacttagtccttcttatgcatttggattttcgtttgcatttcataataggtctcatgaataataactaagatctagattaacaactaacccattagggcctagtgctagcttgaggaagttaaaatatggaccattcactttaaatatatcaaaaggcctatgtcaagcccacaaacttaattgggcattcattggagacaagtattaacatg

SEQ ID NO: 7518 - DNA, 1160 bp, Oryza sativa
aaaatttctgaaaatttgagcaaaatgtagttgaatttgaacaaatattacccaaattcatgaaaaaattgaaaaattgaaaattttcggccaaaataatattgtatctggggtgaccgaaaatttcgggctgaaatttccaacactggttgcgattggagagacaaaaagaagggtgtgggtgcgggaaaatcgtgtgctgctgagctaacgatcccgacggtcagatatcaatcggatggccaagccagacgattaaagagagcgctccaaattacccagccttccagcgcgggcggaccgacatgtggacccacatgaaagtatggcccagcgaacagagaaagaacggtaaattttttttgtgtaaaaatccccacgcgccatggcaaagccaccgtgcggggcgatgtggatagcttggggagcgagcacgtcgtgctgaaatccctccgaacgccctggtccgagcagatcgcccttacttttagggccccatcgtttcgctttttttctaataagccaaaacggcttattagaaaataaaaataaatttgtaggtaaaacttttatatatgtgttcttggtgacttaaaagtcaatactgaaatagaaactacgttgaaaatatctcaaaatcaatctcataattaagtttgaaaatttaaaatttagcttttttttctgcttaatgggcaatccgatgggagccttaattaccccgactagacccctatcaaggatccaaagaacttttaccaataaaggagctcgagcaccagccgctggtgtcaccattctcctcttgcaatttcaccaccaccgacacggcctctgcctctcgctctctctctctaggcggcgcaaatggcagcctgcgtcgataagtggccggcggcgtacccgtgccgcctgccggataagttctactgcgccttgccggactgcaccaccacggaccgtacggtggcgccggcgccggcggctagcgggagcagcggcgactacgtgtgggacgcgctgcgcgccgaggcgcaggacgacgcggacgacgagccgctcctccgcaagttctaccacgacctcgtcctgtcgcggccgtcgctggagtccgcgctcgcctcgctgatggcggccaagctctgcattcccggcgcgct

SEQ ID NO: 7519 - DNA, 22725 bp, Oryza sativa
atgcgtcaaccgatagagtgaaccctgatcggagctgcgcaaggagcttgagcaaaccctagcccgccgccgcccttctcctctctctctctctctgttcccatccccttgggaaacgctagcccatcgcgaccgccttcctccttcctaggtcgcgccagctccctttctccccttacatcctcattcctcacgctgccatcgacccccaccgttctcttgtcccttcgttgctggcgatggcgcgatggaagatggtgaggtcgtcgttcaagagacagcgtatcggcgtatcgcttgaactggcctgctagcacttgattcggagggaaccggcggtttggcttagcgaggtcgtcgttctgctgtcccagcgcagcgaggcagcaaagcatagatctgaggtggcggcgcctagctctgatactgggtgcacacactctactttccccaagacatcatacgcagccgtgcctttggcaacggcacctcaagcgcttgaggtcgatggcgctctattttctcatgtgagtaacgtctttgtcagttatacttgccatggtatccctggttctgattgcttgccaaccatctcagtcactatctcaaattactacatctaatgataggatttttcatccatattaccctggttctgattgctcgccaccatctcagacataatctcaaattgctagctctaatgatatgattttgcatccatattacaccaggattcaccagtgctatgaggcattctacattttggtacagtaatcggatgatatcagcagaaagtgaatcaactaaatgcttatttgaaaagaaaatttctgagtttttatgcgctgaagcttcatctgttatgtgttaattacataaaaggaagtgactgctaggagccacagaagctgtggtgggcaaactaatatactttggagctgtgagccagtgaggctagattgactaaatatatgtggagaaaactgcccacaatatgtattttagaactagccgacaacatgctggcatcaccaactaatttctatcatggtagcaccctggtcaggacagagctttgaagttttttggtgtcctctatgtagcacccaagtgaatcaatgcaaaatttgaaggttcatgtccactttagatttcaggtcagtttgaggttgtgccattagtgtgccatgaggttgagcacccaccaccttgcctaggagatgcaacttactcttttcctgagtcatgtctttgtatcaagctagctctgttaaaattatcatcctcattgactaatgaaaaagcatattaccagatttggatctataatacagttgtgtttcagtgttaaaaaaggataaaaattactaatatttatcttcctttccggtttgccttctactctaattggtagtgtgaaatggttgttaatagacagtggaatcctttttttttgagagagaaataagtgcaatctgattataaatgggaatatcaaatctgatgactccttttgttctgttcatgtaaaatggattggctactaccatagaaggtgctaaagtttgtcaaaattccaggagcgtttctcaaccttgtggctctgctttctcatgttataatgtgctaagcagctgcattgcagttcaagatgtattattttatacacaatatttggaaatgtgagaattgccactaatcttaagtttctcttaagcatgttctttaaatacagcggtatcaccgcttagttaccaaagacaagaataaacaaacttttttttgaacggaaaacaacacaagatagtgccttttcattgaataaagcaggagaaaatacaacccctaagggtaaagagagaaaaggtgttacacgtaaaatatacactatacagggtgcgggatgaactcacgtaaacgtttggcccctgccagagcccaaaggctaacctcctctttgattttcgttagcagggagctcgttgccatctctttatggtcaaagatcctccgattcctctctttccagatctcccagacaactaacacggtgagggatataagtcccttcttcagaatgtcgggcgtgtttgccatgttctcccaccgctgctgcaccgagtaggcttcctcccaatgggccggttccaaatatagaacaaacaaactgacaatagaacttgctgcacaaattattatctcatctttctattttgtttgatattagtttttccatttctaaattaatgggtaagaggaagaaaccaaagccgggagttcattttttgtttactctttttttctatatatagtttaagtgataatgttgacacttcttaccgacatgtactataaagtgattataaaatctatcgattgacttccatgcatgactatctttgtacttaatattactcaaactggtcagaagtatgctttgctttagatgctctcagcagctcttgcatagtcatattatttgcttttctttgagtactattcaatgctatcctataatcatctgtaagctacataactctttaatgaatggcagggcgccgcgaagcgcgcctaaagtcgtgcttcttaatttcatgttacatagccatacataaaattaaattgatcaatgatcctggaaaaaaggattaattgagcaattatactgcacagcttttgcggtccatttaatgtaactctatattggcaatttggcatattggcaatttagcatattgatcgataccagtatcatgcaatggctccgttttatgctgtgtgtatgcatcatgcatatatgcagttagacaccacctagaaaggtcgaaaatgctgatggctaacctggtgatatgataaacacactaatatacatgatgcatcaaagaaagtgcaaactttacccctcgttgatttactggcacatttgttatgtcatggcagtcatgctcatgttacattgcggtatagtgttaaagtgtacatggctactgatcaggctgaaatcgagggacgtagaaatcgtgtcagaaagatcgtggatcatggatggatgatggatggcagaagcagaacacatcaccgaccggtcaaatgcacgccgagattacttagctgtgaaaatacaatgtttggctgggaagtcatcgttgcatgtgtttcggtgttgatatatgttgtgctcgtctttggaatgcagtttattttcaatgttcagaaggttctgaatttcttgccaaaattcaacttctcgacacttctcctagccgttactccggccaacttatctgggccgtaggctgaagaaacgaccatcgttgcggagcccagagcgaaagcaccaaagtcctcttccccattcccaactccgctcctctctctaaaaaaacgacgcagcgcgtgcggtcaccgcctgcacagatctcagcgcggttgtctctgccaacggttgggccgccgtcgccgccatgaaaaaaactaatattagtgaatgacctaatatcaaataaatagaacaagtgagcttcgaacccagaccggctagcccatcactttgtggagcaagctggaagacctctaggtgttttccaatggaaaactctatgcgtacgaataattttgttacggaacatgttcgaacagccaccatgggctgcttctttagcctacatgttgtaatcttctcattagtacttaagcccataactaataaaggcccatgtgcagaacgtcgtgacgtggtcccgccattttccagtgattccctccaaagctaacctcctctccttatcttttcacaatctttgggtaacagaattcgatctgtaaggttcaacaaaaaaaaaaaaaaaaactcaatctccaagtatcccttgatgagcatcctgaccaggtatgtccctgtctatgttttgccatctagattgagtatttcttatgccgtagatcaaatgcattgcacattccttgatgcttcaaccttcataaactgaaattgcattttaggactaaaaatgcacattaagaaccctttcattgtcggcaattcaattaactcgtcgtgttggtttcattaatttcatagtaaaccaatttcacaagaaaagatgtttattgtgtatgttagatttcgttcttatagctggaaatattacaggtagaaaagaagcctttgatgtcctcttctactgttctattctacgaaatctgaagaagcatagaagaatttatgtgcatagaagcatggaagctttgaagtttggtactacgtatggattctaatttagttaaaagaattcagcctgaagtagcatatatgatgcaaaccaaaagaataagaggtatatttttattttctgcaaatctatatatactggagaagatctaccatactaccacaggcaacatctgtccaaactccagatgagtaaatcgtgttcaaatcataccaggaaattactgcatgctaatagcagtgcactattgactcctacacaacgaattgttatccttaatttgcagcataagtggttagttttgtagatccgtacctgtgcatgaagccaaccagctacctatagctcactgctcgtattgtgggctgtggccgtaggtgagcgtcctccgcgtcggctgctagtgcaatcgatattcttgtagctcatatgtttgattgagttgattctctccttgctctctgcatctccgctcaagccaagcactgaaggagtaagaggggtactaaatctgtcaatctgagataggggatctgtttttccctgtactagaagaatccagactgcttattgatagagtgggctatggggctgtgacttttcatgggcttttagcgttctgtgtccccgaagtgtcgtacgtagggatcttttcatacgcacttcgtaatagtttcttcgtgtgtatagcagtgttgttttccaatcgattgagccactgatcatccgcaaagacgaagctatctccttcgtcgattcatccttcccgaacacctcattactcatggccataaaccggatgccccatcgggtgcggacctagttgtgttcatcgctgatgcgcatgaattgctcttaattgctgactgggcttctaagtgcaagagcattttcgacatcaacaaaaacgatgtaagtgtacaattttccttttttttatttctccagcaatacactggtgaatacgagtttgttcactttgggggtggtcacattactaccaaaatcaatatttccaaattagtcaataccaaaattttgacaaattgacaacattgttgttggaggcataccatgaggactttcaaccgaacgtgccgaaacaaccacttagttacgaggcgaagcacttgcaagcggcgaaggcgagtaccaagtggcgaaccacctaccaagcggcgaagcgaagacccttcactaacaggaggtgaagcagcatgacaaagccaattgggctctaaacagacctaccacgcaggaaggcccaataatcaatctaggactggaccttaagagcccatggacccactagttgggccaaaagattattgtagcccttgtaaatatccttgtcataagggcgattaagtcaattcccgagtaaggagaaacctagagttgcaaacatagggttttacaactataaatagaacctaagtagtatgtaacagggcatctattttttttaagaaatcaatatacattccactttacatttccacataattaagtaacaacttgccctttagcagatgtgtttgtcaatcgataacacttacaagttttggtacaatatgataaatgtgttgttgctaaaatttgataatgcaaaatctggtaatgttgatagtagcaacaaactaaacaagccctatatctacatacacatccacaataatattgtttatttcttatgattgtgagtagtccatatgttgggtagcatagcctaaagactacgtttataatatataagtaggctataaggtacttaatacccactcctattgctatggatagcacttaaacttttataaactaacatagtatatgttgtgtttatgcatcatgcatatatgtagttaggaaccacctagaaaggtcgaaaatgctgatggctaacctggtgatatgataaacacactaatatacatgatgcatcaaagaaagtgcaaacttcacccctcgttgatttactggcacatttgttatgtcatggcagtcatgctcatgttacattgcggtatagtgttaaagtgtacatggctaccggtcaggctgaaatagagggacgtagaaatcgtgtcagacagatcgtggatcatggatggatgatggatggcagaagcagaacacatcaccgaccggtcaaatgcacgccgagatcacttagccagttgggctctaaacagacctaccacccatgaaggtccaataaacaacctaggactgaacctttagagcccgtgacccactagttgggccaaaacattttttagcccatgtaaatgtccttgtcataagggcgattaggtcaattcccgagtaaacaaaaaccatagagttgcaaacatggggctttaaaactataaatagaacccaagtggtttgtatcagggcatccaattttgtttttaataaatcaatatacatcccacatagttaagtgataacttgcccttcagcagatttgtttgtcaatcgacaacaattaccaagttttggtagaatatgataaatgtgtttgctaaaatttgacaatgctaaaatatggtaatcttaatagtagcaataaactaaataagtcctgtatctacatacacatccacaataatattgtttatttcttataaatgatccatatgttaggtagcagagcctaaagactactataaagaatacttttataatatgtaagacccactctattataaacttttataaactagcaaaatattgttttatatctttgcaataaacatgacacttgcaaactaataaaagagcttttataaaatacatcgattttattaactcaaatctaggttatgttattttgaagggttgagaaccccttctcttacacacaaacgaaacgacatatcaacgtataattaattaagtattagctaaaatacttaaaaaaaataaattagtatgatttttataccaacttttctatatatttttttttcaaaaaactcatcgtttatcatttagtagttcggaaagcatgcgagtggaaaaggagtgctgggaagaacacagatagaagtattaatattatttaatagtatgatcgtaaatgaacttttaaattttgaaatatatttaagtggtatcttttgataccataatttattaattttatattattagtatttattttctccatttgactgcataagatataagaattttactatcctcactctgttgcacccaatgtgtatttacaagacaagtttattgttgtatctatatcgggtaattaaaacttccttatacaaaattggtttgcctatcaggatcatgatacacaagacaaacatactcgtgcacatgttatgcgttatcagcactatgttgcatagatattgagtaaatttggtagttatagtgtccattaaaattctattgcatactttgaattgtggtatgcaaagagagactaataactttggggcctcataccagaccgtcggcttctccagtgaaacaggcctcggtgcgccggtcaaaccaccctgcatctgaaacttcatcaatttcgtccaaacttttgaaacaccgggacactcttttttttaacatgagccaaatcatttgccctaaagtttttctctctagcaatatgtttaataagaaaatcatcaaaattaacacaatatgcctaataagaaagtcatcaaaattgacgaaaatgtttaaacatatatctaaataatatctattttctggcccgtcaaaacggttatacaccctgaaaacttgtttcactatcaattcgagtaaccaaaatcttctatgtgtatagatggccaaaaggcccaagccccgactggtgtcagcccgtgccggcccagctgtaacgccccgattttcgtttgggattaaaaatcaattaataatgcatttcaagaaattatattaaaagttaaatcaatttaatcaagtgaaattatagaggaaattaaaatttcctttaaaaatcattggctgagaatattttgtaatattctttgtgccctaaaatactctccggatttttccgcaaattttcggagctcaagaaataattttaaagtcacaaagatcatttaaacaattaaataaaaagaaaacaaatttaattctccttccttcccttttgggcttggcccaagccttcccctcctctcccgcgggccgcgcgcctcctctctctctctcggccggcccgcgccttgcgaaagtctactttatgtcccccggtttccctcctctctctccatccggccgacggtcccacctgtcagctcctcctcctacctctcgccagccaaccccagccgccatttccgcccatgtcgccgcaaaatccagcgccctcccgcacccgagctcgcatctaaccacgtggacacgaccccctccacgtcctccaccttttcccccactcaccccgcaagaaacggcgccggtttgacctccccacgagctccacttcacctccccacgtcaccggccgatcccgcctctcccggccacgatctccatccccgagccctatataaagcaccctcgtgctcccctccttcgttttcccctctctcccaagctcccccatgcccggaaccccctcctccccgtgagcccaagcgccgccgctcgtcggcggactccagccgggcgctgccgccgctaccgccgtccccgtgccgcgccgcttgcatcgccggcctcgccgcgctttgccgcatcccatccaccgtccgcttccgcaataaaccacccgggcaccgattccaccgtgaacccgagctccaccgccactttgccgactccggtagcgcgccaccgccgccctagccaccaccaagccacgccaccggcaccgtcggtttcgccgcatcgcgtagcaccccggcctctgcttcgttttcccgttccaccgcaggaacaccatctccaccgcgaagccgaggacatcgccgcgtttgccgccttcggccgcctcttaccgctgttccttgccacctcgcgccacaccaccgcctttactgcgttagccgcgctcccccgtaccccggccgctcctccaccttcgttggagaccgccgaatcgccaccgtcgtcttcgccccgtggagcgccgccgcctccctccgcggccgctccctccgtcgccgcgcctctcggtgggccgcctccttcctccttttcctcttcgccagccgcctcccgtgccagcgccgcgttgcaccgccgccgccgccggttgactggccgtctgcgcgccgcccggccgtccccagccgtccgatcggccttggccgatctgggccgtccaacccgtggaccggcggtggaccgtccttgtggtcccggtccacggtggaccgccacctcgtctcgctgacatgcgggccccgcctgtaggcgccggcccactctcttgctgacgtcagcggcagtccttttcctttgtgaaaatatttaataaatgcgcaataaatcattaataattatagaaattcatttagtggctcaaaacttctaaaattcatatctaattcattcgaactccaaattgggccattcaaattgcaaaattcatctaaaattgagctctacatgtttgtttactttttatgttctgtttccttggtttttattagagtttttcctcgttttgcgtgcctgcgtgtagaatccgtcgtttcagaagatcacggtcgcaaggataagagttcggaagattgtttgaagaagcaaggcaagtcacacattccccttgagcatattgatcccaatttataaatgttttaccgtttacaaataaatatgcatgttttgctaattacatggggtcagggttttacctatctgctcgcttgtgccatgtttacttgatatctgtcctttatcaaccatgggtaataaatcgcctagcttgtgttactttgatgacctagctagaactatatgcttagccatgcttaattaccactagctcagttgatgggataattacagtattagacctttttagtatcagagtgagctgcgtgctcgagacatctggccatgcttcatggtcgtaattatccaactaaaatgcgactgaatggtgggctgtgggtgcatggttttgctggtcgcacccatggcagttaaggaccgattcgcgggatgccctggaagaacttatcgtacttaccacaagccagcgtgggcaacggctgggcttgtagtgtagctttcctctagccgacgcatccaggcaagggtgggcgtgatagagcggggcgggccctgcgacggcctctgtcgcttccggattcacctaggcacgagaggggactgcccgttgcccgctggggacggggggtgaaacctgaggtgtggtgtgcttggttagagggggttatgcgaagggtcctgtcacggcctctttccggtatgtcgtggtggcatgtcggcgcacggaaatgtgtcgtggggctgtgtcttgtgggtacagttgtacacctctgatcagagtaaagctattcgaatagccgtgcccgcggttatgggcggtcgaccagattcaccgtgattagtctcacacttaataagtcgacccaatacgctgtagttcaggtgggttggttgggcctgttcaacgtggtgtagcgttgatcagtggagatttaatgttactctaattactcaacagttttactgttttgctcaataaaatgttttacaaccgcctttatgcaaatagccacaaaccatccttgtatccccttgcacatctgcatcgttggtgtggcttgctgagtacggtggttgtactcagccttgctattattccccctattcagaagtgtagtgcttctaagctaaagacgaagttagaagaccaaggctcagaccccagttgagttttgcctgtggagtggagctgaagccccgctaggatcgcctttttccgctgctgctgctttcgtttcggtgcgaggactaagtgcctcttttgtaagtattttacgctttatttacgtttggaactgtatattacttgtcgttttgtgtaccctggctggtcctagacagggatttaatacacaaaatagtctggaaatttgggctaaatttctgggcgtgacaccagcccagcccgacagttgggccatgtctaggccgctgccttggcatagtgggccggcctggcacgaaacatgaggggcacaatatagacttattgagtcatatataaggcactgccaaagaggagggagggaatataaggcgcggccaaaaaatgagggaggtaaaatagaattattccaaggatgagcacgtcatgcctttaggctggctagcacggcctgactcttattaggccgtaggtggaggccgtgggcaggcccggcccggcctgaccgtttgacgtggcgtgtcgggccaggtggcccatttggccatctatatctatatgtgttgctcatataacttctaatacttgtaagacgaataacaaagcatcatattcgactcgattatttgtgcaagaatattctagggcgaacctatgattcaaagatagcacgtgtaactaagcatggtaattaacaggaacaaactaagtactgcaggctacattgcatgcggcaaagtgacagtaatgatcagtgatcattttgatgcattcggcggagctcaccacctgtccacttgtccaggctagcccagcatagcgagaggggacatcatcgggcgtggccacgtggggcgtgcggggatctgggtggcagtgtgttgatgaaaaatccgcgcttggccgatggtgccagaactatgttggcgctgactaagtcgatgaacataacggcctaggagatcattttagctccagtgcaggtctaaaatattgatgaggtacaggcgtgccaatcagtttgatcctgcaactgacaagatagataaacacgtagatcaccagaaagccgatcggctaacaagccgatggagtaataccaagaggtgaaaaggttggatatgctcagtcttgggcgcccaacgtgagcaaaaaatatcgggggctctcaaccacctatttccacacccgtgacttttcccctccctattttttctcctttatctcgctcatctctctcccacacgttgcatagcggcggcgccgtgcctccttccccgagccgacggccgccgccaatcgctcctcctctgcgacagctatgcttctcctccccgtttcttcgctgtgatggcgatgacaccaaacgctgccacctccccgagccagtggctactgccaatcgctcctcctccgcgacggcgacgcttctcctccatgacggcgacaccgtcgaacgccgccacctccctgagcaagcagccgctacggcagcgcccccgccactgttggcgatggagctctgcgcagccgagctccgtgcgacgtcaacgacagtggctatgcgggtgcggtggagctcggtgcggcgtcgatgcggttgtggttgctaaccaccaaagtggaggaagaggcagatttaggttttcctcttgaatattgtgatgttttagtccatgtaccatgatgtttcatcagttagatcaaaatgttgcaatgtggttttcgatggtgttccatttttttctcgatgtgctcggatttgtctcatgtttcaatacatttgaaactgttgcttcatacgttgtagtaaaatgtttcattgtgtgacttgattctgtttcaccattttcagcactgaaacattttcaattcgatggtgttttattcttattctcgatgtactcggatttgtttcatattttaatatattcgaaatcattgtttcatacgttgtaaaaaaaatgtttcatggtgtaatttgattgtgtttcagcattttaaaagatcgaaacattttcaatctacttggtgaaacatttttttcctcattagtgaaacaacacccgatttttgacaaacaaatcggatgcccgatttgtaggcgcttcacgaaaaattgatcctcgaggctaacaaaattgacaatgcccaactgaaactgctggatgggcccgaccatgatcgagccatttgccacgaaaagaggtagcaaaagcgcgggaaaaccggttttccccgataaaccgcataaaccacctaccctacgcgccccaagagccccaagaggtactcggcctaagactaccctagaatttgacccagagacccagagaagagcaggtattcagttttcttggcctatcaaaaaagcttggcccaacaggcaacaaaaaaaaaaaaaaccctagctggctattctcccagtcccacgccgcaccgcccacacggcgcactcccgcacgcaccgagccaccgacggtccgacgccgcacgccggaggacaccccgcgcggctgccccccggcctgggcctgaccgccttggcgccgccttccggcggccccgcctcgcgcggcctcccgtggtttcgcaagacgccgccccgccgcgtcgggcactccggcctcccgccttatgcgccggccccagcggccctccccctccggactccggactccggtgagcgctagtgaactacctctctggctctccctcagtccggccgtccctctcccccttctatagagttctactagaccagtacttagtaataaatcaatttcttcaataatatctgtgattagccaattaaggagatattgatttgtataaattaccacaaaattgtgtgcaacaatgaacctcatatgacatttttgcatggtatgatggttggagattgaggcatggagaagtcaagcattgcgttacttattcaaaagcatgaagcaaaaaggagttgcatcttgtgatgtaccaatcccacccgtggatttatctaagaccttttgaacaatttacattgtcatttaggtaagattcaatcttatttgttattttctacttgtattgaaccatttacagttatataccgtatcgtttactatttgttattttctacttatttgttattttctacttgtattgaaccatttacagttatataccggcaggctgtgcacgagtgcgtccttcccctttctcgtcctccatcctcgcggcggcggcggcggcggaagcgaaccccgatggcactgagaggcggccacgcggcggcggctgctggggtaagctctgggtccgaggatgacgacgaggaggccggcttctccaggagctacttcctggccaaggagaaggagccctcctctggcaagaagcgcgcccgcgccgccggcaagctctccgacctcaacctcgtcgacgagcaggtctgcataacccgcccctcctggaaaccctccgattcgtgttcccgaggccatggcgaatgccctgattcgagatttggtgcaggtgctgcgagcatccctcgctgagatccccccgaagcacgagagagaggtggaggctctgacgagaagctacaaggagcagtaccgcaactggctgttcgagctcaggttcgtctgctacccaaaatcctcccagtgttgatgttgatgtggatgaagccaaaagatcgatgtgatgttcttctgcaggtgcggatttgggctcctgatgtatggatttggatctaagaagatgttgcttgaggattttgcgtccacgaccttgagcgatttcaccgtcattgtggttaatggctatctcccttccatcaacttgaagcaagtatgacctcctcctgaccgatattgacctttgttgcctgcagtatggattactttatcgcattgttgttgaaaagggaaaaaaaagcattgagcctacagtccttaaggggttaaggtttaggacaaatgaaatactataaggaccaaaggcatcaatttggtatccaaagttgattgtgcaatcttaatttccactgattcatgctcaaagtggcttcaaacattgctctctaatagttgactagttgtgaagctgaaatagatgattcatgaaaactgcgcgcaattcctttatcttggtgttgcttgcagtcatatggagatccttgtttgcctattaggatcatgatcccaaacacctgtaacttaacatattgaaacatctgtaccttctatttgttcaaccattccaatattgtcaaattcggcacctcaagtaaattcatgtgcatgtaattccttactatcattaatcaggaagttcttgttatattgtggaggactattgatttctacatcaaagctcttaattctgccaaattttctgccttgttgccatttcaggtcatagtgacaatagctgaaatattttgggaacaaacaaaacttaagagaaaacgccagacagcaacaaggtcccagttgcagccatttgcatcccaatcaatagatgatattatctcctttctaaataaccagacatctgacaatggggatgacaatgtatgccttcttattcacaacatcgacggacctgccttgcgtgacgctgaatcacagcagtacctagctcaagtttcgtgctgcccgcaagtccatgttgtcgcatcagtagatcatgttaatgcacctttgtgtaagttcctggctagctttaacctcctgtaatgccttcactgtttaagattcctaacctgtcaaataactgtagtatgggacaagaagatggtgcacacacagttcaagtggagctggtatcacgtcccaacgtttgcaccttacaaagttgaaggtgtgttctaccccttgattcttgccagcggcggtcatgcccaaaccatgaaaaccgccctcgttgttctgcaaagcctgacaccaaatgcgcaaagtgtcttcagagttcttgctgaatatcagttggcacacgagaaggaggaaggcaagtttgttgcagacttattttcttatgacttcctgttgtttacaaactaaaccttgctacattgtttgccaggtatgcatttcagtagcttgtataccaaatgccgtgagcgttttcttgtaagcagtcaagtgacgctgaactcccacctgacggagtttaaagaccatgatctggtgaagatcagaaagcactctgatggccaagattgcctccacattcctcttgtttctgatgcgctggagaaattgcttcaggaattgacctgaccagctgggtttggaatttttttttaattgatcgagcggtcagtgatcaccatggaaacagctcagttgtgtattccaatctgtagttgtatatggattattcaccatttcagtttatcaaatagctgcttgtgtcatgaattgttgtgctacatgttctgattttcttctgctcaacattttgatcgtgagctgtgttcggcatctcgcaatttcaaaacattctgtattgttttgaaattgcaatgcgagtgtaaggatttctgcatataccttcccagcattaggtagcgataaaattccatttaaacgtgttctcaaatttgaaattgcgtggtttttactgtaactacttatgcaactgcagcctgtaaagaatcaaatcaaccaatattcaatcgaagaacatgtttttcctttcttccatggaaccagtactaccatgttacatctcaagttattactgatatgatacaacattaacaccacaccaaacatgtacatcttacagttaataggtttaaatcagatctcagtttacatggtgtggaatgcagcacaagttagcacaaggggtgagtgctaaaacttgatcaatttttcatccttgagccataagagcatctctgatagaccttcagttaagtttcttggactgtagcccagctccctcttggctttatcacatgaatatgcccattgatgtctaagaacacgtactgtctgcaatccacattgagaatctagtaagcacaacagcatgacctatctggagatggtaaacttaaataagaagaatactggacatacagggtaactgataagtgggagatttccagtgatgtgagaaataaaaactgaaatccacccatatatttcaatcaaccagagaggtacatggaataggggtgccttcgtatttgtaatgttagcagccatatcgaaaatctgtttgaatgataagttttctccagtaaggagatatctttcccccggtctgcccttctccattgctgctatgtgcccattaacaacgtcgtcaacatggcaaaacgattccctatcatacccatctcctatgtaaccaggtaggcgccaattaaaccgttcaattaactgcaagaatcacaacagtttaatttcttctggtcatggctatctttcaggaaatgttatattttaaaattgaaacaaatatacgataataaataactacatatttgacatagccatgagtaagaaattctctcacaatacgggaaacaatatttccagtagttagttttccaggcccgtagataactccagggtagagaatggtgattggcaccccttctgctgctgcctgcaatgcaattcggtctgcaagaaccttggatttctcgtactctgagcaaaatgttttctcttgatgtctctgaaatttagaacaattgaactctgtttatagcttatagaattactttaatttgtaaaaggcctttttgtaattagaggataatttgatgaaatggttactccatttcaacaggacatgcataagttggataattgttactaaaagtcggtatcaaaaagaattatacaagtggtagaaataagagagtgtcaggggtaaatcaaaatactttggaatggggtaaattgaacagctaggtttcaagagtgagttgcccattatagaaatttatcattaaaagttcaatggaaatcaagaaaaacgactatctactatctatactactaatggacaccttatgtgctcctattaacatgaatgtcgggtcagccaagtgctatctatactactccctccataccaaaatataaggtattttggatgaatgagacattttgtagtactacgaaagtacaaagagagtatgcctagattcgtagtaataggaaatgtcccatccgttcaaaatcccttatattttgggacggagggagtacatatcaaggaatgagcttagaacagaacctatgggcagaactactaaagacaatcataatacaatccttttatttactattcaagcttttcaaacatgaaatggtaaaaagcttacacagttcaaagtcatgttttacctgtgtctcatctgcaacataaccatcagttgggccaattgcaaagaatgaagatgtgtaaattatcttctttacggtcggtgttctcttagcagccttcaacacattctcgagtcctctcacattgacctgtaatcatagcacagaacgcgcatgctcaagtgccatttcttacaccaagccaaaccgaatttgcatgcattttagtttcatgaacagaacagcaaacggaaaatcaattattgttggacttggagccataattttcaaagaccctaaacagcatcgcacaataggcagaatgtctaggttcatctagcgttctatagtactccccactttgatttgaatgaatatagttaccctctacttgccacaggaaaacatcagaaatgaatcagcacgcgtacggtggtgaaaaccgaggggtcggggagccacggctcgacggcggcggcgacgtggaagaccgcgtcgcacccgtcgaaggcggtggcgagggacccctcgtcggtgacgtccccgtaggccagctcgacggatgccgggagcccggaggcgtcgctggagcggcgggcgaacgcgcgcacggcgtggccgtcggccgccagcgccgcgcacaggcggccgccgaggtaccccgtcgcgcccgtcaccaccaccctcatgccgccgcccatcgtcgagtcgccgccgccgccgccaatccaaccgccactagtcaacgcgggcttccaagccttccggcgaggccagccaccagcctgtccagtagtacccctagtcaacccacaagcaagcgggcccaagtcacttgtgggccgggcccaaatatgatctgcttttgcctctcgagtctcaagtctgatcagtgatcagcaggaacaaatttgaccatctaagaagaaatttggccctgtttggtgcacgcattcatcttcaaatttcaaaccacatgttttctttgatttaactatttatgcagttacagcaatgctgatatgtttacatgagtgaaatgtagaacactaaaatctgatcatttcgctgtccttgagccataagagcgtctctgatagaccttcagtcaagctcctaggactgtaccctagctccttcttggccttctcacatgagtatgcccattgatgcctaagaacacgcactgcctgcaaaacccaaacaagaactgaaatctaagtaaccacatcaatacatcatcatcatcaccaatgtgcaaactctgaatctaactagaccctgcaaaaacaaactctgaacctaagtaagtactggaaataaaaggagcacagaaagagacatacagggtagctgatgaacgggagcttcccggtgattcttgaaacaagaactgaaatccacccgtaaatttcaagcaaccagaggggtacgtggaatctgggcgcctttgtgttcgtgatcctggaggccatgtcgaagatctgaaccagcgacgtgttctctccggtgaggaggtatctttcaccttctctgcctttctccattgctgctacatgtccagcaacaacatcgtcgacatggcagaatgattctcgatcatggccatgcccgacgtaaccaggtaaacgcccattgaacctctcgatcaactgcaaattaagagccagtgatgttcaagtttctgatcatgattcatggctgttaattatttcaggaacaagttctttttttttgggtcattcagatataccatatatgcaggatgaataactaggagtagagaaattgtcttacgatgcgagaaacaagatttcctgctgtaagttttccaggaccatacatgaatcctggatagacgatggtgattggcatcccctctgctgctgcctgcaatgcgatctggtctgcaagaacctttgatttctcatactccgtgcaaaatgtttttccttgatgcatctgcaatatcagcaacttattgtttactctgcaaaaatgtttttctttcacgaaaggaatttgaagtatacatatcatcatattttgcacaattttttttagcatgctcagtctggacatctcacacaagaaatggcagattttctagaccgaaggatttgaaaactgagggagctaattaaggagaactccaatataaatatggtacctgtgtctcatctgcaacatatccatcagttgggccaatggcaaagaatgatgacgtataaactattttctttactgttggtgtcctcctggcagctttcaaaacattctcgagccctcccacattgacctgataatcataacacgtccgaggatatgattaaatgcccatttttttaacaccaaatgaccaaatcaattttatagagcatatatttttcggaattgcttgaaaactttcgcgagtttctttttaaaatcctcttttctttttaaaagattgtacacgtaccgtgatgaagatggagggatcgggcagccacgcctcgacggcggcggcgacgtggaagacggcgtcgcacctgtcgaaggcggcggcgagggactccacgtcggcgacgtcgccgtacgccagctcgacggacgccgggagcaggccggcctcaacgtctccgccgccgccgccgccgcccgccgagcggagcgcgaacgcgcgcacggcgtggccggcgtcggccagcgcaccgcacaggcggctgccgaggtaccccgtcgcgcccgtcaccgcgatcctcatgccgccgattagccgccgccgccgcaccagctcagtagccgatccgaccactcaaattaagcaagaacgcaggagctcgatcacggccaggaacatcaggagtcgcagctagataagtttgcgtgcttgacggcgatggctccgtcgccatcaaactccacatcagcttcgtcctcatcgccattctaggggtgtgttttcacgtcaaaattggaagtttggttgaaattgaaacaatgtgatggaaaaaatgaaagtttacgtgtgtagaaaagttttgatgtgattgaaaagttaaaagtttgtaactaaacaaggcctaggttgacaatattacgtatgagtaatttacgggctcgttcactttgctaccattttcaactttactttttttttggcaaagttaaaaaaagtggctacatttagtttgttgtcaaattttagtaagtacgtataaaatattgctaaaatttggtagccttgctaaaattttgacaaccttactaaaatttggcaatgccaaaacttgttaatgttgaaaatagtagcaaagtaaacaagtcctacgtgtacggggcatcattttcgagagatcactcgatcgatcgatcgatcgcgttcagcgtcagacaaatccaacagttccgacctctatgcatccatccatttcatgactcatctgatctgaccaaattttttcagataagggaaaggcaatcggcttgtcgtcaatcatctgaaacagcagctgtactggatttgcattgtcgtgccaggtcaggtcaacaacgtcaggatcgttggcagcattcgccaatcggatccggctcctctgactttggaagcgaacggaagataaacatagtaaaatgaatctggtgttacagtgcaaaacattgctctgcagtttttttactgtagacacagtaaaaaagtaaaaactactgctttgatttactattcaccagatactgtagatcggacgactgataatggatcaaagtcacggtcttctcagaggatctcggtccttcgcgatcaagttcttggactgcatcacagttatgtcaagcacgtactcaagttgcatacccatctttttactacctccgtcctaaaataagtgtagttttacattattcacgttcaacgtttaaccgttcgtcttatttaaaaaaattttatgattagtattttattgttactagatgataaaacatgaatagtattttatgtgtgattaaatatttttaaatttttcacaaattttttaaataagacggacggttaaatgttgggcacggatatctacggctgtacttattttgggacggatgtagtacgtagtagaaaaattcccttctcactgttaccgtacgcgaccacactttatatcggaccaaatatatcacatgggaccacctatacatttgtcgacaaattttctcctaaaaatttgacagatgtaattatagtacaatcgta

SEQ ID NO: 7520 - DNA, 2897 bp, Oryza sativa
gtcgcccccaagaccccctcccccatggtgaccaactcatgctgccaccgcgctctacattctaatcggttgctcttgctcgctcgctgctcgatccgttcattaatttgatctttctttttttggttttatttcttttttcggcggagcagaagcagaagaggcgtaggatcatcgaggcggcggtcgtggctccctcgcctccgaggaggtctcggcgcctcgctaatctccctgaggtcaagtatgcagaggtaactgctttgctttggtgttccatttacacagtaataaatgtcaaggagaaaaaaagattcagtaatattcagtcatagaaaaaaaaaagaagttcagatacacctgcttcttgttctgatgcatctggttctaagtttaaggttacaaattattgagcgtgattttcatacgttctagccgtggctgtcaatccagctagtgcaagctgtaaaaacggcctattgcacagtgaagaagctgtatttcacgttttctgaccaactgaattgataaaaaaatgtgcaaatttggtaggaactactgagcattaaataagtctctgaaacaaaccattcttagcagaacttaacaattttcagtaaatggcattttaaattgtgccattgttcctagcatccacatatgtaagtatgtaaccatcataagaaacatcttttctgtactaagaagtagcatttgtcggcaggtagcaccagatggcgcagagaggatgaaaaggtatgtcattatgtgataacaataacattaccacatgagcgtatgaagcctgtattgcctcccactaagtagcaaaaggtgcaaaactacatcccgttgtccgatttcttctgcaggtctccacgaaaagcaattgacagtatctacctggcaacccgtggatcaatttccatggaagctaggctcgaggcagcaagaaaagcagaggaactggaatcacaacttgaccctgaatttccctccttcgtgaagccaatgctacattcacatgtggtccgaggattttggttggtgagtactgcactatcacattcccatccctgcaacccttctttaaggggaactgttgtcatgtggtactaatacttgtttggtggcatgatcaaaagggcttaccgaggcatttctgcgagacttacctgccaaaacatgatgccattgtcactttgttggatgagaaagacgagcaatttgataccaattaccttgcctacaagaatggcctaagtggtggctgggctggctttgctttggaccatggattgttggatggagatgcgacagtatttcagttggtcaagcctacaaccttcaaggtattaattttactgaactgaacaatatgtctgaataaatttgtacctgtaacttaagcatgttttatatatgaataatgtgaataatccttgaaaattgatttttgtccaggtgcatattatccgagctactgttgatgatggaaatgaggtaaccaagtgacatcaacaaagacggcactactaacacatcggcagacgaaaaattgcattttgggtaggtttaggcctcatctgttagtattaccattaggcacttaatctgttactctgctagtttgcagagcatctatcatgtagcccatatctatgttgggagaaggaacaatttgccactcttatgttgtttgtaattggtgtgtccacaattactgccaattcgacactcgggagtttattagctgacagatttggagtatctgctgtttatgtgtctggctactgcatgtttctgtcctaattaagttttgatggaacatggtacaacttttggcgtttagattggttagattatgaactgcttctttgacctaacaattatcctacactaatgccatctaatgcagcatgtacaacaaatactaataacacaaaatggatcaaaaggatgatgctaaatatcacatcaatctttcaactcacatacagcatcatacatgaatatcatcctacagtttctgaagccttcgctcttctcccttcatcatcaaactgtatctttctgtacataaatgtaacattagattggaaatgatcatctcagatattccttcctttccagcctcaattaagtttgttcccctcagtcctgtatatatatatatatatattttttttttatgcaaaagcaataccatcagcatataaaatggatccaaaatgtgaagactttgttccccaatcatacctcatgtcaagttcaggtttgtttttcaggctctctggtatctggccggtgagattgttgttgttcaggtatctgtctttcgcaggagcaaatgcatgaggcaagtactaagagttatcagctgtttggacatgcaacaaaaagagggttaggatacttacagctccttgagattggtgagtgttcccagcgatgggctgattggtccacttaactgattgccctcaaaatgcctttccaaattcagaaaagttagtatgatggaaatgagtctcctagctaggatgagtagtaatcaatctcctactgcctatccattgagcttacaattcttccaagatgtgcatgctgctcaaatcaggtatggagcctgtgagtttgttgccaccgaaatagctgcatacaatttcaacaggaaaattagacccaagtgcttatcccatttgatcattcggattcactctatatgatcgtgtcaatcttacatatttttcatcccagtcaaatttccaatactgtcagggagcgatcctgaaagaccatgattttttagatccctgtagtaaacagaaaatggatcatatcatcacagcaacaaccaacatctcggtagcttattcactgtcaacaccatatga

SEQ ID NO: 7521 - DNA, 41333 bp, Oryza sativa
acacttacagtgatacgacgcgcacgggtgatccctcggagcagataaccccgggccacgaattctgttccgcaggcaaggatcgccggcccagtccggcggcgggttcttgatgctcctggcaagttcctccattgcaaccactgcacaagcgaagatcctaaaccttctcatcacccaaaaattaatctcacatactgaatctagctagcacaatgatgaacttttaaaattttgctttgctcaaattttgcagaaagaaactgcttgacatttggagatcagcctgtctatcgatctggagcagggtttttattttcgaaattgctttttctttgggggttgggttggagggggggggggggcgaaatttcagaaagttcgattttttttggccgaatttatttgaaattttgactgatttttaataaaatttgaccaaattcacacaaaaaaaaaagcaaaaaaccgaaaattttcggactgagatataagattgccggtggggggcgaatttcggaaattttgaaacgaaatttcaaaccctgatctggaggcgcataccatctttggtggccgtccggccaccgagcggcacaatctggtagatctcgccggcgttgatcagcgggccgaccggcgacgtctcgttgggcgtgagcacgatctccatcttgccggagagaggcatcatggtggagtacaccatgacgccggcggccgaggcgttgagctcccggaagaactccttgccgttgacggcgacgtcgaagacgcgccagctgtaggggctcgccgtgcgggagtcctggaagtagagcgccacgtagtaggtcgccgccggcagctccaccggcggccactgcaccgacagcttcttcccccggctcgtcgtcacgccggcccggagcgccttcgccggcggcacgttccagaactcctccggcgtgatcgccgagtggctctccaccgtcgggttcgcgtccgtgaacggcgcccagtaccggttgtactggtcatctggatagctagaaattccagccatgtcaggttaatcaggacacaacaacgcgccgtcgtggcggcggcgagcggcggaacgcgcgtacctcacgatctcgcccttggcgccgaaccggctgcgcgccaccgtgctcatgacgtacttgtcgaagtcggtggtgttgtacatggagtcgtcgaggctgacgagctcgagcgcggagatgaaggggctggaccgggtgtcggcgcggcgcgccaggcacacgctcatcgtcttcccctgcgcctccgccaccatctcgaagtaggtcgacatgccccgccggaagttgtcggtggtgttcacggcgctccaccgcgtcccgtcgacgatctggtcgaacaccggcggaacgtcgccgccgtcgaacccgccgtagaagtaggtcgtccggacgaggtaccgcgaccccttgacgacggggagctggtagcagtacttcctcgccgtcgcgtcggggaagtagcgcacggtggcgagcagcggcaggatgttcggcttgtcgacggcggacatgttgccgacggcgatgaacccctcatcctgtatccacttgatgctccctatctgctcctccttctccgatccacagtttatatagaaccctataataacatttcgatcacccaccattacacgtcccatttcttgcatgcaagaatcaattactccgtgtttgtgatataattagtggcttaaacttttttttctgatcagttagatataatcaagtttacataaacaattagcaacatatacaacaacaacaacattagatatactatgattatatatgtttgttttgtagaaaatatttttatattcttttataagtttaacaaaattgattatttaataaaaaagataaaatttattataatataaaatggagggagtaccatgaattacctcgaggttgtgggacgacggaggcggtggcatgggaggaggcggtggcatgggaggaggcggcgaggaggagggggaggaggaagaggaaggcaatggggataggcatcgtaatgtcataataggattgggtgggaggggagagagcaatggagcgcgcccacgaaggggaggctccgcgaaggggacgacgcgaggaaagggggctcacgaagggaggccactactgtttatggatcaccgcgcgccacaaacgggtggtttttgcttccttggcttttcaacggcttccgcttaaatttagcaaacgttagttgaactggtcaatcttaggtgtgcgtcatgggccttgaaacctctttcacggcccatgagagaaatgaggcccaagtgatcactggatcaaattattgcgagtggattgtgatttgggcctaagttttactttggaccaccctcaaatcaatcttttcactttagaatcagatagttttgtatattttttagtttggatgatcagaaaattttatcaattttttttaagtttggatcatccttaacttcttcaaacacccataaataacctcaatcaaatcggtttcggtataatggtgaacttccccttttatatgctgctcatatctatacatgaatagtaaagagagtggggtgatccaagccaaatactataggcaaagttatccggtctaaaatgaaaagattggtttaagtgtgatccaaagtaaaactttgacaataaaaaggtgacttcattttactcaattatttacttgtgattgaattattcaccgagggcttagtaaatctatagtccctgtgcgtgtatatatgaacagaggttaaagaagagagaattaacggaggcccaaaattctaaatgcgggcagccagcccatcccagcccagcccagctaagctagcaagctgccacgtcgtacggggacgggacggcggcgatcgccggcgaggcaatctactcccacttgcgggggtcggtgatgttgatcttccagtggtggtcggagaagccggcctcctcggcgaggtgtcggtcccaggcgatctcgatcttcctccgctccgacaggcggcacggcgagcgcatggcctcccccatgtcgtcgtacacctgccaccaccgcgcgtgcgcggcgtcgctggcgtacacccgctggtcgccgatgttccagttgcagtcgtagtcgcggtagcacgtccacggcttcagccccaggtagtggatcgaccacacctccgcgggatccgcccggaacagccgctccttgagcgcccgctccgccgtagtgttcgcccagaagttcttgaggtagttcacccgccgcggcagccggtgccaccagacgaacacctcgttcaggaacccctgatcgccgccgttgtaggaccggatggtccgccgctgccggatcagcgactggaacgtgcactgcgacggctcgatcaccatcaccccggagttgaagagcgagccgtcgttgcccaccgccgtcagctgcgggaagccgaagagggcgtcgaggtcgcggaggacgaggatgtcggcgtcgacgaacaccacgcggtcgtagtcggtgagctgccacagccggaacttgctgtagttgtactcgttgtaggtgccgcgctccgcgcgcgggttgcggatgcgcttgatcttgcgcggggtccagccggcggcgaccagcgccgccagcgccggcttcgacacggtgtggtcgtggaggaggacgaggtcgcgcgtcgacccggcgcgccggatgctctgcgccagcacgatcgcgccgcacaggtacgtgtccgacgagtggagcaccgtcgcgtacgcctcccgccgcggccgccccgccgttgccgccgccgccgtcagctccgacacgttgaacacttcctggatacctgcgttaattcattaattaattgcttgattagttgactgcagcttacgccagagaagaacacgtgctagattcttgcgaaactgcactgtgcctgatctgacaatttacctatccatgaaaacaaatttactccaagtccaaggtgatcagttctaaaaaaaaagaaaaaagtccaaggtgatctgaactcaaaaactagtgcgtacgacgaagaatttttcctaatcttttagcagatcaataaatctatttcttaactatatagtatatgtactcgatccgtattgcgtggcacatgcatcattcatgcacttcttgaactattccaactaagctaaaaaaaaagaactattccaactgaatagtatgaatatactgtataatcttagcttaaaacaaactagaagtgtcagacaagtcaaaaccaccaaagaatcaaatcgaattgcacaaggtaagatcaagcaataaacttaatttgcgacgatattgcgtacggttggtatagatatctggtcatccgccatggagacgaatgtagtagcatgcaatgcaagtattaattggttcatgcacaagctatctctatctatccatctagagtagtatccatttagctacacgcagctgtccggccggctggccaccaaccgaatctagtttaatcagccctgtcgaccgatcgatgtagtatgcatttgttgccatcatagtgttcgactgatcggacggttggaggtgaaaggcttccaaccagcttagctgcatgcctatcacaagttaggtgaaagaggccccagtctctgcccatttatcatcttcttctaattaatctatgagtggtcgtcatcctcttctaattaattaatcttttcttgattaatctgtcaatgctcatccatcgatctccatgtgcatcctgatctattaacatgtacaaaccgtactgtgcgtgtggcatcctatgagcaattgagtagtgtgctaggagtacttatcatcagatcaatcccttaagtaattaatatttagtgctagtatattttttttatcaactgtgaataatgtgtgttgatcgattggtttaggcagtagacctaggccctagatggctagatctatctgctcttgcaaggacaggttttagcttaattagctctcgctagctagcttgtggataacactgacagtgatagatccatgattaccagtagaagcttccactcaggtgggatgccactgtgctgatcaacgataggctagctagctagtttctgctggtacacactctaatcaacctagagcaattaatcaacacctgatgaaccgtataatctgaagaccaacggttgcaaatgcagttacgaaaaaggaacagatttactgttgcaccaaccggatcgatcgtcagtactcctatgaatataatagagcgtcgacgatcgaacaggactaaacacaattcaagttgattgattggaggcttcagtttcaacctgaatcaacgaatcgtcacctcgatcgatcgatcgatcaagctatagctagcaagggatcagattcttcaggtttggtaggaataatggggactactcgatcctagtgtatgttttgctaaagagaaagtcgagtgatgatgatgaattgatgatgagaaccttgtccattatcagctcgtggcctttggcaacatttcccgaccagattcctacgctctttgggtggctttgtcccacacacaccctcgttaaatcgtcctcacacactgatcatgcatatattcacattccaagcgcatacatccctacaagtgattatgggacaaaagctgattggttaattatgctgtgcttgcttgattaattgtgtgggtgtgctgtattgatgctgatcggttttcattaggtgacatgttatgcgtctaaccagcagttgggaacacttctctgaattgaatcatgtcttagtctgatgctaatgttctattttccttagtctgatgctaatgttctattttcctgcatccgttttttttttgttcttatgtgcatgcatggccttggcatattgaagtatttttttttcaaacacaaaaagtagtaaaatccacaatagatttttgttttgcataaaaacttgtaatggaaaaaaatgtcccctttaaactaggtgtttactaccttttttataattcgcatatcctattggctaaaggttactgtaaaccattaattgatggttggagtaataattaatcattcagtggccagttctccacagatactaacggaacagactgaaaataaacctaagctattgatctctgaaacttctttagctattctgcatttctttaaaatttctcacatgtgtatcctgtctcagtgtgatcatgatatattctctcttttagtttctagaagctgaaccacatatgtgccaccaatttttctcttttttcccctttatcacctgtcatatttcccctactttgttttcatgcttgactaacatgcatgcatggcgtgagcgcgtgcatctcacggagaagaaaaccaattaaccagggtgcgagcaaaaaaaaaaaaacaagaaaacattttgatccctcaaagaacaatatcatctaaatagttattatccctttgtttcatattataagttgtttgactttttttcttagtgaaacttctttagttttaattaaatttatagaaaagatagaaacaccgacactaaaccagtctcactaaattcaacattaaatatattttgataatatgtttattttgtattaaaaataaacttaaaaaaaatcaaacgactaataatatgaaagagatggagtattgtgcttagcttacctccgggtccccacagaggtagggcgaggttgcatgagccgacaggaagccggagcttctcctccagccgctcgacgtcgaccatgtacatccaccactcgccgtccctccccaccgcctcgtcgcaccggaacaagtccatcatgggctcgcactcggtgcgcaccaccacgcgcacccgcccgccgccgccgccgccgccggggtcgtgccgcagccccttgcgcgccgccatgtgcgccgtcacgaggtgcacctgcagcctgaacacgtcgcggttccacgcggcgtccgaacggttgcacggcagcgacgccaccaccacgtcgacgtccccgtaccgggagaagtccggcatggggagctccgggcaggacgggccctcgtcgtcctcctcctcgtcgatccactccgggaagaggtccgaccaccggaacatgtcggagacgcgctcgaagtcgacgccgacggcgtcgccctccacgccgagcgccagcagctcgtcgcggccgatgttcaccaggcccatccgcagccgcccacggagctcgtcgaacatcgccggcgccctcccggcgttcacgatcctctccgccgccgccgccaccgccttgttcgccgccacgcctcccagctgcaaaacacaggtgtagccaattcctcgtaagcaatctctcgaacacatggtgggtcggaaatcgaagcttagctttttgacggacgtcggtcgcacgcacgaatggtggactcaccttaccttccgagagagctgggcggtggtcgtcgtcgccggggtgcaggcgtcgcggaaggcggtgcagcggacgagggaggaggcggcgccgcggtcgaggaggtaggagtacttggggtggaggaggagcgccatgtacgcgaggaagaagaaggcgaggaacgccgcgttcagcttcacgatggccgccgccctcagccccgccaccggcgacaacgacgacgacgacgacggcttgacggcctccccggcgccgcccgtcacccccatgccaatggcacaccgcgccgggctagcttgtcctcgtgtcgtgcttcggcggcgaggttggcgcgcgtcgcgagctgaggtgcgcgctgttttgcctaagccggggcggcgttgcatggcgcggggttatatagatcgacgcgcgcggcatggcgcggcgaggcgcgcgcgaaggacgcggtgtgcgctgtgcgtgcgtgcgtgcgtgtgcgcaacagtgtcagtacgtgagaggcaagattgggggcaagtggttgggtacggtgagaaaggatgggggtgcaacgaactgagatgccacgtggcgagagttccattcaatccatgccttctcgaatctcgaggacacttgccacttcagtccccctccctgatgatgatcaagctctacaaattgcgtgtactagtgccaatcatgacgtgcgcgttgtgtgcaggagtaattaggatctgtttagctgatcgagctgaaatgcaactaaacagtttcttcatcgtctgaaataggagcgaaattgggtgtagcattttcattaaatgaactagataggtggtgctgagttttgttttatttttttcccttcagaaccatagatttatatttttctccagctatattaacatataaaactcgcactgactttcgtttaaaaaaaatactccacagctccactctatatataacacctaaaactaaatttagaagttggaatttacaaaatagatccttaacaacaatatttgagttaattttgcatcgcggtgatcccatcccctctatctcgatctctacctaggatcatggctcacgacctcggaatacaagagcatatcatgaattaaaaaattggcttaaacaaattatctcgctctatacaaacatttttttgaaactcacatggattgtggggctcttttttatatacaagaggagcatttggtaaagccaaaattttagaaatttctaaccgatgatccttgaacgtgcggacgttgatacctggtctaaataaaagcagatcgaaccttaattcccatggtcaaaaaggcacgaatcgctatgcagaataacaagagtgaaaacattattactccgtaccagctaggttcctgctagcatattgcactgttagttgacaggagccagcaatcaactttgtttatgtggtaattaagcctagctatgaaagggtatgtagcctagtggttatagtgacttgagtagtaccccaaggttctgagttcaaatctcctatggagcgaattttagattggattgtttgcggggctaagtttcctatttcaatggccgtatatatccggttaaatatagaggatgggtaaaaaatacccttctctagaaaaaattaggcctagctagagcacatattttaactttattgttagtattagtactagctctggttgtctatcactctgctgcctctgcacatactgatctagaacacacatgttctctacttctctgcagtcactgctactgacatgtgggccctactctctttgggccagcatgtcagtgtcagcagaggatctcattcctacagtcaatccatgtgtgctactccgttaaaaaaacgaattccaagctacaaacctaaacacgtttttttggacggaggggtatatataaacaaagaaaaagcactgtaggtacataatatagtactagatcagtcttattacagctgttcaaaaacagttcagtatatagtgaatctagttggtctgttgctactgcagttaattggctctggttgcttttgttgatctgttgctactgcagttaattagctccggttgcttagttgatcaagttaattagctctggctgtgccctaatcaaaattcatatatagtagcttcaagcacgacataccacctttcctaccttctggtggatactcctctcttttataatttctgcagtaagcttgaaacataagtagacactgccattaattaaacaagcacagtgaattaacccagatatgtgtaatctgcatactaattaaattaggttcgtgccagttcaaggcagccacaaccacatacaggcgatccatatattgatttatatatctgatccgtttgttgaggttggtgcatcaatcccccctgaagcagctatgtcgagcctaattgcgatttgattaatcaatttttctcatccaacgatttaattatgcgtgattttaatgattcgatcggtacagttttttttctctttcttcagtgctagtgcttctactagtattcgtgacaataacctgtcggatttggaatatatgattgctgatgtggtgtcgtttttattaacaagcccttgtacagcaaggtacggttcggttgccttgggtcaatcaagagaccattcaaactgttcagggacaggaacaagaacagcttcactctgaatccgacgcaatcttggccgtccgattctgatccgacgtcgctggattagatgaccgacaaaaaaccagagaaaatgttttttgggcgccaagaacatgtacaagtacaatgacgccacacctaggagaagtgatcctaaggcttcctcgatcagcttcgtggaatgaaatattttgtaattaatggaggaaaaataggatcgaaattggcccaaaaatggtcattttccgttgcaaacagtatatcatttcactggaatatttggtaggaacaacatacctctctgacaagaacttccaaggaatttgaatattccaactcaacaaagctagcatgattggtttaatgccaaatacatgaaaattaagtattactcatttcctggagtaccttaaataagtacagttgatttaaggccaaaattaagtgtctaatctagtgagcagccatccgtaactatcataattaaggagaaaaaatatcaccggtgccctgatgtgccacatcccgattaatgctgatatgcatccatctatccagctattatcagtacacaacgtttcatctctcgtaccaaactgacatgtaagctttggtttatccctttcccttcaccttcaagaatcccaatagaagatggtcagatggatggataagctacaagcatactagccacactgttgctgattcgatcttctgaaatgctaagctgatgatggtgccaacaatctcttctctgcacttcggtccttactgcagcaaaagataaagaagttttaaccatcctgatgacctgatcagaatcttcctttttcttctgttcttgttttctagtgatctttcatgatgcaatgaatgagaagaaatatataatatactacttgagaatggagatcaggtgtgatgaacacaaaagctttctggatttaaaagtgcttcctgatatgcattataagccatgtgttcccttttgttttcattgccatctgatcagatgcttccatccaagttacagaggggcagagatgatcgaattggttctggtcgtacatacacgtcgtgctcaggcttaaacactgcgtggttttcacacgtggaaagacgacgacgcacaaagctggaagtaatccacatttagcagcgatcataaaaaaagcagctaattagttggaaccaatgcttcgaggctgcagtacgtctcctttggtttcttttctctttggtgttgttcttctcatttcctttttatctttttccttctcctttcggtatcagtgatactttcagaaactttactccactgtaatgtaagaggaataaatttcagacaaatctatgtatgtgacgttggagagagccgtttgaggggattagtgaagttacatctcacctagaatgactgtttaactggtgatttgaggcataagaaagcattcctaagtgccagctaagtcatgtaaaaatttgcttacacaccaattatattctaatcttttaaccaaagaaatgctacacatggtactattaggtgaaaatgtgttctcctttattatttgcactttatgtgcatgttctacttctactactgctggttccctactctcttttggtcttgatatactgttacttgcaatcaatcttaattaatggccgacaatatctttacaaaagttttaaagaaaagaaacctctactggatgaattttcagggtagtgcttgatcaaatctaagaggtcgattacacatgtacctttactaattattggcagtagtagctgaagaaaggcaaaggcaatgttccattctttaatcatatggttttgaatgcaggtggcatgtatttggaattattaggctatagtcacaaaatgttttttggctggcacataccatgaaggtgattaaacatgcatggttggttgcatagtctaggtccctctactacagcacacaagatttaacagcaaaagtttgataaaaaggtgagagtgaaatgagattcagatgagagtagtaggattgctggttacaaagccttgaaggcaactccatgcccaaacctaacctaccccctgcattcttattcctcttgtgcccatggatggatgatcacttgaacaatagttgtctcaattttttttctcaccaaatcctgttggatttctttgtctttcagttaagaaagtttggggatgaaaagttctttgttcttccaacatcctccaggagagcacaaaaaaaaaaagggtgataggttgatggatgatttgacctggatgcttggagggctctaaaggctttatttcgtagtggaaatatggttgtggattttttttgcctcatatattcatttctcttgaagaagacgatacattcagtatatttatttgtctggaaaaatttatacgaaaaggctctgatgatcgattgagctataattgataagccgtagaaaaataatcgaagcattaaaaaaataattattggtaaaactttatgtgtattatcaacggtttaaaaatcaaggctgtaaaatagacttcgatggacaatttaccttttaactcttttaacttttattagtggtttaaaaaccaagccttaaagttaactttttaaaatgtaaattgcatctatggtatgacaacttgacaagtggatgtgatatagaagaacttgagaattgacgttcgagtgtaacgacttggtaagttggtgcgttctaatacgagaacttaaaaattttagtattttggtgtaacaacttggctaagtatgtgatgttttagttaatgagtgctaggtgaattttttttcacgatgttaataatctaatataccatcacgtagcaatcctattgatattatattataatcttgaatataatatttaagaattacattggagatctaatttgcaccaccggtttgaattttttttcttaccttctcaaatctcaacagaaatataatatcttctacatagtaaagtttaattgactagaatccttatttaaaaaaatactcggtataattaaattgttgcaccacttttttatttattgtatcaaaatcacacctacattgtaagttattgcactcgtacaatcacttataaaattcttacactaaatacctgtaagttgttgtactaggatactcatttaccaaattgcactcaacttaggtagtttatgcatcatgaatgtaatttactcctttttaaaagtttaaactttggccgtagctgataagagacgacgagagccaaagtggtagctcaaacaagatcgagaatgctggtacagtttagctcaagtcaaaccaaatcctgtactactacgcaatttagacgatttacctactgctatgtgattgctaaatggaatcctcttcctgtctcgtcattacagtatgcaatgtaaaagagaaatacagagtaaacgcaaaaccaaagaaattgtgtgttggggattgaacaggtgactttggagttcaaaccacgtacctctttacagtgcattatgctgcgttcatttctccaacaagagttgaatgaaattttagatattcgtggcacgctttcaaactgttaaacggtgtgtttcgtgcggaaactttctatgtgaaagtttctctaaaacatcagattaatttattttttaagtttataataattaaaactcaattaatcacatgttattaccaccttattttgtatgaaacactcaattttaatcatcttcaggagattcgagtgcatgtcgaaatcggtgatacacgcggttctggtcgacggcgacgagaatcttggtgcgattgccgggttgctttcggcatcttttcgcctgggccggcggcggatcgacgcaattaagttaacaaatcggcgtccggcgagtggccggctagccgccagcttcaactgctcgttcagagtagagatcgacctgtcagaatgttgggtggagcggagcgagctgaggcgcgtcctgtctcgttctcgtctcgtcgccgtcgacggcgcacctgccgatctgatctgatcacgttttttttttttttttgctccccttaatcatgattgagttggcgtgatctgatcgcacgggaaaccgcgagcagtgtgaccggcgatctgactgacggagtagtggctactggctagagcttgatagctttgcagatcttgctgtcaatcagccaccggtgtgagtacgctgtgcttgccgttgcgacgtcccgtgtctccggccaccgcgcggaggcgagcttattcgtcatcgtagatttttacgtatccagcgcagcaagaacgaacaagatgccgtcgtccgcgcgttccgcttcgcccatcagaccgcaaccaacgaaaatcctgcgcccccggcggataggattttctccgaacgcatagcctccatgtctgccgccgccgccggcaagagattccccgtcgacgcgaccatctcggtcggggctcctacttctccgccgatggggagacgaaggcggcagacggaacgctgtactagccttgtttggagtgcttaaaattacgataatctactgcttggtagctaacttttgaaaatctggtttatggtttcttagtttattttctgtattcaaaatttgggtgataatttggactgtatagggtgtgttcggacccaatgattcctcaccctctccatcgtattccgcgcgcacgcttttcaaactgttaaacggtgcgcttttttaaaaagtttttatacgaaatttgcttaaaaaaattatattgatctatttttgaaaaaaaaaatagctaatactctctctatactagtaaaaatcacgtttagaacagcatttagcataccaagaagtgattaattatgggtatttttccctgtctacccctattaaatatggttgcgcgtaagaatcttggcagggacaagttggtttttaggttttgcatggcactgttttggcaaggcttgaatacttggttggctgcatggcgctcgtgcaggtggcgtttaggcgcgttttttgtttcgcttttttagtttgggttcactccgcgcgtgatgctgaaatttttttgcatggcgctcgttaccgctattcgcgcgcctatcccgtggtaattttttcgcgtgggcgtgctgagaatgccgacgcttaggttactgcttgcccatatttatacgctaacttgctttcacgtttggagtactgagccatctcatcttctagttctaggcttctagctagcttcctctcactattgcagtacacatggccgaagatggcgatggcgagtttgcctttgatctgaacgagcctccgttggagcacggcaatggtacttttcttctctgtttgacaggatttttcttctcttgtgcatgtttgtacggcaactgtgctatctcttcttctctatatcgtttctcatatcattgttttccattttttttaactggttttgatttgaacttgccactaaatgaatttggtgcagtcgatttcgattatgtacaacaccttgctggtaagccaacttctttttgatacaattagattttgctagaacatgccatggctatttgtactatcaatgaacttgattttcttccttttgctagaacatgtcatggctctcgttgaagtaaaccatcgaaggaaggaaagacatgaccgaagaagtgagaaaacaagtttatcaagctttgttggctagaagcaagaatgggaaactaggcaagaaagatacaagagttgttgcagatcagtttgtcaaccatctttcctagatgaagccaaggctactcttgctgcattgaacatttagaatgaagctagttaggttccgcactcaattaatagagacatccttgtaatgcgattattaagttgtgttatcttaccatttctttggcatcatccttcctgggagtgagctcacgttcgcgcttctcgtcaagcatcttgagcacaatgcgagcggcggcggcggcgtcgagcgtgagagagcacggccggtgagcgcgacgcaagcgacgagagcggggccggcgagcacaatgcaagcggcggcggtggcgagtgcgacgagagcagcggcggcgagcgtgacgagagcgcggccggcgagcgcgacgcaagcggcggcggcagcggcgagagcgacaagagcagggccggcgagcgcgacgcaagcggcggcggcgagcgtgagcggcgaggttgagcggcgtgctgcatgcctgcatgcgacgcttaaggaattaaacgaggcaagcgcgggcgtgctgcggattaattgcgggagcggctatcgaacagacaagggtaattccgtccacatagcctgctgcggttcagaatgtcgttaaaatcgcaaacgaggttatggctagaacgacgtttttttcctatacggagggagtatctaattaatcacgcgctaatggactgcttcatttttcgtgcttaggtgatatgttcctatccatcaacatgaacacacccttaagagagttgtagattatgtgagaaactgtagctggtagaatcttatgcccgcaaagacaaagaaggtgctcgataaaggcgccatgctgggccgacccacgggaacagaccaatcaacggctatctacaaaggaataagtgcgattagactccctttatgtataggctcactctaattcatattcctgaacaacaataccacataataccaggtaatattttgacatctaaactgatacaaccattggcatttaactcccttagcgattttaaatgtggtttcctaacgtactctctccgtttcacaatgtaagtcattctagcatttttcatattcatattgatgtcaatgagtctagatatatatatctatctagattcattcacataaatatgaatgtgaaaaatgctagaatgacctacattgtgaaacggaggaagtaactcgtttcatacgagacccacatatcagcatccattcttcttcgtcttcctctcctctaacttccttcccgggcagcagttccttcccctcctcttctacaagtgacgaatagcaccacgagctcgccgccaccggcgatggccccccctcttcatagcgaacctccactcaactctcgttttctttctccggttttcctcctctttgcctctttggtttcccctcagtcggggtctttggtaaactcttgcgaggacggtggccaggagtggcaaatatgcgtaccatcatacctgtacacagcgctgaatgttggtttgcacagggaagtaagaacatgtatcatcagtaattcagtacttctcaaaatttgcactttacacaccatgaacacaattatatatggtcattttacagatgttggatatcattctgcaaaattggtgatctttcattctcaatatcatgatgggagtacatgtatgtacaatggaattatggcaaaaggaatgatgggctttgcatcattctcatcttgtggcaaacataaacatattactcacattgcaaacaaacagttgccagaacacagcaacacacacaaaaaaaaccattacaacaatatgatcaaacaataaatctaccatgttgtgagtgatcgatcctattattcttctaccaagacagactctacagagttcagaactatactactaaatcgccaatactaactcatccagttctcattgactgcatattcaaccagatccactcttgcatgccttactctggagcatctttccttccatcagcttttgtggaagcaaacagtttgtcagatggaacaacctgcatatatagaacaaaccatgtcagtgctactgatactctgattttttttttagtgtgctgtcttcatctcaatatttgcaacagaataagctaattaaaatcctgagaaattacttggtaattccgtgtaagagcacttcttaacttccttctcttgcatgctttgcttgattctgcatcaacctccgcctcatcatcagcaaaattctgatcagagacctctgtataaaaggaaaatggaagaaaggcgttagagactaggttcatcacattacgctgttttggagcaaccttagtagaactttaacttttttctgttctttctgttcttatgacaagagacatcacccaaaaaataaaaactatacaagctcccgggcttaagaacaatggatttggcatgccgcataaaaatcagtagtgttgataaaacatttgtatgaaatatgacgcaccaccatttgatcccaggaaaagccattgaaagctattttagataaaccgcattaaatcataacctatgaagtgcatggctattcagaacaccttatatagttataatgtgaccgctgatagtcagaaaaagatgatgaaacaaggaattcagacttttaagcattcttcaatgtgaactaatgaggtaattgagttaaccacctgtactttcaccaacagctttttcttccttgcaagcctcccactcccttccatgtgacaacggagtcctcccttggatagtctgaataccagattcatgatcacccactaaagcctccgccgcatcattccttgcattgctactgcattcgcgcggcctgaaatgctggatccaggggcttgcgggcaggcagtattttctcccgatccgtgagcaagcactggtccgatcaaatttgagtttctcccacaccccaccacggagaaccttgaatccgttgccagcatcattttgttcgtgattgtagagttgctcaacgaaagaagcctccattgagcttatataatgcatgtgccgctcatctgtccaccctgacgacatcatgtccaggattcgattgccctgtcaaagaaaaagagacaaccattttattcttcagagttcaggtatttgtaacaacgtcagataaaagagggcctgaactagtgaaattcatgtcaaaaatatcagagtagtgttgattgcatggcttaaagttatactccacgagcagagtaattatgtgtcttcactgcaccatgggcggattatattactatttcgacatgacagacatttcttgaacgattgcatgacaaattcagataaacaattaactgtacaagactaaacactttttactaagaaaaagaagctaatggcaataattcaaggaagcatgcattctgtatgacagaatcatgagcccaacaattgctacctgaaattaagaacaaacacgatggtaaaaagaaaaaactttctgttctaatacttgagcaatgccgcctgcagctggctccgccttgatcggtcgattgactgacacatcactcatttgatttttctcaatgaaccaaggaacccacaaggggaggaaaatccgaagaaatagccaaaaatcttctcgaaccgtatcagaaaccagcccaaaatttcctctcttgaaatatgtgcagctacagagaagtaggggaggtctagggatctggaagcaaatggtgcgaacaaaccaaagtaaatctcctcgcgaccggatgattacgaagagggaaaacaaaaaagaacacacaatttcggacaagatttcaacttcaagaaacaaacaagagaaacaaaaatcacacctctcgctcgatttcacccgcagatcgaacaacccgcctccctcgcagcgagaaagaagagagaacgcatccaagatttggtctgagcggctcgatctatggacagacaagaggaggtgaagaagaggaggagagagagaagcaggagagagaggagaatggaattgcaacggaagaagcaaagggagacgaagaagaatcccctcctgtttaaggagcaaataaatgcggtgcgagagagcgagcaaaaaaaaaaaaagaaaagaaaaagaagaaggcgcggtggctttaccgcttttaccgcctacgtgtgccagcgcttttccacgtggcgaggcgaaacgtggcgcgggggggaaagaaaatatctcgcgcgcgcacacgtgccgggccgcctctcagatatttcgtggccgctctggcgtgggcgtggcgttgccaaaaagatctctgaagctgggccccacctccctgtgcgtaagagaggctaggaaaacaaacaggagtagatttttgagcttcaatttctcataaaatttataattcttgaaatagctttttttaaatctagattttgagagtcgatagctataaaatctagaaaagaattagaagccacaaaaataaaaagaactactttttaaaattttcactaactaactactattatccacatcttaaaatcttttatctccttttgtgaaatgaacatgagttaactggttaacttttttttaatggaaccagtccactaacttttaatttctagatttgatatgagtgctcgtatttacgattaattattattttaactgtatcgatatggactaatctttttaagatgctcaaaaagatagggatagtatatttttgtattttgtttcttaaagtaatcttttatctaccagacaggaagaagaccatctacctgcgaaaccacgagcaagcaggcatgggcttgtccgctcgtagttatctccccggcgacgccttttatattcagttaggataaccaaaagtgtttttcaggtgattctgcagtgaacaaatctactactactactgtccgagatttttctttttcttctgatgcttacttcagtcattcgttatccaaagagagtcttcaggggcaagggatttatacacttttatcacaggcatctgtacataatatctgcaagatatatccaggagatatggcttggaagttgtgacccatagtttgttatgctagtctcaaaagtacaattattgaatcagctaagaaatatctcagggaggagagaaatatctgagggataatccagcaggtgcccctgtttttctaattgcaacttggtgaactgaatataatagtacagtatgacccatgttgacgcaaggacaggcaaactgtttttagactgcccatgttttcttctctgaccctttctgactaaacctttggttcagtgaatatgtttatactattgtttacttaacagtacaactatgcgttattccctgagtatcaaaatataaggattgtgtgtctgttctaatccaaactattataagttcaagcaactttataaaaaagaaaaataatatttatgatcgacaccactagatcaattatgaaaattattattttcagaattcacttcttgggtgtggtaggtgttaagactcttctctacaaaactgaatcaaatttaggataatttgacttgagccctatttgatatagctccatagatccacactggatttaaagtttgaatgctaaattacaacggtttaaatctttatatttcaactataacaggagcaaaatgatacatttgaatgttatcaacagattgaagatctatggatttgtagagttagaaatacctgacttcaaaaaatcaagaatccggataaatacaaaatatcttctttttttttagggaggcagtaacaagacaggtggtggattgttgattcattttaactgaaacaaagtgggcatatctcccaggtgtgacataagcaaccagtgagtgcaaagggagataaggtctcttaatcccttcacatagaaaaaaaaggtcgctttaccccttttgccttttgcaaaagtctaagaattactatgcaggtcgttttacataatgttctttttctccagcatggcatatcggcatcagctctcagtcacaaatcaactttacagaaatatgataagaccaaaataggcatctttcaagttccatcatgtgtaaattggtggagagttgggcacccactaaatagaaaaaaactgactaggggatgatgacacacacaccattgggaatagtcctgactacaactaggaggcaacaggaacttcagactgcagacttttcaggctcctacgagatagcattttataatcctgaaatcagcaagtgataactcattagcctacaaaactgaatcattgtgaactgcaccaagacaacaatacaagtctgatgcatctatgtacaaacagaaccatggagagcagcgtttacctccactacagactgagcacaaagcttcccagatagaactgcaccctccatcgaagccaaatatttctgctttgtgtagtcaccagctagatagaacccttcaatcggtgatctttgcagaggtcggcaaggttcacagtccgggatagtcttgtaaacagatctgtaacagtgagacagaaaagaaaggaacgtgagagaagtgtgcatccaactattagacctacctatgatatatcagatagggggcgctcttgcaaaatgtcctcaccttggtgtcttcacaacatgatacttcagaatctttgctttactctgatcagcagcaatttcatcaggaaatagcttggctagctcttgcatagttgcttcgatgatttcagtgtcactccgtccaacccattcctctgcaggagcaaagaccaactccagcattgaacggtttggatcatagtattcctgtaaagagttcaaaacaaaaggaaagaaaaccgttcagtaggcatccatgtctttaatttcctgagctattatggtccataaaatctagactctagagccaagtgacatgttgcctaaatgaatctgaaataaaatatatctactttccaagtttaataattaatactggattccttctgtaacacatgcacttttgggccttttgttacagctactaaaataaatatcatgtgatgcttgaagatggtaaacccaagaacaaatacacaagagcaataatacatgacagatagttactatttccgaacatataatgtctcctagttagtaccttgcaagttactgacatgtccgcataaacacttaaaagtgaactcctgaaagaaaagggaacaagatcaatacatgggacatatgatatttggtattaatcaagaatgtatacaaaatcaggatagaatgtgcccaatttgggcaatacaaatcgttttagttcataaaccagtcatagcacagagcaaatgcatgaggcagtgaaaggacagcaaaactgatgaggaattagaagagacacctgctgaaaagaaggtggtcatatgtgttctttagttctctatcaaacctgaaatgttcaaaccaacagaaatactaatatgagtcataaggagaaccacaaactcgatgatgagtaatttccgacttggaaccaaaataattaaccaaccaaccatatatgaacatttataacaggaactcccaccaacttctccagcttcttgaaataagatatttctttccactcttgaggtacaagaagcttcaagatatcaactaaatacaggctagtcagttaaaatgagtagccgcatatatataatttatgaactgcagaagaaacaaagattgtagaaaatcacctggtgttgcaaaaacataagcatctccagttatttgagttccatcagtaagtgcaaagtgtttcactgttccatcaggattaagttctattttctgaatacgagaattcagccgaacctcaccacccaaagagcgaacatggtcaacaataggcatgcataacctttcaggaggattaccatccaagaatgccatcttagaaccatgcttctcctacacatttgcataattttttttaaaaggcctctaagcgaaaattcatttgagtttcctcaaggtaggaaacaacagagacaagaaacactaagaaggatgtaatacgtaaggtactactccggaaagaacagaagaattactcatatgcaacacacatgaccatagagcaacataataaatacctgaagaaatcggtttaaagcaatcagaatgcactgcatggataactcatcaggatttatgaaattaagtgcctttgacattgcaatgaaaacctcatcgttcactcgatcaggaacaccctgtgctgatcaaacaactgtatcaggcaccatattaatccgttatcccaaaaaaagggaaagagattgataactatagcatatgtattgtgttttctgtataaaacagttctgtatattagctcataaagaatatagtcaacaggattgtgtgctttgtcaatatgtgcaatggcttttctaggtggaggaagaaatcatgcaaggttgttgacctttaactgaaacagtggtcttaaactaaaagcatagctcaagcttaaacctgtgcaaaaggatctgggcaaaataaagggcataaacttgagtacatgaagcatttcatcctcagaactgccagttcttcccaatgtgaatgcaacaataaagggcatcagtttttttattagaaaataaaaggttttctagcttacaacaccttctcctatatccattccaaattaatgaggtagaaatgtgtcttgtacacagagacttgacaaactgatattgtgaacttatacctgctttttcatccactcagaaacagtaaaaccatcttgagcttcaacataagcttggccaccaaccattgctggcaaaagtccaagagcaaacttcaccttctctggccaagttagcatttcattgtttcttagtatggcccatattcctgttaaatgcacgcatgatcaatgataaataataaataggcatcaattgacaacataaaagctccatggcatgatctattgatctatcattaacgttgctagtaatataccccctaattacagtcatgtgttagtaaaacaaaagtaaccaccaatacgatgtacttctgggaatcttggtttaattaaacaactccagcgctgcatatgatctcaccatttaagggtgcaggcaatgtttcaggaaaatcaaaccggctgaattctcctggcttgtttggcatggcaaatatcatggagtgttccttccattgcaaccgatcattaataccaagctcgccaaacaagttctgtatgttgggataagctccaacttaaaccaaaaaggtatatggttacatacaggcacaaaatgaacaatgtcacatatgtactgttgtggacgacaaaacagtgtgagcatggaaggaaaaacagtatctgtcatattcatatatgtttggaagggaatagtaggttgaaagaagactatgtatgaacaggaggatttatattcaattagctcatgatatttatgtgacgttaaaatttatcaaccatataagctagtaaaaagttactttttagtactgtgaaaaaaaccaatctaaaagtttcttacaaaataaaactaccatgtgtgttaatcctcagacatcacttcatacttcccgcatggcatttctaccttatcgatgaaagagtttgatacatgtttttttgttcaaaacccttagagatatctatcagtgctggcggtaataacctaaataaaatatagcacaacgagaaccttaaaaatccagagttattacttacaaaagatatgaagcccagtttcataccaatctccatcttcatccttccaagcagctatctgttcaaggcatttccccaaaaaaaaaaacaataatccacaaatgctactaacagtgaatatgagctattaagataaaggcaaccaaaaaaaaaaagaatgaataacaaaaaaaattaaatgcaacataaaagcataagagtaaaacctttccacccaaaacatcccttgcctcaagcaatatgggtttatgaccagcatctgccagatattttgccgttgataaaccagctaatcctgaaaaaaaaatcaaagctaaaaactacaatgctaagaccacgatgtgactgctatcaaagttagatatatatgtaaattattcatctgtcaaatcctagaattatatcatacctgctccagcaatcacgacctgtaatggtttagtgggttgttcactgtttctgaaaaatgaagatagttgtccagcttccaaaaagtttattgtgttttctagtggaggtcttggaaagtcctggcaaacaacctgcagaaaagccaatcaaatatattttcacaagagatggaatgtgaggcaataatagagtacaaaggttgaacctgtagagcaccgagcctccgacggaatctttttcctttattccttaagacaagagatttcactccaaagctcacatgctgactacttttcagtgcttggatgctgctacttgcgaagcacctatgagtaggaagttgtcccgcaaaagatcttgcttggctggttccagttatgttcatagatgacaggcagccagtatccatgctgaagcaactcctaaaattatattcagatctgatttgacaaataagcacgcaagagcgtctgcaaaaacaagaggaaccattaaacacacaatacacaaaaccgtttgttatgaaagtcagccaagtatcactgtatcagtatgtaaatttatcaagtttgtcatcactatttgatgaaaaaaaaaaaacgagccaaagaaacagattctattctagtccagtcgtcaaatggaaacatagcatgacaataacaaactgatgccaaaaggaaaaaaagagcaggaccagctgttagttgttaaagctatgtggacagtggtaatattggtttactccctaatcttccgagtttctctatgtggctgcggccaatcaaacttttatagttggagagaaacatgaaaggaaaactgcatatgacccgcataatttggttagtgaagtaaatggattggaacagatcaagcatggcacaaaaagcatgaaaggctcaaatgatatcacactagggcagggcagctggagaggacctcggttgcctcctcatgcaaaagtggtggttagcgcaaactgaactcacaaccatgcgcccgctagtatctaaagatatgcccccaaactaagcactaaatcatcatatgccgcatgctcaaagccagcagtcatctcagcatctctcctactacctatttaccaggaaactaccgccctcccgtcaccgcagtcaatccaacaccttagcaaccccgcaacccggaatgaattcccccaattctacggaatacagatacgtacccccgccgcccgcgcgaccgatccgatcctgctgctgggtacggagggggcgagcacggagtggaggagactcaccggctggaacgacgagcgggcggcgacgtgggactggaggcggaccgcggaagctgcggggggaggagtcagggagggggtgggtttttggggcggtgggaaagggacaaaggggaggcgggggtgaggattgtggaagatgtggtgggggagatgccttttggcgcctgctgctctctacgttctacgtggtatataccaccatcagccaatcagtccatcaccctcaaaaaaactcatatttctgaagggaaatcataggagtattttccttttccgattacacgggagatgtatacgtgcacacgtaacactacactcactctatgaatacgcctcctaacatatattttaagagatggaaaccaacatatccctgattcatgaaaatttcagatgcatgaaaaattctttcctgggggaataagtgtaacagtcatgaagtaatgaaaagatgtgctgctacgaagtaattatctgatgaacagtataatcactgtataagtaatgtttatcaaatgttcgcgtttgccatagcagagacagaaactgtgcgtgcatctgcacacgagagcatgcagtttctcagttctcacggtaatcggaggcgactgtttggtttcaggtgaccgtccgctcactaactggaggtttgaacggtggttggatcagcccaaattcaggtcttctcactgtaccagttcagtccaagctgccatcttcttaacacttcaagaagaaccaaccaaaacccacctcgctaacgccacttaaatctcctgtgatcttgtccatcagattgtctaatgcgtggtgagatcttcactgcaacatttggaatgaaaatgacgatgctgtagccgtgttcattatttcacattctgttccgggcgacagattttagctgaaggcatggatgaaccaggtgaacctttgcttgggctagagaatttcttcgacgaagatgttgatttggtaagtacatttgttaggatgtcgtggatttgaagcattctttgaaaaatgccgtgattcttgtggatatgtgacaggagaatctgcccctggaagacgtttttgagcagctgaatacgtctcagagtgggctctcatcagcagatgctgcagaacgcttgaagttgtttggtgcaaacagattggaggagaagcgtgtaagttgactgttttctttctgatcatcgtttacctgaaactgaaacatattccttttctgaactcctgaatttttttttttaaaaaaatcttttttgtcaggagaacaagatcatcaagttcctcagctttatgtggaatcctttgtcctgggtgatggaggcagcagcagtgatggcattggttctagcaaatggtggtgtaagtgcttgctttgtgttattgaaatattgacatcaaatcgtcgaaaatttgtgcaagcaactcaatggattttctttattattcactcatttactgtctttggtcagagccaaggtactgactgggaagatttcctgggaattgtctgcctcctgattatcaattcaacaatcagcttcattgaggagaacaatgcaggcgatgctgctgctgcactcatggcccggttggcgctaaaaacaaaggttttttttttctgaacagaaattttaaaaatacaggtgaatctattgtgttagtctgatcttgttgtgttcatatattcatggatttacctccaggttcttagagatgagcaatggcaagagcttgatgcttctacattggtacctggggatattatcagcatcaggcttggtgatatggtccctgcagatgcgcgcctacttgagggagatcctctgaagattgatcaggtgactcaaattgccgcgcaccgttcatgtggaagatatcgataattggaatgactgatttagttgatctgtgtaaataatttgattacattttgtttctcctccatcttgtagtcagctctcaccggtgaatcccttcctgtcacaaaaagaacaggggacatagtgttcactggctcaacatgcaagcatggtgagattgaagctgttgtcattgcaactgggatacactctttctttggcaaggcagctcatctagtggattccactgaggttgttgggcattttcagaaggtgattcatcgatcttcagactgtaataagaatctcacaagtggatgtgctgtaagctatttctgactactgaattttcaggttcttacctccataggcaacttctgtatctgttcaatcgccatcggtgcgattgttgaggttataatcatgttcccaatccagcaccggtcataccgggatgggatcaacaatgttcttgttcttctgatcggagggataccgatcgcaatgcctactgttctgtcagtcacacttgcaataggttctcatcacctgtctcaacaggtgtgccaagatattgttatcatgtttctgcaattaacagacagcatatcacatatcattgttacaaaaatacgtagtaatttggcgaaagcgatggcggaggaagccatgctttggaagtcggcaaatgcaggggtcccttccgttacctctgcgaggtcgtggtagccaaatctagcacgagatatccccattagatccccagcctccaataccggtcccgtgcttgtttttcttttcgcattgtaaataacttttatttctcttaatggaaaaaatacgctccttgcgtattcccggaaaaaaatatgtagtaattgatttttggcagggtgctatcactaaaaggatgacagccatagaggaaatggcaggaatggatgttctctgctgtgacaaaaccggaactctcaccctcaaccatctcactgttgacaaaaacctaattgaggtagaaaaattaattaaaaaaatgcaacgtattgaattcataattattgactagctatacaacttatgatccatccttgggtaatttaaggttttcagcagagaaatggacagggaaatgattatcctgctggctgcaagagcatcaagagtggagaatcaagatgcaattgatatggccataataaacatgctagctgaccccaaagaggttctgaactcatctttgcttgatttgaccatcctacatatatttcagaatggttcatggatatcatctttgcattgccaggcacgctctagcatcactgaagttcacttccttccattcaatcctgtcgataagaggacggctataacatacgttgattctgatggtaactggttcagagtcagcaaaggtgctcctgagcaggtaggaacttttcaatccatcactgtaaatctcactgctgttaccatcagaattcagaaaatagtaatacagaccttgatcagataggaagaacatctgatgtctctcatcttcagatcctcagcctatgctacaacaaggatgatatctctgaaaaggtgcagctaatcatcgacagatttgcagagagaggcctccgttcactcgccgtcgcttaccaggtagtcgtagcaccatcaagttcagttcagttcagtttacttgttgctaatgaatatctgtctgatggttgagttcatctgatctgatggcttgagtgaaggaggtgccagagaaatcgaagcacggccatggcggaccatgggtgttctgcggcctcctgccgctgttcgacccgccccggcacgacagcgccgacaccatccgccgagcgcttgatcttggcgtctgcgtgaagatgatcaccggtataatcacgcgatgatcgtactgcttcttgatcgtcaatggagcaacgccaagaagcttcttgatcattgcaggcgatcacctggccatcgcgaaggagaccggccgccgtcttgggatgggcaccaacatgtacccgtcggcgtcgctgttcggccgccacggcgacggcggcggcgcggctgttccggtggaggagctcgtggagaaggcggacgggttcgccggcgtgttcccggagcacaagtacgagatcgtgaggatgattcaaggggggggcggccacgtgtgcgggatgaccggcgacggcgtgaacgacgcgccggcgctgaagaaggccgacatcggcatcgccgtctccgacgcgacgaacgccgcgaggggcgccccggacatcgtgctcaccgagcccggcctcagcgtcatcgtcagcgccgtcctcaccagccgcgccatcttccagcggatgaagaactacacggtgagctagttcttggacactctcacctcatcacctgtaaaaattcacctctcttttgcttgattcacattctcacagagttcttcttcgctgcagatttatgcagtgtccatcactataaggatagtggtaagcgaaactggaattcatcatcacaaaattctcccaaaaatctcgtcattgatcgtcttgtttggatgcagattggatttgttcttctggcatcaatttgggagtacgacttccctccgtttatggttctgatcatagccatactaaatgacggtgatgatcatttttctctgaattttactgcatcaaaagcaggaatagacactcgatttattcagtacttgatggttgggcatctactttgatcaggaactatcatgacaatatcaaaggatcgcgtgaagccatcaccaagcccagatagctggaaactgaatgagatattcgcagctggagttgtcataggaacctaccttgcattggtaaccgtgctgttctactggacagtcacaagaacaaccttctttgaggtaaaatcttgcaacctctgaagaatctgaacctgaacatgagaacatcttgttggtaaatcaacagccgaagcttttgtgtgtatgaattgcagtctcacttcaaggtgagatctctgaagcaaaattccgacgagatctcgtcagcgatgtacctgcaagtcagcatcatcagccaggccctgatattcgtcacacgcagtcagggcttgtccttcctcgagagacctggagccctgctgatttgtgctttcatcctagcacaattggtaaatctgcagaagattttctgaactctgaaacaatcaaaaaaaaacttctgctgctagtagaaggtttctgaatttttctcagtaacggatgatgagtttcttgatctgcaggtggctacactgatcgccgtgtacgcaacgatcagcttcgcgtcgatcagcgcgatcgggtggggatgggcgggcgtgatatggctgtacagcctggtgttctacgcccccctcgatctgatcaagatcgccgtccgctacacgctcagcggcgaagcctggaacctgctgttcgacaggaaggtgggtacagtagcagcatgatctgttcttgggtagttggattccttcctcattcagagctcgcccatggcttcagttcagatctgtgccggccatggatgaataatgaatctgttcgttcttcaggccgcatttgcgagtaggagagactacggcggcaacgagcggcggccggagaccaggtggccgcgctcccatcatcatcatcatcaacaacggagggcgctttccgatcatctcctcagcagcggatggcggcctacgcggatcgcggagcgagccaagcgacgggcagaaatcgccaggtacaagaactgtttgaaaaactggaggattccccggtctttccttattaagattcagattttacctcggttttcggtagtaaatttttcaaactactaaacggtgtgtttgtgcgaaaactttctatatagaagttactttaaaatatgaaatatatccatttgtcaagtttataaaaattaaaacttaattaattatgtgctaatgttttttttcgtctttcctttttttttggttggcttgcagattgggagatgcacatatgctgagagcgcatgtgcaatctgtgatgagactgaagcgtgtggattctgacgtaattcgatcggctcagacagtttgatttgcttgggttttagcatcatgacgttgtatcttcagatttcagagtaaaattaccatagctttttgcatgcaaaatgtcagaaacttgtacggaacaggtcgaatttttgttaaatgacaagtgatgatatatgagcttgtacctgatgattgagtctcttgtaacctccattgaagcatttgctttgtagttgtactactggtcttgttaacaaccagtgaacctgatgctatacttagcagcactatgcttctttggatctttcagatgatataaccaaataatctactaccatgatggcattaatgaacaatcaggaattcagaatactgttctgtagacaggatacaatggcacacctggtcctacaatatatcaagcaacacctgtgattatgtactgatgaaactgactttcttttctatttctccttccattcttctctccaataggcgataggcgaacaaaataaatacaatttgagatgtaacaggaaaagctaggggtgtagtttttgtcatatgaaatcttgttcttggtcgtctgttcggcgcgacgaagtatctccgtcgagcattctcttcgtcatgttggccctctggacaagacgaaccaatgcttgcaccacctctgacattggtggcctgaattctggttcaggctgtaacatgaatttgtttcataagattcagacattctgttccatgtattaggtaattagtattgcatagctcatctgcataggatggtgaaatcctacctggacacacaaagcgagcacgtcggcaaaccgggagagagacttggcagggtacagacccttcagcgcaggatcgaccattctgtccaatgcatcgatgtcatggagctgtggagtcgcccaccgcacaagtgactgctctgacctcggtctagtgctgtaatgcaaagtcacacgattataccgaggttcatcagttagcactaaatttatagttatgcgcaagctggaaactggttacgactgatgagaagatcaagttacctatcgaaaggtctgcgtcccgtcaaaagctctagcatgactactccaaagctgtagacatcgctcttcagtgtgtactgaccagtcatgtccacctctggggcagtgcacccagcactctgttgcgctgcctgcatagttttttttttccgtgacgaacattaatacaatcactagtgaatcaagatgtataaaaggtgtgacatcattgccataaacttctcttttcaattaagaaaattaatacagcctctacatgactacatcaattcgccaacaatttctgtaagtccagtagtcagttttcttggtagtttagcaagcgaaggttcatctcagtgctatttttttttaattaacacacaactgtccaaacaattgtcctcttaaaatgggtgcttggatatatcagcaagagccatacctggaattctgcatcagaaataaagcttgcaagtccagcatctgaaaggtgtggattgaattctgaatccagtagaaggttggatgacttgaaattcttatggatgatggatggagaacaaatttcatgaagatatctacagattatattttcagagaaaatgataagatgtcacatatcatatttcaaaatgagcatagaattctatataaaaggactattattccataatgtataactgtcatccacattcaaccaaagcatgaaactagcaactgtcattctacacataaacacaacatgcaaaggatatttccaagtttagcgagattctgatggtacgatatggttgacagcagtattcttacttcaattgccatgaacaaaaggattgctaattaaatttgtgaaactagtaataaatcagttggtttgtaacttttatggataatgaatgaaaagaaacaaggcccttgtttagttcaatctggacacacatgatggctaaaatcgtacaaaattaataacatgtagtataatgccaaaacagcagatcaacataatatggagagatttttcacttactccagtgcacgggcagagcctagtgcgatcttgacacgagagttccagctaagtggcttgctgtattcgtctgaaagatggagtagatcatggagtgacccattcctgtggaaatcgtaaacaagcaagtgttgcccatgttccatgcaatagcccacaagctcattgagattcggatgatgcagttttgaaatgtctgagaccagttcagcaaaatcatcagatgaatggaatggcatcacggtactatcaagtttcttcacggccagaacctgaatagtgtaaacaagaaaagtaagctctcagaattttgcctatatctaaatgtccaacctgtatcaccctcgaaataacttcaaaagcaaaaaggggaaatacggtaacataaaaactgaaactaacattaagaactatacggcctccaatttatgaggaatacttctatgctcaattgtttctgttcatgaggtcatgacagattttaaggcttttttttcttagctttgcatttccaccttttgactaatgtgataatgaatacacatgctacctttcatttactttgagaaatatacaggaatagcaatagaaaaaattgtagcatacctttccaccagtaaactgtgccctgtatacacgtccaaaagtaccttccccaacaaggttgtccatgctaaagctttctgttgccatctgtagatctgcaactgaataaacagttgcctttataggtgccacattggttttcttcaagacaggcttgtttgataaatcatcatcatcgaaagacttgtggcgttcaatcttggggggtggcttcagactaaatgaagcaggggatggcaaagactctacatctattgtagtagactcttcaataggcttcatgtctgcacattttcagaagcaaattttcagataattgtacaaaatatataacaaaactaaagtatgatgatcagcaaggcatcaggcaaacagacctttaacttcgtttgaagggaacgaagtgaatggctggtgctgttcaaaatgttcttccaatgccgctctgcgttttcttcttcttatcacaaagaatgcaacgactgctccaactaccagcaatgatatgataatgcctgctacacctccaccacctatcccagagcttccaccagaacttgaaccaccattgttttgacctgggctgtttggacggtttggtggaggtggagctgaatacggtggaggtggtggtgctggtccattactccaagaatttccgtcagttctgtacacagggatcttattagttcagggtacatctctcatacatttttacatgtttataagcaaagagaactcactgtagattgtttatcttcttaagttgactaggaatccagccagtgaaatgattgtttgcaacattcctataggaaagcaaagatatgagatgtggtactgcacgtgcaaataaaatattaattacttataggttgatttcttacagatcatcaagggggagattagcaaggacattgatataaccagtaaattgattgttctgcagatatctgagaagaacgagtatgggattacaggcatgtcactccaaaaagacatatctatgagagaaaaacaatcattttcttacaatttcttcaggcttgacaatgatgtgaacccttgtggtaggtcaccagcaagagaattaaaggaaagatccctgcatcacatcacatagggaaatggaaagtgaatatagacattaggaatatgaacaacaaagaaggattttacaatacacaagttaagacccgtctacaatccacgcacacaaaagtactcacagtgttgtcaagctatagaggctggaaaatacatcagttatatttccttgcaattggttatgatttagatttctgcacatacaaagagaaaacatttagctctaccaaattatacaaatttaaaagcaaaatcaacttgatgtttgcaaagatactcacaaatacttaagattagacatcgagaaaatcgagtagggtaaatttccagtgaactggtttcctgcgagattgctgcaaacaataaccacttagcacacagacaccagaaaagctgatgtactttctaaaccacaacttcatttgaggaacttacagcctctcaagcttattagtgggaagattgtactgtatctgttggccaccaccaaggttgttttggctcatatcgctgcattaaaaaatcaattaagactgttatcaactgaattgtcacttgacaggatcagatatgaataatctcagatactcacatctcaatcaatgaacccatggtattcatattgtacgccaaattaccggagagccccaagcttggtaatttgctacaacatcaaacacaaagaaaatattgtaagaagtaagaaagaaggtggtcgagtaagtagtaaactactttgcttcatgatgaggctcacattgcagtaactgatgatcctgagcacgtgataccctgccatgattggccacaagggtctccaccacttgcctgccaacctttgagctgccccggagaattcaggctagtgaagagcgtattgaggacagtaactgcatgaaaaagagcaaataattactacacgtttttcgccgggcctaattgcaacactgtataatgcatgtcagtatgtcaccaaacaaacacattagcaaacttgaaatttgaagtgcccatagacaccaatgcatggattcagatttacaagagtaaatagcatgacatcttaagaggaaaatcgcaaaaaagaaaagaaagaaaaaaaaaagaaagctgaaatgctcatagcaatttttgaccaattcttgccatgctccaacgaacaataaggcaaaaaagaagagaaaaggagggtcaaatctagaggtaggtgtaaggaaaacgactgcattttcttcttggaactgctaaactaaaatttgttctcaaaaattgcccctcgcaatccagacaatgttttgcacgaaattcctcctcaattgagattcagcaagcaaaagtgcaaccataactgagatagctaggtacatagcataggccaaatttggttagtagaaacagcagaaaaagaatggacatgcaagatttccaaccgaatccagtgtatttccttactcggattagcacaacttaactaccccaggggcagaaagaccccatttttatcaacccaaaaatgagaattataagctgccgaaattcacacaccatcttgttcactatgtcgaacagacgtaaatcaagagcattcttgcgcaaagaccagatttcgcaagtaaaaaatgaagaaagattcggttaatcggaagctttcacatccatttccccgttccaaaaccgaatctacagaaaactccgtacaaacagcgccagaatcagcaaaccagccggacgaaccgcaacagaaaacacaaacacagacatcgagcgaagaactccaccgattaatccagcagctctgaaacaaaaacagaaaagaaaaaaagaaagaacaatcgcgcaaaaaggggagaagattccagattctagcttaccatcattagggtcggtgtctgcagcgaccaagatttgcttctggggccaaatgcagaagcagcaggaggagcacaggagcagaagcggcagccatggcgcatccgctcttcccatcttcttcttctccccccacaccaatgctcacacgctctccccactaaaaacgcaaagaaaggcgctttcctcgcatgaaagatcccttctatagcctcctccccactgatttctttcttccaattaatttacttatcttatctcctcctgtatctgctgctgctttcagagtttcaaccttcctccgtgttcttgaatcgcgcagtgggaagtagcggagcagcagctggcaccaggacggggacaagaacgatgaggtcaaatcaattgcaaggttgtcgctttcatcgaggggctttcttgtgaattcagcagccgcgaagggctcacattcaataggagaacatcagattcggagacgaattctttttcttcaaagagaaaaggtaaaaggaaagagctgattttttaaggaaaagctgacacattcgacgtttttattaggatgcatctacaacattttcacgaacaagaaaacaaatccgttgctctacttagctgtactcctatcattcttgggaggttggaataaaaaaaaattgcagcaaaaccgcgcacagattctgctgtcagcgccgggccgatgggcggtgggttggccttggcctgaactcagaaccgcagaatttgggttggaatgcgtgacacatcttttgcatctggtactcgtactataaacctccaccatcagctgatgcaaaagaaattcttgcgtcagggttactgctgctgtacaattttggactccattaatcatctcagagtactactagtacttacggtacgtcgcatgcatgcagagctgtactagcagtctacagtagcacttgattgtcaaattcactaattgtacttagtgctaatgggcaatgctacttagggggtgtttggatcaggggctaaactttagtatctgtcatatcggatgtttgaacattaatttggagtgttaagcataacaaaactaattatataaatgagagctaattcgcgtgataaaaattttaagcctaattgatccataattagcactaatcatgaattaattatgctcaaagttttgttaatagtctatatttaatacttctaattagtatcaaacatccgatgtgatataaacataaattagtccgtgatctgaacaaggccttgtattattttctaagtagaaaatgaagaagaaaggcatcaattatgcagggtggagtcgccgtcgtggcaaacatgggttcggagtaatctgcatgtctgcataattgcatttttctggcaccgcgtgtcatggcgacaagctggatggatcctactcccaataatggagttctttttaaaaaagacaaaaacaaaagggaagacaaaaataatcttggaggtcaaacattgtacactactcaagggcggatccagcccctacacccacaagacccatagatacccccgaaacaccttttttgatttttttatcatgaatggtaaactaaaaagtccctaaatggctgaagattaaagaaagttacatgtaactgagtctcctcaaattttttgttacttggatctgcccctgttcactgctgtatatttatatgtatgtatgacatgattgtatttcaacagcgaaattcacaaaaatgtgatcagctggtagtggatcgggactccttacgcgcatcgtgagtggcatgatcttcatgtcatggcaatttaattactagcattttgatatttgcttggtgggaatttgtgacctgatggcccatcgaaaatctctcagaattttatgccttttatcagaagcaaaatctccaccagccgattaaccctgctgaacaaagtttcccttttatccaaaaaaacaaacttaggggctgcttagttcctccaaaaacttttcccaaaaacatcacattgtatctttggacacatgtacgtagcattaaatataagtaaaaagaaaaactaatcttttaagcctaattagtccataattagccataaagtgctacagtaacccccgatgtgctaatgatggattaattagggtcaaaagattcatctcgcggtttccagtcaagttatgaaattagttttttcatt

SEQ ID NO: 7522 - DNA, 8510 bp, Oryza sativa
ttcaatcaaacttcaattttggtgtaaactaaacacaccctccatgttcgtttttttttaaacaagggagtacttaccaaaaaaaaacattgtagaatctatgaatatgatctaagggaaaggggatgggcaaaacagatattacccttcagtgttgctaatgatgataaagaccatgttaacctaaccagtcaaataaaaaattctgtgttccaaagtacccaaaataaaaactgggagctagtactagctggcttgaatggcgaatggcatggacagcaacatgtgaccgaacagcacagcgagacatgctaatctgatcctgcttcaccaacagcttcgctccacgctcgcacgcatcaaccgaaaaacgttagcatctcctaatcagatttacgagtaccatttttcttctgaaaggtcctaatcagatttgtgcacaagtgtcatggaatactacttggcgagcactcgaggcattctgattggcatcctttgcattctgttcgaggtgatctttcaaagaacgccgtgcaagtgcaagcaatcccgtgatagcgagaaatctgtcaaaaaaaagtgctgtcaaaagcaagcaagcggcgagctgtgtgttaggattttgctgcaaagtcaatggtgcagtgaaccttctgaattctgaacatctggctcggttcatacttcataggactttttatgatttaagttcagactttagaaagtaactctgcaaccaccggacataaagattatactactaccgtgtagtgtgtagtaccgctacattgtactcgtcattgtgtagtataatactagtacactatggtgttgtgaatggagaataggaaagtaattaatggtgtcaaatgataaatggtggtgataatagtatgatttctacagatagagtgattctgctgagtccaatatgctgcaagccagaccctgtttagatgggactaaaacttttaagtccctatcacatcggatgtttggatattaattataaatattaaacgtaggctattaataaaacccatacataatcttggactaattcgcgagacgaatctattgagcctaattaatccatgattagcctatgtgatgctacagtaaacattctttaattatggattaattaggcttaacaaatttgtctcgcgaattagctttcatttatataattagttttgtaagtagtctatatttaatactctaaattagtgtctaaatatagggactaaagttaagtccctagatccaaacagtgacttagcctgcaaaatagcagaacatggcttcaaataactatactccttgattgacagatgctgttctggttgtcgttaatgttggatcggtacgaacagattaggtttccatggcacgtacggagcaaggattaggtttggtggaccgtgaggtaggtgacaccgtgtccgtgtagtgctttgttatgctctggatcttatggtttcatcgctttcagtttcgtttgctctctcactcaacaccagttagtggttgctgacgtcttttctgttgctactattattttaggatcattctgaacttctgaattctgatccttcgtttgtgtcttttccctttagtggtgatcggttgctgtttaatggagacatggcaactaacttcattcgagcaatgtgatgtcatgcatacattaaggttcactaattcataaaagaggatggaaaaaaatagagaacttttacggtacaatttactagcattgaaaaacataagcgttgagctgttcacagcattacaggcattacagttagatgttcagtaggttactgcaagtgcagcatgatgtcgatgttcttgcgacgagtcagtctgacagatgatgcaatggcttaaacataacttaacatgagattaggagttcatgctccatgcatcatctggatcaggaaactggaatggatcatgtgaccaagtaaagagggccaaatgcctctctgcttattgcatgggtcaccttgtcaagctgcatgtgaggcagatagtcatagtcctcatcagcatctgacgatggcgagaagcaggctgcagctgttcgtctgataatccgagccaatttgaagtattctctgactactatctccctagagaggagcggtctgcggaatgcatttctgcatggggaggattcagatgccaaggaggcaattattctgttctgaaactttgtcaagaacgtcgagttcttcttcttcgattctcgatttgcagcttggaggcctgaattgcagaggtattgatcctttgttgcttcatccgtgaactaagatgcagtattgacaatgaagttaaagagggttgcttgcttcctaaatgatacaaattccagaaagaagttcagaacttacattgtcaggcagaccttgagaagacagtaacatattctcaggactacttgaagttgtcttatttgaaacttgagtgcattcttcttcctgtgttatcgttgcttctatgaactgaaacgacgagagattaaaagcttcatcactacagtttcctactttattgcatgaacagtactaaacagtactgtgcgtgctccagctactcccattgtctcagcgaagaagaacgcaatgcaaaaagagagagattcttgcaatatgatccaaccgaatgaaccgagatcaccttgcaatgttcgggatgatgatcgcaactagctctacgacatccagagctcttgctcatcctcatgaccagcttatataacgtgcagctctacaaatccagcttcatgcagaaatgagcaagataaaaccaagacactttctcatgatccatgcaagaaatccaaagtataacgccacttaattaaagaacaaagagagagacagacagccatgaatgaatgaagcaacacaaggtatttggctgcattaccctcgaagtaatggcaggcgagacgctgcaagaagagaggatgagaaatggatcaactcatcaaggccattccggagcaaataggagacgaagcattcaatggggttgattacgatggtatctgctgatgagaagagatccttctcgcatttaaggttggcaatggcagtagctggtatgaacagatcaacaagagacagtgtgtgtacgagagtgtcagcagcatatggtccatgattttgccttgcttctgaagcttttgctactcatcatccgtggcgtgtaacaacgcctgtgtgtatgattatgtcagcgcacgagtgttcagaaaaaaaaaagataactacttcttgtgtgcttgctggtttaattaggtgatctgatcgattgtaaaattctcattccaaagcttcttggctccaagctcctccagtactctgaactttgaagcttcttattcctgtgatttgcagtggctttgtgaatcatgaatgcaaaccaatcatgtggctgctcctcctgcctgcatgcgtactgtctgtaattaagtaagaaagaagcagcatcgatcgatctcagtatctcactgtctgtaatttatcaccctactagcatttataattggtgagaagaactagtaaagaattggagaggaatgtattcatgtgttggaatccagagttttacatgattaattcaactggggagggagggagggagggacagacaatacaagcacatgtgtgggagtcagcagttttcacggtttcagtggtccttgtgatggatgatgaatctgcagccaggcacgcgctgctgtaccgggagggaggagcatggcttcccatgacgagaccttgggaccatgccaagccctagctatcttgcaacattattagtatattatacttcatgggatcaaaaaaataaaatgctagtggtaactactacctaatgtttcatactttcagtttcatagggttcagtatttcaacctttttttcaagacttcagtcttcagcttatgctagcaatgaactactactattataagtgttttttttagaagctattataagtgttttgagaggatgggaaaggagagaaatacgtaaaacaagaggcttgttcactttgctataattttcaaccttaccaagttttggaaaagttaccaaaaaagtggctacatttagttgttgccaaattttagtaactacatatgaaatcttgtcaaaatttagtaaccttgccaaaattttgacaaccttaccaaaaatttgacaatgccaaaaattgataaggttaaaaattgtagcaaagtgaacaggctcgagataaaccattagcacataattaattaagtaataattattttaaactttttaaaaataaattaaaaataaatattaaaaaacacatcattttagcagttgaacgtaagcgcagaaaacgactaatcgagggacttttcctctttatcctctcctaccgaacgggcctatttcaactagatccggcctggtccaggaggcgatgtcgcactcgcaggtgtgcagctctctagtgggcttgcagattaggcccattagtgttgattgggcctcgaagtgctttgtcgtggacatcatccgccgccgtcttcttcctcgaccatgccgttgccggaaccggctagcgcggccggccggcggcggcggggaggccgcagtgggacgacgggtgaaggatcctccagctgcggaaggaggtggtcctcgaggccgaaggggagaggctacggagatggagggaagccgaagagaagggaggctgctgctgctgctgcatttgggagacgagaactcgactcgagccatggcggcagattggtgtttcacggcggaatgctaactagatccagcatctccatagcaaaggtagaatggtagattgaggtgagttttttttcccctcttctgcagttttgatgtattattactgccctcatctgatctgggtaacatatttctgagctcagtagaactgttaaaaaaaggcagaaatgcacaaactcttctcacaaaacaacatacaaatgcttatattttggagcggaggcaatacatggtatattttttaaagtgaaaaaaacaatcagacacatggtattgagtgatagcaaagctgggtgaccacagaaaatacctcctgctttaaatactttatacctgggctgtcaatcctcggagttcctcccaatgtaatgtctgaggaagaagtattgcagctaaattttaagggtttcttgtacgaaacagggacaatcagagattaagaaactctatgtggaaaaggccatgcgcattttgttatgtgattcaacaaataagatgaggaggcaaagtcatggttctgttctaattaacaaatctactatgggggccgttgctccctattgtccacgctccttttcttcatttctctcctgcaggatatcttgtcttttgattcttcattttaggtcttataaatatcacgtggttcaggcctccaatgtcaaattatcattacgtggaactctcttagatgcttgagaaaagttagctcttacctgtccatagaagctccaaggaagcgagaatagtagatactttggttggccatggccactggtgtttctgttgagaacataaaccccaaggttatactagggccatcatcgatcgctgagtgcatagtcagtaagttgtgttcttttgtggcttgctgattcatattctttatttcaggttttacgatgtgaatatgcagttcgtggagaggttgccatccatgctcaggtttcgtggtttagtccatccatgttctggaagtcaatttcaatttattctttttcagcaaatgctagaagagaaattaatagatatctcacatttttcttccagcacctacaacagcagctacagacacaacctggttctcttccatttgatgaggtcattgacaactataatttgcagatcacgtgaataatcggtagatgattcataaattttcaactattatatgcagatcgtgtattgcaacatcgggaaccctcagtccttgggtcaaaaaccaatcacattcttcagggaggtctgtaaatattagacacccaaaacttcatctttcctttttatgctctttcagtatttacgagttatgttacaggttcttgcactttgcaatcatccaaatctgctggagagagaggaaattaaatcattgttcaggtaaacatcaactgcatgccatgattcattaccaagctatgactatacatatatatttatgttctacactttctacatttctaataaaaaggtatgtaagcacattagggtatttcatttatgtatgatataaatgtttcttcatctctttgcagcactgatgctattgctcgggcaaagaaaattctttccatgattcctggaagagccaccggggcatatagtcatagccaggtaaccatctgccaattcactcaactaggagcatcttgagttcataattttccttatagtaagtttcactataactatgttgtcaaaactatcgatttctgcaaatttaactacgcaataagaatgcaagaatagctgatgatcttatcagaaaattgcaaccttatttgattggtctggatccatctgtcacacacacatgcaatactcatgtcgttgcaagtttgggcctacacatcagaaaccaataggagataaggctgcaggtttctgataaaatcctctgctattgttgcagttgtgtgaaatattcaacaaaagatgcagatttaaatcaaacactgcagtttttgtggaatttactcttctttatcctagggtatcaagggactgcgtgatgagattgctgctgggattgcctcccgtgatggtttccctgcaaatgcagatgatatattcctaactaatggagcaagtcctggtgtatgtcctaccttggttatttctgaagaaacaggaatgtaagatattccagtctgacttatgctttccctcttctaggtacacatgatgatgcagttgctgataaggaacaacagagatggcattatgtgtccaattcctcaatactcattgtactcagcatccctagcacttcatggcggagctcttgtatgtagtttatttgtctgacgttataacttcaagctagctactcgatgcagcgcaatagcctgaagacatttcatttcaggtgccatattatcttgatgaatcctcaggatggggtttggaggtttctaagcttaagaatcaacttgaagatgccaggtcaaaaggcataactgttagggcgttggtggtgatcaatcctggaaatcctactggacaggtttgctctcaccgcttctcctatcgtgtgcgatttaaaacatcttatatacaattatacaagtatctattatataattaaaggaatagaaaaaggagcctccacgttcgctctcatggcctagaaattctcacattaaacggagaaaaagaaaaaacaaagtccatatagaaatacaatttagaaatagctgaaattcggaattaaaaaataaggaatattaaaagaggagactagagtccatatagaaatacactttagaaatagttgaaattcggaattaaaaaataaggaatattagaagaggagtatagagcccatataaaaatacaattaggaaataatagaaattcagaattaaaaataaggaatattagaagtagagtatagagtccatatagaaatacaattaggaaataatagaaattctgaattaaaaataaggaatattagaagtagagtatagagtccatatagaaatacaattaagaaaaaaatagaaattcagaattaaaaaataagaaatattagaagtagagtatagagtccatataggaatttaaaactaactaaaattcggaaaaaaaaaggagcctccacgttcgctctaatgacctagaaattctcacattaatcggagaaaaagaaaaagcagagtccgtatagaaatacaatttagaaatagctgaaattcggaattaaaaaataaggatattaaaagaggagactagagtccatatagaaatacaatttagaaatagctgaaattcgaaattaagaaataaggaatattagaagaggagactagagtccatatagaaatacaatttagaaatagttgaaattcggaattaaaaaataaggaatattagaagagaagactagagtccatatagaaataaaattaggaaataactgaaattcggaattaaaaataaggaatattaaaagtagagtatagagtccatatagaaatacaattaggaaataaccgaaattcggaattaaaaataagaaatattagaagtagagtatagagtccatatagaaatacaattaagaaaaaaaatagcaatatggaattaaaaaataaggaatattagaagtagagtatagagttcatattggaatttaaaaccaagtaaaattcggaataaaaaggagccttcatgttcgctctcatg

SEQ ID NO: 7523 - DNA, 12985 bp, Oryza sativa
taataatataatgagaaaacatatatgtttttatatgagagaaaatataatgatgctagccgcgcaatctacgcgggccaccatgctagttcatgattaagacaaagtggcactgttattttgtgatgtttttcatgtcagtaagcatatgttccttgatccgaagaagtatttaggttcaactgatataaatattccaaaaatcataattgaaatgtttttacattgttgttaagattcttgatgagcaacagcaatatgagctagtaaagttctgcaaggacgaggaacttgttcttctggcggatgaggtaaggctagtcatgttcaaaggtgtcagtgtgttgagtgatataataatgttaacaaagtatgatgttaacaaacacaagagaaaactgtccagataatcgttttttggggggtgttgataggtataccaagagaacatttatgttaccaacaagaagatcaactctttcaagaagatagcaagatccatgggatacaatggagacgatttacaattagtatcattgcattctgtttctaaaggtgaaatcccatcatccgcctttctttctccaagtacattgtaactccttaccacatagatatttttttgcctgccatcaggatattacggagagtgtggcaagagaggcggttacatggaggtcactggcttcagcactccagttagagaacaactctacaaaattgcatctgttaacttgtgttcaaatatcaccggccagatccttgcgagcctcataatggatccaccaaaggtgcaataacatatctgtccttacacgaaatgtaattgccaatatacactagattcataacacagagagaccatgcatattgtgcaggctggggacgcatcttatgacctctacgaggaagagaaagacaacatcctaaaatctttatctcgtcgtgcaaaggtgtgtggagtttacttttaacagattcacttcttgctatctatgcagacacttgagctaagacatcattttgtctggaatctggatcacaggcaatggagtctgcatttaacagtattgatggaattacatgcaacaagacggaaggggcgatgtatctgttcccacggatttatctaccacagaaggcaattgaggctgccagggctgtcaacaaagcacctgatgtattctacgctctacgtcttcttgataccaccggcatcgttgtgactcctggatctggttttggacaagtgagctactttctactcttgatctttgaaccatagtgatatgtgctgtctgaatcccacagaatgataagtgaactgttttggggaacggctgaagctcacgcagcacaatctatattcctgaagagtctggtagtagtagtagtctcgttctacaagaacagatagcaccaattaaaaaaaaaacaataacagatagcaaccgttttttctaccatttcagatcatcagatgttatctgttcacctgcaattctgaattcctgaccactcaagtttggtcctttgtgaaaggttgcagggacatggcacgtgagatgcacgatcctgccgcaggaggagaagataccttcgatgatctcccgcttcagggaattccatgaggagttcatgtcacagtatcgcgactgatggactgaactcataaggcttcgccatccagaagacgagaaataaagcaaaacgccgttaatctgcgatgtgttaacggaagatgtgcagcaaccttaatctggaaaacttgagcatactcagtttgggtcgtaaagaattcacgggctgttgcatcagtgtttgcccggtacaaggtttgattggattagcacgatgaatgagtgcagggagacctgcagctaaataaatactccctccgtcctataatataaagtattttgaatttttgattgcaacgtttgaccgctcgtcttattaaaaaaatttaaaattattatttattttattagtgacttactttattatctacattacttcaagcataacttttcgttttttatatttacaaaaaaaaaattgaataagacgagtgatcaaacgttgcaagcaaaaactcaaaatcccttatattgtgggacggagtgtgggacggagtgagtgttaatgttagtagttgtgagttagtgactcgtacctaaaagtaatgctacgaaataaaaatgtgttgagagagtatcttacattcagtaaaggttttccaatcgagttggctatcttgaaacggaacgagaacagcagctattgttttgagctctgaaatctgaagcaggcgacacggagcagcagtctatagcgaatctcttcttgaagcgaaactcaaactcctcgcgatcccgttcattggggcgtggtcgcgtagattcatcattcatgggcctcgcactcccgcggctaagagcaagaacaatagtaggctttatgccagctataacaagaagaaaagagaagagagaaaaaagcgggctataaatttgtatccagctgaaacatggacttcaagacactttgtgtgtttgagaggtgagaccgagtattaattgtgtagtatatttttatagataactatttaatgaatgagctattagattagttatagataatttgaagctaacatttggctatactattaaacttgctctaatcgggccatgtgggctgcaccccaaccatccgggctctcggctctccagcagcatacgacctctcgggactcgggagccctacggatttttcttaattttaatttttatctattaaaacattttctaaaacattcttaaagtataacagatctacacctttaacgtcctctatttttacgacgtggtatatgttctaaaaaaaattaaatcctagctactaacctaaacatatatgtgtctaaattctcatattaggattggattgagttttttatgaaacagaggtgtagctgttaatgcatgttaactgttgttgagaggggagggttgcaccgtagtgcttgtaaaatagccagccttactttacgtagtcgttagcattaaccaatgactatatgtatgtcacgttatataaagaaaaaacgctaacacttttccacgaggccacgttgttgccgccttgtctgctactacctcgacattttggtaccgagaaagtaccaataccgcacttccaccacctgtagccatatggacacgatgcagtggctggcatgttggtagtggcaacgcagggatatgtgggtattggttggcacatgacaaacggcgtcgcccaaacacgtgctgcacgcacgggtacgtcgtaaacgtatgtgcggccacacaccagccgtcgtgctcacgcgtcccagttttaatttgtactttttcctccgtctctttttaggtggagtcataattttcgtgtttaactttaatcatctatcttattaaaaaaatttaatcaatatttttattgttattatatgataaagtatgaatattattttatacgtaacttatttttttattttttaaataaaatatcaaataagagagacgattatggttgcgtttaaaatagaatgcatggagtactagtgtactacatcgagcaggagcgccatagctttgcggcgtccacacaacacacgccgtgccttttcccggagtggcaattggcaaaggcaataacatgcccagaattaagtatgcaaagcggttgctgccaacgccccgggttgtgcacatgggctatttggagaattggattcgcccctacgagtagtagttgctcagctagggttgctgtttgtttgccaaagatattctctgccactccctcctgaatgtttaacgcagttgatttttttaaatatatttgaccgttcgtcttatttaaaaacttttgtgaaatatataaaactatatgtgtacataaaagtatatttaaaaattaatcaaatggtatgaaaagaattaataattgcttatattttttgaataagacgaacggtcatatatatttaaaaaagtcaacggcataaaacatgtaggatggagggagtatatacgaatggtttatgtgaaatgagggggggtgggggggggggtcttttccctgctatgttggaggaaatattctgccgcggttaggtcagtttccaccacggaatgagtggtttataccagagaattggatactgattgctgagtacattccttccttcagaataagagatggaatactcccatattgtcccatatgcgcaaggtagaggctgtttgcttggtggctagagtttgccatgccaaatcttacccacaccacactttgacagcttaggctgagttcgtcagcttgagttcccaactacacatccttcgtttttcatgcgcacgcttcccaaactgctaaacggtgtgttttatgaaaaaaaaactatatacgaaaattgcttttaaaaaatcatattaatccatttttagaaaaaaaactaatactaaattaatcacgtgctaatgaaccacatcgttttacgtgtttggagggagagtttccaactctctctgccaaacacaaccttttgctaagttctttcctcaactttgccaacatacctccctcgttttccgcgtgcatgctttttaaactgctaaacgatgtgttttttaaaaaaaaattatacaaagtcgtttaaaaaaatcatattgatctatttttaaaaaaagtaaatatttaattaatcataagaaaatgagtcgctccgttttacgtgcgcacagtctaaggaccccctccttgtcctatacatgctcttagctatcaacaaaatatgcccgtaatatgcccaacgagttacgataggaattggatgtaagaatattcggattttatttcttctgccaccctctagtggtgcaattcttttattttagttagaagaaattttactacttaaatttatatagaacaaagtcaacagagcgttaaaagtttactgcaactatgcattttaacattacgaaatcaaaagctgatgttttgccacggcgaagtcttaactctaaccgttaaatctcttatcttcacagtgaccgtagcagagatcacacattcacatgcaaaaacacgtctctttctctatacttcactttcacctcgataaaaaagataaataatccacatggcaggtgagaaattaaactattatcccgattatgtggcgcccataaagccagcagcgcaagcccatgtcatgccaacacagtagagcattgcacgcgctgtattcaattcgatcgccatgtgtagcatgtgcgaatattttttatcattagaaaaatatataatcttttcgaggttttgacaaggagagctatagctttcagctggcccaataataataataatcaaataaacaaggaaaacaccacatgtttcactgtactagttgagctctgaccactatatataatcacactgccacacaatctgctagcaattctcctccccctcttgcaatccattctgaattctctgatcttgaattcttcatcttctctctctgcaagaatctcgagatttcaagatcgaggagaacttaaaagtttttacgccatgattccgagagctccgagcctcttccatatcgaggatggagctgtgggtgtcgcggcgtcgacgaagaagccaatgccggctgactccggcgagctcgtcgggctccggctgatcatacagcagtcgccgaggcaacggccgccgctgtccgtgctcaggcggtcggcggtgaggccgtcgccggcggcgacggcggcggcgagtcaggatgaggctggtgctcctgcaggccgggggttcatggggttggggttcttgaactgctgctactgctgccacaagaagctctacgccgacatggatgtgttcgtctacaagtaagacattttacacaacaaatcaagaactccgccttaatccacacttcaaatagaaactttatttggtgattagtgatcatgatcgagctgaggaacttgtggttaattaattcttggatactgactgactgatttatctgtggttttttttgttttgggcagaggggagcacgcgttctgcagcgcggaatgccggagccagcagatggcgagggaggagaggcgagagatcgagatgctggtgaggcggcgccgcgacgcgttccaccgccggcgagcttcgccgccggccaagatcggtggacacgcgaggctgcagatcgctgcttcatgatttatatatacatatgacagacttatcgagatcgaggttcatctccgctagtttctgaacaatttttcaggagaaattagggaggacaatacaacggagacgtacggctactcattctgtcacagattttgttgtcctcgtctacttcacatgtataaattgtaattgtatttttcgatctcttcttttcgtctataaccagcggtagtagtgtagttgctgcagggtgtagatgctgcaaattaagttaagagtgtacaagaaagtagatgaaactgatggacatttgacaacgtgtttacggagtgtttgagatagattaagatgaaaataaagttagcatacgtaaaacaagaaaaccattaatatattattaattgagttaattgttataaactttaaaaatagatttatttgatcttttaaaacaacttacatacatcaagtttttcagacgtaccatttagcagtttgaaaaatatgtttacgaaaatcgagttaagataagtatcctaatcgaaaagaacgtgataactctgaagacatattcacttgcgtggacttaactgatggaatgatcgagctgagacccggaaaacattgtccagatcgaaaataaccatgaaaggttccttaatgcttttcccgaatttcaatcataaaatggcgtggacgttcagtatccgcatagtgcaaatgatctctcaccatggaagcatgagatctgggtgctcatccaacaaaggcctgtcgctttgatcaggcagcgactagctactccctctgtttcagattataatatgttttgactttgatcaaaatcaaattggttcaaatttgaccaagtttatagaaaaaatagtaatattttcaacccaagataaatttattataaagatatatttaattattaatttaataaaactaatttggtaatgtaaatattactatatttgtctataagcttagtcaaacttaaagaagtttgattttgatcaaagttaaaatatcttataacgtgaaacggagggagtacataacaatagatttgcactgtgacaaactatgaacagctagctgcagactgtcatctaaaaaacactgaaaaagttccaacaggatgtttatattagtgtatttgaggaagcttccgattcaaatgtgtactctcttgtgatagaaatcaactatcagggaatctgttagtagtaaatcaaccatctgaactagtatttatctgaaaaccatctgaactatccacggtcctgaactttgcataatgcccccgtttctgtcgctaccaatgatagcgaaaatttttgcataacacggacaactccaaaacacgcgagtacaaaatgggcctttagcccactcgcataaatgggcccccaagtcctcaacgatccttccgctgttactttgccgatgggcctcgtaggccagccatgttagggttcagtagatgggctttgacgatccaatagttagttggtcctttgcttcggcgggcaagaattaagaggcccaactctgaagatgtactggcagacctgaacttactacttcgagcatgttcagattgataccattttttaaagtaaagttgttaaatatgtgtatccatttagtttcttaccaaactttagtaaataaataagaaatcctgccaaaacttagcaatattactaaattgccaaaatttagtaagatttattttggctacaatctaaataggcccttcaactacgttggagttcactgaacttgttcgtaatagatatctcgaacaagaattaggaagtcctgagcattcagctaagtatttttttagcataataaaaaatgactgccagcctaggagaagcagccgctttggggtgggctggttgcctgcggccatggcaatggatagagatgccaattgtgccgttcaacgcacaactgaactggaactggataggaaggctgccaggctggaagggattcctagggtatgtctgggaagtttctacattgtgcagcttctcatgaaatcaaaatcttctctaaataatttagcttttgatataaattctaagaagctatagtagtaaaatgcagaaaatgaattagaaatcaaaagttgaaaaacctactacctcaaaaaattgcatttctagctctaaagctttgtcccacaaaaattgtatttctagccatgtggggcccagcaaattgattcatctagataagtttccttctctcagcttgtaatttaagtatgctaattatatgggttaattatctcaaacttatttttaatcatttgtatatatggaatgtgtgcatgcaatgggttcattaaataaggtcattgtggtcattttctaatcctactgttttatcctaaattagctagaaatgtaatttttatgagacggagggagtagctttttttataatctcagaaactgaccatctacgagctgtttgttactccaatcttaagcttctcaaatagacccatagttgaagagatgccctgtgttgctgcatggtctctgcaccgcacggcaggggagatgtgccgcttcatcaattggccgctccgcccacatgcaagatgcaacgccaacgcccagaaagtaggcgagagagacacatttcttcatttttcttgactatgaatgcgagacactgaacctgttctgcctctggatgataagaaccccacacgttccaactacgcgctgcttcaatttgtagtactgtagtactgtttagagcaggtacaatagcaggctacaaaccagctgcaaatatattttaagaagataaataaggagagagagaagcagcgggctacagatttatagccacctgtagcacggattttaagacgtattgtgtatataacatgtgggaccatatattaatagtgtagtatgtaactatagtataaataagctattaaattggctatagataaattggagctagtagttggctactattgaacttgctcttataacccgcaagttgccgtcgcctcccgccatctcgcatgattaaaagtttaaaaccgaaccaccaaaagcgcgacggcaaattgcatcgccaagttgccactggaacagggacacgcaattaatgtctctcacccttttcctctatctcaaaaggtacatttcgttttctttacctaatttctccctctcaaaataaatttatctttcattcatctcacacgtatcaatacaaaatcggaaaactaaaatacatctattttatcaaactctatatagtctcttatttatctatttttaatataattattttatgctttcacaaacttcgatgtaacgattactctaaaaataaatttattctaggacaaatgagcgaaaaatgaacatataatgagagagaaagtacctttgctcaagtttcaaatgttctcgtagcaaagagtactactggtaaatactctaccatgataataaacctttgctacaatatgagataaaatcctttgtgttacaaatagataatgaatctggtaaaactgaaaatcacgctgtgcaagcgactctgtgaaaaaactgtttctggtgcttttgctgctgtgcctgggacctcctcagcttgtgcaataccgctttcctgaaacttggcacgccgcagaccgcagccaccttggttttgcacatcaagttgaatgaccgagtgtgacacaagatcctgtataaacagagaacgccattcgttaattcgcttgcaaaaaaactttccccagtgtgacatggacacttacgtcctgtttagttcgaaacgaaaatttctagcgtgtcacgtcaaatatacggacacacatttaaagtattaaatgtagactaataacaaaacaaattacagattctatctagaaactgcgaaataaatttattaagcctaattaatccctcatcagtaaatatttattgtagcaccatattgttaaatcatgacgtaattagacttaaaagattcgtcttgatatttacacgcaatctatacttttttttatatttaatatacatgtgttcaaacattcgatgtgattgggtgaaaaaaatttgcgtgtacactaaatagggcctaattcgcttgcaaaaaaaacctttccccagtgtgacacggacactgaatatatatatatatatatatatatatatatatatatatatatatatatatatatatatatatatatatatatatatatatgtatatatatatatatatatatatatatatatatatatatatatatatttgctactcgtagtactagctttgactgtagctgcatcctgctgcctgcgacccttggttgctaccaacagatgatgctgtattaataaacgagaaagtgagcaggtcaagttggcaacttgacaataccggaattccaagaaactggggttggggagaaagttttggtattcgcaggcgatgcagccccgatctccgtggctcacccgtgtggccgtgatgccgttggtcgcacacgtttgggtgaggggagtccatggtgttgcggaggaaggtttggtaggaaggatcggcgagctcaaaaccggggaaagctcttcttcactgtgttgtttggcttgttgggtttcggattcgtgtgatgatactccagtttgatactacagtaaaatcacatgaacccgtaaaatgtactaatagtacggtcagaattttgaatggattttatagggttgatatccatatagtctaagagcaattttaatagtatagcccactactaagtctaattcatttatagccgatataatagtcaatttatacaatagttgtttactatactattaatatatgatcccacctgtcatacatatattgtgtcttggagtccgtactgcagctgactacatatctgtagcccgctactcttctctctcatcttttatctcattaaaatatgttcatagctagctaatagtctgctattgtacctgctctaagagcatccacaatgtagtccaaaagtgatccataagcaatataatatgtcattcaaccacctagtaacattgtgaaattagtacatagcaaaaaaataacaaaagctacccataaacatatgggctggaggataaaatatattatttgtctctacttcttctctccttctaatactatttgctatctatatacattatgaatgttacaatagttaaaatccatacatgtgggtcccgtctatatggactacttttgctatacattgttgttgggcccctttaaatcgtagaattgataaaacgtaggaatagaaaaaacgtaggattttgatagaaatgtaagtgtaaaacagaggattgaaaaaacgcaggaatgactgtttgattgaatcataagaaaaacgcagaaattggatgagagagatatactcaaaggaaagttaccaagaggttgaagctcttgctaaatttcctccaaaatctatataagattgttcatttcataggaatttcaaaggattggataggatccaatcctttgtttcaaagtgtttcttaggaaatttttctataggattgaaatcctccaaaattccaatgtttttcctctaaatcaaaggggccctaactacatgtagttagtaacacttacttcaatcaaatcaagtttattttaagttttgttagcacctgtaaccacatttcaatattgaaaagacttttgttgcttttaggttttctcatcttagtttattttagagcctttgtttctaaatcactaataatatatatatatatatatatatatatatatatatatatatatatatatgaaagttttattcataaattgtttgtttgcaaatatgtcgtgggtctcgtttaagggcctgtttggttggtgccacattttgccacacttgaggtagatcagtttgaccaaatgtgattagtgtttaatttatttccacaattttgacatgccacattttctactcttttggtcccactagtcatagactcttttcttagccaaagtttaccacaagtgtggccatcaaattttgagacacataatttgcatcttgccacaccttcggtacaaaattgtggtaaatcgaggagggcttccaaacaggcccttaggggtccggatcctacctgctccagtggctaacgggtgcggggtgccgagcagcagaagcagtgagcgcggtcgtgccctccacgagcccatctccttccccttccctttccttgccgggccaaccaatgcacgcgcgccgtcgccgtcgccgtcgccgcggacagctgccacaccacacacacacacacacacagcacggcccgtgtctggtactccccctacgcaagtgggcaaacgcagcagcagatgcattgcaccttctcctcccccctccccccgcgtgggccccacccacctgaccttatcccttcgcccccctcctcctcctctttcgccgcgatttctttaggattttttttcccgcgatttcggagccgcgggatggatggcccccctcccccctatttaacaccgcctcgaagctctctccttcctcatcacaagctcacaagttcacaacccaacacccaaaagcaaaagaaaagcagcaaccaaagatgtgcggtggagcgatccttgcggagcttataccgagcgc

SEQ ID NO: 7524 - DNA, 2299 bp, Oryza sativa
ccttcaccaacgccgaggccgccgcgctcgcctacgacgactccgcgcgcgccatccgcggggacagggccaagctcaacttcccttccgctaccacccctgacacccgcaagcgcggtcgagccaccgccgccgccgccccggccgtcaaggcgaccccggtcatcaacctcgtcgaggaggaggacgaggaggaggtcgccgccgccatggcgtccatcaagtacgagcccgagaccagcgagagctccgagtcgaacgccctcccggacttctcctggcagggcatgtcggcctccgacgagttcgccgtcgccgcggcggcgctgtcgctcgacagcgacgacgacctcgccaagaagcgtccgaggaccgagccggaggacaccaccgactccggctccggcgacgacaccgacgcgctgttcgacgcgctgctgttcgccgaccagtacaaccacttcaacggcggcgcctacgagtccctggacagcctgttcagcgccgacgccgtgcagaccaccgccgccgccgccgccgccgaccagggcatggggctctggagcttcgacgacggctgctgcctcgtcgacgtcgaggccagcttgtccttctaggctctagccgtcgtctccggcgaccctgtgactcgatcttgtaccatgtcatgtacatagaagagtggttttgccaagcaagcatgtgttcgtcctggttcctttcggtaatgaaaaattatgtgaggcttctcgttctcgtaaaagatctttttggctgtgcctttgatgcaaaaatctgagtttcagttaatcaccatgtttatgttgtctgatgttcaagaaatcaagacaggattaatatgttcaagaattctttggttctttcaacatgattgatgaatcttttgaacaagaagaagatagtgttaggccgaacgcagcaacaactggtatgctttttgaacaaagactagaccattagttactgctactgcgagtgcaaaggcaaaattatctgaaacgcgctcctattcagattcacatgaaaggcaaaattagattcgaatatggatgaattaccccatctatctttacactgcttcacattcagatgcgactctaccaacgagaaatcaaatgacccaccagcatctatcaggctgtcgatcatttcggtggcgagtttatatcaggtcgcttcaacgaacttgctgtcggcagtagcaactatcatggcctccaaacagcgagaaaagatgctgctaatcttcgatcttatccctacactacttctactagtaccttcattgttccattaacatcatctccgtcaaaaaagaaacaaaaaatatacagagaaagaaagaaagaaagtaacttcaaacagttctgaattcttgaatttccctgtcgtgggatactgtatcgctgtgacaacacggtggtgatggccatagccatgccgtgtttgtctgctaatctgtttgttcctgtcactgattcccttcttgtgaaggcaaagctttgacacagccgtgtcaccgatggcacgaaacagatctttcactttctcatgcagtgaagttactttggctctcgacggcgacacagaacgatctctctctttcacaaggcgaaagaggatttgtaattgttcgtctcgatcagctggtagtggatcggacttccttacgcgcatcgtgagtggcatgatcttcatgtcatggcaatttaattactagcattttgttatttgcttggtgggaatttgtgacctgatggcccatcgaaaatctctcagaattttatgccttttatcagaagcaaaatctccaccagccgattaaccctgctgaacaaagtttcccttttatccaaaaaaacaaacttaggggctgcttagttcctccaaaaacttttcccaaaaacatcacattgtatctttggacacatgtacgtagcattaaatataagtaaaaagaaaaactaatcttttaagcctaattagtccataattagccataaagtgctacagtaacccccgatgtgctaatgatggattaattagggtcaaaagattcatctcgcggtttccagtcaagttatgaaattagttttttcattcgtgtccgaaaaccccatccaacatccgatcaaacgtacgatatgacaccaaaaattttcatttcaccaactaaacaagcccttagaattgaatatgatatatcctagtacaacgaatttgaatgataaggatgtgtttagttcacgctaaaattggaagtttgattgaaattgga

SEQ ID NO: 7525 - DNA, 20668 bp, Oryza sativa
gggggcccccgacgccgcctgaccccgctcctcgccctatccacgctttccctcgtcacggccgcgggaacgatctaccacatctccgcgtgggacccgaaggggaccgtggagaggtccagggcgtccgcgccacgcgtggtggagcgaatgcagcacacctgcgcggcgggaaggtgcttgtgcaggtcgctcatgtccgtgctgtcgtccgccaaccacgaggtgaggtccgggttcgagctccgcgtcgccgcgctgctcgccgacatcgcggccgccagcgccgcgcgccgcgcggccatcgtgtcgtgggggggcggcgccgtcgtcgactggctgctcgagagcgtcgtgcggcgggccacgcaggcggaggccgcgcgggcgctcgcgcacctgctggccgatccctgggttgcgcctgctgtgctcggtcgaccacgagcggttccctgcctcctccaattcatcttctcttaccagccaaaacgcggcaagaaggtaatgtcctgtcaggtgctactcttgaattatttgctttgcttggctgccgtaattgtagctttaacagaataaattttgcaatcagtttaaattattcgagcatgccaatgtagctggctctaatctactaggtgattgttgttgtaaattctgtccaatctgcaagataaagagagaaaactctgaatgtttatattgaattgttagtttctttctttttagttgagaattaatgatttggtgtagcttgatttgttcttgtgttaggaatttcagtattgatatgctatgttataggaatcagatgttgagatgtgcatcagtacagcctgattataggtggaaaacaaaatttgcatcctcgtgtgctctgaggtttctggcatttttatgttttcatcccatgtctttgtgagcatggaacctttggcccttcaggttttcagattgcaaactcttaatatatgctattgatgttaagataaaagatctcatgggggaatgagttatgttatgcacctgcatgccagttatgcaataatgcagttatgtctaatggattatcaagaccttggagttggtaaatataatttattttccttgatggcttggtgatctcagctctcctataggcaatttctttttttgcttgctggcagtgctttttcttcagcttatctcttctttttttcccctatacatgtagtattatgtttcatgcgcatcttaatctagcaatgtaggtctattaaaccatttagattttccagttctggtttccttggactttaacacaatatgagttgtttgtacctaatatattgccctcctgttaatacagaactcggaatactcttcattcaatgtctcagaccattctaaaggaaggagcatgcttgttgctgcacttatggacatcatcacttccaactgcgataatgcggattattcatcatttcagcctttattgccttcagatgctgatacaagagatattgcggcagccatcgaagtcattgagcaaggggggatgcattttgatgaccatgatgataataacagtgatgatggtgacagtggattaaaaggaatagggattaaggtacttggtgggactactgtcttgggattctctagagaaataaactcattggaggtgggcaactcggatgatggtattgttggagcttcgaatagtagaatattgatgcaagaaactgctactgattctccactagtggagaagctaagttctgctgctgctccaggcctctgggatgatttgcagagggagcatgtagctgtaccttttgctacttgggctcttgctaattgggctattgcatctgatttaaaccgttctcgtattcaagaacttgacagtgatggacatactgtcacaactgcactgaaagcacctgaaagaactgtcaagtggcatggagccatggtggcgcgagctcttttggaagaccagagcttgactttggctccttctgtccctgactggtgctcaagtcttcttttgacagcttctcgggctgctgagaatggtgacatggcattggctcaaatgtcactatcaactttcctattatccatgataaggtgtaatgagtcaaaatttgtgatcagacagaagggtcttcatcttcttcgtagtatcgcaaaaaagatagaaaatgagaatgctcagagcaggatgaaggaatcattagcagtggcactgagtttgctctatgctggtgaagttccgttgtcacttgaagaaactcaaagatggtccggcattcttcttcgttggctctttgataaatctgtttcagaaactacaaatctcacagctattaaaatcctttcatgcattcttgaagactatggaccagcttccgtaccaatttctcagggatggttggctctcgtgctttctgagattcttggagataacaagacacagaatttgaaaggaaccacccagcctcaaccagagagagtgaaggtaagaatcttgttattgtttttaataaatatatatttgaatgcgtgtgccgccaactgttcttagtagttaagttggttgataaatgagttttagataaataaacatgacgataatcagactgaaaatactagaacgtcaagaacttaagatcaccagtataatatagtatgtcacatgttcagatttatgacaagtattcctccgcagccgccaccccacgcccccgcaagtgccgccccaccaccgccaccgccacccccaaggcggggacgacaccgaacgtcgtcgtcgtcgtcaacctcgtcgacaaagaggccgaggtcagcgagagctccggtgccagcagcagcgcgctgccggacttctcgtggcagggcatgtcggcgtcgtccgacgacgacgccgcggcgcagcaggcactcctcgacgccgccggcggcgccaagaagcgtccccggagcgagccccacgtcacctccgacgacgaagtgctcccggcgtcattcgacagtgacaacaacaccgccgccgccggcctgctcccgctcgacgatcctttcttgttcggcgaccagttcggcgacctcaacggcggcgcgttcgcctcgctcatggacgggctgttcgccgccggtgaagcgaacgtcgccggcgagagcgtggggctctggagcttcggcgacgactttctcaacgcgtcgtactattagctagggcttccatagttcttgtactttacttgtactgtactgtattgtactgattgttaacgttgccataaagcaatcttgctagtttgtaattctgcgtgtgtggtcgaaattttcatgtttgtgttgtttgaatctgtagttgtcgtatcgtttggggtgtgtttgatttgaacctgtgtcccttctgaccttgattcacctcaagcggcaaaggagccctttaacatgtgaaaattttgacagaaaccgggcctgatggactgcagtaaaaacaagagattcagcgtgcatgtagctgtagaaaactatgatccaacaggcccaaacaacccaattaatctgaacattcagaaagacaaatatggtcaattatccatcatggcagtaaaaaagataggaaattagtcccatggtgttatgtgttattatacttgtaggttgtaattcgttccttctttattattattgtattcaaagctacttggcttcgacttgcaacattaagggcttattcgtttttgaaggattttaacacacatgaataagaaaatgtggaggaataggaattcatgcacacttcagtctatatgaattttccaagagatttgagtggataaaaaattccttaagtttcttctctacaacttgtaggaaagggaaatttcctttggtttctatgggccggttcaaatcaacaagctgctatttgtggctaagaaaacaggtgaattattagcacatgatatatgtgctattataaattttaaaaatatatttatttgatttttttccaaaatacttttacatatatttttttacacaaaacacattgtttatattgatctagggaacgtgttatttgaaaacgaaaaacaagaaaattgttatttcgagctgccgaaaacgaaactcatacttcttcgttttcatggagagatagatcagagagtttcggccacaagttccatggagctcgtactgcttgtgctgtgtagtgtgtactcctacttattcaattagggcctgtttagttcgcgaaaagaaaatttttgggtgtcatatcggacgtttgaccagatgttggaaggggtttttgacacgaatgaaaaaactaatttcataactcgcctggaaaccgcgagacgaatcttttgagcctaattaatccgtcattagcacatgtgggttactgtagcacttgtagctaatcatggactaattaggctcaaaagattcgtctcgtgatttctcccctaactgtgcaattagtttttaaatttatctatatttaatactccatgaatgtgtccaaagattcgatatgatgtttttgggaaaaagtttttgcgaactaaacagcgccttagtagtacaacttgcgacaagttcttttgctcctcaagtacaggcccaagttgagtcacaactcacatctcacaagttgcgtggccacaagaaaaaaaaagcgtcgggaaaaaggtagtgtctagtgctaacgacttggagcagtaatatgcatttatgctttcacgtcggtaagatgtaatgggtgcctaacctaggccgtgctaatcctatctgttagtttggccgtctttagattcaaaattttttcttcaaacttctaacttctccgtcacatcaaatacttggacacatgcatggagcattaaatgtgaacgaaaaaaaaacccaattgcacaatttgcatgtaaatcgcgagacgcatcttttgagcctaattacaccataatttaacaatgtgatgctatagtaaacatttgctaaataacggattaattaggcttaataaattcgtctcgcacattacaggcgaaatttgtattttgttttgttattagtctacgtttaatactttaaatgtgtgtccctatacttaaaaaaattttagcacacgaactaaacacatcctttatctgttgactataaaccattttgtgccttttgtgtgtgcattggtccatgacacatggatgaccatagtgagattagtactgctgaaattgtgttcatctaagggggaaagagggaaagaggttgttgatcagagtgagaggatggggagtctaactgtctacgctctagtacttccttcgcatgataagttaatatagtacggaatataatatatcccagtactataaatctggacatacatccgccagatttgtaatattgtgatctatcacatctaactagattaatttatttttggataaagagaataagaaaactagactggaaagcctaacatgggatcttctgcgagaaatgtggttttctacgtggtttcagcggtttttgccgcggttttacgtagttacacgtttgcgtcgttatgtaaataatattagggtatcgtgtttcctaccagaacaaaataattatgtaatatgtgggtgtttactttccagctcatcatatgatcaagcatcacgttatataatactaaatgattgatcttttttatgagaaaccacaccatcatcatttggaaaaccaaggttgaaacagatgttgcggttgtgttgatggatttgggggtcgtgcacacggtgatcgatagatgcacgtcttcacgcgctaattatttttggtcaagactcaagagagccaagtatagaatagccgacagaggcatgtttggcttaattaggctgagaccatgacaatttttcagagagtttgctgatgataatatccgtcgttttagatgcggtaatatggtacttagtaaaaaaaggagccgtggatatgatgatattatcaaaagaagtgagcctcttaagctccgtagactagttagtttcctgacatccattaatttgctaagtcgatgatgtgggagaacttagcaccaaattgtctaatttagagttttgactacaacagaaaatgaagtggcattttattttattccggttactttgtttatcattatctctaagaataatttattgatatatgaaagttatttcagtacaatcgtcaaaaaatattttcaatattatgattttactagtttaaaataattactcggaatccacgcggcgttgttatagtacatgatgtggatggacgtgtgcgtatatatcgacacggtgcgaaaattgcagtagttggtagtagtatgttttaatatttagaaaagtaaatgaaatatcacgagaatagaatttaaatgtctaagttctggagatggcaccgtccattttcaaaactttttcataaacattatgctgatcactgtcatgtcgggtagctgtacgcctgtactatttgtctattttcagagtgttttaatggcttctagtactattttttttattttcctcaaaagtagctcattttattaattaagctcgtaacatattttagtcaaactttaccagacaatatcctaacttcgcatttctagctatatgatactatacgatgtgattttcggaagaatacactcgataaaacatgtgggctgacatgacacggcctgtccagtgaaccatatctaatcgggcagtgcccactacccagacatgcatattattatttagggttatttgtaaaatttgtccatatttttttaattttgcaagatgctactcgaaagacagttctagtagtatttttacaattttttagtggcagtgttgcaataataattaatgatttaaaccagtggcaaatttgtaattgcctttattatttattatccaccatctcaatcatatactccctccgtttctaaatatttgacaccgttaactttttagcacatgtttgactattcgtcttattaaaaacttctgtaaaatatgtaaaactatatgtatacatataagtatatttaacaatgaatcaaataatatgaaaaaaattaataatatttagaaacagagggagtaataaataaaatcatgcaattccgaataataaaataaaataaaaatctaccatcccaaaggtgtcctatatgttccgtttggaaaatagaattaagctatggatactttcttttttcagatttgcaccgttttggagggggataggatatgcagattgagagtgcttggcgaaattactaaattaccctcgccgtttttgacgtattgttttcgtgagttatccgttagttcgcccgccgccgccgccgccgatccccatccatcccgcgaggcgcgagcgagcagggcgccgtcggcgccgtcgttcgtcatgctgcttccgccgcatccaggtgagcacatcctccgccaccgccgcctgcgccgattcccatccatccatcgctcgagcgagcgagcggggtcgccgtcgcttgtcctgctgcttccgccgcatcccttacgacgcacatcctcttgtctcatctccctctctccacccacgcaattttttttctcgaatttgcgttaaccctagcttcgttgtagtagaaatttgccttaaccttaatactaacaaatgtttgttccgaaaaaagtttggggttgggggggggggggtggggttcaacttaacccctatgtcccatgtcagatccgccactgctttattgtgtgtggcgcattgtctcttagctcttttaaggaaaactaactatcgttctctatgaaatctggctcgcattttctttcaaaaaatctggctcgcacgcactgctggtgtaaatatgatgatacattgtaagaatgaaatatagagttattaagtttagtttctttagcaagttattaatgattcatacactgtttatgagtgtgccattttacccaggtttccaaaggctgcttgctggcacagcttggagaacgtatatggttagaacagtgaaaaaggctttaaaaccaaatgaattattctgtttcctgtcatttcctttaaatatcacgcgatccaaacttctagccctaagtgtggtaagaaatcactgtaggatgatgcatcctcacaagccgtagagcagcttgggaaaaactggaaatttaaaactgtcttagctaaaggaattcttgctgtccgcatattactttcatggttaatttggtgtcaaattacatgcttatcagcatttttagtgctatatgtctggaagcactatatacacaatgataaatgaggtaggtagtataggctactagacctcttgttgatgtctagttccattttgtcatgaataggaaatgctagtgcatcaggatagtgaatattcctccgggagagatcagacggtgacatcttgaggtagaagaatgataagtgaaatctattgaataacacatgaatagaatttcactctattagggtccactaagccaaggctagatatgttcttttccatagcagcttgaaaacaccagccgttggttatctgttatgtactataatatatactgcctctgtaatgttggtacctccatttgtaaacatgatggtttggagatgggtggggtccccaataataaaagactatgtgaataactcaccttttatgtgaaactaatggtatcaatttcacatcaccatcttaatagaactttatatatcagtggttagagttaaagaagtatatctgtggagattctaaatcatcaatcattaactctttgtactttgaaaacagacatatggatgtgtttttgtgcattgaaaacctgtttgaacttaattagatgatcggttggtactgttcttgcaagtttccttagccccattcttcttgatcaaggttttcatctacctctatcttccaggatgcattgtattgaaaaaatgtttcaaatctacttctagttaggtaggtagacttccagcctttattttcctctctttttgctatcatgtttaagaactcaaagcacaatggaacttgtggctaaaactcacagcctcactggcagcgtgatagaaggctaactgctagtgcaagtaatgctgagagcaaacattatatgagtgggcatggtatgttttaccagagtaatgcgcttgattaatgggctgaaattgtaatgaaccttcacatggacatgaaacagaccagctgaaattgaatggcttcttcttccctaaattgctttcttgatttccctattacagcttcctctgccctgcattcatccagataggattaaattgttaaggcacatagcaggtctacattaaatggcccatacattttatccaaatcttacccatatgggtcagatgtgtatgattgtatgctctgatctgtagcggcttatatttttccttttagttaattgtaaccgacaagctgggctccacatgatatttatatgttttggtaatgcaaccttttcgtaaaagagaactattcgttattttaacatacaaacacatcctttttcatttcattttttagaagttaattacgtgtgaatgatcatagcaggtcatgtatgtgaacactgctgactcaacatgaaactgccactgataaacaaatatagaaagaaggaactgcttatggcactatgatttttttaaaaattttatgcactttatgtacacttgttttcgcattatgggaatggggtgaagtggaaaaagaaagttgtgccatggccatctgtatgtccaacttctatgtatctatatatcttgtgtactgcgaacccttcaatctgaaacatttagttttcgtccttattcattactatgctattgtttcttgggtttcaggcagaacattaccagcctatcatggagacaacagatttcttcttggagcttgtttcctgagtaaactgcctatgctgcgcccaatgaagttgtctttggtatgcagtgctaatcccaacaaccataggtcaagaagttcggatatcacacgccatcagaagggtggatcagctcggaggaaaagtaagccttaccaggagaaagatgactctgagaatattgatgaattcgatactgatattatgtcctccaaaaatggaccacccatctctttgacaagcaattcccgtcctcaagcaacatcagtcccaggggaaagagagaaggagatagtagagttgtttaaaagggttcaagcacaattgcgagcaaggggaaaagggaaggaggagaagaagcctgaacaagcaaaagcacagggtgagaggggcagtgttgactcccttctaaatctgcttaggaagcactcagtggaccaacgaaggaagagcggtgatgagaaagaacagagtgttgaccaaacaaagagaagcaatgaatctggaaataaacaaaattcaagcatcttcataaagaatgacactcaggaagaacagaaaaagccacatcctgcagccttcaaaaggccagcttcaaattttaggcgaagatcccctgttcctaatgtaaagttccagcctgttaccaatgttgatgccgaacgagtcatcaataacatcaatgatgccgtacaagaggctaagccaactttggaaaataaggctgctacagatgaaccagactcggtttctacattcgaacctaattctgtaatagaaccagaaaacctatctttggatgaccttgatcatatttcagatgatgaacctgatgcttctgatactgatgaacccagtggagaatatgatgagccatctttgcaaatcccaagtgttccaattattgatgaatctcatgatacgactctgaaatcttccttaggaggtcctgatttaagcactttgaaggtcacagaactaagagaacttgcgaaatctcgaggaatcaaaggatattccaagatgaagaagaatgacctggttgaactgctgagcaacatggcttgatccatcagcagccctgtcaacttggctctgttttgtcccttgttagtcacattgtcttgggcatatgcactatcttgccattcctatcttatctagatgaagttcttttaggtagaaaactgtaaatgagcaaggtaaacaatgttctgttctggttttatcgttgccctttctgttacctagcctctagttaccattgtttttgcgtaaatccttcatcagaattgaaccctggattggccataagactggcaacgattcgacgtcatgctgattatgttctgatgtgtagtgttctattcttatctctgttgtttctcctttctcatggcagctcttgtctgctgttgcatggtttctctcgtttacatccatggttgttactgaacgtttgatgcacaagtcttttgtgtgttcatgaaaagaataagcagaagcaacctataatggatttctttggtgttcaatcgtttactgtctttgttcagagccaaggtactgattgggaggatttcctgggaattgtctgcctcccgattatcaattcaacaatcagcttcattaaggaaaacaatgcaggcgatgcagctgctgcactcatgtcccggttggcgctaaaaacaaaggtttttttttctgaacagaaatttaaaaattgcaagtgaatccattgtgctagtctgatcttgttgtatacatggatttgctaccaggttcttagagatgagcagtggcaagagcttgatgcttccacattggtacctggggatataatcagcatcaggtttggtgacattgtccctgcagatgcgtgcctacttgagggagatcctctgaaaatgaattgccacacgccgttcatgcgaaagatgtcgatcactggaatgtcagactagttgctccgtgtaaataatttgatcacatttttgtttgtccttcatcttgtagtcagctctcactggtgaatcccttcctgtcaccaaaagaaccggggaccatagtgttcactggctcaacatgcaagcatggtgagattgaagctgttgtcattgcaactgggatacactctttctttggcaaggcagctcatctagtggactccactgaggttgttgggcattttcagaaggtgattcatcaatctttagactgtaataagattataagaacctcacaagtggatgtgctgtaagctgtttctaaccactgaattttctgattcttacctccataggcaacttctgtatctactcaatcgccattggtgtgattgttgaggttataatcatgttcccaatccagcaccggtcataccgagatgggattacgacttccctctgtttatggttctgatcatagccatactaaatgatggtgacgatcatttctctctgaattttactgtttctgaagcataaatatataggttcggcatctgctttgatcaggaactatcatgacaatatcaaaggatcgcgtgaagccatcaccaagcccagatacttgcagctggagttgtcatcgtagcctaccttgcattggtcaccatgctgttctatttgtaactcctcaataggcttcatgtctgcacattaccagaagcaaattttcagatgattgcataaaatagataacaaaacaaagtatgatgatcagcaaggctgatatcaggtaagcatacgtttaacttcgtttgaagggaatgaggtgaatggttgctgctgttcaaagtgttcttccattgcagctttgcgttttcttctccttatcacaaagaatgcaaggactgccccagagcttccaccaaaacatgaaccaccattgtcttgacctgggctgtttggacggtttggtggaggggggagctgtatatgatggaggtggtggatttccgtcaattctgtacacaaggatcataataggtcagtgtacaactctcatttttgcatgttcataagccaggagaactcactgtagattgtttaacttcttaatttgactaggaatccagccagtgaaatgattttttgcaacattcctatataggaaagcaaagatatgagatgtggtactgcacgtgcaaataaaatattaattacttataggttgatttcttacagatcatcaagggagagattagcaaggacattgatataaccagtaaatttattgttctgcagatatctgagaagaacgagtatgggatcacaggcatatcactctaaaaagacatatctatgagataaaaataatccaaaaataatcctttttcttacaatgcctgtaatcccatgctcgtagatatgcctgtaaacccatattcgtagaaatatctatttttatctcatagaaatacacacacacatacatatgtccagcattcattataagaaacgtgataacaaaaaaaaaagaaagtcactttttcgagttgccgaaaaaagaactcatacttattttttctgtagagatcagcgagtttcagctactagttccatggagctcgtactgctcgtgcgtgtgtacttcctttaggtggtataacttgcgacagaggttcttttgctcctcaagtacaggcccaagttgggccacaagttgcgtgcccacaagcaaaaaaaaaaaaatcacctgtgaaaaggtaatgccaagtgctaacgacttggattggtcgctgtaaactcacgaaatgcatagtaatatgcatttgtgctttcacgtcagtaagatgtgatgggtgcctaacctaggccgtgctaatcctatctgttagtttatctgttgactactgtgcatcattttgtccaactttttttagaattacactattttgtccattttgtgtgtgcgtgcattggtctatgacgtatggatgaccataatgaagttagtactgttgaaattgtgttcatctaacggataaaatggggaagaggttgctgatcagtgagaggatgggggagcctaactatctactccctccatcccataaaagaacaatctaagatggggcatgatatttcttagtgcaatgagaaaacgtcacatattatcctatgttgtttttttgtggacagagaacataagaaaactagagtaggaagcatattctggaatcttctgcgagaaatgtggtttcagcggtttttggtgtggttttacggtatgtgcacgtttgtgttattatgtaaataatattagaatattttgtttcctataaggataaaaataattttgtaatgcgtaggtgtttacttttcagctcatcatatgatcaagcatgatgttatataatcaaatgatatacccttttttatgagaaaccacaccaccatttggaaaaccaaggatgaaacaaatggtgcaattgtgttgatggatttgggggtcatacacacggtggtcgatagatacatgtctgcacgcgctaattatttttggttaagtgagccaagtatagaatagccgacagaggcatatttggcttaattaaactgagaccatgacaatttttttatagagtttgctgatgataatgtttgtcgttttagctgcggtaatatggctcttagtaaagaaatgtaccgtcgatatgatgatcttttcaaaagaagtgcgcctcttaagctccctagactagttagtctcccggcatccattaattaatttgctaagtcgatgatgtaggagaactttgcaccaaattgtctagttttgagttttgactacacaaaaaatgaagtggcattttttttatcccggttactttgtttatcattatctctaagaataatttattgatatatgaaaattatttcagtacaatcgttaaaaaaatgtattttccatattatgatttaccaatttcaaaaaaaaatactcgaaatccatatgacagtattctagtacatggggtgatgtggatggacgcgtgcttcatgtatctacacggtgcgaaaattgcagtagttggtagtatttaggtttccatatttaaaagagtaaataaaatatcacaagaatagaatttaaatgtctaagttctggagatggtactctccatgttcaaaacttgatcataaacattaggcttcagggtgtcatattggcccctaaattgtttccatgaagagcgctgatcactgtcatgttggtaagttgtgctatttatctatttttacagtgctttagtggaatcttcttctagtactattttttattttcctcggaagcagctcattttattaattatatttgctgctttgccaagtaagtggagcgtggtgaccacgagccacatattttaagaagggagcattgaacttaccattcaaggatcgatcgcgatcgattcctaaaaaatagccataagtgcagaaaagcattgggaaggagacatgcttaaaaaaatgcggatggtggataataacaatgctaattagcctgtcgtctgctctaatccctttagctttgttgttgatctgttctctagctaccttaaactgaatttttgttgttattggagagcttaattgttagtatttgtggaagtgtgtgacatcattgctgagtaatcaacttaacctatagcatttaggatcctttgtggagggaaattagtaggcttgcctgaagtgttaccccctactccaccttctagctatcaatcattagtttgttttactagtaaccacgcactccatatcacttggtttttctctccaagttaaactttatttactacaacacctaaccagtttttattaaatgtatattaagaatatttgtcattatatttattttcggttagaaataccgctacatctttatcctcacaattaatatgaacagaagtagttgtcggtacctgataaacctaattaaagataacatgtatagcattagcttgtttaggtttaccggattattattttcatcgtttatttattggcttatcaggctaaagtaaatttaaaattataacttaatcttagagatgattatttttgggtcatttttcatgttagcctatttattagccctttgtttttagactgccaataataacaccgatataaaatttttacttataaattatttttcgatgtttaatgaaacttaccagagcagtactctttaattaactacctgcctttcttattacaagatcaactaaaaattttctccgcgtaaagctaaagctcagtgctgaatctacagtgccatgatcacgcagaattggtgcgggataacttcgtggggattcgcatgcaaggtgataattagttaagacaaaaaaaaacagaaagcaaagttttagtggcacacctagggtgtatttagttcacgctaaaattgaaagtttctagctttatatgtgtaggaaaattttaatgtgataaaaaaattaaaaatttattgaaaaagtttggaactaaacaagtcttaaacaaaggctaaccttatctcgcgcgaagacgcaattaggcgtcctttttagagttgattaatttttggggggccaagccgagcggagtggaccgtgacgaggacggaggatgcatgtgtccgccacaagccagggagaggaagagaagagacgccgcgacacgacacttgcctagttctcgtcgtctacgcatgcggcgctcgtaaaagttgggcgttctccccgagtactggcattatatatcagcagtaatttttaggtataaattgttttaaaatatcagataaattaatttgtattcatatatctttacattctttaacgtatgctaaaaagaatttaaaaaaaaagacaagcaaaaatatatttatgtgtgtgtaatatctgtgagtagcgggatttgaaccatgatagatagtcatgcgagcacaactctaccacctcactattagtgttttctcggaacttttctttatacggtgtcgttcccaggttcttgccttcggttacttcggatgtcaaggatcctcggatttggccacatggcacctgtagttctagctagagttgaaaaaaaaaagagagatcgagagaagagcacaataggagtagggtataaacggctcgaacctatataaactgcttgcctcccgctatgtcaagcatccaggacatagataatatgatttatctaattaactaccagatattttcaacgctggaattcctaataatttccgaactactataggtatatagatttgatcactatatcgtttagatctttcaattatgatgaacaagatttacatgtgtttatattttcatgtaatttgcttgtttagatttttgttagtcttttttaacaaaatatgagcgctcaaactaaaattacgtgaaatcaaaattgccaagtactatatgtaaaacgacgaagggagtaccaagtgaatgcttccactaacacagggacccaacgatactacgataaattcccaaccttatcgctacaatcaaataagtacttgctccgtttcatattatcgttccactttttttattgttaaattttattgtgtttaaccaagttatagaacaatttatcaacactcaaatatcaaatcagtttcattaaatatagcattgaatatattttgataatatgtttgttttatgttaaaaatacctctatatttttctataaatttgatcaaacctaaagaaatttaactggtatatataaaagcccaccgacttataatatgaaacgggggagtagaaatttaactggaatgatcttttttttttcaagtcaatagatcacacttttagaacaccatgttggtcaccattcacggctgcaggcagggcatgcattgcatggaccagcaaaataatatcttcccacttgggttgaatcagtgcagtgtacgcatatgcatgcatgagtctacaaatatcttgccacttggacagaagattagttcgtgtaggccacgcatctatccatccgtagttaattatcatgtttgagctggcctcttgagtgtgccgatatagatctctggtctatgtgaatctaatgagaggttgagaaagagagtaggtttgaaggaagggagctctgctcctatgattatccattcaagtgcttggtgtgaaagaggtgctcttctatgagctgatcacttcactgtaactcaattggggaataagatggcattgtattaaaaaataaatcaagacatatttctttgcctcaacggcgaagccgggatttagacatgagaagggactactccatccgtctcaaaaaaaaaacctagaactggataatatacattataatacaacgaatctggacacattatagtactatattggttttttatggaacggaggagacctaatacaccattatttaggttaattaattaattagttagataactatgtcaaaaaaatttgttggaggggacagaccactccgcaattgtttgcctgttagtatattactagaagaggtaaaaaaaagtcatcatactatttgttatgaaggtttaatgtcaccattgtaatttttattttaaattctagctcgtccagaattgcattataaaaaaccaccagtttatctttgtatcaaataaaacaaaatgtcatatgcgctcgagaggagaaagggtgatactgtgagaggaatatgtagtgcaggtgcatttggtgtgtgttgggctgatgagttggccgagtgggggcatcatattttgtttagtggaagctcatctttgaagagtggatctgagctaattatgaggaataaatatataggtgacctaattaaaggcactaacataaaatcagagagtattttatacgctatcaagtttatgacattgaattcgtctctctctccctttatacaataacttaccagattaggcatacaatatgtatgagcggcacttacttgacaacagtcatatattatcgagcaaaacttcgaagttgtgggcataaaaagaacataggcgaaatcagaacatattacacaatcagagcaaacttgacactacataattaatctatatcttttatatagttacagccactaagcatcaaatgatcaacatgcaagtacaataatatagtacatattataacttaaaatacaactatactacatcatttacaaattactaaaatttaaactcgatatataagcctggtaaatcatcatacttattatatcattttcacaatatttgaaccaaaactcatcaatcattctacaaaatttaagatgtatttatttgtatatcatgcagcaaaatacgggatgtcatctagctttttaaaaagttgacaccttgatgctccaaggacatatatgtgccattgaaggagttaattagcgtagctacgttgtccacccgcacttttttccattttagtaacaaactttcaactcaaaccatacaagtgtttttcaagaaaccaaatcatacgaattataacttaaaatcatattaccaaactcctgactatggcctcaaaacatccatcaagaattacacaattctaaactaaaactccaaaaacttttatcagaaaatatgtgccgaaaacacagctgcgctaaatagcaatttcggataaataggtggtgtttgaatctcctgaagatgaagataaagacaaagattaagtgttttacgtaaaacgagatggtaataacgtgtgattaattgagttttaatcattacaaacttgaaaaatggattaatctgatattttagacaactttcatatagaaagttttcgcacgaaacacaccgtttagcagtttgaaaaacgtggcccacatttatgctaaagtttatccaacttttatcggagattcaaacagaggcgagacatgacgtggcacgtcagcttgggggcatctgtgcgcgacatctggcatgccagtacgtcatccgccaactcatccaaatttgtgtttataaatgtactatatatatttttttcccttcctcggttacaagaacaaaggcattcgcaacacacacttgaagaaaaaaaacacgacgaacacgttaaaaaaaggtcgaagagaagtgggagacccaaaccgcgaacaatgtgtggaggcgccatcctcgccgagttcatcccggcgccgtcgcgcgccgcggcggcgaccaagcgggtgaccgccagccacctgtggccggccggctccaagaacgccgcccgcggcaagagcaagagcaagaggcagcagaggagcttcgccgacgtcgacgacttcgaggccgccttcgagcagttcgacgatgactccgacttcgacgacgcggaggaagaagacgaaggacacttcgtgttcgcgtccaaatctcgtggtaatgttcgtcgcgtgcgatctcgtctaggtgttcgatcgtgatggcgatgagttcttggcttgatctcaccgaggaagattggtttggtttggttttgttcgtgcagtcgtcgccgggcacgacgggcgcgctgcggcgagggcggcgagcaacaagaagcgggggcggcacttccgaggcatccggcagcggccatgggggaagtgggcggcggagatccgcgacccgcacaagggcacgcgcgtctggctcgg

SEQ ID NO: 7526 - DNA, 5673 bp, Oryza sativa
gaattctctccgcctgctgagaccgcgctacctttcttcaccaacggcttcgtcgacctgacgaccgccgcggcgccgccaccggccatgatgatgacgagctccttcaccgacagcgtcgccacgtcggagtccggcgggagccccgccaagaaggcgaggtccgacgacgtcgactcgtccgagggcagcgtcggcggcggcagcgacacgctgggtttcaccgacgagctggagttcgacccgttcatgctgttccagctcccctactccgacggctacgagtccatcgacagcctcttcgccgccggcgacgccaacagcgcgaacaccgacatgaacgccggcgtcaacctgtggagcttcgacgacttcccaatcgacggcgcccttttctgatgtactcctccattgatgcagtttgtgcactcaattgtaagcatctgaattcacttccattttaatggattcagttaaaaacttaaaatccatctgttcatcaggattatatatcttgatcagataccatgccatttcttggttcaggttaatcacgtcgtcgttgatgaatgtttaaccggaggatgatggggtgcagctgatatcatggcttgcttgattaccgaattatattgcggtgtttgtgtttgtcaattagattctgaatctgtactactgccgatcttatgatcaaaactatatattaagtttatgtactcttaatttgtgggctacttttacggggtcttcgtactgctggtcaaatagtcctatgaaatcgatcatgtcggcaatatcgtcgtcaattatcgtggtcgtggttgttaatgatgtcaaataagtctatgaaaacctggtcctcttggtgtttatgtaccactgatcgatccatcatttgatctctgtcatgttgagatggatcgtgtaagaatatcataatttgctggattcagtccagtcgtaatgtattttggtttgtacaactgcaattttgctttgtttggattataactgctgaaaaaatagagggagagaaagacaggtttttttttatcgtctgaatttctcatttgccaaacagcaatcaggtagatgatcagaaaaccattgttcagtattcctttttttctgaaaacccgtacggttttcctatctgctggcaatcctgtttgccacaacacttgatcagttcatatcatgttttatgttgcagcttgcaaaattttttaaaaaaaaatctgtcatgttttatgttgcagcttgcaaaaattaaaaaaaaaataaatctgtctttttcagcaagtttttttattcaggaacagtaccgctactacagggatgtgaaaaccgacgcgcgaaacggtgggcgccttatgaaaccgtggttttgcgatttgattagtgatattttagtcggcaatttgcgcaaattgctcttatctttcttacctagatgaggccatgacagtgactttgctcaactaaattccaaattaagttggggttgcaggattctcaagcaaatataaaagtttaggtgcgcacacgcagcaagcaaaggcaaattacctaatgaggatgagcagagaacttggcaaggtctgcagggactagcattgtttaaatgcaagttgagtgtgccatggcattatacaccaggaccattacatgctatacctaatctcatctccttcagaaaaaaaaaactactagttgcacacttgcatgattgcatctattatactatgcatgtagtcgtagatagctcgggaagatagcccaattcggtggtccatgattctccattgaagattggatctaccattcattgttcatttgttcttgatataaagttgtgttgagtttcaaatggctacttgaacctgttccactatctgaataattttccctgcagatcctaagaaaaaaaaaatagaatcttcaattctcttgatgataattgttttcatggcttggagggtttgcacaagcttttcttatcctggcatagaactttcaggatcaatagaagaaactgaataattagtaccatcataaccagctcctaacttcttttacttggagaactaccagttggccatgcttatggttgtggaattgcaaatagccctaaaaattttcctctagccattttgtggaattcggattttggttctgaattccatcaaacagatagaactcctccaattaccttcatttccatcgaaaaagaccggtagaacgtgaccaactgcctattcacaacacacaaacattgtgcaagaatttgttagtactgagtgctccgttaacaaaacttcaccaaaagcaaaagaagagtatagatgaacactcatatacgcttcctttcaaaaacaaaacagaaatcactcacatatgaaaacatagatcaccgatctctgctgaaccaatgcaccctgatggaaacaacagccttcagagttcagagttcagatttcagttcagacacccacattggacatcatagtatgcatctgaaaaaggagagaaaacatgaaatggatcatcaacttgggatgctataagtagcaaagaaatgacatggtggggttacactgttacgcttgatggcatgaaatctaagggtttctaaccctttctgcaaatgaggacaaacggctggtcttatactagtgttactcatggtttgatgcttccaaattctgaactttatgcaagtctgtgggagtataaccaaccctgggtaaacactaaagacaggctgtgggctgaaagaagagcccatggtattctttcctactgttttgtgctatactaaagtatactcttttcatgacagcatctacaccggttcacattagctccaacctattctaacaagattttgacagtatcatttggagggtatattcagaaaacctttctttgtgcacgtggatatgattttgagttttgtcataatgctcacatgccagagagagagagagagattaagacatcactgtgtgttttgccattggacattggacagtgtttgggcgagctccacatgttagtgactagactaagagcattaagatttacaattgttgtatattcattcatatcatcaaatgctccttgaataggactcctttggattaaaggcacttcaaaggaaatttggaggattttatttcttcggaaaatttccgtatactagctcatttagaacaaagggatgccattggtccatctctcataaacacataataagatccatgctgcagctggctacaaatctatactctagtatgattttcttctctctctcttttcacatgcgcttgtagttactccccccgtcccattttaattgcagtagaatagtgtgggtttctgtatctaacgtttgactgtccatcttattttaaaaaattaaataaaataagtcacaaataaagtatcattcatgttttatcatataataataataaaaatattgtttataaaaatatttcaaataaaacggatgataaaacgttgcgcgcataaacccacaattacatttaaaatgggacagatggagtagtttatagcatgctattgtatttgttgaacccttaatcccagaaaatctccacatctactgaaccttataggtgtgtttggcaaatgagttatgagaggtgtgattgttaaagggaaatagatgaatggctataattaaatgaggtgagaagtatggatgctagtgtacaatattaccctatcctttttttcccaataaagtctatgtccttatcccagtaaagttcacaacatcgaatatccaatcaatttaacctgcaaccaacttttgccacaatttttttaaggagacgaattgacaacgaggcagcccacagacttcggcgcccacaagatcgggagatagcggcccacggagactagacagcccatccccacatcagccagcgacggcgacgccgacgacgacgacttttcctctatttaccactctcccgcgtcgcgccatagcgacgtctctcccggagaaagaagagcgcgccgcgccatgtgcggcggtgcaatcctcgccgatttcaccccggcgagggtgccccggcggctgaccgccgccgagctcctgccggtgaccccgactccccccgccgccgagaggagaaccacccggaagcgcaagtccgacgtcgacttcgaggcggagttcgagcttttcgaggacgacgacgacgacgatgagttcgagctttccgacgatggcgacgagagtttggccgtgtcatgtgtgtcgtcccccaagtcgaaggcagtaccttcgttttcttgtacgatgagatggagaaatcttgcctgctttcttgaaggattttcacctgacggcaacctgaactttacacgatttcttctcctgctgttgatttcatcgatcgccggcggcagtttcgtcggatgtctcctcgagctccaggccgcggcggcgcgtggcggcggcggcggccggtcgtcggaaggcgagcaagaagagcaagtacaggggcgtccggcgccggccgtcggggaggttcgcggcggagatcagggaccccaagaaggggcggcgcgtgtggctcggcacgtacggcagcgccgaggaggccgccatggcctacgaccgcgaggcccgccgcatccgcggcaagggcgcgaggctcaacttcccccgcgacggcgatggctcccctcgccggagtaacgaccggccctgctggaccatcgacctcaacctccccgcggcggccgtctccggtgacgacgacgacgccatggccgtcgacgccgcagacgcagacgcaggcagtgctggccgtgcagcagcctatgcaggtactaccacctcggaggatatctcaagatgtattaatacgtgatatatcactttgtaaatatgcatgtttaaaattaactcctacatctcaaaataaaataaaacaatttaattgtgaatatacgttaactagttatagtttaatttatttttttttcgtttttatttttttcgttgcgggagtagaagttgaatttgaatttgcatgtgtgctggcggagaaacttggctcgtaggctcgtagcatggagcattgccctgttcgcatcatatcatacggttgagctcgatttttgcgaaagaaagaaaggattccaatattctcactgatgaatgatgatcaaggttgataaaatgagcgaactcgatcaaaccaaaccaacaaatttcgaagaatcaagtagatttactaatgtattggcgttgttggcttgttgccgtcgcagatcaagaagcactgagcgcggcaaagtgcaagatcaagcagtgtcctcgcgacgaacagatggcgagcgccacacctgagctcatggaggaggacgcgagcagcagcagaaacatggtgcccctgtccatggcgctgcagctgcagtatgcggcgatgatcgccgaatgcgaccgcgagatggaggagatcgccgccgtggagagggacctcgagaggcgcaggaggcaggtgttcgagcgcagaggccacctggtcaggcaggcctctcttctgctcgactgacgatcttgctgaactgaactctgaatgtttgagcttgtctgaagtctgaactctgcactatgccatatgg

SEQ ID NO: 7527 - DNA, 15725 bp, Oryza sativa
aggcgcaggaggcaggtgttcgagcgcagaggccacctggtcaggcaggcttctcttctgctcgactgacgatcatgcgtgaactgaactctgaatgttagagcttgtctgaagtctgaactctgcactatgccatatggtgtttcaccttcactgtgaggctgacatgtgggccagacgtccgtttgccttgcttgcttttgagctgcaactgggcgttgtgctgcaagcctgcaaagtgcctgtgtaaagtttgtgggattgtgtgtgtggatcttgtatccttgtgactttgcaagctttaattttgtgaggaacaatagtattttagattggtgtgtaaaatatagaaataaataatagtagcaactaaattttggttttcagctcttcatcagatggtttgtcatgggaacaaaatttcaaacatgagcaaattaaggtcatgttattatcaattgtgatagatttaataattacgtactacctctgtttcaggttataaggctttctagcattacccacattcatatactccctccgtcttataatataacaacctaataccggatgtgacactttatagtacaacgaatatggacatgcttcctgtccatattcattatactatgaagtgtcccatctagttataggtttctatattatggatggagggagtatatgttaatgaatctaggcacgtatatatatgtattgattcattaacatatatttaaatgcgggtaatgctagaaattattataatatgaaacggaggaagtaggtgataggatcgtaaggatgttcatcatctgtataattgtcccgcatgtaaaaaagacgaaatataattcgtgtcatcacatcaatcgtatgtgattgctcgagcgtatttactagtatcaatatcatggttcctaccaaaaataaatcgtcgtcatgaactcatggtacttttaatagattggtatcatggaatgaataaaatggatccacttttttctaaaggctcctatttcaattttttttttcaaaagtggcaaggccttgttcttttctccaacaaaagttcgataaaatttttgatacacgctgcacgcttttcaactgctaaatggtgtgtttcgtacgaaaactttctatatgaaagttgctctcaaatatcaaattaatctatttttcatcaagtttgtattgattaaaacttaactaataacacctcaataccatctcgttttacataaaacacttaatactatctttatcttcatctttaaaagaaaagaacaccacctttgttaggattagcaattctagttgttgcttatgccacacctttggttattagcaggggtgtccatgaaataaccaaaccttggaagggcacatgcgcatttctaccagcatctttttgcatccgcggcacacgaagtaggagtataaggatagctgagggactaaagcgaaaaaattcgcacgaacccgaaaacccttttctccatcgcctccccctccgccgcgccgccacttctctcctctcctcctctcgccgctcccagggtttcgcgcgagatctactctagcattcgggcgttagggttccccgagatggcgagcgagcaggcggcggagagctacacggtggaggagctcgtcgccgtgaacccctacaaccccgacatcctcaacgacctcgagggcttcgtcaacgatcaggtaaaccctagccatgggatacttgcggccccgtttgattttgttcgtgtgattgttggaattttgcgaaggattggtccgtggctgtgctgaaaaagcctcgcgccttctcatgtttacatggtccgcaaatcgttaaattctcctatgaaaaaaaaaatcctgattcatatgcgctatggcgatagctagaaatagcagtatttgtgtatttttttcgggcagactgtagtggagcacatcgttgtggaggagttgtgaattaagcggcagcacttgtaaagagaatggttgctgtttggtacatcaataaatcttattgtcagtcatctcaatgctaactgatggattttcaattgataatatctgttgtcgttggtcatgaaagtggcaagatggagatttcggtcagatgacacacattcatatcaatatttgacatgctgtttggcttacgatttataaagaaacaaactcaacagaccttttttttgtgctctagctattgtgagtatgtgcatgcatcttttgtagctcatctgttttattccagcatataaagaaacaaactcaacagacctttttttttgtgctctagctattgtgagtatgtgcatgcatcttttgtagctcatctgttttattccagcataagtttttggttctaatgctttcaaatttaccgaccttttcttttcatataggtttccaaccaaacatataacttggatgcaaatcttagtcttcttcgtctgtaccaggtgacagtccatctctgtacaaaccgcttttacccatattttggctcgagttatatgtttatttaatgatgcgtttccctttgcagttcgaaccagaaaggttgagtgtgcagattgtatctcgcatattgattaaggtcagaaaagaactaatgttaacattaataaataaacaatggttttttgttgatcacttccaactgttttgctctctttatgttgttctattgacaggctctcatggcaatgccaggcccggacttcagcctatgcttattcttaattccagagcatgtggtacggaaacaattccctgcctcatgtatatgtcgcatcaaaaactatctatctaataaaatgctattgcggatgcatcttaaatagtatcgatacccagtgatctatttgttttggtggtgattgccaaattgaccctgaaataacattatcatatatgtatgcctagagatgtgcaatgtatatatataataacatgtagttgatggaataaaatcatattcaccatggatttggaatttaaatatttgtgcaagggaacaatctttgcccatttagtcttagatatgtagatataacagacccgaatactttatacattgtgtttattatagctgtacatctagttcttttatttgttgggctctgttctcttatcatgtgagttttgaccactgtcctctatgctcttcttatttcagcaaatggaggaacagttcaagacgttgatagttctctctcactacctggaggtatgtatctggcttgactattgtatatatgttgaacagttagtgggataaccactgttaaccgcaatcaacgtctttgtagactgctaggttccgtcaattttgggatgaggcgtcgaagaaccgcaacatattggatgttgttccaggtatgtcttgtggaattggagccatgttttgttcacacgttgtgaagtggtaattgttgcaagctagatgattgtactggtatttccccctccattttcctgattgatttggccaattgggtgtgactgataaactgtaccttttctgattactttatttcagcattttctcgcacaactcatattttagaaagtaactttgtgacttatcatcgtttagacgtttaccatgtgtttatgtggcatgttcatgcccgcgttgtcatgtaaatgagtatgtattagtatcctagatgcccagagattggttaccatatcaagcagtcttgagcgaacttctgtttgattctttctactgactactgaggaattctttttaatctaacatgaactacctatggattatttttatgaatgtttgctatattggacactttcttatggcaattgatatggattctttccgtttgacctaatggtgaagtgttttttttttttgaaacactagtgaaggcttacttaactaatccctttacaggttttgagcaggcaatccaatcctatgcgatacatgtgctctccttgacataccagaaagttcctaggcctgttcttgcggaggtaaatgatgtcattttaaattaattattacacgagtcctcgagggagcatgagttttcattcaatcctttttgtttaaactttagatgaccaaggattcgtggtaatattaagtttcatattactaatgctacaaatatttgttacgccagaagtgtcaccatcatcatccaaattttgctatcatttaggtgttattggttgcctcgcacatggattgtcccttgttggctgaaactcattacttttcttttcaggccatcaacattgagggtcttgcattggacaagttcctggagcaccatattgcaaactccggttgggtgatcgagaagggtgcacgatctcagctgattgtccttccacgcaacgagttcaatcaccctgagctcaagaagaacacagctgaaactgttccgttcgagcatgtaactcgcatattccctgtccttagctgagtcaacaaccagaccaactgagattttgcattacagaacttctgagcgcgtgaagatactctgggcgcatctgttttctctgctgtgatgtactgcgttttgatatgcctgttttagctaaacaagtcaattctagtgacgatccgagcgtcatatctgcctagttatgtttatgtaagcattctgccatgatattacattgttggcaagatattttatcaggtcagagcaaaattttgcatagcggccgtgttcggctttgggcacaactcgatcttccatttaccacgagactacaaccattcctcgttgtcagatttttgcgattgctagtgttctgttgcgtaggggactcattgtgaaaaaaaaaacccgtatgtggtcggtgtaaaaacggattggttttagcctattttttcgtacggagttggcttgtagtagttgcatttttttaccagttttcgtttagttttccgcaaaagtggggagtggttttgacttccaaaaacaggataataaactcttattaccacaagcatctcttagaaaaaacaaatatgtatatcatttcatcgagcgaaacagcttggatatcgatttttgttgtcgctggcaaaagaaaccgcccaaattcatattgaggaaaaaggagtaaattcacatgaacagggggtctttctgcaaaaagaaaaaaaacttgggccggcccatgcacaccctgcccaaggagagtcgctgcctcacctaaacgccaattagggttttcaggggggcggagatataatgacataaaagcccctctccttcctcctcccttctccttcgcgccgccactctctccgagctctcgcctctcctcctcccccgtcttcccttcgcgcgcgccacccccacacacgcgaccatggcggcagtggcaggaggcgcagcgcgggcgctgtcgcaggcggagcaggacgtgcagatgatgctcgccgccgacgtccacctcggcaccaagaactgcgacttccagatggagcgctacgtctacaagcgccgctccgatggtacgcatgcacccacccccacctacaggcatctcacccggctctgcttgttcgtcgatgctcacagctagccattacaatgttcttgccatgagatttcctacgtaggataggtttaccatgttcttgccactagatttcctaggttggattggtgtggattgtgcacttgtatcatagtgctcgcctttgttcatgctttgttagtatcctagctttagctaagtatccaacttgttgtgagctagaattattacggcatggtgctcaacttgatctgatttcgtgtcatatcgtgtgtggcatagttgcattgcaacctgttgcaaggtatgctgctgttcttttgggagggtatcttgaatatgaatacgtgaacatcgttgctgcaattcataggtatctacatcatcaacctcggcaagacatgggagaagctgcagctcgcggcgagggtgattgttgccattgagaacccccaggacatcattgtccagtcggcccgcccctacggccagcgcgccgtcctcaagttcgcgcagtacactggcgcgcacgccattgctggaaggcatacgcctggtacatttaccaatcagctccagacctccttcagcgagccccgtctgctcatcctcactgacccaaggaccgatcaccaggtgaaaatgatcaccatgtcacggtagtgcgttggtgaattgggtacagtattgtttactgatcgtgttatcctgaattatgtctgcagccaatcaaggagtctgctctgggaaacatcccgaccattgccttctgtgacaccgattccccaatgcggtatgtcgatatcggcatcccggccaacaacaaggggaggaacagcattgggtgcctgttctggctcttggctaggatggttctgcagatgaggggtactatcctccctggccacaagtgggatgttatggtatgcggtgttattacttcaagaacacgttgacattggaagtgcattcatgaagataatttcatatcctttgtatgcttatacactgagtatgtcttttgcaggttgatctgtttttctacagagaccctgaggaggccaaggagcaggaggaggaagctccagcacaagactttgctgccatcactgattacaccgcacctgaacaatggtctgctgaccagtggacctctgatgtggctgctcccccagctgctactgttggtgattggggcgcagctccaggtttgtggtttatccccttctaatatatttatatttttaaccaggtatataactgttgtggacctctgaattttgttcttgtgatgctaaaaatttcatatcattggaatattcttgaaaaaaactgttgtgctgattgctgctcatactgttagcaattgtctcttcgttttcctgcataggctgtaaaatttacatgccttaagcgcttgtactaacttggaactgatcattctccctttctgtggcagctccagttgctgctgccgaaggatgggatcaagcaggagcacccgtagccactgaagccgccgtcgttccaccggttgcgcctactggatgggacccggcagctcaaccagctgctcaaggctgggattaggctaggcaatcactttgagatgtcttccgcagcttaagttaaatatttcccgaggcatgaatgaacacccaaaatccaatgtgatcatctatagctacaccatgaactcaactgtttttaggaatttctagctgaacctgtgttgtttgtccgtccctatttcgaacaacaatgctgtgagggtgagctcggcaagatgtgtggtatatgttaagctttctacttttgtcctaagtttattctgtagcgtttatatcaatcttttcctcggtgcaatggcatggttctatacgctcagtttgttattcaaatctggtacttgtacagtttgagaaatgttgtgcggaaacaaaaacaatttcccaagacgtgaatgcattttatcccttctaatctccacctaaacagacgtgctgcctcactgaaacttagttctaagggctctactctactgatgtacgtgtaaaacagatttaccatgcatttcaaaacctgaaaaatcctaggaaagagcaattttttttggggggggggggtgtatttctattggttcaaaatcatataaactcaaggcgtgcaaaggtttccttgggctaatggacattggtcctcaagtacaaaggcagaaaggagcttgactgcaagactcatctgtcgagcaaagacgaaagtcggccttggtgatccgacgatgctgagtggaaaggctgtcgctcaatggataaaaaagtttaaattatgtttctctttcaaattaaaggggccctagcgaccaaacgattttcctaaaaatcaaaagatacaaccaaagtattgcagcagttgcacaaacctgtatcttgattcgttaatatagtaatttcccatcatgttgcaacagcactcccattcatcatggagttcagggttcatgcaagacaatactggtaacatgaatcagcaggaccccagaagaaaattagttcatgcatcaggtgcaatttcatacatctctggaaaggaaaaaaaaaaacacacaaccaggctgactgaaacattggcttgacaactcatttcctcctgtaccgtgtggcctgttagattgtctcgcaatcattaccgtgttgccaacgattagtgtattttgtacagtgaagactgaaaaggcaagttccatacagagagcaagtaaagtaaaaattggtaaatatgtataatactataacatatttacaacagggattagcatttccatttttttttcatttttgtttgagaagttcttttttctgttttatccttttcctataacatattgccaaagattctaactaagctaacccttgcaaagaatgtgatatatgtttctcctatttattgtcttcagtatggtcaattcttcttcaccatagaaattcaatcgtgtacctcaaccgaaccgagtcagaatggtttcatattccccaatggattgtcatctttgagcactttctctgggcaaaccaagttgatgtttcttccatttgttgtgatgatctcttcgatcacgagaccgttgcagtttgcagcagatgtagcttgacttcgagtgtttcctttaatgtagctgcgatagcttctgctgttgaatccttttgctgagatgtcaccaagacaattttatagctctagtagcaaagcatgcctccgccatccacccaatgcgtgaagcggtcagagtagtcacggatgtctgacatttggctgcttgagcgtgacagatctgtgtcatctcttccctgctaaggaggaaaagtttcaatatcaataaatgtacagagtaaatgcctgatggcagaaagaacgcgtcgatagattacatttgaaaaatgtaaaatctgggttggaacaaaacaaatgtacagcaagcttgagtggcatatatctctactattataaaaattgaagatgtttttgccggtattttggtacctcattcgcgtatgagtcggttttcaagtccgttcgcttttggaaatacaaatccgtatttgagacagttttgagtcagtttgtaagttcgttcgcttttagaaatacagaagaaatcgtataagaaatctctttaaaaactcacatactaacttgagacgatcggacacctaattacagctcatgattttctaacaaaatatatatccaagcgaatttaacacagtgaatttcatcttaactcgatataataataataataataataatattaatattaaaatagcctttacccgttgcaatgcacgggcattttttctagtaattttaaaaagaaaagaggggaaaagactgacctcatcattgtgtccctgttcactgtatgatgtagttgattcaatactgacaacatccatgggtgaattgatgagtgatgacctgtaaatgagtttgaaacatcttattaccgttaaccattacagcagttccctccaaaaaaatgaaataaaatactatagtgtgagtaatataacatctcagcctagaattcactcctttagttgccagatcaaggggatagaatttgtgcagttggatatacaaataaatcacagatgtgttacctctcataaatttcctcctcacaagaatttcctgaagatgataacagatcaagatcaagaaagtttgaagagtgcaattcaggataacccaatcttctcaaataattctgccgctcttctgaaattgagtgtctcccagacaatgtgctatagtttgtactgaacatgagaaaaatgcagttagttcatagtatggacaatctgaagttctccaacaaccaccaattcgttttcaaacaaggatagagcacctggagcacgggttaggttctatagagatctctggtgcagaatcagaaggttctctaatatcctccagtggttgcattgggagcaattctgagcttgtgttgttttttccaacattacagtcagatacaggtccaccagtgttgtcacataaaatattaccgtccgataacgacctctttatgaatgatctgctgatatgaaatatggatgttactaaactagacatggaaattccaaaattcaataaaataatataacaaaaacaaagtacaattggcagaaccactaattgaccagattctagatagcttgggtaacccaacacatcattatatcagcaattaataccaagataggttctaccttaagctaatcaacatattatattctagatcattgattatcattactaggtggaacatccaaatataagttctctgtgtgaatgaaaggctctcacacccttattaatttgcagttccaagacaaagttttagtattgttcaatccaaacgagcaaacaggcagctagagcaaaataaaatggtgacaccttttgaatttataacatggattgagaagtgaacagtgtcagatttacttggaatctttcatattccatatgattgtctggtaaactgtctaaatataagctgaagttgtactgcatattacagctttctgaacaacatttcttaatggaaattgacttcagtacctcccagtttcttcagttaaagttccttgcctgccaatgttgtaatgctgatctgagtccaatttccaaagcgcaggttttccttcttgtggttggaaatgacccaagaacctgcaattctaaagtcagacagacccgtttgtggtaatatactagagcgataccaacagctcccatggttctgtcatataattttctccgagaattctgcctattgtacatgtatagagtaatacagacatgagaagcttacacatttatagaatcctgcttctcaggatcagtgtaggcattactgtagtagcgctgaagggtccggaggaactcctgagattgtgttgctgccttccattggcctctttgctcacagaagatctgtaacatatatcagcagtatggagtactcagacagtcagactaataactcaaaagagaagtttggacttttggggtgtaaagaaaaaaaaatctttagaagaaaaataatattatgactattgacttcaccgccaattaagaagaaaaatcgctttgaaagaaacaaaaataggacaattgaataagaatatgaagaagggtttaatgaaagatgcatttgtttgagaattgtattacacagtagaggaagcacaaattttgctccaacgagtcagtaaatagaattaagcaagtaccttgttgtgagcagcagagccaccatattgaatagctagcgtatcacccatccgttcatagaaatccataagatcatcggccaaaggagcatgcaattcaattgtaggggttttattgagctggagcacatgaagttgacgccctaaagcagctaagccatacgcaaactgtgcaacatttgtgcggtccaagcagtctatgcagttagtcctgaggacacccttttgcagtaaaagaggtactagcttaattgcacataaattttgaacctggatgttttcgaagtcacctgagttggcaacagcttcttgtccactgatgcatttaaaaagaaaaaaaatgcattagtactgttatgtgagctcataagataagaccaaattggagagcacctacttccaattggttcaaaagctgccttatttgggtggtctactgtgctcaaggcacaacttttactaatccaaagaatgaatatgttacagggtaacatcatgaaggaacatttttggacaaacaacatcattttgtttctggtggccaggcaaaattttagataactcttataactcttaagtaggccaaatgttaccttgatgcatcctcatactttgatgtagttatctcacagtggaggaagtcagttagatccaacacatctgatgctaccttgttcaacagcgaaagcacattggtacctttcctgtaaatagcacttagtacttaacatcgaaggcaatttacaagtaattacaagcttgaatcctaatggcttggatataagatttccttggagtacgatacactaccttctagaaagcttactcagatccatgtgtaaaaactttagacgtttgtcatctggcagccccttgttaatataatgtatagcctttgcgaattctgcacggagcaaagattcacgaggtttcttctcacgagtctgaaaaaaatacaagggacccgaaatggatatgagaactccagattgataacaaagaacataaggtcgtcaatatggcaattaaatttccttttcagaaaaaaaatattgcaattaaattgatagatatataagtcagtagtgattcacatgtaaactatcaaaaaaaaatccatcagagaataaaccaaatttgtattccacacttattctcaccttgatcaagtttaagataattattgggttcccatatctaagtgcaaggttctcaaaatgaaggcgagttgtcttgtagtctacatccggtttcactgcaggtagcaaggtgattggagtattagagaagacagtctacagatggcaaatgcatgacagactgacagtctagaacttacgtatgatatctggcctaatgttgagtcttgaagtttcctgaaaccatataagaggtatggatcctctatgttgtacaacagatgatatctgatgtggtatttcatctggtgtgtcctcaaaaacaatttgttcagtctcaacatcattggcaaccctacccttttcattaacacctcttttcaagaatctgtatttgaaaatgacatgcaaaattaacattgtaagatcaggcgacatagattacattgtttaggctccattcttttcaacataaattagggtgctaaacccaaaggattgtaatgcaaacctggttccagcaaaatgacgtgagcgccttgctataagtgtcaaccagaattccttcccagctactgagagctttgactgtgcaacaaaatatgtttagcatggctctgtgtataatacttgacagatgaaagtatgaaacacagtacttacataatgaaaatgcaaatagagtagcaataagaagttcctatttatcagaaacatttagaactgccaatcatacatgtcctaattcaaaggtcttgaaccaggaccaaagaacctcaacggcacaacgcttaccgtttaataaacattacagataagtataaatagcgctgtaatttcacatctaagcattggtttgctaagactgcacaaaggggaatttaacaacttaggaaaagcattaacagtctgctgagacttacgagcaaaattttcgactcgggaaagcctcaagaagctcaaactgataaatgtcagcaggttatacaaagccatgcctttgcaaaccctttatttcgagctttcactacatgtcaggtcacacattgtggagtaaaacacaaaagttagtgggatggcattgagttagcagtatccctacttgtggtcttcgttgatgaatagacagtgctggatatgcataagctcatcaattagagatgaaaagaatggatcgcatcaaatgcagtatcggagacttagaatgttgcagcagaatacctgtttaaaaaatccatggattaaggcaacagtccacgttgtattcttgagatggttccggatagctcgagacagaaactcgttccaaacaaacattgtctcataaacaacttgcccagtattcttgtcagttatgttcttctgaaggctgcgcatgatattgtaagagtagctgaagaagaagtctttcgagagatcgaccgagcaaaggagccgtttatatctacaaaaagtgaaaggtaaaaatataaatatccgcagacaatagaaatgagaaaaactctagatatagtatatttagaatcatactaagaagaatattagtggatcaaagaaattcgaaacaattctatatacctctgaccttatgaacaccacacacaatgctcagaactgcaagaattgacgtatgcaccgaccgtatgagtagggtgcatattattatcaacaagaaaattgtatacttaaaggcaaagtgatattaattgcacacacagaacacctggaattgcccaggttcaactacaagcgtgaatatatgaacaaaaacttatctgaaagatatgcagatagacacacgcacacaaaagaaaattgtcatagaaaagaaaaacgtgaaatcaaggacactttggcgccgatagtgcacattgtctcatcacaatgtagcaaacaaatgaactgaaatattacgagaaggaaaactacaaaaggataaatgaatacaagcactatgatatgtccagatacaaaacaaagcaagctggcatctttcatattgctaggaaccagcgatggatttacaacaggcaaagcacaatatttacacatagaaaaaatgaaagacctgttctcatccctagaataagccacgttgggccacacaataggacttggaattgcaatcaattcgctcttgccgacagaatatatttcatgactgcagattgtaccaactttccttcttctggtaattagaaccatgtaataagggccaagaaattttataaaacctgagtaaagcaaagatggagtaaatgttataatttgaagttttgaactaccaggaagtttgatcaataaacaatggtatctcagttcctgtttcattaccaactattccatagcatttcgtgacaaatttcagtccaccagtcaatctattcccctcatgaattccccacagcagttcttggcattcattctctgtgtaacttgtatgatcttcctcgatttccagctcagtaggctccatcctgtcaatcttcagcaccctccatagagtccttgtcttgtcccttccgataagataaaatttctacaacaaaagatcaaactcatgtcaactcaacaaaagttaaacaagggataatttttagaacaactttagacatcaacactcccttgtagcaatgaaacagtcattgaggaagaaaaatagctcctataaattgttgctgtacaaatagagaaaccttggtttctgcatcacgaagctgaaagctaactacgcgttgaaaatcccaatatatatacagtaatgcacaagatcagctcaaacaatgtattttggcactagcatagcaggattcaattacacattcgtgggcaaacaacacggcggttcagcatccatcaataaacaaaatcttttttagataatgatgattaaacaagatcatcagaaagcaaatgtttaatctgcctgaaaaacgatagccccctttaagaaaaaatcccccctttataacctcttttcttaaacgctcttctcccctgcaaaagaaaacaaaaggagggatcttcccttacctttttgcagccttttaccctataacaaaaactaagcgaaccaatcataaaggagatccctcacacagacagtgaggacattaaatcactcaagaatctaatcaaccataaacgaacaaaaacacagccattataacaaagtaaagcgcgtgagcttcaattgctgacacaaagatctctccatatatatgaaacc

SEQ ID NO: 7528 - DNA, 11728 bp, Oryza sativa
  unsure (1)..(11728): unsure at all n locations
ggtcgcacacgtttgggtgaggggagtccatggtgttgcggaggaaggtttgggtaggaaggatcggcgagctcaaaaccggagaaagctcttcttcactgtgttgaatgccttgttgggtttcgaattcgtgtgatgatactccagtttgatactacagtaaaatcacatgaacccgtaaaatgtactaatagtacggtcagaattttgaatggattttatagggttcatatccatatagtctaagagcaattttaatagtatagcccactactaagtctaattcgtttatagccgatgtaatagtcaatttatacaatagttggttactagcctattaatatatgatcccacctgtcatacatatattgtgtcttggagtccgtacggcagcngnnnnnannnngacgcttcnccatccccatccccatctcccccccttcctcctcctcctcctcctcctcctctccctactcgatttgctgcggctttgcgaggctggagaagaagggtttaagcgagggagagagagagaagaggcagagaggaatggggttttgggtccttttcaacgtcgtggtcctcgtgggtcaagtaaagcagagggcaggcagagggaatcgaccgttggaacggggaggggtaaaacggtgaattcaggtcagtgggacgtgtgtccctgacaggtggggcccgcacattcatccgagatgtttcgtgcttcgtgcgatgcggagtacgtgtgcgcccgtattttcgggagaaaggaaagggcacgaaaagaatagctgggccggaaaagtagttagatttttttttatccgagttttgggccggcccagaaacttggtccacggggctaaatgtgatacgattttgctatatatttgtcgacaaattttctcctaaaaatttgacagatgtaattacagtacaatcgtagtgtaattacactgtaacttgcatgtaatcacactgtaactatagtgtaacttatatgtaactttcaaaaatctctttgtaatatgttatttcggtaaaatggaggttgtgggaacaaatccttacacatatgtttgtgctgtgatttttttttcttccttaccaaagcaaatcttgtaatagatttaacgattcaaaattacgtgaaacttatatacaagttacactgtagttacatgcacgttacaatgtaattacatataagttacagtgtgattaccaaagtaaagcgcgtgagctacaattgctgacacatagatctcttcatatatatggaacctacaacccaattcataccaaatcaaaacgatgagaatacaaaattttgtaagaggatccctaccgatctggtctcgtagagccggaacttctgaaggaatttgtctggcgtcatagcctccatcagatcagatcagctaagcgaaccacacgaccgccgcgaaattcaaaccaagaaaatcagaggggaaaaacaactcggcgtagttcagctcctcgtcggctgcttcaaatagagcatcctgctcgagcacaccaaatgctccagggagaaaatccaaccaaatctctcacctctcggatcaagaacgcaccaacaacgcccagagaaccactcagacagatcgaaatcgatccaattccccccaagatacccccagaaagggcgcacctttggatctccaatagatgcaaaacacccgtaaaatgggattaaatcgagccaaaatcagcgggctcgtcagcagcaacaagacgacgaaatcacgcgtaaaaacgagagctttggccgcccagaggggggaagagaaggatcgtaaataggagtaggcaaaattccctgtgcaagaatggatttttgtgagagatagggaggagaggatgcgaggaaggaggagagggggggaagacgatggccacaagaagcttgcgacgacgccgtcgtccacaaaaacacgcagagaaggggagaaaacgcgagagtggaagggggctaatacaaatcaatcaatcattgccgcaaccgcatctccttgagctggatttatatatactttcttctttttctttctttctttctttttttttttgctactagtgagcaactttgctttgttttgttttgtgctgtccaagaggaaactggtaaatgccatctttttgttgcatacgacgaggtaacagtgaacattatgagaaattcaggatgcagattttgttttccattacagagaataatgtgttgtttgtaataaatggataataagttaatagtatgtaaaaatgatgtactccctccggtttctttacagaggagaatgtgatcttttattgaatggaatataaattactactaggatatgtgggtcagttttttcgccgaataactgaatgactgaatagttgattgaataatcactattacgagagtaaaaataaatgaattaactattataatgttaaaagtagatttaaaatattttaaaaaaattatatatataaaaagttcttttctgaagctcgcacggtttagaagcccatgaagtataccactgtcgctcaatgcatccttaaaaaaatacacatcctacaagtagtataattaactgtcgacgataaatggaagttaggaatagctcaacacatctaacctaagtagatattgtatataaaaggtataattgactaaagcaatgatgtagtattcagaaacctctacttacagatctgaatctgaacttacttttttatttccatttatgaatgaggaaatactaaccaaaaaaaaaaaaagaactgaaaggcataacgcaagctactgaatagaatgaccagaatatgcttaggctggacttcaactaacagagcatcagagtggagtactttcaggtaatagtgcgagcatccatatggcattcttttattcaaatactgacaagaatgactgtgggttcatgcaagatgccatctcttgaaaaagtttgaagcacacaaaggaagtacttcaacttattttccttgtgaaaagctgcatatccatccaataataattagattaagataatccccttttcaatatgcaattgttgcagaatagcatgtaccccatgaagcatatgaatattccactaggaggaactgttcttaccaaatctatcattggcacaatttacggtctatcaggattcaggtataactacttaaattaaaaacgaagtttttgttccctttacatgtgtggagtgaacagcatcaccggtctattctccaggaccactcaccctttcatcacccaactctcaaattgcagcagatgtgttcaagaaaacgaacatcgtccagaatagtctaccaaattaatgagccagtgtacgtgcattttctttttctttcatttctttttttagtttttgatttggacaaagatcttatccatacaatcgaggactcactcatgacaagcagcaagtctattaccattagatattatcaacccccagttaaccacagtacttatctcaacattatcacatcactggcatcaacatcaccgtgcatgatcctaacccagctttttttttttacattaccttttaacccagctgcctgctggattctagacaagtgttgcatccagatcatctcggacacatatgaggcacgagatggttaatctcgtacatgcgtttgtcaaggcctttttgacacctcctcctcttcctcttcttccaatcttttgacctctttttgtgcatgttgttgttgcaactttgtaggcactggagagtgtgactttgtggggttaggtgtgtgactatcccttttccacatggatttcaaggtgaaggagaacaagtggccatgggcatggccatgtagcaagattgggtcactggtaagtagcaacagtgatcaccttgccaaacacaaagccatcatcctttatgtcccttttgggtaggtagctctggtaggaacaagtccacaattattatagtagttttacaaaaaaaaagaatttcagaaaaaaaataatgttcttgaaaagctgatatgatctttctgctacttcctatgatttctgcattgttcatcttgagcctcagcttgacataggattttttttagagtattagtcaaacctaggtaggtttagcagttgggacactgccttggctctatcctacatagttttagcggcccagatagctttgacatatactcctacggtcatagataggatagtagtattgtctcctccaaaaagaaacttactttttcacttgtccaaattcatgtgtataaaagtgaaaaattggatgagggatgtatactcagctgtcatagataagataaggcatgctcgactgcttgcaactacggctgctctgcagcagtcagcagaaaagccagcacgtatagttcttcgtaaaaaagatcaatcatctaaagaatgatgttactagatttatcattaaacaaactatcataatatataactccttttatttaaaacatcttatttttaaaatattattggttaaaatagcattttaaaaatatgtcgaagttcaaaaatacttatattttaggatggagggagtacttacatataaaatattactatctcattaaagtgatattactatctcattaaagtgaaatctttttagtactgaggaagtacgtgcatatgagagcacccctccaataaaaaaaaaaacaaatcctagctaggagttgcttttttttatagagtagtacacctgaggtcatctgacacattcatcagcttaattctcatattattgcaacattcatcagatcactctactagtggtaattaatgtgtaaagcagttgcctgtcctgctacacattgtctcacagaacagttcaacagagaagtcaaaagcgagctcgtacttgtgaatagtgttggccaattaatcacggagtcatggttttattggcatttagctcattagctggaccaattatttcctcatggagtgttgatttggtggcacatcaaaaagtcctaagcttagtggtttgatttgatcacacacacatgagatccacgaggtgtggagatgtcatgcttctgacgaggaagacgctgatgttttagttggctagcaggttaatgtttcttatgttcagattagcactatagattaaggtgaaaatgcaatggagtaagtgacaggacaatgcagagtatagcgctagttaagataggcctaagcttgattattgcaaaatgcaaatcatgtgttactcaccaaacatactgactagtaaattactaatcaaactgaaattatccgcatgctctagatataatagttctgaactagtacacatacaacttgaccagtttaaaaggagtttacaccccacatcagtcgataataaaacaatacattgacgttcatttcatagttaacttgagcgccacttaaactggtatgattggtcgattgatccgagtcaagtctcgtaatttaaccaagaaaaaatcatctcaaatgccaagtgaactatttgcagcccaacaaccagaacatgacacatgcaatccacctgtcagcagcctctgtatttttatggagaggtacccatctgtcagtgtcacttgtgctgaaattccacgcctgcatatgcttgcgtccctctcggatcgacctcttgctcaagtcaatacaggttggctaacctgaattctactaattaatgaggtgtttttgagtcgatacatccatgtggaccaggcaggctagtgtctccttgcaacaacttacgatcggttttcttagtagtagtattatgtataggaaacaaaataaaccctgtatcaatgctagagaactgtttctaggtacattttaagcaagcataatagtcgattataatttgtgacgaatacgggattatggagttaaaaccatacacccattgctactgtactatcttaaaagtatttattttcatctaaaataaaaataaaatgattcatccaagtagtatcgatgtactcgcagcttcaaattcatgatttttttggatttaggattcaaaatacctaagcctaaataatgtagagctgttgttacaaacatgaccgaccatagtgtgtttcttccaccctgattagagtgaaggcaactataacttctcttagactgagtttagttctaaactttttctttaaacttctaacttttttatcatatcaaaactttcctacacacacaaatttctaatttttccattacattgttacaatttcaaccaaacttttaattttggtgtgaattaaacacacccttagttaaaatatatggacttctgaccggtgttatggcacccaacagcaaagccctgttactgcacagcaacaatccggaccatcgttatttcaccatgtgctctaatcctaaagctaatgaaattaataactatggttaggaagcaaacatccactccgtacacacgtagaactaactaacagattctttgttttttaatctgttcatgctgtgtgtttgcattcaccccagcagggcaacgcatgcaaaacaacgcaagtaacgtaaccggtaatcacacgcaattaatctcgtcaatcagattagattaattacgtgcacatcatccgtgtccagagatgatcagtaaggctggcacgacaccgatatatacctatcgatggatgtcgttaatacgtgatgctgtttccatcgcttgcttaacgcatgcttttctgattaaatttattcagatcagatcagcagcaacttgatttcagtttccgatttggccttctcttggacgggatcgccggtgacgtacgtgccattcgtttaattagcatcacccgttgagtgattagcatgtttaaccagcatgtgattagactagttccgaccggattaattacgttaactgatcaagctaagcaagcttgtttctgattcaaacaccccgtcatgcatctagttgaggtaatataatccgttttccttggaacagaattggggattattattgctgacttggcatggatggattagctgtattcattctgaattggcgccagaagagagaaagagaagagcccagctctgaccgtggtatatatccaacttgatgagttcgtgcccacttgtgtgatagattatacgcataattttgctttcattaagatgctcctggattattataaacagttagcgttagctacctaccagcctgcaacagaagcatgcaggtatgggtacaaaaagtcagcttgtgagatcaggcttaccatattgatgaaattattaagttaactaacatgaggtttgcagtcaataggtgataaatgatactcctcctcatgttatcatttagggcctctctcaatttctgtaaaattacacactgtagcttttataaaaaataaattaaaaatagtattattagtaaatacttcctcctttcacaatgtaagccattttaacatttttctcatttatattgatgttaatgaataggaatgatttacattgtgaaatggagggagtataaattttagtgtttctagctccactcgtgtgacccgtgccaatccattcgtggttttatcaggagcgaacacatcgtgatgaatttgatggtggcaggccgctggatcggaggaagaacataaaaccaaccgatcgtgacttgatatggatgaatgaaagcttcgatcgatctcgatggataacaaaattttttgcttctcaatcagcgttgtaagtagccatgctctgcggctgcaacctgtcaggtcgtcatcggctgcaagatgggtttttcctttaccaaagtgagaaaaacgccatggttatcctatccatccactttgcaggaagcgataacggtgaacgctacaatgtttatccactggaatccgctggccgctgggccggtccggcaggcaaaagcccaagcgcgaaaccgcaaggtgcaagcccgcgacacgcgcgcgacaagggccgcaaccgcgatgagacgttggtttggaacaagttcactttaggtccctcttcttaaagtcgtcgagttcgaatttcatcgttgaaccacaatatcagatatgaagaattcctcaaccaataaaaccagtataccaaaaatctcaagatagtatgctccccgggtttggttaatgtggtaaataggacccacatgagccctacaaagcgggttggcttggttgaggaggcggcgacaagggctgaagtggagggcagtggtggtggaggcaaggtggtggaagggggcgattgttgtggcttgggcatcacgccgatggcatgagctagcagcattgcccccttcccctctgtgatgtgggcgggcatgctcagcgagtggcgggcagggggagatgggtggcaagctgtgggcaccggggagacgtgaggtgcagacgcaagcatgggagctcgttcagctgcctgcccttacaatctgctgcacccaccgcctctcttcaagtcggtgaccgtctttctccttgccgcgcgccttcccgtcaactgtcgctcctaccccctccccctggttggtcgccgccttactccacgacgccacaaccaccctaccaatccacgaccaacactcccttcctcctctagctgctccttccttgccgtagcatgtcgctccccacttccccagtcaccaccctcgttgtcgccttctttctccctgccctcttcaggtatggcaaggacgtccacaccctcgttgagtactccatcgatgactacctctaccccaacattgatttctataccttcctcaccaagcaaggcacatttgcattccttccttctaaatcaacatctttgcattttctttagattgatttgctcacaaattgaatcgagcagctttgatgcgcggttgttcatggggacgatgcgggggaagcgaatgatgttcgtgggggaactcgcggcgtcaatggtgggtggatccggagagacacaggggaaaagaagggtagtgattttttttatgacatgtgtgtcccatactaaatcagtcgggttgaccgaagtcagctcgtcacgttagctaaaacatgagagtataatgtcttggaatctttggtgcaccgatttttataagtcaaaggactcttcatatctgatattatggtttagggatgaaattcgaactctgttaaaataagagatctgaagtgaacttatcccagttggtttttgcgcggggaaaagtacacccaaggtccctcaacttgtcatcgagatacaaaatcgtcctcaaaccataaaaccagatatctcgcgtcccttaactaattaaaaccggtcacaaaaggtccctcgacggttttgaccccggttttatcctacgtggctgctgagtcagcgtgggacccacgtgggtcccacatgtcagcttgggccacgttagcctcctctctttctcccgtattctctccctttctcatttctctctcactcttcccttctcttctcaggcaagccgggcggcgctgctggggaggaggcccccggggcgaggtgggggaggaagcggcagcggcggctgcgatgcgggagaaggcgagggcgcacgtccgctccgatggcggcgagcgtcgtgtccgacaagtccggcggcggtggagcgagcttgctccgggcgtcgcgggtcttcttcctcgccatgctctcgccggtgaggcactcataccgccgcatccgcgcgtggtagatcagcgccagcatgtactggtcggtgtcgtacacgtcccgctccggcagcgcgccaccgctggggagcgccgcggggccgaacccgtcgttcatgacgagcttgcacacgtccatcgacctcgagtacagccggcagtcgcggacgatctcggcgttgaaccgcggagggagctcgtacatgtacacccgccggctgggcaccggtctgttgacactgtaattaggatagttgggttatttggtttgccaaattgctgattggttagtgatttacttaattaattgctttattgggaatttgtgtgctgagttaacaggtactacacgtgggctttgcatgcatggcggtgtatcgttgcctcgttgggcagggaaggcattgctttacttcatagatggcacagcctgttgtcacgaagaaccaaatcaatgtggtgctagctatagctactggtttgcgaagagacgatggagatggaggcagatggaggcccatacacgccgcaggctgcggttggatgggttttgcgtgaaggcatacgtgcgtgtttttgtagagttagagataaacttttgttagacgccgacgtgctccggtggtaggaccgcatgcggcggcgcgaccgccggtggctctgggcgttcgccggcgcgccgcgccccggagcaccaagaccgtgcgcgcccagatcatcgagcagtgcacgcgtcgccgtcctgcacccacttcggaaactcgccggggcggatcatggagctcctcaattccgcgtgttctgcatccagccgcgtggcgactcctatacccgcaagtcgacgttcgactccatgctcgccggctacatcccggtgttcctccacccagcgtcggcgtacaccaagtacacttggcacctgccgagggaacggactaccggagctattcggtgtccatcccccacaccgacgtcgttgccggcggtcagaacgcgagcatcgaggcggcgctgaggaggatcccggcggcgacggtggcaaggatgcggacgagctcagcattccggctgatcccgcctcgccccggcggtctcctccccggcagtgccagcaacgctgcttacctaagaagagaagggaagagtgagacagatgcggaagggagagaataggggaaagatagaggaggctgacgtggcccaagctgacatgtggggtccacgtgggtcccacgctgactcagcagccacgtaggataaaaccggggtcaaaaccgccgagtgacttttgtgaccggttttgattagttaagggacgtgggatatctggttttgtatctcgaggacaagttgagggaccttcggtgtactttttccttttgcgcgtccccgagacgtacaggccgtgtgaagaaaacttagcgaacggcccgcgcgaagcggcggaatcgcggggtcgcgcgcgaggcgaggcccgggtcggatcggaggaggatgtcgagccgggagatggagtggaagtggatcggagcccgtcgcggtgggatgatatggacgcgcggcccagcgagcggtcgcgcagcgacgacggcgatgtacgtggccggccggtgtagacatccgcgggaggacacgtacgctgctcaactcccaggccgatttggttgctgcggcgtgtgtgggtggtacaccggtacgcgtcgagggaccatgcagcgagacgtcgatggctcgcctcgctcgctcggccgttttcagttttcttctccttctctactagctacgactgtcacactgcgctgtacgtctctgcactgcacgatcggctgctggtgggaattaagccgaccgacgtcgacgtacgtgtggttgttggcgccttggccacgaacagcgagctattcacacgaacacgtacgtcacagatgatgcgcgcgcgtgtcgtcgggttcattaatgcgcgcga

SEQ ID NO: 7529 - DNA, 4079 bp, Oryza sativa
atatatcaggcacgtgcaggatatatatatagcactagtacagtgttcaaaagcgacataccaaacgcgtacatgctcacgcacgtacggaccagaccaggagtgaaaactcaacctggaccggacgaccgaccggaccacgtaccgtgggagcggctcgatcgatcggtctcggacgaattgaaatcaaataaacccaacggagacgacgacgaaccggccgttgcatatatacgattggattaattaatataatgtgttgtgttagttctctctcgtgcgtaatagtactactagtcttggtctttcggttgatcaaattaaagtccagacgccactagctactgcgtttcagctgtatatacaagcatatggtttcgtcgtcgttcgtgcaagttttgaaaatggaaacattaattctttcgttcgcgtgttgaatccttgacgtgagcaaatcttgaattccaagctttggaaaaagttgcagtttattaattaatttgagtgcaacatggatcgaattgaagatagaaacaataatttattaggaccagttttgaaattaatggaacggaagaaaatatatatgcaggaaattcacgtaccaccagcgtcgacctaactaacctacctagaggattcatgttgcaaaatttctacgaaggtacatcgatcttcctcctttacgtacattattttctcagaactaccttaaataaacaacatttagcttaactataacttctactaccttatacggctacgtcgtacgcatgtacgtatttcatcatttcttccaaatgtaggatggcattcatgcatcttaatttcgacgcagtttctatcctatttctagggctcattccctagctagctaaatatatattttacaaatacaggatagtagtacatacttcttttttttagatggtatcgttggtttttagcatagggtttcaacacttatcttattaaaataaatttatataggtcttatttattttgttggcactaattactttattattatagaaactttaagcatgatttataaaaaaagtttttatatttgcactaaacttttaaataatatgaatagtcaaatattaatctaaaaattaacgaagccatctatttagaaaacaaaggtgttgcagtttaattcatcactggaactataaatgtcaattgcatgcattgctgatgaaacggtacaactagcctacaaaatatagtttttctataactcacgttttatttccatttcagaaattaaacaaaaagctcaagatttatcgtacaattagatgaattaaaacggtttttcagatctctagcataacacctgttgctaggataagatagataggaaatattttgacattcataagttggagtacttacttgttttttttttggataatgggaatggcttctacaccaacgggggtgtatatatatacaaccattggagtacttagttgttgggctctcatatgtttagccattatcggctaaccgatttactaattatcttggtatccacatcacttgcaacgagtttcacgaaatatttgcttgaatttgacttagcaacggtggtaggctccaatgatatggctcctgttcaaagtttctcctcttagttgtatccacaatatattgttgacgtacaaagttaaaggtaactatttacacgtacgcaacattaattaatcatggaaaaaaaagaggaaatatgcattgtattggaattaagtagatgttctgagtgtctaaatacacatataatgcccataattatatttttttatctattgaaccttttaaatttttattttttaaaataaactatataccaaaacttccaaaactaatcttttggccacaacagctaggctagaataacaaaacaacatgcctaattttgtttcatcatgccgacttgactgacgtgacaagggttttgtgacttttgtcataattaaggcgtggcaaaacaccgggggcgtaccatattgttgtttcaccgcttgacaatcaaaagcaaaagcaaatagcttgattctgaaagcagattcgtagaaacgaggcatggtttctaataaaaaccaaaagttagcaatgaagctgcttttgtggggtgatgatgttgatctaaaactatcactagaagtattatataaattgcacatttcgcatgtttcaaaatctgaattcacaatcagattttaagaatccaactcctgaaaaatcacaatccagagacaagattgtgacaataaaaaacaaaaataaacggaataatgtaagtaatgggtttgcaagatgatgtgttcggttatgtgcgtaaattaattatggaacggtcgttcagtgcatgcatctcccacagccaaaaattaaattttaaaacatggtattagagttcattttaaagttttttcatcttagttcattttcagtattgacttttaaattactaagaaacacatatgtaaaaggtgtactcataaattatttttagttacttttcttttacggtttatctccatacagtaaacgatgagaagcttagctgcttgccttttcagaggccaaaacgactaattaaactgcctaaaaatttaccatctgatagctacatatgcagattattggtggtcaaaatcatgaccgattgacgccacaacatgaacgggcaacttgaaaaaaaaaagaaaagaaaaacatggtgtatatatacattcatgaaacctgcctagaatagatgatatatatatatatatatatatatatatatatataacttccttaacatctgactatggtgcaacaacccgaaagggagagaactataaaatatttacagaaggaaaaaaaaacatataactaccaagtaccgactaattgaagctagcattattgtggtcaactcttagttaagtgctactctagtagtttgtatacatagtatcgactgtttgaccattttgacttggttggtttgtattttaggtatcatatatgcatcttagaagctattgacttgacccgtggaaaagttcaaaatgccatgaattgttttcttggctgttggttgccatttgcatttgattaaaaaccaatcatactcccagatcattcataaatattgaacaaactaataaatttatccttgaatttaaccaatgtaagaaatataaaacagaacagtatatggctgatccatgaaattcacacgtacagaagcgatcgaaacaggcggatacgatttcagacaataaatgaattttattgaatttcatcatcagacaaaaaagaatgattacaaattaagaggtttggaaaaaccacctttgatcatgcacacatcgatcgtacagatcgtacatacggacctaacttacatggtcccgttcttggatatgatttgattcctctcccggtcgcggccgagaccagatcgtagttcgagtcctcaccaaatcaattccccagttcacatgacacatgaacacgacctaagctagtcctccattattattaactaacaattaattaatcagcccttaataatcaattaacttaattacttttataaacaaataacgaatcttattatatcattttatacgactgaattaacggtatcttgattcggtgtacgggaaggatggacggccaggattggctactcttccttgtagtcctggttgttgtagggggcgaagagctcggcgaggaagttggacttgcggtggacgcgggagccgaggtcggcgcacatggcgtcgctgtcgtggatgctgtaggtggagatgcagtggcggcggtagaaccgcgtcgtccgccgcatcgcctccgtctcgccgtcgacgtgcctcaccatctcctccaccgccggcagcgcgaacctcccccccagcagccccgccagccacctgcacctcagctccgacgtgtgcaggttcgacacgctctccacgtaccccacgaacgccatgttcggtatcagcggatgaaaagtccccctacacccacaaaaaaaaaacactcatccattagctaattgtgcg

SEQ ID NO: 7530 - DNA, 1683 bp, Oryza sativa
gctcgaccacgccacgggcgtcgtcatcggcgagacggccgtcgtcggctacggcgtgtccatcctgcacgccgtgacgctgggcggcacggggaaggagtccggcgaccggcaccccaaggtcggggacggtgtgctgatcggcgccggggcgagcgtgctcggcaatgtgcacattggcgacggagcggagatcggagccggtgcaatcgtgctacgggacgtggcggacggaaccacggccaagccgatcatcggcaagaaggcggagccgcaacgagagcttcccggggtaaccatggagcagagatggtcggattgaatggtttgagtagcgtgcagtgtgaacgcgaactggttagtacaatagagtttccctccaaaagttattttctggtgatgactactcttgtaaacctatatacggagtactctctagagattagacaagtactcaattagcattgagccatttcaaatctttttttctttttttttctttttctaaggaataacgaaaaacgtttctgatcatctgttgcctccttgtaagtatagtaggagttcatcctctcatatgtgtttttttagagaaggatattttttacctggcctttatatccaaccggatatatgcagccattttaattaggaatttagcctattgaatagggaatttagtcttatcctcttgtatgttcttctgctgaagatcatagtatttttcttcttacaatgtgaagtacggatgctttcttaaatacttgagtagtacagattgatagtacataccgagtactacagtttctgattctgaccaagtataatggtttgacgaaaccctacgtgaaggtggtcaactagccagtagatgagtagtggataagtttattaacttgactagagcacaaagtatagtagcccaaacgaaaacatgaccactaaactgtgaacgagttgcataaatatagccgcagagaacacttccttcaagacttcgtccaaacaaatcggctaaatctacagcctttttcgtgtttacatcgcagacgcaaataattgacgatattggtatcctgcgaactgaaggacgtcaggatagatacaagtggatgccagctgtggttacccgacgaaagggacttttgtgattagctaactcgatgaggctctctggcagcaaagtcaactttgatatccagtaatctattgctggcggaaactgcccttgtgtccgcgttctccaatatgaagtcccaaggaatcgaatatcgagtgcttctaccatgattttccgtgcttaattttgatcatctgtcttaattaaaaaaattaaaaaaaagattaaaaacataagtcacaggtactattcatatttcatcatctcataataataaaaatactaattataaaatatttttaaataagatggacgactaaagttagatgaaaaactcattgttgcttaaaataagacagagggaggtagatattgcttgcggaaactgcccttgtatctgggctcaccaatataaagtcacaaggaatcaaatgcctccagataacggtacagtccactataaacttatatagctcatattagttaatactccgaccgcccctaaatataagggattttggttggatattatacatcctagtacaataaatctggacagggat

SEQ ID NO: 7531 - DNA, 14294 bp, Oryza sativa
aaaatcccttatatttagggacggagggagtatgtatagtagatgagctataaggttatctttatttttcttctcttctttatattcctcatctatgtatttaatgtatttatcttgaagtgtgtgaatagctaacttttgcataaaaatcgaccgcttcattttttagattctctcttctttacataagtggtttataacctactaatagtattaatcttgttctaacatgtaaaatgtaacctctacacaatcttaaaaaaaatggaaagagaaagtaaaatatatagtgtgagagtgagttagttaaagaagattttggagtttgtgtgctaattaagcggtaacatattatacaagttgccttttattgatttagagcaggtttaataatgtcgtaaacttgctaaccgtaaaacatccacatcatctatagcacattagtatagattgctcatataacaatggtctttattactatcatttacggtaacaactgatatattttttaattgatacatgtcccactaattactgcattcttcactattgttccaagcatgaaccaatctccaccaggtttacttctctttcttcattgtacagtgtgctgcagctgggtgataattgtatcgtcggctcgcgttctctctctaccattttctcctccagcacagcagtggggctgacttggttacgctatcactgatccaggttgacctattagacatgctcttatagatagcatagttaaaagaaaaaagtacgaattacaccccccgacccgaactatcgcgcttgaccgaattaccttcttgaacccgaaaaccatgcattgctcaccctgaactttcaataccggatgaattaccaatctagagcggttttatcctacgtggcatacgcgtggcagtccagtcagcattttttttaaaaaatggtggggtccacctgtcatgcctccacttcacctcttcctaatatctctctctctcttgcgcgcgggcgcaagtgcgcacggcggcgtggagccgcgaacgatggcggcgtacatgggcgggtggtgggcggcagccgcgaggcaaggaggtagcattgcccgcagtagggatggcgacggggagaacgggccgagcgcggccgtcgaggtggaggctgcggcggaggggggcagcgagaaggtggctcgatgatgaacctgaggagaaggacacctcctgcatgacgaccggcgatgaaggcggtgagttcggccggtcggtggtgaagccgaaggcagagcgtgtcatttgcgccaactgcccgcatcgtccttccagatccgcgcggcctccgcccccgtccgctaatgtccggtctcggggaggatggaagggaggtggcgccatcgtgagatacaaccacggaggaggcggggacgacgtcaacgtgagaggcggagacagcagtgccgcgatgaaggtgggagagcggaggaggacgaggaggaaacgatagcgagagcgaggaggagacggcggcggtgacaaggagaaggggcaacgatggaatttcacggtcgcacggaggaagaattggactacggcgtcaaataaaaaaccgattcaggattgaactacaacgtcaaacaaaaaaataatatggagggagtaattgacaacagagaagacattactcacgtgagaaaatagagcgccattgacctcaagcgcttgaggtgccgttgccaaaggcacggttgcgtacgatgtcttggggaaagtggagtgcgtgcgcccagtatcagagcttggcgccaccacctcagatctatgcttcgctgcctcgctgcactggaacaacagaacgacaacctcgctaagccaaactgccggttccctccgaatcaagtgctagcaggccagttcaagcgatatgccgatacgttgtctcctgtctacagtctccacgcagcccctcaccatctttcatcgcgccaacgccagcaacgaagggacaagagaggaatgaggatggtcgatggcagcatgaggaatgaggatgcaaggggagaaagggagctagcgtgacctaggaaggaggaagacggttatgatgggctagcgtttcccaaggggatgggaagggagagagagaggagaagggcggcggtaggctagggtttgcccgagctccttgtgaagttgagattggagagagagagagaggagggtgtgggtgcggggatatcgtgtgctactgagctaacgatcccgacgatcggatatcaatcggatggccaagccaggcgattgaagagagcgctccaaattcaccagccttccagcgcgggcggaccgacatgtggacccacgagaaagtatggcccagcgaacagagaaagaacggtatttttttttgcgtaaaaatcccatgcgccatggcaaagccacgtcgtgctgaaatccctccgaacgccatggtgcaagcagatcgcccttacttttaattaccccgactagacattttgcgcgcgttgcgcgccctatcaagggtccaatgaacttttaccaataagaatattgtgagaataaaattaaagatctataatctctctgatagagacaaaaatcatgaatttctatggtaaatagagtgagcatcgtgttgtagttatgctaacaaatttttttcctaaaacacagagttggtatatctagacaaaattaacatgaacaccatataacagcttaaaccatcacgtaggctaaatataaatcacatagtgcatagcataattcatcaattcagcttgttttcttcacatcctattgaagagggtataagtcatttaataacatgtaagtacataatatacatcgatacttaggaagtgtaatatttctgcatgtcatagtcagacaatcatatcttaacaatccattttgaccaaaagtttaaccaccaaactgtccgcacagaagaagcatatgttagacaacaaagtaaaccatactggggttaaaaaatatagagtaaatttcataaaactacatatattttgcacattctatcacaaaactacagatttaagaacttatttcacaaaactacagatttagtgtctacgtttatcacaaaactacaggtactttgcacaatacatcacaaaactacagatttaagaacttgtttcacaaaactacagatttaatatcttcatttatcacaaaactacaagttcagtgtcttcattatcacaaaactacatgttttagcattgttaaaacctgtagttttgtgataatgaagacactaaacatgtagttttgtgataaaagaagacactaaatgtgtagttatgggataaacgaatacactaaatctatagttttatgaaacaagtttttaaatatgtagttttgtgatagattatacaaagtacctgtagttctgtagttttgtgataaaagtagacactaaatatgtagttttgtgaagcaagctcttaaatctgtagttttgtgataaattgtgcaaaatacctgtagttttgtgaaatttactcaaaaatatatctcacgaatttaagctagataacatttctcaagtacctgaagaccatgtgtacaataaatgatttattcatgtgcattagatatgctcagcagcagccagcaagctatacaaagaaaatatcacattgttcatacttctttgaatggcataactacgatatttgtaacagatagcagatgtttcactcactaaatcaacagtacatagaaaaaaaaaacatagctaactaactacttgaaacaactgtttccgaaggaaaactacaactaagcactgacatgatagctactaaacacaaaaggcaaaaactcaagttaaaatcatggaatacttatcacacatccataatgtattttttaatagtgccactgctaatttccttcctatttcattcgacctgagaactcaataaactaatgctgaaatagttaaccttccacaaatcaggcattcaaattcatgcaaaatggaaattgctcaagacaaatgatggaaactgctatgttattttacgaatatccagacaacgtgttgcagtgagacattaaaatgctatgcagattcagggttgccataattaacttcttctccctggtaagacctcgtcaagcaaaagccaatcaacatgagctgcatctgaattcaatcaacaatgttagaagcagttgtgttcgcctaatttttctgaagatcaatcttgttatctgttagagagtaacaatagacccccactaatttaagtagcagttaagaacaaaaataataaattcagagagaaatgacaactcccatctaactctgcttaccttgcagaagcacaatccaattattcattgaatcctaaacctacagcaggacactactattaatatgtagtttaaatcattagtactttgttcactggaaattatgcaaaatcatagatggattattgatatttattgaactaaaagcatgatacataacattcttgaacttgggtccacattcaacatgaattgctgtcacagaaaaaggagaaaaaacagagtatgcattctgatgtggctgccttgccttgccatctaatgtattctgatctggctaccttgcattgcgcctgacaccaatcaatggaaaccatgacactaagacagagagggccatctcttaccgacaagaaggaaccatatcggggattgcaatttctctgttcatctcgaattgcaacggaggagttgcaggtgaatatggcagcgactgtgccatttccgtggtccatccaagatctcatcgaacctagtatttgtgcttctacacctgccatccctaatcggcggaggagatagagctcagctgctcaggaggcatcagcaacggtgaggaggcagccgacagggggacagacgccagcgatggtccactgatccggcgaagcggccgaccgctcgaggggacgtaatgtcggcgcggggcttgctggtggtgacggagctgagcgtggtgctcggcaccgtggtcacgctccttggacccgtcaaccttccctccaccagcgggcggcgctcagccagacattggtgagccgctcgagttagaggcgggcctcttcgtcacgggcgacagcgccggtgcgaacatctctagccctagccatctttgacgaccccctccaccatcggcctcgctgtggaacgtcttttctagatctggacaccatgtctcctcccgatctgctcttcctcgacctcgcggcttcggaccggtgccatcgtcgtcacctccaccgccgtcaacctgggggaccacgccggcactccatctccgactcctcgccggcgatcgatctcctgacagaaggggatgtgcaggccggctgcaagagcggaagagaggcggctagggtttgggagggtggggtgaggggtgggcgccggccgccaggtggtagggttgttcgtttttacaaaaaaggccactcacttgttgttatttaaagtgcggcctatttttcgttttttttctcttcttagcataagatatttcaggtcttggagggccttaaagtaagaatacagaacacataaacgaagacaagggacttatcacagattatcaataatagcaagggctttttttgtaaaacgaccagagtcaacgcgggcctcccgctcgctcgtgaaattcggctgcctggagtttcggggccgacgtggatagcacgggaaacggccacgcctatgcaaaacgctatggaggcgccaatccagggcaggtttaaatttaaccgctgtctctaactctatcatattaaatatcacgatcaaggacaaggtcacaagggccatcaagattctaaaattttatacacgtatactagggcctatttgaaggaaatctacagcaattagttgcagtcttgtatttctagacaaactttatgtcaaaaatcatttcaagaccggaagcacaccagaaataaaactagtgatcattggatcagacacacagtttgccaactacaaacagctatcctcaccacaacaatcatggagattcactctaatgtagacatgtattgcagttcactgctgaaatgaattgagacaaaaatatcaatgtatcatgaagcactatattcccccatagaacatcatacccccccaaaaaataccatgtgcattcaatgagaacatacctggaaagctcaaagcaaggctagtgcaacaaccagctattccagcattaacaactgcaaatgaagaattcataattagtgctatatattcaactaccaagatgttacatctaaaaaactagcacgatgttaacagaaaatagggaactaaaacaatgcacatactgtcatctttgccacgcagccttctcaacaggcacacaactagacaatggacgccagagagaactgcaaaactttgatccgataaatttatgttatgagcaaggtgtctggatgattttcatgtacagaagaactgaattcacattatcaatagttaaccttggcagaggaccctgggtgctgaacaagcccttaaatcccctcttagtgaacaaaccttgtcctgaataaagaatccagtacagaacataaagattttacacgaggaaaataactagttgctacaaatggccttaactaattcacatgtctggtacttaacaagattaatagcatcttcattgacataaatatcaaaattcagatgaaggaaccaaagattcctcacaagatgtgctattatctacacattctagatttattacaaattcttacagccatactaggtgagtttgaggagaaggggattgagaagattgggaagatacgcaaaacgaggtgagccattaccgtatgattaattgagtattaactattttaaatttaaaaaatggattaatctgattttttaaagcaactttcctatagaaaatttttgcaaaaaacgcaccgtttagtagtttgggaagcgtgcgcgcggaaaacaaaacaaactatctctctttctccagctgccgaacacagcgtaagaataggttaggaatgaacttcctttgcatgacatggaaaggaacaaaatctaaaactagaaaaagttcgtgattacaacaacatagacaacatgggcagcaccggaaacacataaacactgaaacacaagggggcaacggagaaattgggataataccatatccaatggtagacaccaaatgaactgttggtagtggatgcatgagtgttgctgcactctgaagcacggtagacaaatcatgatgactaaaagcaactgcgcacattgaaagttttattagcatgcaatttgtttattacccagttagaagagatgcaaatagaaagattgcgttgttatctttttaaaatgaagcgtagagaaaaaaatcacagtaactaaagaatgctgggcattcataacccattctgtgcagttacaaaacagaaggtaggttattggtcatagtctctgccatcttcgtaggaagaaataccagtacgaacaaaaggtacattattgtgaagaacaaaaacaacagaggccacagaggtggtgcatcttttgtagctatacaattacttgaaggatggtgcaacaagaaatcaagcttacagaaaagggtaggtcttacttaggcctaacagtctagcagccaggtatttacttgctgtcactgtacaatatatggacatagcaaatagagcataattaggcataattactgaaacaggggataaaaacatttaaacataaaagggggaaaggtctatacatccatggtggcaaaacctgggaggtaattagaaattctcacacggtacaggggaagtattaggtggatttgtagtgcaattgataaagtaggcaacccggctgttcagggggtgaaatggattttttttttctgtgacagtctaaaactgacgctctgtatagattgttcatggtgtaaagtaataactattctctactaacgagcatgtccaaattgatgatgggttagaaataagaaatattacactgcccagcacaaacaataagctatcattgatgatgagttataatgcaggcaagaatagccaaaatatataccttcttacatagcttgaacacgactttgtccagaaggcttcactaactcctccctgtcaatcatcatcctaactctctttgcatcctcaaccattccggcctttgcatatatatttgacatagtcacaaaatttccagggttatctggctccaattgaaccagtttctcaaaagcgatctgtgcatgatccacatcatggtgcatcctacttccagataacaaagcaccccatacaactgcatttggtctgattggcatctgatcaataaatccagcagcctctctgaacctcccagctcgtgaaagcaaatccacaatacaagcacactgctccatagtagggatgagggcagaattttccacaaaccgctcaaaaagcgcaagaccttcatcaaccaagccacagtggcagcatgccatgagcagagttgtgaatgtcactgaatctggctgcatcccacaacgcaacattgcatccacaagttcaagtgccctctctccatgcccattctttgcgaaagcacctatcatcacattccatgacacaacatccttccgttcaatctcgaagaacacatgttctgcattgtcgacacatccaacacgtgaatacatgttcatcaacgcattccacagaattgcgtttgaaccactatcaccatggtttctcaccatgtgcccatggacctgtcttccagactccaaatcacaagcccccagcacagcaaccgcggtacgggcattccctcgaacacctcttgcgcgcatctcccggaagcaatcccacgcctcgccattcatcccggcaccagcgaaccccccaatcatcgcgttccaggacaccacgtcctcgccgtccatacgatcaaagatcctcttggccgcgctcaccctcccacacatcgcatacagcgcgacgagcgccggccggccgaggcgtagaaggccagcagtggcgcggtctttaccccgtaggcgtgcgcggcgcgaacggggagggaggcggatgcgcggcggcagcaggagacgacgcaggagaggagctcggcgtcggggcgggcgaccgcggcggcggagaagagggagagggcctcccgggggcggccgtggcgggagagcgcggagaggatggcggtgtaggatccggtggaagggtgggggatgagggagaaggcgcggagcgcgcaggggaggaggccggagagggagtaggcggagacgagggcgttggaggccgggagcgaggaggggaggacccccagcttgagagcggcggcgtgtagggtggagacggccggggcggcggcgccgggggtggtggcggcggagacgagtaggcgagggagggagagagggtcgacgggaagagcgcgccgctcgccggcggcgggggccgaggtcgagcacctggcgcgtccgaacattgcgcgctctgtaaatcccgtagattaccattccatggctttccacgttaatcgaacggcttacaatcaccatggaaatgccttcgagtgtttgacgatctttctctcttttgattttctgttttaacaaacatcatgatcaatacatgaaaattcgtatacgtaggaatcacaaattgaaatcggttcctatcaaagaaaaaaaggaatcaacgattgaaattttcatattggtgtagttttgcattgtatcggatagcggggttgatgcgacaactgcacggaaatatattggttgtattatagtaatgttagtttcattttaaattaaaaaaatgttattgataattaagacttcaatcctaaccgatgaaatgggatgcaatatccttttctcgaatgcacgtgcacgtagtcgtaccaactctatcactataaacacattcaaaaatttaggttagaagtcaccgcaggtactacttaccacgaaaaaaataggctagaagatatacccgtctaataaaataatcactggccaccgcaaagcattgtttaccgagaaagacatgaccaatttattattgcgccatttcccaaaaactagtacagaaatcaccacacattaccatatgccgaattcatatcctctactcagcattatgccaaagttatgttgagtagaggagactcaaacattgtcagacatgttgcaccataagtaacctagctaattaattgatacttaattcattcgtagaaagtaatccatgatagacacaaagtaatctatgatagacacactacatgtaaagaacacgtaggccaaaatctcatatttctaattaacattttccccatatatatatatatatatatatatatatatatatatatatatatatatatatatatatatatagtaaatttgtttggtgctccatggtgcccgggcaccattgttgaaattgagtatatacccaattcaaatgagcatgaaactttttcaattatttaggtattaatattaactactttactaactagttgaaagcaagtttgaactgaatttgaacttgtttttgttagattttgattctaggtatatagcatccatacatataattagttaggtatgtaatcatggattgtgaaataaagttaaatttgagttgttttgttgataggtataggtatgaatcgaattcttataactaggtatatactcacaatttgaaaattttgaaaaatttaagtgattttgtgcatttgaaaccatggtgcccgggcaccatggtgccccatatgagtgtcctatatatatatatatatatatatatattataacacggccgggaggaggaaatgaaaaaggagccatgatgagaggaatagacagattacttacatctatctaccctaaagttcaacaaatactttcactcattctttcattcatcactcaatggttcagattatccctgtgaaatccaatgctccagattcaccctccccacaaacgagcgctcccttcccaccccaaccgcgcccaaacctcaccatcacaccgccccgccacgattgacgtccccgctgaccccagcttctcgtagaacgctaaaccctaacctcccctctctccccaccgctcgaggtcgcgccctcatcgctgctgctcgtcgcccggagcgagcgatgcggtcaccggagatgagcacaaccgctggggcaccacgctttctcgatcggaggccagcaggatggaggaggttgcgggagagacgccgacgccgtcacacgctgttgatccgattccttgctactagatcaggatgcagtcccttttttttcgtaatctgcatgtaatcctagggttggaggaaaggcactgtggagaggagaaaagtgagacggggtgccggcgtgccgatgcagacgagtggccaagaataggtaaatagctctgttctattgctagctagcttttttttttacttactatgacaaattgatcgatctccctgttggatttttattaattctgattgaggaatgacgttttgttttgaacttttgtgccgtttgatttgcaagattactttgctagatttagcaattgtataatattcaaaacagaggctttcactatcactaattagagagcagaaacagaaagaatatagagtcagagttggtgtaccctgcaagtctgacgattggattgtacatgaactgcaatttgcatttcatgctactatggcattatgctcagtgaatcttgctgacttcctttattcaggcacaagtaatttgtgtcggatgatcaattctaagcagtgtctatgtgaataccgtttgaacaaggagctgtgtgggtttttaggattcaattctaatgaagccaaagaaaatatcttgaagatatttttcaggttattgttgtcttttgtgtccttcagagatggggattttgtactaatttagtcactatcttgatatacctgtgctgctgctacccataatactaaagtctgcctagataatgattttcaaactgcattgcatgaccagaaatattatcagttaggattagattgttctcaaggttttaatgattgtcacatggatagttctttctactactttcactatgtaggtgcatatctatgggagtaatatatgttccatgtgtgtctgcatcaactaaaatacctgatggatgtacatgttcattaggaaattagagctgcaacaaataaatttcatgatttttgttcccaccatcatagtaaatttcatgtgatatagaggaatagcaagctaacacacgttcttgagattctttaaacaatcaattatttacttgttggtaaatcatgcatctacagttagatttgtggtttccgtgattacattacatcacctgaagtaatcaacagatttgagcattttgtgtatgcaagtagttgaagaatttcaccatgttctgcatgatatgaagtatgaacattatgctagagttactgtagatcctggcatcacagtcccttaggtttggtaaattcaaatttaccatgttactaagacatgtacgataatttacaggaatatgaaattatttttagaccaaatatattacaacaatatatataccgttgtttggttttgagacatttgaacttattttgctaaaatatgtatcttttagcatatgattgtttaattcacattactaaatatcgccgtagcgttagtacgggcatattaccagttccaacaattggccatgttttttcaatggaattttcgttaaccaaatgaaggcatcaaattcctgtgtctggggtagacgtactaggacaacacgaacaggaaaatacgcacagaacatacttcctccatctcaaaatagataaatcaactcttgtacactagaattcattcatgtatatgtatatgtaaaattattttgcttgaccctagtatgaaggtgaaatatatttaattaaatccgatccagagcacaaaatgagaagtgtttttattcataaatttctatttaaaacacacgagagtcacataccctatcgagaaggctgtaccgtctggacctatgattaaccatctggagcgttgtgctgctgttcttattacaaccacgccgaacctcgacgccggtgaacaccgcgaatttctcgtcgaaatcaaagttggacctccaccctttgtacatgaatctgacaatgcagaacctgccggcgccgagagggacgaggtgcggcgtcaccggtgagccgctgggcgacacggggctcaccttccacacattgcgccgcggcggcgaggtcggacgcgcacagctcgttgccgtcggaggagagcgcgaaccagagcttgtgctcgggcgcatactcggcgcggcctctgaacggaagcaaccagtcgccgagcttggtccatgtggcggtggacgtgtcaaaggagtaagtccccgcggcggcggcgacggtgctctgcactgtcatccagatgcatgagccgccgacggccgtgtaggcggtgaggaagtcatcatcatcttggaaaaagttgcggatgctatcaagggcatcatcggcggtgaaggcgaagggcggcgaagggaggaggcgccagtgccagtgcggcgtggcgaaggggtggtttgggtggcgatcgtggacgagaaccttgaagcaagaggagggggattgggaggaggccgggtacctttccatgacgtagatgttgcctccgatggtgagcgacaccgggaaggccttgggtgtgttcatcgggggaaggatggtgacggcgcgcgaggcggcgccgtacagcaccccgctgccgctgtagtcgacggcgaccacgtcgttcttttcgccgcctctgccgctgccgctgccgctgccgagaggcatgaaatccacggaggagggccaactcggaagcccgtatgatgggcaagggtggaagatcatggcggcgcgaggcagctgagcgtcctcgacttccatagcgccgccgcgccgcccttcttcatcctcatcggcggcgagcggacggaacagcgtcgagacgtcgacgcggtgcaggccgtaggacggctgccgccgggcgatgccgtcgagcaccagattcacaaatcgccgccgactgttcattctcgccgccgccgccgccaccgcc

SEQ ID NO: 7532 - DNA, 1793 bp, Oryza sativa
gatccgatcccccggatctaatctaaaacggggacgagaaagagcctggatgaaatcgtaaaaggacgaagggaaagtagtactactccccttgccttggtgacggcccaagaggaggccggagagggagtaggcggagacgagggcgttggaggccgggagcgaggagggaggacccccagcttgagggcggcggcgtgtagggtggagacggccggggcggcggcgccgggggtggtggcggcggagacgagtaggcgagggagggagagagggtcgacggggagagcgcgccgctcgccggcggcgggggccgaggtcgagcacctggcgcgtccgaacattgcgcgctctgtaaatcccgtagattaccattccatggctttccacgttaatcgaacggcttacaatcaccatggaaatgccttcgagtgtttgacgatctttctctcttttgattttctgttttaacaaacatcatgatccacacatgaaaattcgtatacgtagggatcacaaattgaaatcggttcctatcaaagaaaaaaaaggtgtagttttgcattgtatcggatagcggggttgatgcgacaactgcatggaaatatattggttatattacagtaatgttagtttcattttaaattaaaaaatgttattgataatcaagacttcaatcctaaccgatgaaatgggatgcaatattcttttctcgaatgcacatacacgtagtcgtaccaactctatcactataaacacattcaaaaatttaggttagaagtcaccgcagatacttcttaccacaaaacttacctcgaattaaggcacctttgaaaaatacctgtctaataaaataatcacaggtcaccacaagcattgtttacccagaaagacatgaccaatttaccatatgcgccatattaaaaaactagtctagaaatcaccacacgttaccatatgccaaattcatatcctctactcagcattatgccaaagttatattgagtagaggagactcaaacattgtcggacatgttgcactataagtagcctagctaattaatttatacttaattcatccgtataaagtaatttatgatagacacactacgtgtaaagaacacgtaggccaaaatcttatatttctaattaacatttttgcatatatatatatatatatatatattaaaatcaaatagctatatcaaccatgcgaactaatgagcaccctcccccccccccttccccgtaatggaacttcaaacaactgccagcaaactctccccagcttgatcattgagaacactcaaccgccatatatcaagcaaaccatatcatatatctagctcagaagatatttggtaatttaacactccttaatattggtttcgattatttgacatattagtccactttcattcatcttagatggttctacatgttatcctcaaaagtatcaattgaagcaacaggacaacgaaaaaagtgttaaattatcatttttttccaagtttggtaggtaaattgttctaaaaaaaatgtttgctaggtaaacattatgttttagagtacaacgcagagcagcatgcgactatgtcctcgctcacaacgtccattttgcaagtagaatcgtatcaatttgacagtgttgtaatttgaactcaagaggattaatttcaaaacaacgtgccaatctccacgtgctcccagcaatgacacacgggtttgtcacgtttcccaaacttagcccatcaaagaaaggaatagaccggaagaaagcccatcacgactcg

SEQ ID NO: 7533 - DNA, 507 bp, Oryza sativa
agtactaatgcattttttttctttttaaatgctcagtgggcaaggagctgttgcaactcaggtacatcaaacatcaaggatcaaaatttatgtgcaactaagctagtacctcttttactgcaaaagggtgtcctcaggactaactgcatagactgcttggaccgcacaaatgttgcacagtttgcgtatggcttagctgctttagggcgtcaacttcatgtgctccagctcaatgaaacccctacaattgaattgcatgctcctttggccgatgatcttatggatttctatgaacggatgggtgatacgctagctattcaatatggtggctctgctgctcacaacaaggtacttgcttaattctatttactgactcgttggagcataatttgtgcttcctctactgtgtaatacaattctcaaacaaatgcatctttcattaaacccttcttcatattcttattcaattgtcctatttttgtttctttcaaagcgatttttcttctt

SEQ ID NO: 7534 - DNA, 617 bp, Oryza sativa
tcaccatgcctttgcaaaccctttatttcgagctttcactacatgtcaggtcacacattgtggagtaaaacacaaaagttagtgggatggcattgagttagcagtatccctacttgtggtcttcgttgatgaatagacagtgctggatatgcataagctcatcaattagagatgaaaagaatggatcgcatcaaatgcagtatcggagacttagaatgttgcagcagaatacctgtttaaaaaatccatggattaaggcaacagtccacgttgtattcttgagatggttccggatagctcgagacagaaactcgttccaaacaaacattgtctcataaacaacttgcccagtattcttgtcagttatgttcttctgaaggctgcgcatgatattgtaagagtagctgaagaagaagtctttcgagagatcgaccgagcaaaggagccgtttatatctacaaaaagtgaaaggtaaaaatataaatatccgcagacaatagaaatgagaaaaactctagatatagtatatttagaatcatactaagaagaatattagtggatcaaagaaattcgaaacaattctatatacctctgaccttatgaacaccacacacaat

SEQ ID NO: 7535 - DNA, 739 bp, Oryza sativa
aaaaaaagaactgaaaggcataacgcaagctactgaatagaatgaccagaatatgcttaggctggacttcaactaacagagcatcagagtggagtactttcaggtaatagtgcgagcatccatatggcattcttttattcaaatactgacaagaatgactgtgggttcatgcaagatgccatctcttgaaaaagtttgaagcacacaaaggaagtacttcaacttattttccttgtgaaaagctgcatatccatccaataataattagattaagataatccccttttcaatatgcaattgttgcagaatagcatgtaccccatgaagcatatgaatattccactaggaggaactgttcttaccaaatctatcattggcacaatttacggtctatcaggattcaggtataactacttaaattaaaaacgaagtttttgttccctttacatgtgtggagtgaacagcatcaccggtctattctccaggaccactcaccctttcatcacccaactctcaaattgcagcagatgtgttcaagaaaacgaacatcgtccagaatagtctaccaaattaatgagccagtgtacgtgcattttctttttctttcatttctttttttagtttttgatttggacaaagatcttatccatacaatcgaggactcactcatgacaagcagcaagtctattaccattagatattatcaacccccagttaaccactgatgagctacttgcag

SEQ ID NO: 7536 - DNA, 19822 bp, Oryza sativa
gccaagaaggttagaactgctttgtattgtttattcagcatttcgccatcagtagtcatatcatgactagtcgacttttgaaaatttgttagtcagaactgttgtgtgttgtttgttcaaaatttctttagtttgtattttgcaagtggacactattctcagatttgccagcagttaatccctgtggatttaataatgctgtcaaatagttttttatagaggcgcttttcaaggagtcacctagtaacattagatgttcttaatttgttgtatgggtccatcgtttcttatgatatacgcagtgccttcaagtgtggtgtagacgtgtagttactcttgggttatgtagaacagggtgtgtttgtttaccagaaatgacacaccaagtacatgactggagatgctatgaaacatattattaactttgatagaactgggaagtgcaatcttgccagttacagtaatcattgtctatctcacatggtttaaaagcatttctttcaagacatattatacatgtatatgtctaccagtgtaccacacaatatggaaacatggagaaaataggacattgtactataacatatctgataccttggttcaattttcattttggactcttgtaccatttaaaagatgtccacaaagtttcattactgttcaaaagacatccctggccgaaacaacccgatttttcatgagcagactgtttttctaattattattaaagttggtcaatgtggacactgactgtgggatggagagtgatgggtggcttaacagtatatggagttgagccaaattccatgaaagtaaattttattgaaaccactgtttgcaattgaaaactctgttgttttggcctgagagattcctttgaatggttttgcaagttaaggggtatgttttaaaaagtactacctccatcccagaatataagcatttttagagttggacacggttattaaggaagtaggtaaaagtgaatgatggagggctgtgattggttgagtagtggaggtaggtgggaaaagtgaatggtggagggttgtgattggttggaaaaagaatgttggtgaagaagttgttatattttgggacaaatgttgagggctaaaagttgttatattttgggacggagggagtatgaattaggatggaaattaaactgtgacaggaggtcagatacatagaatggattttctcaagcagacataacttataactaggttgctaagagcagactttgccttttggaaaaaaaactgaatattttgagttgctggtcaatttctttaaaattgggtgttttggctgccaaaatatattcaagaatatacctgagtgagatgttttttgtgttcagctctgtttgcataccagttcaaactgactcttatagttgtaaggtttattttggtcatttactttttctccttggtgctttcctttaggaagaaagcgatagagtgaaagccgaagttgctgctgctgcacaggcatctgcaatgctgtttgaacatacaagcttctctcccagtagtgggccacatggcgattttatgttctctctggatgactttgaaggtaaataaactcatttatgaacagacctgattttgcatattcagactttctattggggcaaaacacatacttgttagtgctcctaatccacattctgaagcattcacatgtttgcaattgtgcttttagttctctgcatgttgcatcctgtatggttggttgccctgcctcacttcatatgtgtgtatatattttccatttaagctcttggaaacaatgctggaccctccacgagtccaccagccagcgaaagaaagcttttctccgatgttgcacggcttggctttgcgtctgcccaagactcgcctcctataagagttgaatctggggatttgactggcaaaagtgaaagcacgggggaacaaggtatggtgacacacgatgcacctttggacgctggcacttaccagtgtgcggcagtgcccatttttcttctagtgaaatcctggcataactaaactgttttctatgcagggccagccgcaacacccgcattatcctttgccagcatcatttcctccactagagcgtcagacaatagcctggacacgcacaaaccaaatgtagtcgggaagaaaggcaagaaacccaccaaagtgctcttgtccactggcggtggccgccgatactgaaggaagagtgacactggaatggaagcagttgccagttggctgtttcctataagcagtgtgtatagtgcataacctggacttcacatctgtaacactcccaagtcccaagtagcagctttttctcccatgtggtttgatctaaatcgcctgactgttttagaaggtttttactgtgtatctacatcctgacccatgctaagggagtaagggtgactgccctgtcgcaaaatgagaagagctatgtaaaatttgataaataatgatgctaaggatcatgcgcaatactttgctcaatgtacgtcgacgagttgatccgtcataggctgatacagcctgctgtttaaatcgtgagatgctctgagtcatattttcaaaatcacggttacggggcatatatataaattataaaatacacaatatagaaggaaggaaaagcagaaatgcatggtttaatgcaataagtttcaaatgggatggaatgtcaaactttaagtaacttatgatgatatttatactaggagtattggcaatgtatggactaaatattgaaaaagtagcagaaattaatttctttgtttaaaaagcaacggaaatatgtgttcgatagggtaaagctaatgggcgatcgatcgctccaggtgatcgaccccatcccccctatatggctcctctccccttcttctcttcgtactacaccataaatctttttaaaaataaaaaaacagttagaaaaatttatgtatagaaatactatatatataaaaaatatttgaattcaaatttaaatttgaatcgggtattttgacttataaactttgggttaataaactttagatgtatagaaaataatatatataaaaattatttgaattcaaattcaaatttgaataggatatataaacttttgacttataaactttggctctctaaactttagatgtatagaaaatactatatataaaaaatatttgaattcaaatcaaatttgaatcggatgtataaacttttgacttataaactttgggtctctaaactttaggtgtatagaaatactatatatataaaaaatttgaattcaaattcaaatttgaatcgggtatataaatttttgacttataaactttagatatatagaaaatactatatataaaaaaaatttgaattgaaattcaaatttgaatcggataaataaacttttgacttataaactttgggtctctaaactttaggtgtataaactttagatgtgtaaacttgaggtgtataaattttagatgtataaatttactaaaaatagcaaagtaatacggtaccaaaaaagaaaaccacgttgaggaggagggggtgtcgccctgatcgcccttagcgatcaatcgcccattagcttttccatgttcgatatgcattcgagagtatcccgatacgcatttgtgtttgatacgatatctgatatggatatgcttgtttttagaagtatcgttttctctttttttctgtaataacaaattaaaatggttgtaaatttgtaattgctcttttattttttgaaaggcagcatccaatattggacatgactacacagcgctactacttcatctatgagaaatcctatccacctatacttcaaataaaaatttctcttaaactactcatccgatctacgatccgattacaccgtcgtgttcgtaattaaatctttgtagaaagatctcacatgattatattctgatgaaaaattgtaaattacatttataatatatcaaaattacttttagatttcactaaatcacttcttagatatatttttttagataatggaataaatatcccggcctttactcaaaagagctacagccaattattacatagacatataaaagtaaatttaataaagcctaaaagtaatttatatatattatagaagtaacttataataaaaagaaagtaactttaatatatgctttttttttcataggacgtgactacacaactagtggcagccgctccatctaatgtcttcttttaacttgaaaaatacaatagtgtgagtcttttttaacttcttcagattcgtgtactctagttgatgcctggactatgcacagatagccgggattcgggttgtcgaatctctgggcgtgacaagttggtatcagagccgatcttgaccgtaggacaaaccaaacggaaagcccatagagccctatgaaattctcttattcccctggaaatctcttcttccctccttttcaagtggtccagtgagtccaaataaatgagtttgttttcaagtttctgaatttcatcaaaaaaatatttttctttgtgccttttgattttttttaaaaaaaatgttttcggcatttcaaaaagaaaaataatattttcggaaaaaaattcttggcaaaaaaaaggaaaaggttttggcagaaaaaaagggaagggtttcggtttaaaaagaaagggagagtttcgtttttaaaaaaaaaattgggccaaaaatagtattttttaaaaaaatatttatattgcttcagtatttttgatttcagtttagtgccttttctttctttttgtttccagttttaatgccagcatctcgtttctgatcggagtcagttttgttccttctatcttttctttagatggccgattctccctgtactcaccatggtgaaggcatggaaggatttgttgcggagcttgcaaatatgacatttgttgccggttacattgaagctccatagtacacagttattgagcccctcaatggagagttgccatatagagttcgcttggaagttcgtggtattttgggcactcttctgattaatacggtggttgagacttctgaggaacagcagagcatgcttgcctggaagccacttatttggtggtggcggcggccggcgggcggtggggaggaggcgtgacggtggctgatctgacgaggacaacggcgacgacgaggacgacggctgcggcggctttgaggttagggaggaggcgtggcgatggcggatctgacgaggacgatggtgatggcgacaaggttagggttcggtttttttttatttttttttggttttttatttttgcgtgcgggcgatataagcacccgcacgcgaaaatcagattttcgcatgagggtgcgccacccgcacgcaaaaaatagcgattttcgcagacaactgggtgcgtgcggttcgcccactcgcacgtgaaaacccttttccaccgcacgaaaaaatccttttcgtagttgtgatttgtttacatgaataggtatgtgaattattggctagcaaaggattgtcgaggtccttttactattattttttcaaatggaaaattgtgctaagatagtctttcaccaatggacctggcactgatttggttttttgacaagttatcttgcccatgtgatagagttttacgttaacttaattaagataactaacccacaggagtccactctatcccaagcctaccatttagttgttgtccttcgaagaatttcgttcttagattatacacacacgtttactgtggatatgatacactgaaatactcttgggtgaaggctacaacggtatttgtgcgcttatagattattccgtggtcataataaataccaacagtgaggcgcggcggcggcggatacaacggtggggaggggcagcggctgccctaccccgcgcggcggcagtggggaggcacagtggcggtggatctggctctggctccggcgacgggagcgggcggacccagccgccgctaggcccctatgcccccacaacgacgacgaggagggcaggttaggtttcgccatttttgggttttaatttttttggatttttatttttgcgagcgggcgacataagcacccgcacgtaaaaagtcggattttcgcgtgaacgattttcacagaccatttggtgcatgtggatcgccctgccatccgtgaaaattgggattggaccgtatggaaaaacctgttatgtagcggtgataaatgaaagttgttgcacaatttttttgtaataatgaaaacttattaataaattatgagttaataatgacttttcgtgtttttttacggggtccttttcgtgttttctgtgcactaactttatcttccttccatagaaacaaacactgccttagtcgattctatcgaaatatacggaggtagtacgtacgtactccctccatcccaaaatatttgacaccgttgacttttttaaatatgtttgaccgtttattttatttaaaaaaatcaagtaattattaattcttttcctatcatttgatttattgttaaatatacttttatgtatacatatagttttacatatttcacaaaagtttttgaataagacgaatggtcaaacatatttaaaaaaatcaatgacgtcaaacatttagggaaggaggtagtacgtgggaggaggaaaacgtcgatcccatgcacaaccgtgtggggagggtcgcatttgcccgtccacttgaatcaacagggcccaaaaaaatcgaccgatctccgctaccaccactaccactactagtagcagggttggtccgagatcgatgcagcatatctgttccagagacagctacggccctacaaaacaatctccccctttccggagttccatcaatcatcatcatggtcgtcgtcgtcattgggcgtgagagaaaccaccagagatcagcaaagcgagcaagcaacaacggccatgtcccatgttacccacgtaggagtactaccacgcatctgcattggaatctagcagagcgtacaccgcaacaacgagaacgagaacaaattaagctatatgctagatcaaaaaaaggaggaggaggaaagagatacatacatcgatccagtacgtgatgatgatgcaagatagacagatagatagatagatagatagatgcacgaacacgagctaggcgcagccatccaaaagattttcgcggtacaccacgcgtgcgtgcatgcatggacaagcgtgcaagcaaccaagcgaaacgaagcaacgcaagcgcgtgcatgcatgccggagaggagaggacagagacaagctacatggtaataagagattctccatgctcctttctttctaaaataaacgaacataatacgtagtgtgacatcatcgatcccttcacatattgatcatcatataatactaaaaaatttaaattgatcattatataaccagtgccctttggtttgacgtgcaacagtattgtatttaggagaaagtctaaattacacctctaaactattaggtgagtacgaattacacctagatccgaaaaccagacattttttaccctcaactattaatatcaagtgaagaactctcctaacttaatctagagtggttttggtcctacatgacagtctaggtagcattttttaagaaatcggtgggatccatctgttagagaggggtgaaacggagagaatctgataggtggattccgcatattgtttttaaataaaatgctgacttgactaccaactaagatcataaccactccggattaagttagaggttcttcatccgatattaataattgagcatgaaagatgtctgatttcagatcttgggataattcatactcacccaatgttaagtgatgcgatttatgcatgcatgcaaattaagcatgcatgtatgcatgcacgcatttagaggttgttaagctttcattttttccatcacaacttaattacattaaataaaatatgtgatatcgagtagtgaacatgtgagacaatctcacatatctagtcaacttcagcctgatatgtgcctgtcaaattatatgaaggcgacgaccagatgtgttacacattcagaagacttaacaaattttgctaaaactctctacaacgtttcaaatgttctcaactcacattggttttcatgaaaaaacttatatatatgatgatcaatatagaataaaaaaaagtattaactcgcatgcgtcccagctcgatccatccatctcgtctgatgttgcaacagtggtgtacatgcatgcatgctagtaggtcaaagacatcagaggccactgaccgtgcttgctctcaggctctcagcttcttcttcctccacacacacacacacacacactctctctctctctctctacacagttacactgtacataacactgcatgttttctataattttattgccacattttgctgctaagctaatgccattttccaagagacaaattcagctagttgtgatggagtttttgaaatggtcaggttgattcaaggaaggagagagagaaagagagaggaggagggagggacaaggggggaacctttcctcggtttggcagaagaggaatctgcgcaggagatggtggcccaagagccgggccgggccagtggtttggtttgagctccgctagctgcatcagccagcagggacaacatgcaacaccaaaacacaccatacgagagagagcgatatgtagagagagagagagagagagtggccatggtagtaggttgatgttacctttccccctagcatcattcatcgatccccccctctctctcccccttggctgcagcagaaagctttcatcatttgcacctttcaaccccttcatgcttatacttttcttcctttggtcgtacaccacattatcacagttttccttcttcttttatcttaaacaaaaagaagatcaaggctggttcattcattaaaaaaatattattgtcttctatagcatcctcaatgcaacattgataaggaacacacaattacttatatagactcggtatacacatgtgaaacaggttccataggccttcggactatcgtagcatagaataccattcatgaataccaggaagctaggcatggttaattaaaactttcaccttgatcgctctcgacctctcgttgttttggaagcatatctcattattacagtatcattacttcactaaaaaggaagcggacaagccgtcaattactcatagcctaatacgcatacttacacgccagtgaatccagcgcacgaaaacaaaacctctctcacggcccccagatttacataggcgccggaaaaaccatcggcgcatatcacgacgctcccacccccacccgccagcaccatatcagccgtaggaagtgcaccagaaaccacccgataccttgggcaagcatacaagacgtaggaagtgaaccagaaaccgcccgataccctgggcaggcatcggcgtccgtccgttaatcccagcgcatactatgttggcacacagttggcactcgtccagacagactgttcctccaattccctccaccccctcctaaaccaaaccaaagaaccctataaaccaaaaccaaaaccaaaaaaccaccccaaaaacacccaagattggcagcagcaggagcaacaatggcagtatatataacagtggctccaaccaggcaccaccaccacctccacctccaccactgtagcctcacgcgtcatacgctgcctacgctacccccggggggccacgcgcaccaccaccaccaccgcggcatcggcagccgctgcggcagcaacagcaaaagcaaattcctttctcctcctccttctcctcctcctcctcctcctcctccttcttcttcttcttcttcttcttcctcgccgtccgtttggttcttgttggagagggggaggggtgggggggtggggtgttggtggtggtagtggacttgacgactgccccgaacatcgagatgatcgcctcgtcgctgcgcaactgctccctcaacggcgggggaggaggaggaggagggcggcgcagggggaggcgcgcggcggcgacggaggggagcgacgacagcgagggggtcaccgtcgagctcaactccgaggtcgccctgccctaccactgggagcagtgcctcgacatccgggtacgtctactactactcgcccatctcttcttccacacatgcatccatacatgcatacgccgcgtttccttttcttccccgatcgattcttccgacgtcggcgacggtggccgccggcgccccgccctttgtccaatcatttggagacataaatggatagcagtttccgaggtaggtgggtgtggtttggtttgggctcgattgggatcaatcatttgatcattaatggcgaaagcgggcgctcgaactggagagagagacgagacgagacgacccgtccgcgctgattttttttttcttcttcctcctcttctctttctgctcctcgtctcccttctctcttcttgttcttgttcttggatccttgcttcatctgcgattcctctcttcgtctatgcaaatattttttttatttatctctgttttttttcttcggttcttatcttcgtttggttggggattcgatcatcttcagagagattcaggccgttctttttaacacagggatgacaaaagttcagaaaagaaacctcggaaaagatggtactatttttttctttttttttgttgatgatatcaaggctcttcaaatctccacaccttctctggtctctgatctaagcgcgcattcagatctgtgttgcattctaaatttctgacacatccctgtagatccattcctttttgctctgtctctatctgaaactctagatttcgctatagatttcttctggaccacaatgctctgtttttttggtcctgggttctaatctaatcgcagagctttgttaaacaccagatgattctcacctctgggaaatcttcagttccattgtgacaaagtgtctccctttctttttcatccctgctagtactttgaacagacgaatgaatgcctaccccaatgaagattcatgcgtattaatcaccaaaatggagtgttcatctccaccttgtctccagcaacagagtagacaaaaatgctcttcttatggttatttcagtagccttttctgaagatactactgcaatacatttatgtgctttttaagtagaacagctttcctgcagattagagtttttttttttttacaaaggatgaaatgagaatttggtggtggtgttcttcattgccaaccttgccctgtgatttgcaaacaaacaagaggacaaagagagcagcattcattacaccatttgatccagattttttttctttcccctgttctgctgtactttgttatgggcatcagttattaataggttctcaaccttgtttcacggaagcaactgaatgccaccgcattaattgttcttgcagactgtcaccaaaatgtacttgtagattttccccacccaaacttctccatgcatcatgcacatttactcaccacattcttgaaacagcatttcgccatttgcaagattaacttaatctgtaccactagctgtctagttcaagcgcatttcctttattgttattatttttagatgaattttgatgtgtagttcatgacttcatgtgaatttgtgtgaaatgtgctttgtgattggctttgctgatgcagacggggcaagtttactacatcaactgggaggacggcacccggacgaccatcgatccgcgctcgtcgtcggcgtactcgccgtcgccggcgtcgcggtccgcgtcgtcctcctcccgccgctgctcgcgcgcgcggggccgcggcggcggaggcggcgccgccgccgcggcgtcgaccaccacgtcgtcggggtacacctccgtgtcgtccgtgggcgcggtcaccgcggcggcggcggcgtggcgctcgcacgacagcagcgggcacggctacggctacggctacggctacggcagctatggctacggctacggctacgacggccgcgacggcgacgacgaggagagcagcagcagcagtagcagcagcagcagcagcagcagcagcgccagcagcagccggggctccgccgtgtcgtccacgctctcgtcgttctcccccaccgacgagtcggcctccggcgccggcagcggctacgccgtcggcgacaacggcgcccacgtcctcgtcaccgccggctgccgggcttgcttcatgtacttcatggtgaggaagaccgccgacgtgtgccccaagtgcggcagctccggcctcctccacctcagccgcaacggctacgtgtgagcctccgccgccgccgccgtcgcccgcgccgccgctcgccgccgccgagttccgcaattcactaattgtaggggggccttctcgcaattgtgcatgctctgttagagagaacttccaaagggaaaaaaaatattgagagagagagagagaagagtttttggcgagaaggtccccaagtttcgccattattacctacattgcactccaatgtatgggaggagacccatctctagaattcttgttttccttccattgtttcttggttgtctcctctcttttttttttctttttcttttttctttttctgttccagtttgtgagactaaccccctttttcccccttcacatttccctttaccttttcaaggatgaacatttgtaaccctgatttccattcttgagctagctggagctggggtcatgcaacaactagttactaattagtgcattaaaaccatctgcaggttcttgtctggattagcagctgttgagtatagagcttgctttggaagttggcagggtgtgatgtgggtgccaagtaaagtgccaactgcatactgctggctggctggagctgtggctcgtggctttgattttggtagagagcatatattgatgatgcatcatggtgtgtgatctactactacttctatgtgatgtgctgctgccctgtttgcttctgcttgtgtgatattcttctggtgtgtgccttggaagcaagtgcatgtgtgtgtgtatatatgaattatatatatatatatatatatatatatatatatgtgtgtgtgtgtgtgtgtgtgtgtgtgtgtgtgtgtgtgtgtacacaaaccgtggtctatgctggctggcctgacgctggttttgttgtttagcatcctccttccccattgtgcccatccgtattctgacgcctgcacctgtcatgcatgttcccacaagaacaaaagagaaaaagaaaagaaagaaagaagaaatccttgtgaagaggttaaaggggataagggagagagagatttggtagttggattcttgttcttccaagagagaattaaattcctcttgctttcttactactatgatagtatgagcatatagtattttcctagttaggttcacgtgatgcagtttgtgcttagcaccattctagcctagctataagcactactgggactggaatgtttgtcttggtgttgtttatcctattcctgtggtttatgtctctagttacccacacttaatcatacttcttttttgtctcttggtagagatagttgccagttgccaccccatgcattgctctggggttggaggcagcatgtgcttcagtttagttgctaaaacaacaaggaccacttgcaaattggatactgcaaattggacattgcattttaatgagacagccgattctagaagaagctaccacactggtttaaattccctttcccctgctctgggtcctttaggtctatgaccatttttctctttggcctatattagtacaattatgctgaatagattgtaatagccttcccttcagaactgcgtaaccagtctatttgacaggtggacccacttacacataccacctcacttatacttccatcatcgcttcgtataaaaggatcaacccgggagtcatatggttgaagggatgaattctaatatgtcggttccactcttactaaactagcaaggtgatagtaaacatacgcacatagttatcataagtcacacatgctaaattctaattagaccaggatgctatgtagttgtccattcttctttttaagtttacaaactaggaatcttcgtttacctaggatcccttgttgtcaatggcagtggaagatagattacaatggacttagagcagatacaatagcaagctattaaccagctataaacatattttaatgagataaacgatgagagagaagagcagcgggctacagattcgtagccagctgcaacacggactccaagacgcaatgtgtatatgacaggtgggactatatattaatagtatagtaagcaactattgtatgaattggctattagtttagctataaataaattgaagatagtagtgagcgagcgagcaaaagctctagttgaaactaagtgagcgagcaaaagctagttgtatctgcagcgtgccagggtggctagctaggcagatacaaattggtcgtgtacagtgcagaatgtttttggctcgatttgtggagatcgcgacggtttggcaagtgcgataggggttctgcgtatggtggtcatggtctgatgaagtctcgtccttagatccgtacgtgtcggccgcttcatgtattttcaagttggctataccttaaaagttgatcatttaattaagcatgtttctctgctgccgagtaaggttttctaacataagagagaccacccaagagtcttggagataacctaatacgctattactttggttaattacctaattagttacatgattatatatatgtaaactagaaaaaatatctgtgtgttgcaacggataaaaacatttttgaatcgtatacattatactctttttgggccaaaagattatttcttcgttctatttttatcccagcctagcccgctacctctctcagcttggcgtgcgtctctttgacctagcccacgagtaaagctgtaggcccggctcgcatagccgactgtcgtctttaacaatagataaaaacattttcgatcactatacattatagcaactcatatagccgactgctgtcgtcaaagctcgaaagagtgtgatgctagaactgatcctccccatcaaagcccggaagagtgtgatgctagaactgatctcctatcaaatcgcatcgaatctttattgatcttctaaaattggttaagggtttgtgatgcacttattctactcttctgtttttatcaaaatctgagcgaatccataaaactcttaaatagagattagatctggtaaattaaagcggaattgaaaggaaaaattatgggaaaaataatgagggagtccggtaaattaaagcggcattgaaaggaaaaattatggagaaaataataagagagtagtgaggaatcgatttttactatcaattgaaggagagaatgcggagaccgatcgacatggcggtggagatgacgagaacaaacggcgaaaaagaaaaaaaaacagaacgttaaaagagaaaaaaacaacgggtgaaaaaaaaggaaaaaagaagcgaagaaaaaaaatggaggaacggtaaaaaggaaaaaaaagatgaaaataaaaaaaaagtgacggacaaaaaaacagaaaccttacgtattttaacaatatactagaaaaaatgcccgtgcgttgcaacgggtaaaaacatttttagattgctatatattttcctatttggttttggacaaaaactcatttctttccttccttgtcaagtggagctgtaggtccccgattctccccatcaaatctggtcaaatcccccacatcaaatccagtcgaatctttctcgatcttccaaattggtagagagtttttgatacactagttctcctctttccatttttattgaaatcgaagcgacaaaactcgagataaaaaggtgatttttaaatagagattaaattcagtaaattaaagcggagttaaaaggaaaaatcatgaggaaaatggtgaaggagtagggggattgatgtttggcaatcaattggaggagagaacgcatggggaggtagattgacatggcggcgacgttagtgttcggccccgcgacgaaaaaaacatggcacaaatccttatcgcgtgtggaaaaatacaactaaaaaaacagcaatgaagaaaaacatatgaaaaaacccggaaaaaaggcctagaaaaaaagtaaaaagccgatggaaaaagagcagaaaaaagacggacaaaaaaagacgaaaaaaacagaaaaaaaaagaaaaaagaaaaagggtgaaaaaggacggaaagaaaaaaaagccggtgatttttaaatagagattaaattcagtgaattacagcggagttaaaagggaaaatcatgaggaaaatggtgagggagtaggggggattgatgtttggcaatcaattggaggagggaacgcatgggaagatagatcaacatggcggcgacgttagtgttcgccccgtgatgaaaaaaacatggcacaaatccttaccgcgtgcggaaaaatacaactaaaaaacagcaacgaagaaaaacatatgaaaataaccggaaaaaaggcccagaaaaaaaattaaaaagcacatggaaaaagagcagaaaaaaagacggacaaaaaaaagactaaaaaacagaaaaaagaaaaaagaaaaagggtgaaaaaggactgagaaaaaaaagtccaataggctgttttcttgctggtttttttccgtccgatcggtttttttatccgattggtttattcgcacgcggttttcttccccagtttttttttgcatgtggttattttgcacgctttttttttccgccggataaaggaaaacggacgaaaaaaatttgcaaaaaaggacgaaaaagaaaaaaaagacggacggaattttttttacgaaaccttacgtattttttaattaggtaatataaatatagatatagaagtattgttcgaggaggccatgctactagccgtccctgtctccgcaactgacgtctctgtttgatcggtataacctacaataatcttaattttaatagtcgaatatgtgtactgagctatagactttagaaaatctagccttttctagttcaatccaacagaatttgtggcatggttttggtcattttggagaacaagcaacttaggtgaaaactctcaatgacctacaccagttaattagatccatcgacggcatcgacttaagcggctttttttcaccgggaaagaccgaaggagaccatccgaatatattaaaaaggaaaaaaattacaacaatcgacagacactatcgaagtcagaagtgcaccaaagtgcatgactaagaaccacgtgctaaccacacaaacacaacccaccgagagaggaacctagcaccaaaagacctccgctatacgtggccgatcgccactaggcctacgacaaaacaacaaagacgagactctaaaacgatgcccccacagagatcacgacatcaaagacgccgccatcacctcgagaaactcgccaaggaagagatgaatcctcgacagtgccctagagggggttacaacacccgaaggcgtagccattgccggcccggtgaactactagacatggctttcgcctggaacccctgcaacctttcttgaagttcgtcgcccatccactcaaaaaccaccacactggcagcacgaggcctccaccgcaccgtattaagcggcctttttctgtttgaagaatttgctttggagaaacttttgatctgcgatggtgaaatatcttagccgtgccctcgttaacgaaagaagtataaacaacttttatcatcatcatcgagtccaaacaatgttgctccaaattgttactttggtcttttgctccttgtcttaatttacatttagcaaatgccgatgtaattgtacatcatagttggtgttataggccagaattataccatgatttcttaaaaacagtcgattggacatcatttcgcaattttcagaagatgtttaattagtttgcttcctcggaagttttctgaaggggaaagccaattcaaaaaccaatatagccaaattcttttcacataggacattggctaaaaacatactccttcagtaacaaaaacatgccattttgaacatgtatggttcatgtaaaattcgaaaaacttcaaatacaaatattttttaatgctagctagtaatagatttattaaaatcgcagaggttaaggcctgattttaaatataaatatcttcattaatgctagttctagtattggatttgttaaaatcgtagaggttaaggtctgatcgaggaagtctttataaaagcacgctgtgaaagaatgtatcgtagatttgtatttaaaaataaattcttaacatcactcctaccatatcgaagactacatcaaaagtcctaaaatatacccacttcgttctgaaatataagattttttgggttatttagcaaacaataatatttaggtcaaaaaattcttacttttaattgtcaattttttaattttgaattaattagattttctttccaagcatctgattaaatttacatgcattgaaacatagaaatcgcatcagtgcatgaataccgttaaaacgaaggtttgtattgtgatcagaggggcaagtttcaactttcaactttcaaattaagtttctgaaaaaaaaaagagaagaactttcaactttcaaggatgactggcctgccagccaggccaggccatgcacactcgagggtaagaatggtcaaagcttgaggtagctagctagaggattaatacgccacagaagcagaggtaataaccaacagagccgtggatttttcactgtttttaagacctggagcaaacggacaaagcccacgtatagcaaggcagcaaactcagcatagtagctgaaatcactcgcggacaagcctgaaaccatacaaaaaaaaaatgcagccaaggaatgcaacaaacgcatgggatcaaaatgggcatactttttagaagcctgtggcatcccctagcaaagtacagctaaaaatcctgcaagcaaacaaagcagctcgtaggcaggagatagagaggagatccatccgccatcgttctatatatactcagccggtcccgtgtcttccccatccccaagttattaattgcatcctgtcattctcttttcacctttggacaaacacataatgagatataaatatatatttatatagttttgaatgggaagaatgttgcgaaagcatattagaaactaatatattgttaggctcgcattttcctcaggaccgatatcgatccagagtagaagtacatgcgcacgtgagtatacggtcgatggttgtatatctgtaccacgtaaggccaaacctctaattttgtttagatgtatgttaaaattattagatattttttctcgtgaatagggcatggaggagtataattaagctcgtgtgctacatatatcttccgattttgatacaagcttacaaaatgcctcttgtccgctaattttatcccatttgtttctttgtgccaagggaaacaaaagtcgaggggaaccacacagtggcacacacatatcctacaaaagtgacacatcgatgtgagaaacacccagagtagagaggggacgtacccgttcgtaccacacacacacgcacattggaagctagctacagcaagagagaagatgcgcaagacatgcaactaaaagatttgtgaccagaattcacaaacaacaggggg

SEQ ID NO: 7537 - DNA, 32840 bp, Oryza sativa
  unsure (1)..(32840): unsure at all n locations
ccccccgaccctcacgcttagactccgttcttttcttttatcttaattttcattagtattcttttaaactgttaaataacatatttcgtatgaaaacttttttatatataaaggttaccttaaaatatcagataagtctaggtttttcaagtttttaatagttaaaatttaattaatctgtattgttttttctaatactgattgtaatcttataattttcttgttatactaatatatcgccctatatagtaccggttctttttcgataagaaaaagacaaagggggaggtggtaaaggaggtgagagagcaggaaaggtgagacagcgttgttctcatctgtgtctctgggaagggaggaataaagtggtcatgatgcatgtggtactcatctcctacttgtgcattggagagggagagagagtgtgtgtgatgagaggagctagacaagggaaccttttgctgggtttggcagaagggggaatctgtgcaggaggggggccaaggacagtgttttggggctgtatgcccagcccccagctgagctgcaccacctacaactgcagctgccttgctagctaacaaagcctatgcacagcagggacagcatgcaacaccaaaacactccatacgagagagagcgatagagggagatagagaggggagggagtgttaaatagcattagtagcattgctaattaggctaagagcatctccaacatcttctccaaatcccactctccaaatacccatatagccaactctccatctgatttgactagttaaactcgttgcttgctccatcagtctctttatctaccatctccattataaatctatgacaaatgggacccacatgtcagcctatgctattcctaccccctacttttcccctttctcttttctcaccattttctagatggcaacagcggtgaatggctcgacgagcacggtgcggcagatggcgatggcaacctcagcggccggtggtccgacggcggatgcgcggaggttggcggccagacgacggcagaggtccccccccctcgcgaatccacgccgacggccgaatccggcgggggaggaggcagcgagagtccacacatcgtcgtcccggcgaatccacgccgccatccgcgtaggggaggaggcagcggagtccacacgtgccccccacccccaccccccggcgattacacgccgccggccgaatccggcggggtaggagacagcggagcccctcaagacgacggatgcagaggggatggtgacggccacctcgacgacgacagtggtgcccgaggaggaggccatcgacagcgatgatggatccggcgccttcttccccatcatcgctcctccctcgtcgccggcgccaacacacccctcctcgctcttgcctggtcatcgcggagctccctcggcgacggaggaaatcagacggcgacgactgtgcaggtgcgagccagcgacatcgcaggatgacgatggcgctgtaggacgatgatgtcggcgacgatcgatctgtgcggtgaaagagaggggaaagagatattgaggtggggagcaacgtgggtcccacagctagcaaccaagtttggctaggcaggcaaactggccaagtttggccagccaaggagccattttggccagctagatggcttggccagtcaaatagagaagctattggagtgtttttttttcttcaaacttgctaaaatttaacttggagattgggataaggggactgttggagttgctctaagttcttttcttctatttcccaactaatctttctcattttccacgtacacacttttcaaattactaaacggtacattttaaaaaaagttttataccaaatttgtctcaaaaattatattaatctattttaagttatttttagctgatacttaattaattatacattaataaaccaccacattttcagtgtggggagatggagttccaaattccacctcccggacacagccttaacactcctcctaagacaatcaagagtgtccatgctcaccatataattaagagcacgtgggtagaacacataagcaacagcttattgtttaagaaaaccagcttgtctgtgtctttctttaaaaaaacacaaagatattatgagatactaagggcatgtttgtctgtttttattttggattataggcctatacctaacaagtgaatctaattgctaagatcgaaagatccttcctttttcattatagttcacaattctttgtggatatgatcatggtattaatatgcaccttccatcttaaaataagttgatttcttattagtaagtatcatttccctccagctcagcacacaacaaaaatcacaggtgaaggagtttcttgtttgtcgttcttaatatttcttaaaaaattactagaaatataattccaaacaattatgcccgaaatattacttattattctttatagttacagacataatctgcaaacgctcgaatatactgctgtagcatttcatccggaagtatttccaagggatcgtattttatttagtcctaaggaaagatatgagaagagagtattataataacaattatatcacttatgttgatcaaaatctaatacaggggttaatcaatttaaggacaagggttgattgacacacaaaaagaattaaccaaaatactctcactgaaataatagtctaagctaattggagaaagaaatagaaaagcataattcctgtacttatagtatatagtcattttaattaacactttctattatacaattatgcagccaatacccctaactatgccctcctgtaatatcgagaaatcacgcctaattgccgagttccttatccgtcatggccatccaattggtaatagatacggaggagtacccacactaggaaaatctcttagccctatatacgcacgtggaggaatacatgtactaagatgtcaccatcagcagcctacctctatagatccgtacatatagcaccatttactggtatctaataatctaagcattgtgcttacattactacatactactctatatctctgcagatgacatagaacaatcaaataattgattaccaaaccaataccattgcatatctctagtaagctagctacataattattacgagacaagtatgaactaaagtcggtactcgaataattatataaatgaagtaaaggaacaaaactatataaagaagaatatttcattattgaattaagtcttacaagagagagagaggagctagtagagcgatacctgaaatctctagaagacttgaagaactaagaaaactattctaattctactccactagcattagaacaaagtaaataactagagagtttcttgattgatccttcttggtgtgtgttgaaatggagatgtagtgatccttttataggctcaatgatggttatgatagttgaaaatgtcctaaacaccctgcaaacatcattgggaagcaatttaggatgtccacgtggaaggccaggatgaacggcgctggtggcggtttcggctgaaccttgggctggcacatcctttctcctggacttcgcttgatggatccttagcttagtggcatgatggttgggccaaattacaggtgttctaatgggtttgtgggcccatccatccattaagtctgccacacgtcgagctttgattgtttgaacgattattttccatcgtttctcctccatttatatgaagatcgcctatatacaaatacgttgccaagtacaagtggaaataaattattcttaaacaaatatgcatacaaatattgctaattctcttttatttccggatgtattgacagtcgaaattggtctattatgaccgtcaatagtcgttagctctcctctttgactaggggtggcaatttccccgtttgggggtggggggcgcgggtacccgcccctacggggccagggacgggggcgaaatgctactcgcaggtgatacgggggcagggccccgacatcatgcggagccgggggcagggaaacatctccacccgcggggccttaggattacattatagagtgaaaatatagttgtaggatcataaagggcctttcccaccccaaaagctagcctatcaggtgaggggctcccccacttatattttacgtcctttgcccttcctcaactaatgtgggactactcaataatctcccccttcacacattggtgtcccttagccgttcaccgccccttcaccatttccccatggtccctcaggtatacgggccccgcaggcacccacggttcatcaggcctttacacactttgtccctcgggccagaaatgttgaactagccaggctctgataccaattataggatcgtaaagggcctttcccaccccaaaaagctagattatgaggtgaggggctcccctacttatatcttagatcctttgcccttccacaagcaatgtgggactattcaacaatagtgataacccgttatgaaaataaggcccatcaggcttaagaaggaactctccccttatcctatcccgaaatttctccccaacacatgtgccgcaagtcatcatcagattcatgagccaaaagcggtggagtgagaagcggtcacaccgttggagcgagaagcgctctccctcctcgtcgtctactgtcctctcctccggcctccatccctccatgccaggtcatcgacttcttgttccccttgctggatgtctccgcatgtcctctcctttttcccgtcacttgcttcgttcccagccaaggaagggttgccgggcgtgcctccatcccttcgtcgacaaccagccatgcaaacaagtgcttgttgccatccaatgatgtcaccatgttctccatgttgccgcccgatgcgaggcctcgctcacctgccgggtccccgttttccatttggatgactctacggggctaaggccggagccgggcactactacaaaacatcaaataggtgtcagcactataggtgccggaagtgctaaaatcggcatctataggcctttccacacttccgctggttgaaatcgcaaaaaaccggcacctttaagcaattataggtgtcggtttttttcaaaaaaatcaaaacctttaatattaaaaaccggcacctatagggcgattgagccgagccgaatgagtcgacgagataaggcatccacagacttccatctcttgcgtctctctcttcctcgtctctcgactctctctcactgctcgcggccggcaaaggcggcggggcagcccccgccatcccatccgccagatctggggaggggtggcccagcggcgtcatcggcgggaggcggcatgcggcagtggaagggaggggggatgcggcggcgggacgagaggcgctggcggcctggcggcagcaccctcccctcttgactctctctcgttgcccgtggccggcggaggctgcggtggcggccgcgccctcctctccgccaaatctagggaggggcggcccagcggcggccgtggaggggcggcctagcggcggcatgcggcagcggaagggaggggcgacgcggcggcgggacgagaggcggtggcgccctacctccatcagatctggaaggagggcaggcggcgggtggggaggtggtggcagcccggcggcgggacgagaggcagtggtggagccctccctattagtgaatgatttctgtgatgttcttcagtgtttcttgttctgtgatgttggttgattggggattggggattgtgattgatttggagttctatgatgtggggtggatgagctcgatgtcgagctttttttggctcgcgagtggtctcaaaggtgctggtttttaaaatgggattggtgccggagcactcatcggtgccgccttcatagtgccggttggaaaaacccacacttttcacatgttctttggtagttgggaggggggggggagaacgcggggagcgggggcggggacatccttgtccaacccgcccatgccccacgcctttgccatccctatctttgacacatctttgccgccaattcccatacccccacaaaaccctctccttgcttctcctccctctctacagcgtcttccatatactcctccttaatcgcgatctatatatagtcagcatgccttccagcaacaaatttaatatatagtcacttatttgtattttttttttggaatgacttagtgtgaattcgattaaattgttttactgtacatgatataggatttggaggtatatatattgtctggtatgttgagtatcactgacagttcttatcacgatttgacagtgataatgagccaacggtgatgattgaactaccgaattataggtaggtctataattcggtagtgacatagaccatcctcaaagcgtgacacatgcataaacataactgctaatttaaaaatcacttaattttagagtaggtctatatccagaatagaaattattatcttatccagaatagaaattattatcttagctataaggtttctgtacggttaggcgtggcgcagagtgacgatcccaacgggcgacaatgtgggcttgcacccccggcccctaagctacagttgaccaaaaccatttgtatattattcaactctagagataaaatatttgctggatggcagaaaacaaacaattaattgaacctaaatctccttaatttgcatgtctattagcagcccctttgaatttgtaggaaaagtgtaggaaatttgaaggatttacataggatgataggattgaatcatatcttatcttttaaaattagtaggaatgagaaatcctaaatcctatagagattttggaggaaagttagcaagaggttcaacctcttaaaaaattcctttgagtctatctctgatttctacgtttttcctgctatcaaatcaaacggtcattcatttgttttccctgtattttctaatcatctgttttacacttgcattcctgtcagaatcatatgtttcttttttctattcctcatttttccactcatgttattcaaaaatgccctaaaattttgtccatctaacagcagtttccatgtacctccaatatactataggagagtacatgcatgcatggacaggggccagggcgattgtagctaggggtgcatcatgggttggcagcttggcgtgcgaagacgcgactcactcgagctagtgatcagctacgactgactcatgactgactacactgatctctcgccatggccggacattacgtacaatgcatggatggatgggtatgaggttggtgaaggtcgctcagatgcatgaggggctatagcttagcttcagcagttcatgctttagcggcgacgaatatatgtgtcacggggagacaagagggcactgtgtctcacaggggagggcagcatgatggggatggggcatagcatatatatcccccatccattttccatgcatccatgaccccccctctctctctctgcctctcttctgcgctttgcatccatccatgcatcacgcagaccggacacacagtggctagcaatagtaacatgcatgtacaccaacaccgatcgatccatctcccatttatctggggccgcatatactccctctattctagaatataagtatttttagagttgaacacggttattaagaaagtaggtatgattaaatgggagagtgttgtgattggagtagaagtgaaggtaggtgggaaaattgaatggtggaggcttgtaattggttgagaaaaaaaatgtgggcgaagaagttattatattttgggacaaattttaagctaaaagttgttatattttgcgacggagggaatatatgcatatgctacttcatccgttttatattataagattttctagcattgtccaaatatatatatatatataaatctagaaatatattaacatctatatgaatatgggcaatgctagaaaatattgtgatatgaaacggagggagtactagcttagccctacatgtatatcatatcgatcgatctcgatatcacgcgcgccaatataattggtatacactgtttgaatcagggtgcgaggaggggccggccgggcaaaaagtagtttctttcttcttcttcatcatcagaatatatgtatatatcgatgatctatctggaattagttaagcacttaagcaccacgtacacatatcgtacgtatatgcataatgcttgcatgtgccggactgccggctggccaagttagatggatcggttaaatatttcaccgacgaccagccgggttgacaatgattatttgctaggagcatctccaacagagtttgctattatcggctctacttcgaatgtttatttggttattagcttgtcaaaaaaaatttacaagagccaaatttaacattcactccaacgatttttaatggtatagcagacgctgcagcacgagagagaattaagagtggagtggagtggagtggccatatggggagaaggaatagtacgtggggctcactatccgtaagtgattttggatagacaagtttggccaatgaggtgagagatttgggcagtcggatggtttagctatccaatccaattagagaggttgttggagtacgaattttttaattttctaaaattaccaaaatttggcttagcaagggtcatttgagaggccatctcgcagatgctctaacgtgtgtaaggtcaattaattccaaccttgcatctgctactagctagcaatggcatgcaggttggcagcaggagggtgtgatcagtactttgcagttaaggaattgcgtggtctggggaggcaagtacgtatacgcaggcaacgccatgatcccaacctggacgatgtcgatcgatgtgattgatgaccatcaggggaatttcaactaactaactccgtccatcgtttccccggcccccgcggtacgtacgtcgcgcagttgcatgcacgcggacgcgacacgcgacgtacgtgctgcgacgacgctcgctctcttgttctcgcgtgatccagccaaggcgccccccggccgcgttcgattcttcctccgtgggcagcggtcgagctgagctagctagctgggtggacagcgatcgatggcgacgacgtggtgttcgatcgcgcgagccccgcgcgtcgtacctactacagtacctatctacctgcggtacggcgaaactacgcgtacattggatgctgtctaagagccagtttgatcgatcgatcgagctgagatcgagggatatgcatgcgcgcagttagggatgcagttaggtcgatccgcgaacttatatatagataaaagtagggggtaactaatggatttgtcatttgtcatctggttatctaataatttgatctacgagaaacgtctaggggtctttcggctagtttcataaggtggtgggctagccgatctgagttcaaagcctcaccccttctaattatttgatgttaggctattctctaatattcgcgttcttttaataatttgatctataagtgagttcacagatcgacccacttgcatccttatgtacggtaaagttgaaccatgacgcagaaacccgtggattacccatttatttgacctctatatacgtagatttgcggatcggcccacttacatccctacatgcactgaagatatctatctcattatgctcttagtaccttgtaatggtaattatagcttctttgtagcaaaggaaaaatgaagaaaatataaaggattgaaatcatacgagggaatttttttttgctctacaacttacaagcagctgccgaaatataaattctataacttgattttcatgttttttttcatgtaaatttattttatagcattggtttttaaatcaataacaacatagatataaaagttttacttttataatatttttaatcactaataaaccgtatgacttataacctagtgtgctacattacactgtcaactatctaattgactattcattctagaaatagtacattataaaaataggatcattctcttggatgaaaccgtaaattattggtgaattcttagtagtgacggtgctattttaaaactaataatatatctgtactttttaataggtcaagtttatataattagagatagactagaaagatgattaagaatataatattggatacggtagttactcacgtgcacggagcgtatgacgtgccacgtgtgtgagagaaggggagggaaggaggacgactccgcttaatggatagcatttttattattacggtggtggactactggttgttgctatcataatattagcttttttttacataattaaccaagtgtgaaaactccaccttatagatagttagtgttagtgtgtggatccttttatttaccagtgagataaagttaaagccagtatattttcaagagtccgcattaaaatctgtacttactagttcttcctctctctcacacacactggttcaatctcaattctcaaagttggaagcaactccagctcaacagatcagtcatatgcactctctctctctctctctctgtggccccccaaggccgtccagggatttgtacatgtcagaccaggggctttggagggttgtccatgtgtgggccctggcagagattctctctttcaaattcctctcgtctatggatttcttgtttcaattcttttagccgtatttctatcttttttttctccctgatgaatacaagcatgtatgtaaacggacaagggcatacggacaccatgaaaaaacagttgtaccgtctgtgatactgtcctagctatggtccatgtactggtacagggtaggtaggcagtggacagtacacacagcagtgtggcgtggatggagtatggacctagggaatgtatatcacataggaatgcacaaatttgagttatacttttcagagcattaaaattagagggaccatggtacatttaggtggtgtttaaatctccttaacataaagatgaatataaagattaaatatttcacgcaaaataaggaggtaataacgtgtgattaattgagttttaattattacaaacttgaaaaatggattaatatgatattttagaacaactttcatatagaaagttttcgcacgaaatgcaccgtttagcagtttgaaaagcgtgccacttttatccaaaagtttatccacttttttcagtaaattaatctgcagtgtggtgtgtggatgaagtatgatgtcatgttatcatactgtttttatcatgtatttcctatatgcatcgaatttcattgaaaatgataatttatatgtatattgtagattaatcaaagataaagataatgtatgtgtacttgcttgaacagaaagatatgcaacttaggtcaaaataggtggtccaatgtacaattcactctagaaataattatacgatagtactgcaggtgctttttctgatcaacacggactcatctaaatatttgaggcattaatggagtcgccaaccatcttgatagaaaactctaaagcaagatgggttttgaagattaaacctgctaccggagccgatttagagatgtaaaccggtctctaggttgatttaggtcaatatggagttaatcacccatctcatgggtgaatcggaaggtttacgagacaaacctacaaaggttatcgtactctcgtagcgaaggcaggcgatttatgatgaaaatcgagaaaaatagatgaaactaggataaagtaaaagacatgactgaaagtaagtaatgtaaaagaatgattcgatagggtaggtttgaattgaattggccatagcccttataaagagatcggtcttgccttctacatgatcctctccatgtcttactcgggggatagactaattagaactcgaataataccttaccaagtaaggaaacctaagacccgataaaattgaactcggagtcggactcagccggtctaaccgaccatatgctgccggtatgaccaacactatgccggcggttagaccggccccgtgaaggaaaccgtgacatttccaaatttggctatatttttctattttcgttcttggtgtctgttgggtgttaacaagtacttcaaaaataaataatgtggctaattgtacataaaagtctagctaattcttgtaaactatattgtttaatatttcatatgctgtaaattttaaaaaattctcatacatttaactaaaggtctttatttttgtttcgttccgagactccaaattgtgaggatcggctacttgctccttgggttgggtgagtgtatagtagtccttgggttgggttttgtggacccatagctaagtatggtacaaattgagcagtatgtttgaaataaatgttcagaaactctattaatatacccaaaacatattgccatatatattcacatgcagagtataatattttaaagaactagagagttttaattaggacacaactcaggatgggacgctcgacggggagagggaaaatcaggcgctaatgtcagcatgatgtatgcgtgcaaaaccactttaaactattttttcttttaaattatttatccaaatcatgattcgattgcaccattaaattcgttgcaattaaatctttaaaacaagatcacacatggatatattccgatgaaatttttttagcttattattgaatttttttaaaatgttgcacgatgttccaccaagtatatcagaattgtttcaccaagtagattgaaaatgtttcaatcgtttaaatcgggcgttgttttaccttatataaaaataatgtttcagcaaatagcgaaagaatgcttcagttcactgtaacatttgatccatacatagtgaaacattataattacactaggtgaaacatttttggtggaacaaaaaataaaacgaattcccttaatagggggtttccaaaatgtgggtgatttgttgcaaaagaatatttcaatttactgtaacattagatctatacatagtgaaacattatgagtacactaggtgaaacattttttttgtgaaacaaaaaatgaaacgaaattccttaatagagggtttccaaaatatgtgggtgatttgttacaaaagaatgtttcaattcactgcaacattagatctatacatagtgaaatattataagtacactaggtgaaacatttttttgagacacgtggtaggtgagggcaggacacatggtggggcccagggggtcacgtgcgcggttggggggggggagccgccggtcgcctgaggcgaaggattctcgttttcattatctatgtatgcaaatacctaagatctagtacagaaaaatcaaggacccatattataattttactaatcttaaatcctttcattcaattaacatcgtagaacaaacagcttaaatagaacaaataccttatattatgcatggatggaccaaaggaataatcctgactaattatactgaacaacgacgactgagccacttggcatgcatagttggcatgcagtccatgtgtaaagctagaaacaaaatgtttgccaattaagctggcatatagctgggccatcaaatgatagatattcacaatcgaagctatatatatatgcctcatggatccacctagcagacgaaccaaaacatgattcattttagatttcccaggaaaaagttgatataaatataagagattcattttgggtgaatcttctaggaagcttattaagagatcaaggagtacgacttatatgtttcacccgaagagtagtctactgacggtctattaccagataacactctgagtgaaactggcttgtacaagacttgcaattcaaagcgtagtccattaattgttcaagttgtgagtaagtttagttttgagttctaggtagatgttcaaccctaattgttctccatcaaaccactggtatataaacaatacattgaaaaaaaaaggcaaatttcagtgaaattttgaaatttggtgagggattgttgaaattaatagatgggccttagcccattcgaaaattaattctttaaaaaatcataaaagctcacctcatgggataatatggatgaagagcttagtaccactttgcgtattctatgagagggagacctccttataagggaggatactctcatagccgctcgagacatgtgaggtggagagattaggggggaatacacgcgcgctcgctcgcctcacatggcatggcatggcggcgcgtgtgcacgacgacgtcgaatggtccccgaaattggttcctcacccttgcacagatgcccgtcgctcgtagtccaactctatcccgctcgtcggcatacaccggtgatccgttgctcgtagtccaactctatcccgctcgtcagcatacaccggtgatccttgcacagatgcccaccgctcgtagtcctactctatcccgctcgttggcatacaccggtgatcgggggagcaggtctccgaaaccttcgtcttcgacgtcttacaccgggagaaggtggcaataaggtttttgggaaacgctttatgcgactgctccctgttcgtccacaacggctcgtcttcctcttcgctcacgtgctgcacgccatcgtcaatgcacagtaccacgagcaaccagttttctaaaaccctcggtacgtgttcgacatgttgcgcatatttgatatgttcatgctttactgtctagtttacatgtgtagatcttattatgcgattatgctagtttacatatgcagtgtcataatttatttatggaataagttaaatcattatatgctaaattcaacaatgacaacggcaaatgtaattttatagcattgagtgtaactatttttcttcccataaatgaccatggaagtgagtttttcctcgatgccaatatgcaaggaaggattttaaattgtgcacatgaaactgaggaatttttcaattgcacaatcatttgtgtaattaaaacaaaagggaaaccttttattgtgccatggagctataggtagcattagttttatggtaactaggggagcatttgtcattttaccgtgtctaacaaatggcgccagtccctaacaattttgatggtatacaatggaattggtatatcaatggcgtccggataggggggtttttttgagagaaaagaagaatctacttcaaccgatatgcccttaggcacggccatacataacatagaaatcacacgtggaaggggtgggcaattagctagagcagcacagttcaggctgcatatggaccagaaaaagctctgggactctacttagttcttatttgtatttcgtctatacaagaaaagaaggatttgtgtttagcaagacaaaggcctgtttgacagaaggaagggcctgattgacagacggctccgaagtagcaggggcctgattgacagatggctccagaggggtgttgtgattcagctcctgctgaatgaacgcaacccactccggatcctgctcgtaaaggctcagatagaagtttagctagatacttctttctttttctcccgagctgattgcagtctgtaaaccaaccgtcaatctcccacttcacttgttgtgaaatagatcaagattgatgtcagaaaccaaccgtagaaagagaggtcgaagcacctcatttccattccggagcatcttaatcttaagtttcctatttatcgaagaaaaattccattatcagctcactcttcatcaatctggcggcgtggccggtgagctccggtaggccagatcgggggcggcgtggtcggcgagctttgggtagcgcagatcgagaggcggcgctccccccgagttgtagccggcgagctctccggccgccgccgcatggagtatgctggttatctatctctttttccctccgctttttctgatctttcggcttctcccactactacagaataggtattctgtgccggttttcccaaccggcacaagggaggcggcactgattggaaatcaaaaaggtgtagaaccggcatcttttaggttcgtagaataaaaaaaagccggctcgatgcatcggctccatcgatcgagccgacgcatcgagccgagcagtcccccctcccacatccgcaacaaaaattttttggcaacattcatctcacaaaataaatcactgaatcacatttgaatcagtgaatcaaacatttgaatcatgcaacattcatctcataaacaaatctggcaatattcatctcacatcaaacatcattgaatcactgaatcaaacatttgaatcaggcagccgcaagcgaaggagacggttgggggtgctcaccgtcgcctgtgaggggcccgccgccgtcgttgccgctgcctaccccccgccgtatctggcggaggggagggctccaccgccgccgctgcctcctctcccgccggatctggcggaggggaggccgctgctgctgccgcccatgagccatgccacttgccgcngcagccacctccccttctaccgcggccgcggccgcctcccctcccgcgggatctggcggaggggagggcgcggtcgccgctaccgcctccgccagctagtcgctagcagtgcgggggagagagaagagagcgagacgagaagaagagagcgtgacgagagagaagggagagagcgagacgatcgaaccttatccaatgctcgtctcgtcgtggtggggcgcaccggtcggctcatccgatgccggccagctcggctcgatttacataggtgttggttttttttaaaaaaaacagcacctataatatattataggtgtcagtttttaattaatcgacacctataatatattaaatgtgctgttttttagaaaaccgacacaaagtataatagatgctgatttttattttagaaccgacacctataattacttaaaggtgcctttttttttgcgatttcaacctacaaaggtgggaaaaagcctatagatgccggttttagcactaccggcacctatagtgacgacatctatttgattttttttgtaatgtcccatttctcgtcggcactcggcagtgtcaccggcgagctccaagcccactcggatcttggcctggaagcgcgggttggggggaagaatggggaggatttcggaggagcagcagagaggggaccgcatcgcactttctttttcgggcgtgagaaacccagaccctagctatatgaggggcaaaaccttgcaaggcacgggacccacctcctttctcctccacgtcggtcggtgttcagcaacgaggtaactcaccacatcgtggcactgtgaaaggccttagcagtttagcacgtggcatttatatcaaacatgcatgtactactcccttcggacggaaataaatgacgtttcagacagcaaaacgaacttacacttggcatcatttcattgttggaaatgataaataatagtgacgggagggagtaataaattactagttgttattcgttaattgaaacaaatatatatacatagtggatcctgcatgcatgtatgcattcggagtcagatgaacgaactaatgactgactctctaccaatcaccctaaaagtacggtacagaatgaagaaatttctcttgtgatcaggcattgacaccatcatatatttcaccggtggagaagtggttttttactctcggttagtaacaccctgactacgaatccgagactaaaaatcgctatctttagtcccgggtgaaataatcaggagtaaaaatctatctttagtcccggttgacgttaccaaccgggactaaagatgaagccctttttaggactaaagatggagccgggctagatccggttgctcctttatttttttttcttttcttcattgtttgtaatatattgatttcactccattcccgtccacagatctcaaatcaatcatccccgatgaacgcactgatgaagcctagaggggggggggtgaataggctgtccctaaaaacttataaacaaatcacagcggtaaaattcaaacagacccggaacttcctggtaaggaactccgaaacttccggcctgccaggcccggaacttctggtgttcttaggacaggaacttccgggttacagatgaaagatgaaattcaaatttcgaaacaggagactaagccaatcgtctcaagatgatgcacaggtattctaagcaggagatatatcacagaatcatccatagaaacatcacagaaagagacaagagcggtttttttcctgaagtttggatcttgcgatcctactctctgttgaggagctccaaagagctaggtctcaattaaccccttgccttacttgtgcaaaaaccctagaggaaatccacagccttcaaccacaaacacccctaggcaaatttctagaattgagtgaccaccaagatccaactcaacctacttctagaaattcgtcacaagtgtaggttgctctacttggaaaacctctagaatctcagcataagaacttcattaacttaccttgttccctttcggaggagaggagatccttcacaaacttacccgggacatccacaatatgcaacggattctcgcgggcgacactaaccgtctaggagatcatctccaagagtaataagcaccgagatgacagcccacgagatactccaagtgctcacccaagatcctagtcttcacacctctccaaatcttcttctctccctctcaatctctctttctcacaagaattaggctctagattgagcggagaaggcaataaacacttgggagaggctagcaacagctctaggttcgaaaagtgaaagtggaatggccaaagaacaagctggaaacgagctgtatatgtataacggctaggtgacgtcatctagccgttactcacaattttaaactggaaactagacaggaagttccggatctggaagacaggaacttccggactacacttaggaaaatatttttcacaagaccggaactttcggacctggaagacaggaagttccggacttgcacttttggacatatggagtatttgcaaaaattactcttagggaaacttgacacttggtttatactaagagcacttgacatatatcagagcatcacctagaacccctcttaatagtatggtttttcctaaaaacttgatttcaatagataaactatcctatgcacttctcaagttccggtccgctttgattttgtacttttttggggggggggggtctccaagcatccatctttcacacattggactaatgcacctgaaagttacttaatgaactcattagtcacttaaccacatttgtcattaatcaccaaaacccactaggaggattaatgcactttcacccgaattgtcccaaatcgattatcacctccaaatttcatcagtgatcccaattatatatatttattttatagatcctcctatgcaaatacagtgccacacacactttttccctcttgatcattgactcaaactgtgccctacaagtgtacatgttagcatgttaattagagaggtgtccagccaacaacacaccttggacagctagctactccctccgtatcaaaatataagtatttttaaattttgacatagtttttgatatgctactttgactaacaatatctataaaaaataagacattttaaataaaaagaattacatattatgatagtttgtttaatgataaatttagtaacattaattttaaatgattgatcttttttatttttttactattaatatcaaaattaaaaatgtttaacttgatactattctaaaaatgcttatattttaagatggagagagaatagcttgcatggacgtacgtacattttgtttgtgcatgagatgtgtgatgagttgttgcaagctctgcatgggaaagtcggtcgctagctaggccctaacaaacaattaatgtttgcagatctatgatctatcaatcgatcgagatttcaagcaaattaaggcccacacattatatattgcagcaaattaaccacgaatgtgaagtactccatctgtcaaaaaaaaaaaaaccttgtttccgtgctcaacatttgaccgttcatcttatttaaaaaaattatgaaaaaaattaaaaagacaagtcacgcataaaatattaatcatgttttatcatctaacaacaatgaaaatacgaattatgaaaaaatttcatataagacggacagtcagaattaaacacaaaaactcaggtttgtcttttttttgtgggatggagggagtagatgatagactagcagctagctagctaggttggtcttgtgtttggttgccgtccggcccagccctgcatgcatgctgagccggccggacacgatatatagatcacgtacgtacgttacctacagtgaaagattgaacagcctgatgcatatatactgtgcatgcacattgggctgccgcttcatctgccatcaaatgtatgtacatgcttttatcagagtatacatgtgcgcatgcaacgcatatggtctatttggggatctgagctttagtttctgataagcagctggtagtaatatatccggttagcaagaatctgaagaaactggaacaaccagttcctgacttctactacctccgtttcaggttatatgactttctagcattacccatattcatataaatgttaatgaatctagatataaaaaaaaatatgtgtctaaattcattaacatctatacgaatatgagcaatagtagaaagtcttataacctaaaacggaagtagtagtttttttttatttctacaactacagcttctcagaatctaaaagaaaaaccgaattgttggaggagtttttattctgtgaggaactactaccgaaagctccccaagtaggacccgggctgaatggtcagtagtgcagcgctaagtcaaccatatgaatttggcacgaactcaattttacaggaataagcttaattatattgatctcaattttacagcagttagcatgcagttgcttgtgcttgtgaaatggcatggcatggcatatggtacgcaagcatccagctaaacatggaaagtggtgggggggtgggggggggggcaatatggcatcatggccttatgattcagggccttgatgagctgaactaaggcccggcctgcactgtttgcatgtccagcttattaagcttctttcactgtcgtcccggctgtctctcgcgagccctgtatagttgtaggaatcgaatcacgctggctacctacctagctccctccctgcatggaccacgggccccaccacgcagctggcctggcacttgtgccattgccatgccagctctctctatgtgagacgacacataggctgtgtttagtgtttaagatccaaacttcagtcattttttatcacatcaatctgtcatatacataactttttagccacatcatctccaatttcaatcaaaattcaaactttgcgcttaactaaacacacagccatactttctctctctacgtactctatctagctaggttctggcctataatgcatgtgtgtgtgctctctgctttgaccggaggtgtttagccttggactcaccatgcccccaaaaaaaggtttcctcccaattgccacgtagcagtagtttaagaagtatcctaattccacattttattaaaaaaccaacctaatactaaatataacatatgttaatactataaatctgaatagagataatagcttgtcattttataggatgaaaggagtactccttgcatgcccctgggtggccatctactacgatcattttatacctttggtaaactagctcaatacccctactttgcaatgagaattttcgaaaaaaaaacaattagaagggagcagctatatagaacattcgacggtattttgatgaaaactttgaaaaataactttagtataattaagtgcaattatattatgactacactatagcttacttaatgtaactagatgaaaaatgtgtgaggtgagatggttaacaaatcaagcaagcatgtgttcaacaggatgtgggttcgactccactctgactcatgcgcgcgactgaattttttgcagctctgcacgaatcttgaggagatccaatggttattagaaatgagaaagtttgcatgaatctcgaggagatccaatggctagaaatgtgaaagtttttttttgcgaaaaaattgtcacaattgtcgagcaattccaaaaatagaatccaattgtacactttaaagtctcaaaaaaataaaataaaataatcgccataaaaatatctttatgtcatagctgtcatcattttatacccacgttaaaataaaattttcttgttttataacttaggatcagggaacagtcaaaagtccacgtactcactctatactcgtaaaggaagttgttttgtatagcgacatggtctctaaaatacaattttaacttcttgtttatataaaaatatttattaaaaatggatatatgtatacttttatgaaagtatttttcaaaacaaatctattcatataacttttatattttcaaactcaacaacttgagaaatattcatgatttatatttctaatatttgacttaaatattatcccaaacgacttacttataattattacgtagggagtatctcactgtctagtaacccacgttctcgtgatatgggtgacgatagatttatcaatcaccatcaccattaaggagaataatgaggctacgccttaatctagacccgtaatataatgttcaaatagatgacatccacatggctggtgcggcgctggcgggaggaggagcgtcggctggctggcagcacgtgcacgaggtgcgactggcgagagcagaggccagtgaggctcggcaggtggcggcggaggcggccctggtgcgtggaggtgcggtcgaggtgccggtgcgacgcgacgaggctgcccggcgtggaggcagtggccgatgcggcgggaggagaggccagtggcccggtgaggcacgaccggtggcagcgcgcggagactggccggtggggggcgccggtgcagtggtgcccacgctccggcggaggttttggatggcggtggagcaatggtacatgtgtggtagatcgacaggtggtggacggcgggtgaaaacccagcccggccttggccggacaggcaacgatgacgttcgagtgtcattcccctcctgagggcgttgtcgtgccgtctcgcccctcaaggatggctgccgagtgaaagcttagtcttggttctctttgagaccttgacggatggcggtggtggtgttccgtcgcttctctcgttggagacgtcgtctaggcatccccttgccgaaaccccccgagcaattggtgcaagcacactctagattctcatcctcttgtggcggcgtcctagtttctacaagttccatcttctctctcaccctctctccctgaatcctgaagtcttggatagagttggctttgtgttgattgtatgggtcggattttgggtgatctcggcagtgttctgttgttggcctagcggcggtcggtcacgcttagcggcggccgatccggtgttagccttctcctggatctgtgtgttggcgctgtcggtgtgtgggtggtggtataattttctttttttctggttacgaccttgcaaggttgtaatcttgtaatttttttctgctctatcaatagaatttcacaccgtctagtgcgagtcgttaaaaaaaaaacatgacggcatgtttctatatatatctctctcgtgtgaacccacaacacctgaagaaaaggccccctctcggctctcgccataggccagccaggagccttggcagcatgcctcgctgctcctgagatacccctgcaaatccttgatgccttgaggctgatatcaaagactaatagaatttgagaacttctaacgatacccatctcaaagtattgttatagtttgctagcttcagctctgaggtctccgaacagagggccctcgttccgctcagccccagggcggcacgggcggcgatcaagcaagcacgccgctgccaaactcttcctctccttccctccaccttgctgctgctcgagcggtaggactggatccggtccccgcatggctggatcaggcgcctcacccggtggtgacgggaaggaggcgcagcgcccaacgaggagcgcggaagaggcggcggatgtggcgacgtgcgaggaggacggcgtacatgggcagacaaaacgatggcgggatcgccgtgaaccatggttcacggcaaaacgactccacgtgcctttgacaccaatggcgggatcgccttggagtcgaagctgctgggtcgctgggcggcaagctccgcaacgatgacacgtgcctcgtgaagtcaaagtcaaagctttgtgctgccttttcagcatctcgacattgatgttcgccgttaggttccgccgttgtttttagtttttttaaaaaagtttggtttacagcccatgtatcatgtcagttcttgcaaaaagggagagtgcgtacggtgttggatccagtcctataaggcctaggccaacctagactattttggcccgtgtacaacttaaaagtgagtctacacctatggatctctctggctgcccatataatctatctgcaagagctcgaaaagccatcatattcacgtactatatatgaaggcctagaaatgaacatattaattagaaaaaacacttagatcgtggtgatatcaaattataatggtgtagcttaattgcaatagttgtagttttaatactacctatagaaacagaagaaaatggtttgtatatgaaatccaatcctatttttaatatttattgttacaaaatataattccataaatgtaaataggatctaagagttttataacaaatccaattttaactaactgcgctgggaaatcttgtcgttcaagcaatcaaaagatctatcctaagagcacatgaggaagaaaaaagatgtgctctcatcgcttggagcttgttgccgtaactaattaaaatttaaatccaaacttaattttaaatgattctagactatttttcatcattttctcttttcttcagccttggtttttttaccactaagaaaatgaatatacaaaatcctaccctaaaatcattttccgttgcattgtttattttttttgtcaaccgaagccaacaatcttttctttacttatagcttgtctggggagaaaatgggaaatctgtccatgttgaataaaacaatataatacaatagttccttcatccacaaatataaaaagtatttctagatacttttcggagagactaaggaaaatgaaaaaaaaaatgttgatgctccacattaaatgagggttatacggttggtgatgggagagtgattggtgagacaaatactgtgcttcctcttgcttgaaatatttctgaccatgttccctatgctgttaaaattgatacaagaattccaaagtacccaatctttagatttgaaaacattggggttgaaatggagggattttctgatcttgtcagcagggttttgtctgtggatcctggttttgataatccagctaagtgcatcagttttaagctaaaatttttaaggaaaagtctgttgaagtggagtaaaaatttgtcaaagttaactactcttctagttaactgtaataatgtgttgaactttttggacttgatagaggaacaaaggcccttgggtatatattaatggaatttcaaagagattatcaagttgcagacgataaagcttctagaattcaagaagctatactggaaaaaaaaagatgtacaaacagatggatgttgttaggagaggagaacactaaattcttccagtctattgccacaaaaagatttagattgaattccatctctcagatttatgatcaatctggtcaagtggtttctttgcatgaccaaaaggcaagtcttttcttccaaagctttaagaacagaatggggatctcttcttctccctcaatggcctttaatcccttatccaattaatttggattgtctggtagatcagttctctacccaagaggttgacaacttaattaagataattcccctagagaaggcccctggttcagatgggtttaatgggttctttctaaagaaatattagcctatcatttctcaagatttctacaggctggcagcccatttccatgcttttttctactgatttgcagcctcttaacagctcttacattactttagtgcctaagaaaatccttccagaaactgtgaatgactttaggcctatctctctggtgggggtcagtttgaaaattttaattaaattgatggcaaatcgtctccagggtattatgctcaagcttgttcatgaaaaccaatatggttttattagaggcaaaacaatacaagattgcttagcatggtcttttgaatatattcatcagtgtcatcaatccaagagggagataatcctgctgaagcttgattttgaaaaggcctttgattctattgagcactctgtgctcctttctatcatgcaaagcatgggtttcaataacaagtggttgcaatgggttcagatggtgttttctccatctcatacttctgttctgctcaatggtgttcctggaaattctttcaaatgtaggagaggagttagacagggggaccccctttcccccttgctttttgttcttggtgctaagctgttgcaaagagttatcaacagagccttttctctgcgtctgctgtccaaaccaattaatgaacaagatggcaagggttttcctgtgattcagtatgctgatgatactttggttcttcttaaagcatcttagagggaagtattttgtttcaaagctttgcttaactcttttgctcagtcaattggactcaaggtgaactatcattatcataattcgagcttatatccaatcaatctcccccaagagaatgctaagctctttgttggcttacttgggtgctctattggtacaatgcctttcacccacttgggtttgcccatgggaacaactaggccaagagttgtggactttgctcctttggtcgacagagttgagagaagattgatagctagttctcttttttttgccacagggtggaatgctcactttaattatctatgtcttatcttcaatcccaacttattacatgtgttccctacagttgtctgtttctgtagccaaagctattgatactgcaaggaaaaattgtctatggaggggaaacaacccaagctcatctagaaaatcccttgcttcatgggaaatggtgtgtagaccaaaggtgaaaggaggtttgggaattattaatttgagagttcagaacacagctcttttactgaagcatcttgtgaagttttacaaaggagaagatctgccttgggttcaattaatctggaattcttactatggcattaaggtgcctcatatgatttggaataaaggctctttctggtggcgagatattattgctttgtcagacattttcagaggaatttcaagatgtactgtcagaacaggttcttcagctcttttctgggatgatccttggaatgaagaggttaggtgtttgactttctcaaatctgtttagtgtggccttggataaaaagtagtccgtgcagcagctgtcctctcatcctttggaagattgtttccctttggctttaagaagtcaatcttatgaagaatttctcaatttggaggaagagatttcctttcttaatttacaagatagcaagggagatgactggagttttctatggaattctgatagatacactgctaataagttttacaagctcactttcatgactgtgcaaacacctagaccttttgtttggatatggaaaatacgatgtgttttgaagataaaaagtctttgtctggcttcttttcaatgatagattgaacaccagagatatgcttgatcgtcatcactatacaaaggagaacgatgacttcacttgtgaacttcgtgttaataatcttagggaaacaagagagcatgttttcctcttttgtccattcagtcagagaagttagcagtatttgggcattctgtgggatccaatctcaactttttttcaaatgattgtatcggcacgcctgcagtttaggcaaaaaggtttcatgaaatttttctttgttgctgcctagcatatctggaagcaaaggaatgggaaaaattttcgaaatgagcaaccttcctttggatcatggagaatcctgttcaagaaagaagttcttctgcatatgtgcagaatggaccctttaaaacatatagtttttttatcggttataacttttgtaattcctaatgtttttctattctttcttccttgtaatttgtaaatatttttgttttaaatgaaaattacactgcgaggcaaagccctggcaatactttaagtaaaaaaaataccagtactataagaatcctaatattttgaaacaaattaattttaaatccttagagtgtttatatttgttaacatagggagttcgtgacatgttaacagtaaaaatggatacaaatgaatgaaaataagttgcaatttaacatacagattcaaagttctgacattcaaattcttcacctactttcttttctcatctaacctcaacattcactcaattaatatccttacttcctcagtacccgtgtccaatcctagaagttctttttttattttatgatggaggtaatggtactttaaaaaatgttttctagatgagcgtcatactttctaacattgacaacatatacataaatatcttgtcactcaattctaggcttctagcccacctgacagccattgcgaaatgagtcaagattcaaaccataccaaccaactaacctaccatcgcccaccgacgaccaccatggcgaccaagatggcagcggtggtggcctagggctagtactattatgctccttgcctcaaccttggtgggcagccatcttctcgatcaacgcttgggcaacattgatataaagtgagaagatggtgcctcccgcatctatgtcgaggttcctgttggcgcctgttgaatgccgattttatgccgccaatacttgcataaaacttagataataaaacatccaacatagtggtagggcttaattctaacatattccacgagtgttggtgtatatttagatgcaggtaataaaccgccaaagttaggaggaaatctagactaaaattaaggggaattatatccacataagagttgggctcctaaactccatcgaaacaccagaaattgagcccaactaccagagaaatgtataaaggaagctgaggaggaggcccaggccaaatcctgggctagttgggccaagccccgaaccctgatctccaccattggttctggggtttggcatggacgctccagatgctctcttgatggcggttgcggggaattttggacatttcgcatatctataaccatcataccaacctatttaaggacctaactccttcactttacacacacacactccaagcttgagcagaattataagagactctattgtactttattgtatactagaatggggagagagtaaggtagaagaagccagaggaattcaggagttgtcggtaatcctatccttatttttgtaccttgttaattactctagttcaatagaaatatctttccgattaattacaatttactttgtgagaattattcttggttagttcctaacagcatatgggatcattgttcactatagtccattaaaatatagttattgctttagtaagttataaacactagagtagttattaattgcttaaacgtggtgtttaggtagttaattttcagtggttgctacgtaccccacagtacattagaggtggatgtagaggtggtaacagccctcagaatcactttaagtcctccctgtccgggtacggagtagagcgacatctggtagcagcgaactagctagtgcctaaagtaccacgttagaattaaactaagctttccgtagacactgcttctcactagaaaaatcctctctatcctttgcctacaactgcttcgtgtccttggatgaacctgacgaggagctgaacacacacgttccctatgaattcaataccttggaatactcccggtgaagtgctacatcggtattctccgtgcacttgcggaatttatctgtgacattaagaaatacaacagttcccacgttgtggatgcactaccacattgtagaaactctggatgagaagccggtgttccatgtcgtgatgcgggcaggcttggatgcactattggaaattctcccatgcatcgggaattgactcatcatacaactgttgaaatcccaatcttttgttccacagtgcggttggctttttggtggacaagtatatagaaagaaatatattggagcatctcatccatataaagatagcctcttgatcaaatggatagaacaccactttgccttctcaaccagagaatggggaataggcgaaggtgttgcaaacctttaagaactgttggaggtgtccgttgcatcttcaaaggtttgctatagaatggattatgagcaaccatattactaatggtttgctacataatggattgataaaaccctgagcttcacttgatatgctcacgactctgataggcccgacttttggtgagttgatgataatacttcgatttgggagaaacgctgatgatccgactacaaccgtacgagacgttgttgtgctgtgccttagcgattgatacatctatccgtggattgttgattttgctgctgcagattgaccctattcctacaagcaaatcgaagaaacaaacaagaacaatataaatgcaatctgacattacaaatatgaattgaatacacacacgataagttggggttccgtaatgagaaaacaacgatctaaccgatcatgactttacccgaaaaagtaccaatggctaaactttaatctaaacaaaacctgagaaacactaaaggggtacatagctatttacagaggtgggaggacttgagctggggccccaaacgaagctacaaacccaaaggcccatgacaggtggtgccacaccttgtttattcaattgcggatgattcatttggaatttggagatggggctagatacgttggaaagagtacttcaagagcttttcaccaagtactcatggactcaaaatggagctcgtatgcacatttagtggctgtttgaaatcaacgctgttagaggcggtcaatttggattccagaatttgggcgagttgatctcaatgccttcagttaacccataatgtgaataatggttatatatatgcacagtaggcatggtcacatcatgaactatgagcaactatgggcatgtttgatagagctagccaaaacagtttcagctccatccaaaatgggagtggagctagctggagtgctttcagaaaataaacttgaaggaggagctggattttggctgttccacaactccactctagacctagctcttggagttaaatttaggagttggagccctgccaaatatgccctatatcaataaacatcagctttggcttaaaattctctgccttgacattgatggtcggcctttgcgggactttgctaacaggatcggaatagtcctgaattttcctctcggccataatgatccgtggaggctgagttagaggcggtgaaggaagaactaacaggatattctcctatgatttggcctatgatgatgagatgtgtttatgataatgatatttttcacttattcatgaacaactcatgataactttgacaattttttgggagatcaaaattgaccataaacatgtcatgtcttcagatcaacaaaaaacatgaggaaatgcaaacccgcttagaaaagtaataaacttccactcatcaagacaatgtacaaagaatgaaagttttatccaattgcgttcttagcaacgacgcgaaaaagtgcttgttgaatttcttatgctctcacaaaatagttccgcacgtgcatggaattatcaatatagtactttatctcggagtattctagggtattgtatttatattttccaaaggacacactgctggcacaaaatgttttcttcattctatgttgcttgtgtaaggaaatctacactaattagagatgggggtaagatctaataaaagatatgactgaagttaaactacagatgacacttagggacccaacctatccaatttaggagtttcaaaggagactaaggagtagatgtatttcagcatgagaaaatctcagcatggcttgtactaataaggcacagggcgcatgttctcactatcaaggaatttcccttcttgatgtctaacaccaacacactagaactaacgtggacgactattaaggacgccttgggctatcaccacctgtacgattacatccatcaatttttctaactaccctttccttgaactatacatccaaggcaccacatctagcggactaggtcgtatactcgtaaaatactcccgctggttagaagagagcactctcaaatccagctaggtgaactaaatccaaccaagaaacctgcaaactctacaccacagacttctagtttattccacatgatgagtgaccaatccgttgattagagaaatactctgtaacataaataaagagtgaatgtaattgcggaaaataaatactaaaaaatataaagcaaatatatgttagcctaaatgtataacttgtaagatacaaga

SEQ ID NO: 7538 - DNA, 2215 bp, Oryza sativa
tattcctgacattctagcaaataaaaataaacagagtggagcttctaacacgagaggggtgtcgtggggctatgttacctggatacgcctcccaggccacgtattcatatcggatatggataagtatcggatatgccccgatacgtatctcgtacgtatcggttgttttcacgattttcagataataaaaaaaattcccgatacggtcgcgatacgttctaaccctaaaatcatcgatcaaaaccatcgaacactgagcaagccaaagaacatcaacggcgctgcttccccaaccccaactcagctcgctctcttccttgcgtcgtagcacagcaccgccaccatcctccgccactgccattccccgccgccgccgcgtcgcacctcctccgtccaccgccgtgcctccgctgtttgccatcgcctagcagcggcgccatccgctgggcacagcgccaccgcctccagagggcgcagcactgtcgggtgctgcctagagagggcccaacactgtcacttgatgagccaaatcttgagagagtgctagaagatcttggtgcattggatatacaagatgataatggcgcttcagccacttcagttacaatggatgaaagcagcaattgatttattgagttgtatttgaagtcctaaacaattctatttgaattagctctatgatgatgttgatgttatctaccgtctctgtgaactggttgtgatgtgtgaaactatgcatgttgatgaactattaatttgtgatttgcgtactatttgaaatcttgcacttacatatgcactggtttagccttatattatttgtattttggtgagatgaatctaatggttggtgacttggtgttggcatgctctgctatgctaaattgctaattgcctagtttacgatttattttttttatttttatttatatatatatacgcgtatccccgtatctttattattaggaagatggcgtatccgtatctgtatcgtcgtatctagataatataattgtggaaaaagggcgcgcaggtcggccaggcaaataggatgggccgggccaagcctggacacgtggtcccaacgaccagcactcctttagtgagcggactcatttgatgtcttaggctatttccaacacaagacactaacatagttttcataaactgacattactcttttaatgcaaacaccactattccatacttaaatttaatgttacttatctcacataatgtcttaaatgttgtgtagaaaccatatctcatgcgagacatggtttcattatcttttctcatttatttatttgccacatcatttttcattttaggtagcagtttatttaatgttatggacactatcctagttattgggttggaaatggccttatatcatctttgatgaacattacaaacattgaatttcatctaaagtcgattagaatgactgtcgtgaaataggccaggccggtcgactcttggccatgccaaggtggccgtctcgacatggcttaagcgaattgaaggctagaaattcatatgatttctcttctaaaattatacgtgtgatgtgtagcatttctggaggtgactagggattggtcgcccgatccaaatcttcgaaaaatcggacgctgacgttagcacctgttttacgtgcaaaactattttaaactgatttttctcttaaattatttatctaaatcatgatccgattgcaccattaaattcgttgcaattaaatcttcaaaacaaggccacatatggatatattccgatgaaaaaaaatagcttattattgattttttttaaatgttgcacgatgtttcaccaggtatatcggaattgtttcactaagtagatcgaaaatgtttcacccgtttaaatctggtgttgtttcaccttatataaaaacaatgtttcagcaaatagcgaaagaatatttcagttcactataatatttgatccatacatagtgaaatattataagtacactaggtgaaatatttttcggtggaataaaaaataaaatgaaatcccttaatagggggtttccaaaatatgtgggtttttttggttgcaatggagtatttcagtttgtaacattagaactatacatagtgaaatattgtgaatacactagatgaaatatttttggtggaaaaaataaaacaaattcccttaataggaggtatccaaaggatttttttcaatg

SEQ ID NO: 7539 - DNA, 5517 bp, Oryza sativa
aatgcgccggtaataaacaaggtctcgtaatttctcctatcttcaacatttgctttggtacgttgttgactaactacattttctagaagagttttatggagtattacgaacgattacacataaaatcctataaaattttccaacgaaaatatttttttttcagaccttgtccaaacgcatacacatataaatatcttctccgtttccaggcttccagcccacaacctgacagccgcggcgagacaagtcaagattcaaaccaacccaacccaacccaaccgccgtcaccgacgacgaccaccaccaccatggcggccaaggcggcgttccccgcgccggccggcgacgagccggcgatcggcatcccgtaccatccggcggcggcgggggcccagggcggttactactacgcgccggacccctacgcggcggggatgcccccgccgaacgcgatctacgccggcgcgcccaagggggtgcccctgcagcagaccatgttccgcgacacccccgcgccattccactgccaggcctgcggcgccgcggccgtctcctccctccggtgagaacccgccgtactcgcccccctgcagtctttttattgtggcctttacctgcgattcgaagggatagatgtggaattcgagcggttgataggtcgagattgccagcattcggtgtattgatctgcaacgagtactagattgttcggtagtctaatctgcaccgtgaaaagggagaagaagaaatcgatactttctaggttgtcgaaaccagagaagctcaagccctggtggagttccccatgtttttcatgtcatctgtttcttgttattcgtttgctcttatccaagtcgcattcacgattggctttctgttaagttgagtttctataggggaggtgagaatttgagttattgttaaattatgaatctgatgatatgaggaagagaatataataggttcatagtatatcagttacaaacttgtaattactctcccattttaaggtttacaacagatgcaaatcaagggcctaagtctgcttggacaacataatccttaccagtgcttttgtatcatcttgatgtaattggatgagttcaataaaagattccattatctgaaaacatgaacttacaaatactactccctccgcccctaaatataagggattttggttggatgtgacacatcctagtacaataaatctggacaagagcttgactagattcgttgtactaagatgtgtcacacccaactaaaatcccttatatttagggacggagagagtagaagaaaggcattcttccatctggtagaaaacactttgaagagttccttgtgttctgaacccttctaggtcagttgaaataacatgtcagagcttgtactggaagctaaaagttacacgaacatatttagctttcttcttctaatgaagagtctcgagcgctagagttaatcatgcacttaggacatgtaacacctagtttagctaatatataacatgaccatcgtaataaaacacaataacagaaattggcagtcatatatactagccactttgtcgcacgttgcgtgactttgatgcccacattgacaagtatgtaaaagttctatgagtaatgtctattggatatatgtgcggaatttcaatttttatatgaagaacttgataaagaactactatggattttatttcattttattttttcatcttaaattgaataaatgtttaacttatcaagtgtataaatgtctttcagtttgaaagaagaagattcattttaatagaattcatattttattagtagaaaagtttattttgatttttcttttaaagttgggtttcatggtataatggataatcatcagtctgtttaagctccagtcacatgaagaaaagaggatggaatttctgctttccggctgctattaggaaggaatttataatggttcaattaagcccattattctgtttgggccatcgattactcagagccaccaacaaattgctttgtttccatcgctggtggaactcttccctctccttttctcctggaagcctcttgaagcctccagacaaccccttctttattttgaccttttgattctttgttggtctctatatccaacggtaaattttgtttcaaagctgtatctgacggccattagtcttttgatgatgtggcaaatcctccactcgagaaagaataattctttcactactttagattagatctatatatatggatgtttgtgaattgtaacatggtagccatctacttccactaacttgtcacttgtgttatttagtagcctctgtactcaatgaacaggtccgaagatacaatttttttcccagtccatgggaggtattgtgtggcagaggtattttttttatgttaattggaaggtattgtacctctattgacaggtatatatctcctgccactgtaggaaccaaattatagcatatttttatagcattgcgaaaaaaaggaaccaaattacatcttgagctaagctcattttctgtttttgaactgctgccgagaccatctaattggctgtgctaaggcttactgaagctcatctgagcttgcatgattcttggaattgtttgcaatcagctttatatctgaattgagtgttactctgtttttaaatgaccgtctttcgtatgtttcctggcaatattgctgcccacattgctaagtgtctgttgcattaagtccttacatctgaaacaacttttggtgaacgatattagtctttatgtttgaaaggtgttatttttgggattatatagaaacaagtattagaagacaaactgtatcaaaaacagtctacttgtttcaaccatatatacaagagaggcgcagtatacctttctagtggggtctgccctttattattattattatgttcgtaattgcatttgcatttatgaggcgcaaatcagatggtgccactaaatatgatgaagtggcactatatgagttttgttactagttttgaattgggctttgaaaagaaccaaagaccatctaaatatttgcctgcattatctgttctagttaactctgaatggttgcatgagctatggattgagacaatttgtcagatttttttgtgaaccgaaaatcatgtgtcagcttggtgatgcaagatttgactgctgactgctgagtagtgagtaatggttttatatgctaaagttggcgatgcaagaatgggcacgaataacacatttcttgtatttattttcctgatagggaaatgaactggcacaccatagttaagcctgagccccatattgatactataaatttgggtcttagtgcattattttagttgtaagtagctgtcgatttgtgtgttatgatttcctactccacacctcaagaccagtagcaccaataccataccaaacatatcattaggtgaagcttcattacttaaaaaaacacactcatggctgttgttgctttgaacaggtcgaagccaagtctagcatcagttgtggcttgcatgatgcccttcatgatgggcgtctgcttcctttgtccttccatggactgcctctggcacaaataccactactgccccagctgtggggaaaaggttcgccatcgtcttgtccaaacgctgttctcccattgagctttttctttcagttttttttttcaactttcttttgaatgcactcgatctgcaggtggctgagttcaagaagtcggatccgtgcctcgttgtggatccaactcgctggtctgaaccgagcttcgctgtgcctgcgtaagaacataccctcttgatatccaaaccgtttccatggatgagaactatgcattgttcttgagtgatctgctctgtacatagagaaggcaactaccttgttgtataccatatatatgtatctaaaccgctgtattttcgctaaagtaatgaactgtttattcatgtttgtcactcgatcatctgacggggttcaatttagacatttgcatatttattcgcggttgcaccaattatatacatatccaatcctagctatgggttggcatcatttaattataagtaaatcaattgtcattccttattatcagtttgtacttccgaaggaaaagagtcaagttctttggggggaggtctaacgcgcgagttgctaaacgcgataagagcgagtcaacgtgcgcccacacagcctaggtgtgtcttctttctttcctgggccttgagcccactagtaacatgcatgttggcccagtcaaaatatatacattcatccacattggtagctaggattggaaaaggtacaccgaaggtccctcaacttgccatcgagttacgaaatcatcccccaaccgtaaaaccagataatatatgacatccctcaacttataaaacatatatggcatccctcaacttacaaaaccgttcgctttaggtccttcggtggttttgaacccagttttatccgacgtggtggctaagtcagcgtggaacgcacatgtcagcgtggccacatcatctctattttccccttgatgtgactatggtcactacagatataaccattgctcacatcatggaagaacaagatgatattaagatcaagtcttccaagtgctggaatcagattcggccacctgctaccctgctaacttcaaatggccgccgaatctacatacgacctccgttttcggcccatgaatacttgatggaaagctctcggagtcctctttccaacggatccggcctcatcaccaaattccatccaagtcatccgcagatgaagaaacaatgtgctgcatcacctgtcatgggcctttgggtttgtaatttcgtttgggaccccggcccaagtggggcctatgtggggtgcgccccaatctggtggagcacgaccctaggatcctcttggttgttctcccacccctataagtagctagataccccttcagggttgcttgggttttatttagattaaagtttagctttgttactttgccgtgtaatcccgtgatcagttatatcgccgatttactcgttacagaaccccaacctatcatttgtattcaattcatatctgcaattcagattgtttttatcttattcttgcttgtttcttcgatttgcttgcaggaataacgttgatctgcaccggcaagatcaacaacccacggagaggtgtatcgatcgctaaggcgcaagacaacaatgtctagtacggttgtaatcgggtcgtcaatatttctctcaaatcgtagttatctcaactcactgaaagatcgggccaacaacagccttgagtgtctcgagtggagctcagggttcatcagcctctctcttccttgtctctctccccccttctctactctgcaagatcggcagcctcggtggcgtgcgtcgccggtgattgcgatgacgggggacgcggcggccgtgggggaaggagatgtcggcaggcggcgcgcggacggcggctgcatgctatcttggccatgg

SEQ ID NO: 7540 - DNA, 14721 bp, Oryza sativa
ggccctcctgcgcatcgccggcattcacgtcactggccgtcgtacactcgtcttcgtccgtgtggacctcctactccagctcagcctcgtcggcgcgcggacgccaccgcgcgcctctccttctgtagctcctccaggctccaacgcgacctccctccgtctctcctctgtcacaaaccggcgcctcagccgctccacgctgccgccctcctccatgtcaccgccattcgcatcactggccgtcgcgcactcatcttcctccgcgtcggcctcctgctccagctcggcggccgctgacgccgccgcgcgcctctccttctctagctcctccagtgcgacctccctccatctcccctcggccgtgagccgccgcctcagtcgctccacgttgtcgccctcctctgcgccgccactgttcgtgtcaccggctgccgcgcattcgtcttcctctgcgtcagcctcctgctccagctcggcctcgtcggccgccgcgcacctatccttctccagctcctccagcgtggcctttctccacctcccctcggccgcgagccgccgcttcagccgctccacaccgccgccgtcgttcgcgtcaccggccgctgcacactcgtcttcctccgcgtcagcctcctgctctagctcggccacccgccgcccgccaacagctcctccccccaccgccgccacgttgcccatagccgccatcactgccgacgcccgccgccgaggcattgcctgccttgcagagcagagaagggggagagagagagagatgaggaagggagagaagagggtaaaagagagatgatgtggccacactgacatgtggggccctcgtgagttcctcgctgactcagccatcacgtcggataaaaccgggttcaaaaccgccgaaggacctaaagcgaatggattttgtaactcgatgacaagttgagggaccttcggtatactttttcctctaggatttgattctttttggaatagagagactatatataaaactttacacataaaaaagtttatacaatttatacatatatgttttgtacctatgtgtatataaagtttgcacatataaatttttatacatatataaattttatatttataattttgaatcgaattcaaaaacaattcatccaactcttcatcaagctagagtgtcaaacgaccaaagtatctcttacgcatattggtagcagtagatgtgggcaaaaacaaaccacgaacggaatgccgaaccaaagttttggtttttcgattggttcctcagtttctattttcatgtaactcagtatttagtttgtagtcgtatgtccttttttctagtgtgaatcaaacttactgaagaaaccgacaccatgcaagattaaatctttagagtagatgtctttcacctgcttgatgtagacagggcacacatagctttcgcggttttgtcttgtgagtggcataacaccaagtatccaaccttggtcgtgcacttgattattgttgggacttgggagtggctcggcttagctgtagacatgctcctctttgacaataaaccaccaaagcaacattttttctcacaactatatattgtgattttctactatacagaaaccgaacatccgagaaaccgaaaaagccttaaaacggatgctcaccttagcacatcctctcaactctcgaggcacaccttggtattcataaaaaggtttttcgtgaccgcatgattagatactagaagctgccaaaatcccaaaagggtccacgcattcaaaggtgagaaaaattagctcttctactctcttgaaatattctctctttttttaaggcttaacttataagctaaaaagtctaatactaaacaaataagcagctttttcgtttggctttttttaagccataagccactctaacactattaagccactctaacactattaagccaaaacctaagttggagaagcttttttggcttatataaggtagatgtacgactccaccactaaacttaggatattaaatccattggtataaatcataagccgataagctaacttaaaagcctaagctaataagtttagcctaaacaaagagggcgtccctataacataagcacaattacattgtgtggtgacatggtaagtcaccccgcacctttatgttgaagccaagtcgccaccttagcctaaagagtggcctctagaggcgcacatgtctcatgaaaaacacatacggttttttaagcaacttgaaaagactacttgatgcgtaagctattgtggagggagttgtgttcactactaaaaaaggcacatagagatcggcgctataggtgcctgaagtgcgaaaaccgacatatgtagacctttttccatctccgtagactaaaaacacaaaaaactgacacctttaagtaactataggtgcctgttataaagaagaaccgacacccctatattgagcggagtcgaaccgcaccacaccgcaccttgtcatccatatcctctcctccttatctcttgtatgtccttatcctctccaccgcatcctctcccatctctctctctctctctttctctctctctctctctctctcaggcgcagtggcgtgtggtggcgggtgaagccctcccctccgccagatctgtcgggaggggaggtgacggtgggaggcaggcggcgcccctcccctctgccagatccgttgggaggggaggcgacaatagcgacgtgcgattgtgggcgacggcgggaggggaggcggcggtggcgggtggcgccttcggacgtgctgtgggatctgcttcttcgccaccgccgacgagctatgcaagatgggacccgatgtgctgctcgtctgctgctccatcctctccatggaggccgtcatccatcctctccatgttctttgtgttttgtgtttgagttgatgttctttgggtagttcttgatgccgattaattctatgaattaaatgttgggtgatatcgggtgaaggggagctgctcgatgctttgagccgatgcattgagccgctttttttggggtgaagacggcagctacgagcttttttctttgtttgtatttttggacctcaaaggtgccggttttggagccagcacctttgtgccggttggaaaatttgacatctatgctaggttcccaaccaatacctatctagtttgtgtagtagtggttatgccagtagttctcttccataaatcatcatggtggtttttttccccttcaaaccactgtgcattgagaaggaatgccatgtacagtagctttaacctaagtggcacatttaacaatataatcaggggcagaaacatgcatggggcagctatagcttgggccccacacctagcttcataatccccattataatcttgaaaaatactttgtaatttgtgaaaatatttaagctcttattagcttaattaaccttgaactttgtgcctctccgtcaccagatatatgatgaagggccaccttgaactatagactatatatctaaaacctccaatatgatacgtaggttgtgttttagtttctgaaattgggagaagtttggagaaagttggtagattggaaaaaaaagtgggaagtttatgtaagtaggaaagttttggatgtgatgtgatgtgatgaaaagttaggagtttgagggaagtttagtgtgaactaaacagggccgtagtatatactttctcttccgatacgacaggacacacccttaaggttgattttgacaactggcacacagacaagacacgtgttgcgtcacagaaacccatgcatccaggtcagctcttacgtaggttagttcacactgtgtgtggcggcgctgcacttgcgacgacgacgtacgtatgtacgccgagacatgtatgcacgtacatactagtaatgtatacgctagctaaccaccgtttgaccggcgaaattaaacctgttgggccgttcttcggtccacggtcaaaaccccgcacgtctgaccttgatcgctaatcgcttattcgcttacaacgagggatcgaggagatcaagggatcgagtaattgcttcctccgttttatattataaactttctaggattggtcgtttcatattataaaactttctagcattggtcgcattcatatagaattgctagaaagtcttattactcggaagactggttaaaaaactaaggatttgacatgatatgaaagaagaagtatatatactaattaggtcgtttaattagtaccaatatatcatagcttacgtatgatggtttaatttcttcgtggctgagcaaccgctggtcgtttggaattaacacggtccaacgaagcagatcagcatatggtcctttcttcccaggcatgcatgactagcgtgcatgtttcgtgccttccaaacaaagtgctgtatggcgagcgagatcatctcagattgttcttcgcaactctttgcgattattggggctaaaatatctgtaaatttctaaactcatgatttgtgtgttttgcaattcgtgatccggtaaccctagatactttttctctagtttggcaaccgacgacgacccagagttagggtttgaccatgaccccggattgacatgatggtaggaaggtatgtagagggagattgtcggatttaaagcgatggctatgagaggcgtcggtgtcaaagccatgaggatggaagaaggcggtggtcgagtcgacgttggcggcggaggcaaagcaaagaagtggtaggaagcggtggcctagatggcggatccggtagcaaggaatcacttgataggccttcgctgctactagattgaggaggaggctggtcaggaggcctcgccgacgctgttgacgtctttcgaccgagcgatgacgtgttgggtggggaggcgtcagcggtgcgctaggcattatcagatgacatccaaagagcgttaggaaagaaccaagggggttgggggatagatgataatgtagaatcactgtagcagtacgaatctcgaaactattagatagcctagcttaattttgcaatattctaggtatttttttgtcaaatgaaatgagtgcttttatattcgtacgtaccaaacaaagtgttgcagcatatagtactagtttatccatctttatcaacaaacgtataaattcaccgcattattttatttattttttattatgcataagacgtatgcacgcaccacaacactctcatacttccccaaatgtgcccactctcaaatagatggaagcaaacagtgaatccccacaacactaatgttgcttctccaattattttatgtttgtctttctaacaagaacacaattcaatgtgtaattcatcattttcactataatcttgggctagaataatagtaaatttaataatggaccaatctcgtgaaaccatgcatgacgaaccaaacttatgcctacaaatgtacacatgggcatatgttaatatattttcctttatttttgtcactccttaaaaatatatgaataaattacactgatagtaaatgaatttgtaagatgaatataattattttaatacataaagttgtaaaacgttcatttcattaatttatacaaagttgtatggtacatgcaaattaacttaaggccaaagcggcacagtatgagtaatcttgctgagttggatgaacaattgaaatattctccttattagtcaaacattatgtctaaatagaggtataatttactcaaaatatattatgtcctaattgccatcgaattcttgcgcttctctttttccctactgttctgctagtattcctgacccttttttttaaaaaaaaaaattacccagtttgacgttatattcttttaagaagaagacccgtatgcccttatgtaaactgcaaacaataggaaatccccaaaataaaaaaaaaacaatgattatttttatgtgttttaaactatttagtatatatcccgcaaaaaaactacttctatttagtatatacaacataaaaaagaatctcctaaaatttatttatcattgtcacgcaataaatagtggcattacaatatttttttaataaataagtatgctgagttctctttttcagaaaaaaataaacaaattttgaaaaggttcggggggaaaaaagaacaccattaaaaagtggacaggtggcctcggtttgggttggtgcttggtggtcatgtctcgctcaacttgggtggtcatgaatcatgtcacggtgcccttgccattttgcaagtgcttcctgatcgacctgacggtcaggccacttcattgattcatcggttgcgcttgcacgcacccacgcgtatctatccgagcaaccagggcatcacaccccatcaacctaacattcgcagccataattaaaaaaagttaaacactttctggaaagaaaaaaaaaagggtgagttacagaggcatagaacagagggaacatattctatgcacacaaactttccgtgcacacttcgtgcacaccaactaacaaatgctacgaaaaattctaccagaaatacacataacctttctgtgcacaccaacttaaaaaataccacgaaaaattttagcagaagttgaacatttactcatattagtattacacatatctacaaagtctcatatttaaatttattatactttagcctaaaaaaaggtgaaaatctgacagtcttaagggtaaaaatatgtcagaatcttgtcttttttattatggctaaaatataatgaatttgaagataaaatttcacatgtaggtttaatactatttgaagtatgtgtacaattttttttaaaattttttgtgatatttattagttgatgtgcacggagtattcataggaagcttgtgtgcatagtatatattccctatagcaaataggttgcctgtaaaaatatcacactcacagaacattagataattagctgaagaagagaaatgacgagccacccttcgtatagataacaacctctatataaattctaaggtaagttcaaagagagagcgagatagtacgagagtgaattaacaaaagataaaatcacttaggttcgtgtattagagataatatgttgttactttctccatccaaaagtcttatcctattttatttgttgcattgtttttatttaatgagagggacatattttttagtcattatacatctaatacttaaatgaatggatcgtcttttcattttaccgcccaagtaatcatcttagagcaagtttgatagtatatctaactactccaaatcatctatagttaatctaatagactattcatacaaaagttactacaaatatatactacgccattatataattggttccatctctcatacaaacacaacatcttaaaatccgtactgcagctgagtgtaaatttgcaacacactttttttctctctcatctctttttttttctgcatatgcttatagctagcttatagtatgctattgtacttgctcttaatatatttattggtttgtatgtatgcctataatttattagtctttgttatatgagggatgaggtaagataaaagaaatagtataacttagactttagcatgaagggagtacctattaactaatgaacagtagatggtatgactgaaatagaagagaaaattccttgtttaccttaaaagttcatccaatctcttctatacccatgagatttgctcattctttttcatacccctaaatttcagtttggatccattctatacctcttccgttagttgaccgttaaattcctaccataaattccattttgccctttggtattgagaaaatataaatttatgatttatattgatggagtataaaaatttattatatacaactattatgagtttattttgtgagatattatttacaaaaataatttttatcttgtatgaaaaaaataaattatcataaataatatcttgcataacaaagtcataaataatatttatgataatttatttttatatatgacataaaaataattttttattatttatttcgaacataaatagatttatcttataaaaatattgtactactgtaacaaaatatgctatatatacagtttttaatggtaaaaaatatattatatttgttatttctaaaaataaactttgtcatagatatttttttttgtttttccttcacggaggcgaaactaaaatattatttttgttaaataatatcccacaaaataaactcataaataaaatagtcgcatacaataaatttatacactcaatcaatatactttataaaattatattttcttgataccaaatggaaaaatggatattattgtaggaatttaacggtcaactaacgaaaagggtatagaaggggtcaaaactgaaatttagaagtatggaagggaacgagcaaatctcagaagaatagaaaagattaggtaaactttcagggtacacatgcaattttcttgaaataaaaactagtagaagtaattaactaaaccaaaataataatccacaggtttcaatgttaatatcttctttctataaagctaatacccactaaatacctaaatctcaacatgcaatcattgtatttattagtacttctaaaacctacacgcaagcatgccacgtcaatccagtaaacacgtaaagctcaacatgtaagtatatagtaattatatttataatttattttattctaaaattaaacatacacatgctaaataaccattctcaaatcatttttataatatttcaatctaaatgatttcatcatttctccattatacaatatatatctcgcagcaaagcgtgagacattatttagttcatatggtatgactgaaacaaaaagtaggagtagtatagttactaaaccaaaataataatccacaggtttcagtgttaatttaggtaagtatcactgtatcatcagccgctgttagtatctgacgagatgtcatcatcaaattcaaaagcaaaggggaacaacaaatacagtagaaaattaatcttttctccgacgaaaaaccaacccaaatcaagaaaaattcgtagcaaaatctccttgatgctaccactactactatttgccggtctaagctaagctttctctcagtcagtctacaattattattatactactatatcaaatccaagactgctttttgtctaatcttctttttctttggtcaaccaagggcatgggggccccactatatctttccattaggctaaagttataaaagaagcagcagcagctataactataaaatctccctccatttttagtctacctttcatagaggaacaacgaaagatcaagagagagagagagaggcgaaatcaaggcccttttcttttcttgcgatttccaccatcgccgcccaaagcaaaagattagataagcttaatccccacaaaattataaggattgttagacaggaggagtaatcgatcagagaggggagagggaagagagatcgatcgatgaagtcgccgttgctgaggctgaagggcttcggccaccaccagcagcacagggagaggaagtcgcggcagccgcagccgcagccgacgccggccaagctcgacgagctcgccgacgccgcccaggtgcgcgagtccatcgacttattgattaattgattgatttattgatttcttcctctcctcctcccatctatctcctgttttttttttttttttgggatttctgtgatcaaatcggcgtcaaaatcggatcttgggaggagccctatgcgaaattgcgatttttagccaccccccgcgttgttttccaggtggagtgcgctgttctttggttggtgcactcgtttattgattaggtgtggatgctcaaaatgattttactactagtagtattttggttattcaatgcggctggaggaacagagctcgaactgtttaaatagaaattgatccatcaattttcgtttttaattattttctgatggtcattggtggtcgtttagaataatcaaagctttgaacttgccccgtgttgattcaagcgtgcagaaggactaaacttttatttaatccaaaccagggtgtgaataaccgccggaaaccgcgcggttaccgcggttaccgcccgtaccgcgggggtacggttacccgtaccgcgcggtacggtttaataaaattcatccaaatttaaaaatttaaaaaaaaagaaaaaaatcaaaaaaaatagtgaaggtagtgcttgatttatagtgttttatggtgaagaaatttctcaaaaaagagtaatatttattcaaatttgagagcaaaacggagaataaatttgaaaattggaaaaagaaaaaaaaatgggccggcccgttactgtgcaacccattacacatcgcgcggtaaccgcgccaaaccgcgtggttaccgcgtcaaaccgtgcggtaaccgcgccaaaccgcgcggtttgcccgaatttttgaattcaaatttcgatttgtaaatttgtcgcggttttgcgcggttaccgcggttaccgccggtaaccgccgtaccgccgggtggcggtaaccgggcccccggcggtttttgaaaccctgatccaaacagtaggagcctcgtttaaattagtatatcggatgttcaaagtagagtagttgttaggctaacctccacgaaaacgacgtgcaacttctctgcaattttgccctttacgtgtttgcccgggagccattctgctcgcgggtcatgtctggtcaaagtctacgataggagaggacgacgcgtccatcggagaaagttgctgcgaagatagcaatcgattatatttaatataatctcggtcagctgttcgacgtaatcttgactggaactctggataaagtatgaacgcttatccaagaacacgcacgagatattccgttccgattccgcgtcggtctctggtgctgaattgggagttgaaccatgaacagagaggagtttctgaagtacgccagcttagttgcaatttctgactttccaccaattattggacagagtgacaggcaatgcaactaatcttgatatcttttgtgccatctgaatgatgacactgagaagcacttgcaatgtaatgcgccattaagctggagaagttgttctcaacagcctactgctactgttggtcaatgacagtgatatgacagaaactgtttttccctttacttcgccttatcagatatatgtctaagaggactgtgtgatccatgttttactgggcagcttataatttattctgctttctaatgggttcagcttgctgtatttggtacttctaccctttcttaggattgtggctgcctacaatttattgctggccagcaattaaatagtactagtctattggtaatgggaaatatttcctttgcattgttgcattcataactgaaatatggttttgcgtttgtctcaggatgtggaagaaatgaggaactgttatgatggcttcatttcagcagcagctgctacaacgaatggcgtatatggtacctcctgtttctaaattctaatgcttaacatggtttctgtcaacagttgatagcatgtttgtctatacatcatttcttaagttgatcatagtgtaatattgtgcagagtttgctgaggctttagaggaactgggaagttgcttacttgcaaaacctgtgctaaatgacgacgacgacgatagtggtgagttgtccattattaaccatatagaaattcatggtgtaaaacatcgcgttactagattctaaccactatgaaaaccatgtatgcttgtacttccttcagtccaaagtttccttttgttgactactgtaatcgtttttatgcttatttttttaccttcaggcagagtgttgatgatgctcggtaaggcccaatatgaactacagaaatctgcggatagatacgtaagttacttttgttgttactgtgaatttttaaaacaacaatttggaattcattatagttatttaaatttttttaccacgttacaatctgttggtgctgacacgcttttaaattggctatccagcgaacaaatatcatccacacaatcacaaccccatctgaatctcttcttaaggagctgcaaactttagaggtttgatatacaaaatttcctctgaaatctttgctcagttatgtattcttataattgaaaacaacaactgctaccactttataccaattgtttattggctactcattagttggttaattaggattgcctgtgaaccacaggaaaaacaatatgtttacatcaatgtagcatgatatgcttatacattttgtttgcattgcgcaggaaatgaaacaacaatgcgacatgaaaaggttcaaacacacctcaagttcattttcatttttggtcatttctcactgagacgcatcttgaacaatcctattctgttccctgcagggacgcatatgaaaccatgagggcatcctatagtgacaaaggagggtcaaggcattccaaaaccgaatcattctccacagaacaactggacgcttcttttcttgaataccaagaggattcagcacttttcacatttcgcttgaaatcattaaagcaagggcaattccagagcctgttaacacaggctgctcgccatcatgctgctcaggtaactcaatgaaactgttaactatttccctgagatttgagtgccacataacctaactgtatatatattcagttaagttttttcaggaaaggactcaaatgtctcgaagcacttgaacctcgtgtcaaagcaatatctgagaaacatcacattgactataacttcagcggtctagaggatgatggttctgacaatgatggctacagtacttacgattcttgtagtgatgacggagaactgagtttcgactatgaaataaacgatagagaccaagattttcttacttcgagaggttcaatggatgtaagttccatttatatttggttactgtcttttaatttgtttgtgtgccttacagcagaggccatggatgtaaaacatttccattaaataataaaaaaagcccttttaatgctgctgcctctcatctagtgcttctacttaaccacctcatacatatatagcctagtttcagctttttcctcttaattggttttacaatatatggatcttataaatcagcatcaatggtagcatttgaactggcataagcttcaactctttatgctttctttgtctaatcagctcactaaggttctatagtttgcactgattatctctggaatttgctcactttattttctgttcatttttattcataaaattctactgagaatactgatgatctgtcttttatatttttatctaatttatgttcttttattttgtgtccagtttgataaaagtgatcagactacttcaccaaagccaatcaaagaaaacaagcaggtgtgctgccactccataatactcatattagaagtgttctaactgggtcgactaatatgatttcgttagttagttatttctcttatccaaatttcactacgttttattttgatgcactcactgagtttggaaaaactattatttttcaatgtggtggttgatatgagtgtttacacccaaatctatcactactcaaagagcaattattcaagcgaaaaaaatatatatgtatgatgcaccttcaccagcctctacccctctatctccagttttgtaccaagttaacaaaatgctagtacatatatttatattctgaaattctgattggtatctcataataagcaggaagaggcaaaacaagcagaggccgaaatagtgttcccgcaattgaagcccgagttcgctacacattcagctccactttttgctggcgatttgcttgatgaaactgacaggcttcggcaaatgaggccatcctcaaccaaacactcgtacaggctccctaccccagttggtgctgacaccccgtaccatcaggttcacacaggctgcatcattccgcgcaattcttcgaaacaaagccccatgccccgacgaatctgtggcactcgtctcctctgacaaaagactacaatggcgccatgcacaacgccgctaccaagccgtcgtcatcatcaagcaccgatgatctgaagaagctgaagagggagtcatggtcaggtccgatcccgatcaaggccgggtcaggcggcaagcccttctctcaggctgaccacaggccatcgcccaccatggcttaccctggtgcaatgcctgcggccaagccgcacgtccggcacgcgtcgtcgtcgtctgtgtcacccaaggtttccccaaagatgtcaccggtgccaccagcatcgtcgctgaagatcagcgagctccacctgctgccgctgcctccagccaatgtggatcctgtccggccttctggtctggtcggctactccggccctctggtgtcgaagcgcgcgccgacgccggcccgtgcctccccgaaggcgtcaagaacggcgtcgccgctgcctaggccgcctgcggccttggcaaggagctactccataccttccaacagccagaggacgcccatcatcactgtgaataagctcttggaggctaagcatagcagggagggcagtgatgcttcttccccaccactgactccattgtcattgtctgatttgtgccaccaggagaaggcagggaaggcagctgcaggcaacacaaggagaaagggt

SEQ ID NO: 7541 - DNA, 14398 bp, Oryza sativa
ttgcatcaccttgtactactaaatgagaaatggtaccataatcttttggtacttttatttgtttcccaatgtgctaagaaaggagatttaggctgctttatatacatattgaaatattataatttagtttctgtagtttcatgtgtttctgcatgccatcaagaattccgacattttcaatgttatgtgcagtccttggcaagtatatatatatgctatagttgtcacagatcttgtagattttcagtcttgtttttgttagttctttctcagaagattttgtgaaccatctaaccatcgtttttctgttcgttgcagaaaccttgtgatacacccgtcaaattcgaaccattgctggacaattttgtttgtaagttagtggtgtattgtaggtttttgtgttcataatattctttcgttttgccacctgccttgtaaataaaaagaaataaaggtggcaaagcaatgtaagtatgtaacacattctttaacgctttttttttttttttggtttagctatctacactagttcttttggttcagaaaatctgagttagcaagggcatgaacagtggttttacaacaggttgtgctagttatctgaaataacagatatgtatcattgatgattcgattctatagattttacctagaatggtatacatgattaagctgtctattataccttctggtaaacggagttcttctatcctctttctcttccttccatatcgaaaaatcatgcatggcattctcttgcggatgatgttgtcacaccttctgtatttttctcatattacaaggtgaaaccccccacgttactgtgagagtttactatgataataataagtatgtgtatgataacataagcttacataacttgatatggtttatgataatttaaatttaaatagtatatagaatgatgattcaatgtaaaagtaaggcactatggctttatgagagaagaaaaagagagagataatttggaccataaattaatcatctaagggtaaaaacaattaagataatatggcttaatgagagaagagaaaattaatattacctaagtgaggatgaactatatagaatgtgtgggatgatgatttaacattcttgcattttaaagctctaaaattcaataattataaaattatagataatatagcatgcttgcatgatgtttaaatataacaattattagtggaggatgatgtgtcatctttgcatgtagagctttagaatttagtggattataactttatagtaatactaggtgaaaccccgcgcattgctgtgggaatttagtatgataacaataaaaaaaaatgtgtaagatagctagataacatcagattaagtaaattaatgtggtctatgataatttaaatttaaatagtatgtaaaatggtgattcaaacgtaaaaagtaagatggtatgactttatggaagaagaaaagtagggagatagtttggaccgtagattaatcatctaaaggctaaaaacaattgatatgatataacttaattagaggaaaaaaagagaaagataatttggaccatagattaatcatttaagcactaactaagtgaggatgaactatataagtatataggatatcataaaacataataaagatatacattgaaacattatatgaattatgttggatgataatttcacatgtttgtatttgaaaagctcttaaattataaaaactataaagatatagcatgattgcatgatgtttaaatgtgatgattgttagtggatgatgatgtggtatcttgttaattagtggatgatgatgtgacatcttgttagtggatgatgatgtggtatctttgcatgttaagcttaaggagttagtgggggataactttatagtaagatatgataagaattatgtaggatgataatttaacattcatgcattttaaagctctaaaattcaatataaaattatagttgatatagaatgcttgcatgatgtttaaatgtaataattattagtcgaggacgatgatgttacatctttgcattttgagctttagaatttagtgggttataagtttgtagtaagataagatttaataaattatttggacaatgcttagagaaaaaattgagcgtcccactcccaccgagcctgcatacatgcatctattaatactcatctaatttataatttgattaaaccattattctcgttgcgattaaatatttataataagatctcacttgattatgttttgataaaatattatattacatgaaattgtttcactacctataaaaaattgtttcattacttactcaaatgtttcaattaagtttctaaaatgttttagaaaaatataacatttttttttgaaggggagaaaaatgtaacatttagaaaatactgactgcaacaacaacaaccactgtataattaagccccaacgaatgaaacatcacaaagaaatcatatgaaaaaatatttcaaaaatacttgacattacttaagcgtgttcatatcatatatgaaaattcagttgagagcgttaaaacaccataaaataatttctgaaaaagatttcttacgcttcagggatacgaatccactgggtagggaatcaaaatgcacttcattcattcttgtccacccgttgcccagcccagactgcttaggcccacatgttgaaggcccacctatgccgatctcctggaactccggcatcctcgccagtagccgccgctcccaccgtccaacgaaaggaagcgggcggccggcgctcggcggcgctcggcaggcatggcgatcggatgggatgggatcggatcggcgcagggccaaggcccgagggtcgcatcctgcgactcctgtgagttcgtgggctatgctcgctcgctcttctcctgaggtaaatcaatcaaggctagctgcaaagctcttgtgaaagaatcatcatgttcgttttaccgatcttgggattgtgctcgtgtgagcttcggtagtttccacttacatgtttttttgttctctagttttgcagagatctagttgtcagttgcagatttacggtcaccttgttgcaattttttttcgaacggtcagtgcgttatcaacgttttatatagagaagtgtctcattttaatgagaaaacgtaaccccaattttccataattaattgtaattttttttcaatcggtcaggctgttactgacgttttatataaaaaagaagtgtcctattttaagtaaaaaaggaaccatcacccagtttttcctaattaactataccttgttgcaaattgcagaaaaaatattccgtatatagtatttagtatagattatatcggtaagcattgacatccccacacaatatggacacagttcttttaactatgatttcagtttactatgcttccacaaactcgtcgaccatagtccatatgacacagttggaatctatgatttcagtttactatgtttccaccgactcatcgaccatatcctacacggttggaatcctggagatggttatattaattagaaagtcggctgttggttgcttatttcaattctgtgacccattgcgtaatgtacaacagtacaagccagcacaaattattgtctggtttagccaaagaatctggacacaacaatttgatcatatagcactcctactccaaagaacatgccaaatgcaattgcgaagacaaacttgtcaatgtactgctttgtggggattgtggagactggagctgctcctgctgaattgcagcggtgcaaaagcatagggctgcatagcttcgggttcccagcaaaactggaagttggaaatgtgctgaactggcctatagttggtacaggcccttcaaggtcattgtaagaaatgttgaagttagaaagaaagtgcaagttcgccagtgacgaagggattgcacctgtcagatggttggaagacaggtctagcaccatcagattcttgaggttgctggccgattgcgggatctccccatgtaagttgttgaagctcaagttgagtgagaggagcgctttcaactgaccaatctccatggggatcacaccactgaatttgttgttacctagattcaacattttagggaatgcattagccgtatggtactgaagagatggagccacaaaaactggcatccgaaagagtcttgggtttgagtgatccgcaatcttgtctgatcttagcattggcatctctgttagtgatgttggtatttcccctataaggctattattggataagtctacatacttaaggtagtttaggctcttgatccaggttggtattggtccactaagttgattgttgtataaaagtagaagttccaatttttttagctttgagagccaactaggtatttttccagtcagtgcacaatcatttatgccaagaacctgaagattctcaagaccatgaattgtttcatcctgtgaatagtttcatgcatgaaattgcccccaattagcaaggtagtgaggttccttaagctcttgagtatatgaagtgcacctgtgatattggtaaagtagttgtacgaaagagatacaaaggtaagggatttcaacttttctgtctcctctggcaactgaccgtgaagcttattgaaagataaccgcaaccaagttaaattactgcatgagtagatacttgctggaattgtgccggtgaagtaattcgtgcaaagatctaaagttttcagatttggtaggttggagaagttaaccttagcaaggtctcctgtgaatttgttgctcacgaggacgatggctgctagatttgtgcaattggccaaggttgatggcagctccccagatatgtagttatggtccatgcgaagctcctccagtttcttgagctcgcctatagattctgggaccttgccactgaaactgttccccccaagatcaagaaaaactagattactgagctttatcacaagcttaattgttccttgcaaaccattgttaggaaaagagaggtactccaatgatgtggcatggaagagatcatccgggagggccccactaatgttgttgtggccagctttgagcattctaagtgcagagcatttacctatcccagcggggatttcgccactgaattggttgtagcaaaggtcaagagcagcaaaggatagtgagctgatgcagaaagaggaaggtatgtgcccagtgaagctgttgttgcttgcattgatcgctactaggttgctcattttctcccatgtggtggatggaaatgctccagtaaacagattacttgagatattcagtacctggagtggccaatcagatgatgatgagtctacctcttgtagttccccgccgaggcggttgaagctgacatcgaggacaacgatgctgccagagaatatcagctctggcggaagcccaccggagagtgagttgtatgacaggttgagccgcgacaagctggtgagctcgctcagggatgacgagatgcgcccttcaaggcctcttgaggccagcaagatcttggttactgcaccatccacatcacagatgatcccttcccaggtacagcagtcggtcctattcctccatgacgcagcgaggccattatcatgtggcggtgacagctccgcgaggaaccggaggagggttagcctctcctgctcaatgcatgaaccgacgggaggacagatgaagctcagcggcagtagcacaagcgcaaggtgaaagaaattcatgcgaaaactgctggctttgtttgcatgaaggatgtgatttggcttcttggtcagtatttctgtcagaaactggcaggctactgagcatggtttgccaatataagctggtatcctgtgcaaaaaaaatacagtccttgagctatatattgtcgaataacattgctaaattccttgcagagagaaagaatagcattgcctaaacgcaccaaacaggcgaagaacaataagctgatggaatgttgacctacgcgtttgctactgctgcctctcactggcttagtgctatgcttaggtatggtttgtaaattcgatctattatttgctttcagcatgatgtgttagactcacattgtttgacggaaatacttgcacttaaaaagtatatttatccatacacttggccacttgagacacactagtctacttgagatgatttgttaaacttccattccttcactcctgaagcagagtcatggtccaaagtctataagcctacactgatttcctttgatttatctatttttgtatgacgtacactgctgctgatcttaacaacctatccagcagttgcattttgaattcgtccccaactcgcgactgttgactgttcttggccttcacagcaattgaaagattgacctgtgttttgttggttacattctactctttttatgtttccttgagatggttagttggatcaatactgaaagtgtaaccgatgcagatctaaataaccatgtgttgcgtgctgctgctggaatgcgcttgcgtttgcaaggttgaacaaactttgagccttcaacttcctagtaaaggctgagccttcatggacttgcttgtgtgttgtactgctatagtgctatctacgagtactactagtataatagaagtattctggttcaccttcattgttttctacgaagtttgtatggaaattagttactgaagtttgcatgcgtagatgctttctggagttgtgccattgaagctgttcatgggaagatcaactgtcgttagattagtcaggacaccaactcttccagtggaagttcaccgaacagcaaattgcaggacaggttaggccatcgtcgtctcctggtctgtggaggagctggttgtagaattattattattatttaaatctttttaatttttaattttaaaagtaaacctttctaaatctataccttttagccatgttagcacggtgaaacaatgttaccatgccgctctatctaacgtgtcaacgttattttgccacaccagtctgattggcgtgatagtaatgttattttgccacaccagtctgattggcgtgatagtaatgttttgccacgttggccacactagtggcaaaaaaaaaaactttctagaggcaagaaaaaacagccataccaaccgcggctggtgaaataataaaaatttaaaatagtaaaaaaaaattcttctggaagaggctaaacacagcatagaatagagcaaacccaagcaagtcactgggcagtttgcttctgcttttgcatagaaagtgggaatgactcatggttgaaatattgttttctcaaattggtgcagactggataaatctgtacaagtttttggatcagacaatctgacttctgccataatgtcctgaaatgtgtggtttgccttcaaaatgttatataccacatgatgcattccaagattaacaaataattttcaccctttggtcagatcaatgaactttgttacattatgtgatacagaacatgtataacgaggaccagaagtcagccatctcaacagtaaaaaaaaaggtcaacgaaaagcctatataaattgacaaaactggacatgactgcgaggcaaatatcgctcagtcacaagatctcacaatcaaaaaccaaagaaacatctgatcatctccaaccaagtgattgccttatccctgagaaaatcaatcccagagaccttcctatcatggacacccagaagtacgacactgcagcactaactttggtgacaacagcccttatgaaaggcatggcaatatctgacatttctaataataggctgaaataatacctcctgcaacagaacagagtaaagttatgttcatcttgccccaagtcgcacagaaatgtttccatgaattattcatgaaaagaatggtagaaaaggaaattgcgaataccatccagccagagctctcaattctttcgtccttctcaccggaagagaaaatgagcttatgtgaacgtactctagaagagtaacggtggaaggctttccaaatccaagcctccaccagtttgtcacttcagcttgattatctgctggtttttcacaaagttttctggataaaacatataactcaaacctgtcctcgtacattgagacaactgactcaaaatactggtgcagccacccattaattgccaccttaaaaaaatttagcactggattatcaaatctggaagtaagaaaaaactggaatagagatgtttcctaaaaacttaaaaatattaaccaaaaagaggagagttcaaagtgcaaatatttgcccaattagattattcacgtaacatgtactgtgatattcacttaaaaatatttgtttggcaatcaaaatgtcttataaggttaagagaaaatgacacagaaggtacacatgtggacaaaatgtagtatattagaatcgcagcatcgtctctgttcacagttcatttcttacacgtaaatcatgatgagaacttgagaaggctggtcgtagttaattagtgatgatataacactacaataccatacgagaacaataagagtacttgaagaaaaaatatttcaagatctgttagtctgttgatatggtttccagcttgggtaggatttaaatatttgttggcttgtctccaaggagactactaacttcatgcaaagccaactataaatcatcaacttaccaaatccaaactgtgagcataaaaagtgcttattttttggtgtatatacaagcaagttttgaaaagcacatttgaacagtaaaagcacaagcaacaccttgaattatccacaactattacctcgttacgcattctttgaagttctctggttgacagcgagcatagagctaagctggaaccaacaacatcagtcggcatatcaccatcaactgatataagctctatgtaaatactagcgaccgcgtcagctaagaaaataaccaggtcctccaaaattctcgctccatgttcagccagaaatttagcatcaaaatagctataagacctgccatcaggaaatgaaggataagaatgaactcatttaccttatggaaggattactgtttggtaaatagctatatatggatataagtacagacaataaacaaccaatagtgccatcttaaactcttaaacaggagatggagttcagatggaaaaaagtggtaccatatggatcaagaagtgaagataaatagtaccttgcagaaccaaatctcaggaaataaagcagatccaaatagagttcagatttccctaatctgttgaacctcttcaagatcctgtcatcctcctttattttgctggttaccgtcttcataagttcctttatcaggaaaaaagaaaactatcagggacttgaaggcatgacaatatggagaaatgtaagacagttgaaaataatggtatacttcattgatcttgctgttctcccaggctttttcttcttgaatccatttcataaatgttggttcaatcaagccatcaatcaacgtagttgatatttgcaaccatttgatcccatctacaagttcagaactttcaggaacatttcttacctgcacaagatcaaattaactacaacaaaatcaacacatgtgttctgacatattatacagctgtgctggttagaaagaaaaacatatcttgatactgactgaactttagtccatagttctagtggctagtcaagtaacattaaaaaaacaaagagagaaagcttaactaagctagtgaaacatgcaagaacaatcttcaggattcatccattataatactctacagaaggatagtggcaccattttagtagaaaatatcacaactaccagcttgcttaagctttttgaagtatgctctctcccttagaaaaaaaaataagtgaagtatgcatgggtaatcttcagtattcatccatgataatccccagcatattagaaagaaaaagttgatggccctcttgcctccatctcaagtagctgaaaggtagctagaagaagccgcagcctgggaccaccatgaattgcaagcatactcaaaggataatttttgcgattgttcttgagttcactatcgctgccatccgaagtggcatctcgaccattcgattgcaaggcttctgaaagtttcattctcacttcactccatgtatcgctggggtaaaacctagtattcccttcaggtaaccatttcatatccctagaaattggaatggaaagaatacattatcattttttattgtcaagccaatgttttgagatctagaagtcatacttaagcagctactcttacctaccagaatcagatggacctggagctccaagatgttggttttgactatggtttctagcatgaggaaatgcatggccagagggtacaactccagccaaatatgcaaaaactatactgatagttagtagagcttcatcagaaagcaataacaaatttggtgagatcatactctcagaatccacaagcgactgcaagaaataacatttaactgatgtttcgatccggcaacaccttccatgaaaacccaaaggagcaaatgcaccagttttctgttttcttcctaaattggactggcatggaagctgaatcttgtgactgtgattactgcaaatgaagaaaatcaaacattaaattaccattgaagaactcaagatgactaatatcaacagagtacggaaaacttttttacctctttggcagattaatagacataatccttgtggggagcttgctgtgagattggatccatctccctcgatgttgtcctctcagtgttgccaaggaacacccagccattacaaaaattacagtacttctcaacccctgttcaatgcatcacaaaggctgatagggagaaagcatgtttcctgcacaacaaaacatggaaaatggaaatttaggagggggagtgagcagggttggacgatatggctcaaactaacatagcatctgaaactatatgaaattccccaatcacaaaatgtggtatgatatgaagtaataagaacgcatattgaagcaaataccttattgtcaatgaatccatttagttaaaagaaaatatttggtattgaaacaaaacgaaattgtgcttatggtacacactctcatccatgtttccttgtaagttatttacttatatcttattttcaccccctatggccctgtcctcaaaagttgaagcacatatactttttaaccaacagtaaattctgaacaaggaatacatcattatacgcttctttccacacccaaagccctgatgaggatgtcaatgtaatgctctcactcctcaggattcttgtctggaacacaagaaaccccttctgccgtccacagcagctaagccgccgccccccaccctctcctccacccacctccctcgtgcgctccgcctgcgcctcctccctctccccccagatcgaatcgcggtggcgacgcacccgagagccaaaggaccaagaaaaaaacaatggcgcgaggaggggagggagcgaagcagagaaaaatccaacttacgggcagccggagaagcaggtccgcgggaggggacacggattcctccgctcctcctagctcttctcccacggattggagaagaatctcctactaccaagaacgctcacccgatgaactccatgcgctcgcttctttctcctttcactgccgcgaccaaccacaccacagctgtgtcacccatgtggcattcgctcgtcatacctacgccgggttcaccagatcgatccatacgccgctgactcagatgggcccgcatgtcatgtgagcgggagaagaggaggcgcacgggtgcaggaggtgaggttggtggtccgcgtccacgcgggggggctcgcaaagttatcgccggcgcaagggttgggtttttttgtgctttgtttttctgtggacgtgaggaccaacgtgggcctcgtggttgacagcaacagggctgtccttagcactagtgtccaagtctgtgtcacttgggttgggcccaatcgctttctagcagcccaagtcccaagtgatgtgttcatggcccattagggaggggaggtcttttgcttttgtactcctcttatttctttttgaaaggtttacatatatattcttataaagcaatcttttggggtggggtgggggggttataaagcaagtttgttgaaattaagccaggtaaaatccgtatcaagtaaaatgtttcaagtggaagggtaagggtagatatgaataaaattggctcaaatgtttgaattgattggtttctctggtttatccttcaacaaatccatggagtgaacttgattgttccaacaaataaggactcatatgcttatttacgggtgtacaattcagacctcatgaacatccaatgatgttggtctgggatgccatcctacaagattaccccgtccaccaagtcccaaactcgcaagtactcaacaatgacttagacaatgagtgctcctttgatatcagcagtccacccatgattttctaaagtttgtgctatggtaggatgcttgctaatctttttagggatcatatttactagattaggggccagctccgctatggttctattttgcaaccatctattcgaccaaccttcaacatgtggttggttcctgggtaaggattggaactacactctctctgatctcttttacttgccagtactgttggccagtgtgattttatttttgaccaataaaaacttttaaattacaatgttttgatgaatgtaagtagtatagttataattaggtgctttgatagtttggtatcttttaaaatatttatatttttctcaaacaatacgagcggctaattaatgtttgtacatagatagtattcgatgccaagtaaaaaaggaaccgttacataaaaagtgttcctcaatcaaggactagtattcataacaagagagtataagaggttttggaacacaaaaataaacagttagagatcttatgaaaattattagatattctgaaaaatcatatataggatcatactctctcagttcttgttttagttttgtcctaagtcaaacttctctaattctgaccgagtttataatataaaaatacatagacatctacaacaacaaattagtttcattaaatccaccatttgaaatatgttttgatactacatttatttgttattatagatgtcggcacatttttagttaggggtgcttaatttcttgctttggtaaagtcatataaccactgaaaattaattatcccaccggctgggtgtaaatgacatagtaaataagctgctagataaactcggttaaagttagagaagttgacttaggtaaaactaaaacgacctacaatatggaatggagggagtaaaatataaaggatagataataatagttggtttcatcatttccccatttttcttttttttgggttaatatttgataaaaattcatccatgtcatgatcatatttatatatggaattttggaacatgccatcctaattttctgttgatagtcatatatcttttagtatggaattttggagtatttgttattttgaagtgaatgaagtcagcaagaatgtgggttattgcagctcatactataaagtaaaatttctaagtgtgaaacttcatacatataataatagtactacttatatacagttactaccatgcaatgaggactgctaggctgtatgtaatatatatctacatatatgcttggaaaatagttccatatatttcaagaaacggggataattaagaggggaacttcatataaagatgaaaccatgaaactcatgggtatagtattaatatttatgctattttagcaatcaatcttctaagcagccccttcaacatatattagatgtttttccatgtttgcgctatctggtctaagcctctcctctagtctccgttgttggaaaataatacttttttcggtttttaatatattatgttgttaacttttgattattcatcttattaaaaaatacttaagtattattaattttattgtgaattgatttatcattaaaggtaccataaacatgtattttttttatattatatttttttaaaataagacggaacatacattcaaaaggtaatgatgttacctattaaaaaccagagagtgtccatgatcaagtaaagtggtcaatgtgtacgtgggatgcaggaagtagcattaattgaccaaaaggatgcatttttgttccatcaaaaggtgccaagagggaaagtagcaaagcatcttctagcaagctagctatagagattgagatgctgatgagatggatcatttttgtattaacaggagttgtgccaaaatatcttctactgcatccaaaatattgaagtaaagttagatcgatc

SEQ ID NO: 7542 - DNA, 16062 bp, Oryza sativa
  unsure (1)..(16062): unsure at all n locations
ctcacgaatatataattcagttctttcagattacttcctgcaggcggaccggtcgtccgtctgcgaagacccattttggagaatagttttcctagtagtgatgacttaaataattgtcaacattatactttgttaggatcgatgtttttactttttagtgtataaggagattgattgagtgtacaatttccttcaactgtagcatgaatgattcgatgttattgttatttgtatatacagatgtgtaggtatactatgtatgtattaaagtgactacaacaagagtgatagctctctagtcctaaacaacgatgaatgtacttgctaaaaatagaagcatcacgtccctcagacgtagttttgttaaaaaaaaaaagagatgtcatagtgcatttccacttttagtactatgtagtcacgtctcacgtgctaacggagtctagtaccattgcactattacttttaaaatctttggtgacttatatcttttaaacaatatattgttttcaagatttgattgaaccatcgtactctattgaaaatatataacaaaacgagctcaatattgaatatatttagattatttacttctatggcagtgttgttacttcgaatactatgaagagttacttccttatagcggtataattacttttaataccatgaagaatgacttccctctggcagtgcagttatttttaacatcgtaaaaggtcagttctatttttttaagttacttttctctaggaatgtagtaacttctaatattaagagttacttctaatactaatactgtgaatagtttatcctattttctaaagagttacttcttatataaaataagttgcatttatcgaaaacaataatctatacacacatatggtttacctcgaataaaaaaggcatgtatttacttgtaaatctacactttacctatgaagatatttttaacacatatatgtaattacttctaatgctataaaaagttactttcattatagagcttagttaattctaacatttaactaaattaattttaaatattttaatatattcaatattgtacttattttatcatatattttgagtgaagttcaatggttaaaacgggtgttaaaaataatatatggtttgaaatatataattcatcaaaaattttaaatagactagtactacatgaatactcacatctttcgatggctaccgcatggcgtctcgctgtaagactatttcgcgcgcgggaattagattttaccttttattttaggtgcatcatttatatgccccagcaaatctattgtagtatctattggtgtgtatgtataccggataggaaaagacatgatatattggacccgcttgatatattgggctcctactacaagagcttttggagttgggtatttgcaaggacgaaaccagttaggaacagccccagggcgattttttaaatattttttgaacctttttaatttttaattttaaaaagacatgccttttaaaaataaacccatccaaaatttattttcaagatctgaaacttttggcctatactatcacgccgctcctgctagcggggcaacattatttggccacgccggcgggcgcttgcgtggcagcgttttttgatcacgcgctctcgctggcatggcaagacaaaattgtcacacccactgcacgcgacatgacagagttattaggccacactaaaaggtttagatttagaaatatattttggaatggtctattaataaaattaaaacataaaaaggtctaaaaataaaaaaaaaagtttccccagggccagctctattaaacaatagattctggcttaaaagatgaaacatcataaaaggacctagctccgccattttatttgtaatacatgataaagttcaattattacaaattttcttgccaatccaaataaataaacaaattttaggcctcttttaaattgaaaaaaaattaggagagtttttataagaattaaacagaatcatgattattctccaaaggagtccttagagttgaagttcagagtagctcggagttattttagtaggccgtcatattcatatttttatgcctaaaagttaacttttaaactactatatttagagtctaagaactccatatatatttatgagaatgcttggagtcggagccataccaaacttgacaattgaacctatttgagacgtgttgccttgtagacctcagaaatagacggacagtattgggcatgtgccgagggaaaaatgagctgatagaccatgaccataagctgtcaaaacctaacctaaccgaatatattccgatggtactacaaaatgtatagatgtcaaagagcagacgaagttgttgaggggagatatgggtatctaggacaaatatataaatgcatttacactgcattgtccaactaatattattccctgcacacatataccttttctgtgctataaatacctgaagacatgcgtaatgaagcagagcaagccatgcatgaaagattcagatttgagagggttaatttcagagcttaattagtagaggaggggccttccatgaggacaagagctgattcggtagccaaggatgacttgcctaatgcctatgtgcatgtgtttatacgctgctcatctgcattttgattatcccctgatcagtcctgtcgtcaattatatgtgtgtgtagtactctgtactcatacatatataggcatgtcttccttggctattcggagcggctcttgtctctcgtggaaggctgcatgctgcactcttcttttttgtgcaggctttgcaatctgcgccgcattggttcaaatgttagatgcctcaatggaaacaactatttggatggcaggacttctttggatatgaaaaattacatgctatttatgctacctattttatagtaatgctcttattgatctgtttgtgttacatgtttattggtaagatgtccatggattgcaacgaaacatttagttttatggagattatatttttcatgattaggcgtccatacaattaagaatgaactatggaatatgcatgaagttgaaaaaacaggctatttctgattttcaggaggtcaattgtgaccatgctaggtgggacgtgaaagggcggacggatgatttctcgactaataagaagtaaatgtgtgcaatatagtaatatttctatacaacaaaaagtgtgctatttacttcgtttgaagttcgtattgtctacaagttggctgatatattccgtgtgtttgaccactttaaatacttcaattacgttcaactaaagaaatatggttatagttatatttatcatcaacgtacttcgattatattgtgcagaatttaaaatatttacatatctattacaagaaaaaatatttgtgaaattttaaatagcgttaatcatatatgtttgaccggtttctacaacattatatttataataacactatagtattattgaatcatttttgtaatgaattcgagaagcacggtggcatggtgttttagtcgtgccatacccaaggtcctagcctctcctcttctcccgcgacaccacaccgctgtcgccactccgcttagcgatgatgacaatgctttgcattgcttaagatccgttccctaagcgaatcacgtatatttttatatttttttggaattgtgtattcatgatattttttttcctcacgcggatgtacttttaatatgattttactgatgctgaagattttctaatggtcctttttaatgtgggttaagagttttgtgtgagtgtggtgtatgtgcgtgtatgcgtctttcatgtaaatcaaaaataaaataaaatttagacgaatttataccatttcatttttgtctcaacaaatgttttcttagaatgttttagagggaaatgtatgtaagggctagttggtttgaagccgaaatttgccataccaaaatattggtattttgaatagtaattttgtcaatgtttggtttaccaccaatacttcctaatactacacattaccaatagtattttcaatatttggattaagtctattttgcctccctcatctcttgtccttggtcgaatcgcatacctcaaccacaaaaccgagtataatgcctcccccatcttcgaaaaccggtgcaaatcaactccctcgttagttttgggagcagtttcacttggtccaagtgtgctaacgtggcacccggtcatcaaagaaaccgaaaatagaagcgggtcccacgtataaccacaagggtaaacataaaaaatagtggggcccacttgtaagccccagttctccttctctgattcctcctcccttctctctctctcaagcaaagctcacatgcactctggcgccggctgctggagggccagcggcatggctaggagggttggcagaggggtttaggtgcgagagagtgagcagtgccgcatgcgcagaggctgatttggaggtagggacattggagctgtaccgcgcggcaatcgccgagttcgtggtgacactattgttccagtacgagacggtgaccatggttatcaggcacaaacaccaagacgccgccatcgtcagtgaggaatgtggtggcgtcagcctctatggtgtcacctgggccttcggtggcatcatccaagaccaccacttggcatctacggcagcactcgcttcacactttgcgtctcagccgcatgatgtaaccaaaactcctcgattcccctataagagaccgcacaactccacaaaccacaagccgcctcccgtctaggaccccgttgtcggtgaaatgggaacccacgtacccatttatacggcaaaaggatcattctcaaataaatagcactatatttaaaaataaaaggtaaccctagggtgttgtagctagggggcccttccggagggctttgggcccacctaagattttatatatgggattttctctggctgaggagggatactgcgtatatggtccaaaactccgagtatagaagtagctttcggcctggctcgggccccaagcataccccaaatatgccttaaaaatatagcctatggtctgtctcgggcccggccctgttccataccccgggctcaccctagcccttgcagattctacaatcctcggcaagagggcgtaaaaacatgcaagatctatatcttaagaggatgagataagatctgcctcgggctcggcctagctctgggccctgagctcgccttagcccctacaagtcacacgttgctcaaggaagaagggtgacgaggcttgccaagcataaaggcgtgatccaaggtgtgcttcgggcccggccttgcctcgggcccagggctcaccttggaccttgtatagctcgcgcccctctactcagaggggcgacagaaggtacaagacacacaatctcaagatattctttcgtcaacgacgccttcgagaaactcatcaaggaataataaaccttctttaagcgcaataggacgcgacctcagaaacttctgggaagttgggcgtgctccacaattagttgtaaggcagcacgccccgccataaatgaaacaggattatagggggatccctggccagtctaagttgaaaggacgtggacaagacgccagcgttgagtcactttggacggtggcgcctgggacacacgccgcacatgccccgcaccacttgatttagccaaatgggcagagaagcaaatgtggcactgtttcgggcaggtcgggcctcgtcgggcccaccacgcaccacgtggtgagcacactggcggaggcccaactgtctcaaacgaagcctgggagcccggggtaatatgaaccgtaagacttgatgggtttcttgagggttgcataagggaaccagctggcaacgacaagacggctgatgagacaagactaagagtagatttgtaataatgtgagcccctccttggaatataaaaggaagggtaatagatacagatgaagggttgctttctgctatgtcagttatttcgctttgtagcctgaaaaggcctctcttgtatttagctgatctagagaaaacaaaaaacaccaacacaagagtagggtattacacctctgggtagcctaaacctgtataacctcctgcctccttctcgcggggcggccgagccccgtgaaaccgctgtgatcgtagatacctcgcaccgctcgcctactaaccccctggtcgactcttcactctcggggaggggtctccactccccgctgtccaagggacccccctccccccttgacacccgtcattgtggccacccaccatgaagcactacaagtgcctcgacaagatcgggaggaagtcgagggtgtggtgcatagggtgcaggacccgaggactagggaaacccgccgtgaagtgcctccatagagggatcaactacggtgaggtggagtgctttcgcgagccacggtgcctcgaggcgtgccagggccacccgtaccttgttgagcatcccacgacacacagagagatgaagaggggtggcgatggcagagcttgcccgtgttgctatgtcgtgacggagtacatcaacaggtcaagccttgtgcgtgtcgtgcaggaggagcggtgcgacaactgatgtggcagctcctcgacggtgccacagcaatgcacatagcagggatcatgcaacggaacctcaagccggacaacatcgccgtcagcccccacgacgacctcaagatcagcgacttcggcacgtagctcgtcaccaaggccggagcaccgctatacacatcaccaaaggtcacgctatcgtaccgcgtgctagagctcatcctggggtcacgggagtatgacttcctcgttgataggtggttgctcggcagcatcatggccaatatcctcaccggcggcccactcttcctcatccccacgctgcatcgccatgtccgcgcacagcttgtacatgtcgttggtgtcacccctggcttccaccgacgacatgaagaagaggagcaacatgaccgccgcaaccgatgcgtacgtgcactgctccactttaccgagcaccaccgcactggccatagatgcggagggtgaggccacaccgcggggacgaggggtagcagcggtgccctgccagatcgatacgtacgggtagcctccccgtccctcttgggtagtcgatggagccgccggaaagggggagagatggggaaattgttttcatccctcgaggggaggatatccccttgtttcatgcatgtcacctaaatagttaaaaaaatatttaaaaattagtaagataaattaatatgaaatatatcactccacagacatgcaatttaaaattcaactactacagcattagattggagtgatcaaaagaggaggcatgagtcaatccaaggttgtagactgtatgagcttccaagtggcctcatggggaagatacttgtgtgcaatagtggtaaaatgaagataaagctcggagatgcactgtttgatgtaattagtgaaatatctgctgcgtatccatttatagacttttgattcttcccgacacatctaacataaattaaatgtacaggtttcagctggtatgaagtgcgaatttgttcaagaggttgtacctattaacacaagggagaagcacttctgcagccttggtaagatcaagaagcatctcattggaacaactgatatcgacaacttgctagataaatgaagatggaatatcgtgtgggaaatcgaaaaatatgtatagctttacaccatgagttagtcccgagtctcagtccaggtcaccaaggggtggttgcgtctgctgcagctgtgactttggagttctgagtttgcaataggagaatgctggtttagtataatgtagaaaaggctagtgtagaggtttagcctagtagtttatcaaagttctggtgagttctctcaaacacatattgttttcacttagtgaaaaaaattaactgttggttacaatttataacaacaagccgtcattttctctgtgagcaacctgtgtaagaatcgttgtgctgacgcagtagtcatctcatgttgttttgcacattttgttgaagtacatggagggtgaggtttttaatggttttgctaggggaaattgtctgattgttcacaatcatatggcacgccacatggaattggaaattagcactatgcaacattgcatcagtgaggtttaacccatagaactcataaactttacaatacctgatatccaactactaaaatacaccaaacacaaaaaatgacggcaacgcagaacaaaatacggagaaatttgtgctattggttttagtggaaacatgtaacgaaggaaatgcagatgatgttattgtatacaaacttgttgtggcctctttcaacttgttgtggctatcgtagaaaccaatgagaatcacaagttaacagatatttaatattattgtgccaacccgcacatcctgtggagaccaattccgcctatacaagctagttaggcaaacttcaaggagtataaaagcatgtttggttgccatttcattttcacaattgtgtgccaaaagttcagtagaatgtggctccaaagcttctatttgacctaaatagtaatcgtctttctctctagtaaaattaaaacattagagaacatcttcctaaaatgtaatacctcaacaaaagaaagaaagaaagaaatgccctcttgtacaagtctaaaggcctgcaaccatctattttttttggggataagcaagcatgacatgagtcaactttttcatgcaattattttgaaacgagtgaaatttgtaggccatctatgatgcatggaactatatgtcaaggagcaaccttcgtggatcttcaaccacatccttgatacggcgcaagaagagaacagcttccctaccatcgatcagcctatggtcatacattagtgcaaggtacatcattggccttgcaaggacactgccattcacaaccacaagacgttgaacaatggaatgcattccgaggattgatgactacattagataaagctcgtgttagagggaacttacaaacaaaattacaaggcagcaaaaaaaaacaagtgagcacctgtggagaattaatgataggtgtactgataaggcttccataaacaccaccatttgagatggtaaaggtccctcctgccatattgttgatggactgtgccccctcagttgccttctttgcaaggttgtttatacccttctctatgtcagcaaaattcattgcatctatatcgtggataacaagcaccacaagaccctaaaacaaatgacatgtcacatcattacaacagattgcataaaataatagttagggcagtcaacataaagaaaaacaggtggcgataccttggaagttccaacagcaacactgatgtcaatgtactccctgtagatgatgtcatcaccatcaatgacagcattaacaattggttggttttgaagcgcagaaacagcagcctgcaaaagcaagtgggtttttagtacaacccacacaattgccacaattatggtttaagtatctcataagattgcgttttttttttctcgaacacgcgagagagatgtgtatcattatattaagaagaagaaaaaaaggggtaaacattaccttcacaaagcaagacattaagcccaatttgacaccatgcttctcaacaaactgatctttataatcggaaagtagcttcattaggttagtcctacatcacagtacatatgatgttgaaacagatatagaaaagtgaaagccacaagatgaatgtcacaaagcaaatttatccttgtatacactgaaagttatagtaaataaaaaggtgatgtaacatatgcaggaaatagccatatagattcaaactccattgataatccgtttcttctagcacataaatatatgaggtgcattgatgctagtcctcaactaaacatagtagtctgatgtttcatttacacaataatcacgttaacttattggcatgaacaagaaccaatactatagctattggagtattattgcgcgctaggatgaatagcttattcccgttatcttaaattggccaaaagccagcagcttatgcattacattaaccaagcagacgtacaagaaataagcaatccaactaatgatgcacttacatgtcaacttcattgaatgtaattagcattgcaaaagtgttctgagaatccttcaaacgatttgcgatacgcttcctaagccttggcattggcacctgcattttgatggtgacaaaatgtatgcaaccgcaagagtcaagaatatgaagtaacatagtatatcttatcatgatgtactgtaactaagtgatggatatggccttacccgtctctctctttccttaggagggagttgtggttctgaagaggaagttagttttgattcgtgtgttgtgctggactctacttttggtggtttagcctcaaccttgttttcctttgtagaaggtggttttgtgctatgcttctgggaggtatcttcagatgattgtgtatgtgtcttgctttgagcagcagacttagatatgatagcaactttgacacctggagtaacaatgccaccttcactcgcaacgaactgtaatgcattgatgtggttagaaaagtaatctactaaagaatcatatttagcaaatatggaaataacaaatcaggggaaggctctttgttaccttttcaattatcccagcttctggactagcaacatccatcgtaacctgaaataaaagggtatttcattttctgaaaacaattttgcaaaagatagcaacaatagcttagaagttgaaaacaagaataaacagtgcacagaatcaccttatcagtttcgatctgagctatgggttcatcagcttcaactctatcaccaggttctgtatcagatagcatgtgaatacaaagaagtttgaccactcaaattgcatatagatagatgcgtactctttaagaaggtggcaagggttccatcggttatggattcacccatgaagggaacaacagcatcaaccaagtcaccttaaaggaagaaaaaaattgattaagcatttaactggtagaaatttgtaaacattatatcatctatagggtttctgtaccttaccattctttgaagcaaatgatctagtccaaggttgataaggagaagcatttgaaaggaaatatcgtccgctacatatgaattacatgccacatttttgttaagaactatgaatttagtaaagtgtagtgacaattccaaaccatagagagcaaggatgtgccaaataatcaacttttacagcacaggcacacaatgacaatgaagtttgctcgctctgatcattaccaagttggcagtgagcatccatgaacacctaaaataaaggtttgaacaaactaagaggttgtcaggattccaaactaacaaatgttgagtttctaaccttcaagtagcttagtgctgaaatgtctgacatgtttataactccgtaagaagcataatgtctgcaagtgaaccagatccgttagaaagacaaaccaagtataagcaaaagtaaatgaaggaacataaaccgtatatgcttgtgggaacaaaaggataatgggtaaacaagtaacttatatctgctacccagtagtgccggccttagcccctcaccttatttcagcacaatgaatatctcactgccagggggtactgggtttgcatgttaaattgtcaattagagaattcaatggcaaaaccaaaatttcccccataaaatctaatctaacctacttaaaaaatttgtaattttctgtttgtcacaattatgatttcattcgtcaacaaaacgccttcccagcttgtgtttcgtatagcacatgttgaaggcccaaacaggagtctacttcgttcccctgatgtccacctccaatccttttcctcgtctgtcatccatcgagcaagcgctgatgaggttgccgcacgacaccacgatttctgagttaactgaaccgccccccaccccccccccccaaaaaaaagaaagaaaatacatctaacatccaaatccaaagcccccaagatttatgagtgctacacgctagctcaagtgctcaaaggcccaaaaatataatccttatttagaaaaggaaaaggaactctccttaccgcaaaaacgagaaagggaaagaccacctggaccacatctattgtgccgcgcgctagcatgccatgagtaatagacgaaggtgggtggaggcaccactgtgcagcgcagggggcgtgagcaaagcgccaatggaaagcgcgtcagcgagcagcaagcgtgtttggttggttgccacacattggcacgccacactttagttatgccacaatatcttaggtatgtgtttctttcgctaccgcaattatgccatgccacaatttcttagccttgggacccacatgtcatactctcaaattttgagctaagcatgctacacttatggccaactatttctaagccacacttgtgccaccatgccttaactagcctatacttagttatagcaaggttaggcatcaaccaaacatccgtggatgcctgcccggatggggattagattaggattagattagattgggttgtttctctctctacgtatgggctggctggttggctgatttttcagttcgaaccatttaagcctattatctattcttacttataaaagagccatcactcctactaccaactcttaatttttcttttaaggaaaaaaacatatggggctaaagggccgacatgttaactactcccaccatcactctacttttttggaagaaaaaatattagtatgataaagaaaaggtcaacatgtgattaacaataacaattaagatatgctaataatattttaatgataattttaaataattaaaatcccattgcaatgtacaggtaatatgctagtgaaaaataatcaaggtagtatgctatactacttacaagtggaaaactcaggtttgaagaacaatatttgatgggttaattggatccatgccaatacaaatatgtcaaattaaaaaaatatcactactattcgcgatatcggctacatgccactagaatttaggaaaattataaccgtgccaatccgtcgtattttccatccatttttccggtcatcccccgttatttctatcgttgccgtcctgtactcctgtgccatctccgagaccacgcaaccgtaacaaggagcaaactggaggtgatggcagcggcggaggagcagcccgagcaggtgtccaggcgggtggcgggcgccgtgccggcggaggcgagcccacacggtcgcgtcggagtcgagccctggcggtggtggcccagccggtgaggacggcggggccggagcagatgtcggggacgccggcgacgaggagctcaagaccgggaccagggacatgacctgatggcgaggaagatggcccaagatcggcggctgctgtgctgcttgacgacgacgatgacgaacggcctggccgaagagatcgagatcgatctctcctaagacaagcacgatgacgacgagggagctcggcggcggcgaaggagctcggcggtgagggaacttggtgacggtggggcttccggcgccttggccggaggcggcgggcacttcctcggcggcatagctcggcgacggcgacgggcggcgccggcgccttctcctgctcctcgtcgtcgccggcacggaggcgtccgcgtctgccgccctcccccctcgcttccgcgcgcgcgtccgacgactccgttccaccgcgaaccccgccaggcccagccacgactgccgccggcctgtcctccgcccgtgccggccgtcgcgccagctccccatcatcttctccgttttgtcgcgtgcgcctcatcggcttcgactccggtggtcgagctgctcacgcgcgtccgggggatggtgcctccggcgctgggcgaagggcttcctgggcggtggatgatgcgcacggtggacgccggcggccgccgcggcggggcgcagtagaggcggcgacgatgcagctgcttacgacggccagcaacggcaagggcggcgccgtcgtgtcgccgcaccccgaacacgtccatctactgcttcatcatcgttcaaaaaatctactgcttcatccaccgtaggcaccagcaccagcagcagcagctcgatgaggccgcgatcgaatccattgccctcacgcggtaccgcgacgtacggcgccggcatgctcggtgccaccgactgccccgtctgcctcggcgagttccgcgacggcgagctcctccgcctactccccgagtgcggcctcgcgttccacgtcccctgcatcgacgcctagctctgcgcccacgtgaactgccgctccgttggccgcggcggacggcgccggagggccgggagacagccagctgctgctcgatctaacagaaaatgtgacagagacgacgggaattgtaatggagtggtatggttctaattttagaagattgcagtggtatctatccgattttataaatagtagtggtatttttttcaatatggcatatttacgatgacatggatctaattagctcatatttggtgatgcggtggtagctagcgcgactgaaaccaaatgacaaactaatatgaagatgttcaacagacacagtgacacacaccaagacttgttcccattgtccctgttcatcgagtaggaagattaaactcgcgtgaagatttactagaatcacattctaattcacaaaatgtttaaattaatatgtaatgatcatgcagttgaggcaatcatcaacaggcaatccatttcttatgcggtggccggaataaatctatattccttaatttattttaaaaaaatcaacaggtaatcaatgatcaagggagccagcatatcacctcaacatgattgcacacaaaagttcctgtgcttttgctatcgctaactgtccgcgtgaaaaaattctgaatcgactccagaagctaccatgctctctccagtttttttttctacagcatggcaacgacacaatcagaccaaaccgcatgatcgagcaaacaaaaaataaaatttgcaatctcctcgaatttcacagtttaagcatcctctaccgtcctgatcaacaacaaccaactagaaaaaatcgcattcttaccatcctaataacacagaagaaaaatgaacggagaggcgatggaaagagcaccaaaccaccatcgggacaacaaattaaatccagccccaaaatcaaccccaacaacgagactcataacgagtcaggccccatcgcattaaatcccccatatacattttacgcgtcatgcgtaagaagaggggggagggatgccggattaccgtcgcagggcggcggaggaggtggcgggcggcgatacgggacgccattcaccggaggtgaaggaggggagaggggacatcgtcacgtactcgcatgtggtgtgttgatctgctcaaacaaggtggaggtggtggctttttgcgaattttattgcttttgtcttttctttttcttttctccctttttgtgattgtttccttccttcttttctttcttaccatttagcctctcacccttgacaagactacatatcaagcatttgttttttattaaaaaaaaacaggcgccgtcagtaagcatgtatgtaactatttctctccgggaaccttcacaggcatggaactatttatctcttccacgtnnnnnnnnnnnnnnnnnnnnncgcacccctttctctctcctcatattcccttaatagcaaattttaaatcatttttttcacaaaatacttatttgatgtgtgatccaattgcaccgttggatttgttgcaattaaatcttaacaaagagatctcacattattaggatgaacaaaaataacataattatattactaattgaaatatttttatattatatatgaaacattaagttgtagtgttgaaacattacagaatacatgctgaaacatcgagaacaacacgtgcaacgt

SEQ ID NO: 7543 - DNA, 21387 bp, Oryza sativa
acattattaggatgaacaaaaataacataattatattactaattgaaatatttttatattatatatgaaacattaagttgtagttgttgaaacattacagaatacatgctgaaacatcgagaacaacacgtgcaacgttataaatgatttagtgaaacatccaaataacaccacttgcaacattttaataacttaatgaaacatcataaaatatctgttgaaatatacaaagaacaccacatgcaatattctaatttttttatagagctagtgaaataccttctgaaacatcacaaaatactttctggaacacccaaagaacaccacatgcaacattacaaatgatgtagtgaaacatcgtaatatacttactgcaacatttaaaaaatctactgcaacaaaaaattggaaaacaaatatttttatcgaaatataatcatatgagatcttgttataaatattcaattgcaacaaatacaatggtatgatcggatcgtatattgaataaatagtttaggagaaaaaagtgctaaaagctttgttaaagttggacatgaatattagtaatagtgttgatgtgacgttttggatgtaaaaagagacggataaaaatggaccgactatcaaacgcccgagcagatgagtttttttcgggtgctcttaagaaaggaagccaataggcaatgcttttggcacgttgtgtcccgcgtcgaggacgatgctgataaacctctttgttagaatgagatcttctgttctgcagtaccgtggctcatatgattgcgactacggctcacatcatttggccataattaagctaataatatatcgtatggcttattaaaaaaataatttatgagtaattttttatatagatggttttagtgatataaatgtcaaatttagcagcgatttaaaaaaaacttcgatgaaaattttcaaaatttaaattttagcgacaaatgatttatatagagcaaaaggtggaggccttctacggcagcagcagtactgtatatgagctaagtccctctccgttcacgtttcaagcataatcatatgatttgactttgttgtttacttgagaaaagtgtaattatttaatttaactatcacttatactatagccttaccatagtgtccctatatgcatatttgacaggtggggctaagtagaaacaatgagagtattggaagtatatatgtgtgacaggtggatccaaatttctgagggagacaaagttacaattttattataatcaggagcggagctagtatatgttagggggtgcccaggaactcggtcaagaaaattttttagctatacctcatctattttcaccatgtatgcaccccctcaatacaaacttagacacccgtatcagcttaaacttgatctaaagtaaagtaaattaaacaagtggcactacgctctgtttcgctctagctccgcccctgattataatatcgtgtattattgttgcagctttgtaaatgacgagctagacttgtagaaaaataatagctttgacaaaactagttataattttctaaaatttaatcttcttgatgtgtaaaaggctatatattagccgataattattatagagcatttaaaaaaacaagttataacactagaatctcttcaccaatcaccatgcaacaaataaacactaatagcactaaattattatgggcacgcttctcaatcttctaaattttacgctttttactataactaggagggtagcccacgcatatgcacaggaaccttgtttaatttttactacaaatgattatgttgataatattttcgaaatattctttgactctatgttaaacatgtttttgtaaataattggtttgggcatattacttaaaacacaaaaattgtcacgatagtagagtttgttcgtatctatttgtactacgtctcattctttcctatgcaatatttaccataccttatttttggattttctaaattttaagtaatattttttcctgtatgctatagataatttttatgatatattaatgaaagatagtttctgttaaaaatatagctaatatgactattttatctaattaaatatagacttatattacttatacaccctcggtgacataaagagtcaaattttgtcccaaaccaatgagaatttatatgaaacctagacaaagtgatttttttaaaagaaaaaaaaactaccacgataatctccatagcaccatattattgcttatattttgttttcaacacctaccattcataatcacgtgagacacctttagtagagaatgctgttaatttactaaacttatttacagtaactaatctgtggagtatacttatagtcacatcactaggtgtatgacatacatctagggatgaaaactttttggattcctaacctatgttcggaaacacaaactgtcggtcgaaattttttcggaaacgaaaacaaatatgataaaggcagtttccgtcggaactcagaataggtttgcaaacaatttctcagaattttcgaagttacaaaggcccataccatagtccatataccataataatactccagtcaaattcaagttagcatcctaattgattgtgttttgtgatatactgttgaccgttgagacctgagacagtaattggacttgacaaagttcgaagctaagtttgaggggttttttcttcccataaattttcgttgccgtattcgcgccagttcgtatttagggatgaaaatggtttggaaagtttcccaattccggacatgttttcaggaatgaaaaatgtcggtcagaattttttcggaaactttcggaaacggaaacaaatataataaggctactatccatcggaaactttccggaaatgaattcagttaacatagtatttctcatatacaactaattagcttcagccttctctactctaaatggttagatttatactatgtattgaggtgcttaattaaatagagatattttgtagtcaagaactttagattttttttttgcgtaattgctatttttattagaccatactacttataattatagttatagatggatatagtttttttttctccaagaaagtaaagtgtaaaactagttgtgttattattaattgataaaatgtagaataatagctttatttttttagaaaaaaaatattgagctacatctcttagttgatttgagaagttcagttttaagtgctttctatattttgataaatatccgttattgtattcgctccattttcgtattcgataatatttgatttcgtttttgtatcatgggttcccgattccgaaaaaaatatagaaacggaaacgataaaggtggtttctgtccgtttccgaaccattttcatccctattcctattctctttgttttcagttccggttccaattctaaaataaaatgaaaatggaaacgatagaggtttttgtctgcttccgtagcgttgtacattcgtcaagtaatatttgacacccaaaaatacgatgtgaaattatttaaaatattatcataatattaattattatatgtcggcatcatgtgttgtgacgtatttagaaccatagacatcaatagtttatttaataataatttatttaattaaaggaatacaaggggattagaaattgaatatataattttgaaataatttaaaagatacagtatttcaagagtgttttggatattttatatttgttatatagatgtagtttaacggcgtgaatttgtagagtaatatattttatcttttgaggataatggataagtgaatttatgagaattcgcttggagaactatatgccgtttttttttaactttttcattttctgtctgcctcctgaacaggtttatttgtcagtggaccgaactgcttaaacatgtcgtgtgttgtatgcccagccattgacactgacagtgatcaatctgatgttgccaatctgccttgaagagcacgtgcatatgcacagatgggctggacagcagatggcggcccggcccagctatcttccttccgattttcagtttttcaggacagacagttctgcggcgtggggcctcatcacttcatcagtaataatcgtagcaccgaaaatcagaacttgatgagcattgcaactttgaagctatgcaggaaaagtaagtgtaatgtaatcctacacgtccctgcaagatttgcacatgtttaccaggtgatccccaacggaaaaacagatggaatatgtgatcatttaaattgctgccacaaatccatttgaatcctcgcaacaatttatcttggcaaagctcaacattttacagctgcccttgccaaattccgcattgcaattcaactccacccaaataggtcgtcgttacagtcttacagatacaacagtaacaacaactgtttcaactccttgctacaggatgcatcatccatgatccatcatgaatccaaacgtccccagggcaaattaaaaaacaggaccagggcttagctctagtacatcaacctatttaaaagttttgtaaacttgtaaccctccacaaggggtctctcctcttcttcctgtatacagatcagtcactaaagtctgcagaccagcaaggcaactggatcgattattgcacaagctcagggatgagcctcagcaagaatgagatttcacactgcgagaaatgtggcgttgcggcgtcttttgctgccccattgctcaaattatcggcgttcaggtcaggctccgggacggtgatgagctcagagacggcctcggtgatctcctgcactaggtcgacgatcacaccgttcacccccatcagatgttgcatgtacaccgcctccggtacgttgctgcacaaaagggatgggagattttgagcacttgaaattcagatataatgcaagaaagtgctcgaggtaaccgtaaactgtactgcttacttcagtgttccataagtcagtagggagaggttagcctctttgatctttggtacagcagcggggtgcctgaaaattcctcgtgcctccgacacgattccttgcatgccgctggcgaggcatagcttgatggcctcttccaatgagttcctcctaacgtcagcgtagatttctgtgcctccattagtcaaaaagtaaacctgattgaagaagatgcaagggatgaggagatcagtaactgttcatggtacgaaaagtactgttatggaacttgcaaatttgcaatgcatcagatactagtgtacttacagggtatgtgctttgcaattttcgcataacctgtgcagcgtcaggctggaagctagagaaaataataggccgatccttggcatactcaaaaacaacctgatcaggtagtacagataaaaggtgagatgttgttagattggccataggtatcaatctgcaaattttctgaatagccataacactatgctaacacataccttcaggatggcctggaggatacaagtgagctcttcctcctggtattcaagattgtcatcaaatttgagctcaatattgaagcccaatctaggattgaccttctcgaaagcttcttgaagtgtgcaaagagggtcatctgactgcacattccaattcactatccgaccatctttcagtttccgtagcaagggttttccaccctgaattcagaaccaaccaatatgtgatcagatcaattctagttatcctccaaagttaaaatcaattctagttatccccaaaagttcaaatgagaaaaatagtttctagcatacctttccctgctcattttgtgggccatatagcaggaagtcttccaactgaaggtctgtgacacgcttatctaaaattttaccctgaaaatggatgccattatggatacaggttagttttttctttaccatatatcacatgattcacgaaatggtccatgcctatatgacagtctcaatgatgttacttttttgtctgaatttttaaggtagctactgtaattcatacagtaaaagaaaagtaacttacatcttctttagtaaagatgaagttatcatggaagatgactgggcacccatccttggtaacctgcaaaattgatattcacggtttgttctcttctcaacatctttgcacaccgaattattgaagagacaaagagagaaggacaagaacaaaaagtaaacaaatcagtatcttctttcagcattttaagtttcatatgtaattaagcaaactgagtgtggaaacatttatcgagaatgtgtcaccataagtgtagtttagatatgacccattctaccctatctcttgtttctgtcaagaatcaaaatcagtagagcaagctgataagccattgctccaagccaaaaacaggcccagtgacacaatgattcctcctgaagtgtcgccactatgaattgctccatgtttgcgttacagcacaagatactttatagattcttttagtgcgtaggtggggtgtatgagcaaacgacaaaggcccactgtgttgattcggagctgagctgacactggagtaaactggaccatatcccatatcccatatccattgccacctacctcgtgagcgaacctaactcgtttcgtattttactaaaagagctgggagataatttgttccatacaccatttctttgtgtcggcctagctacttcatttgtttacgtgacattttaattttcatttaaagtaatgctagtatcaaaatgtttttggacaaaccaagtgtcttcctgttcctctttgataatcctaaacatattggggttgcaaacatcaaagtttccgggcatctgacaacacaatttctgaaaggagtaaaaatggccatcaccaaagtgactagtataaaatggagtactcgacgaagaatcttgatatagctgaaaaaggatgtatttctgtctctgtgagtattaaaaaattaatccggtgtggttaaatgtcttaaatcatctccaaatttcatactactccctccccccccccttttttttttgtgtgcgaagatcacaaatttacaatcggaagctggctattcgaacaacaacccccctttatttaggtttattataaaacagcaccagtgtgacgaggagaatcggaacgggaaattccaattaatcgtgccggtgagattttcgattcgcgtttcagtttctccaagaagggcaattattatgtcgatcgattcgtatttcccaagaaggcgagcgagaacgggcgggcgcgtggggcttacgtgtgacaccgcgaatcggaacagcagctcaccgcgacgcgtcgccacaccgttggctcttctgtttcgcccgcgggcggcggcgagcgctcgctacgctacgcggcgcccccactcctctgccctccatggcgctgacgcgtcgccatcgaggagaggaagccggcgacccgtcccatcacccaggtgaacgtgaacccatctccccatctgcctctcttcctttccttttccttgattggtctcgctttttcgtctcgaacgcccacggggacccccaaatttagcacgagcagctcaaccccacccaggttaccgctatgacggatggatggacatggatggacggatgatgaagaattttttttcgttacctggacgtcgaactcgacgtagtcgacggggaatcgggcggcctcgttgaacgacctgagcgagttctccttcacctcctgcatccgccggtcgggcgacgccagcgcgttcatccccttcccgcggtgcccgatcaccgcgaacctctgccccccgccgccgccgccgacggccgccgcggcgctccgagcacccgccgcgtccacctctgctgcataaccaaggaaataactaacgccgccgcggcacggtgtctcgacgccacgcaatgaatattgaataatccgtacgtaccgaggatggcggaggtggcgggggcgccggcggcgaggacgtcgagcgccatggggacgtcggcgacgcgcgcggccttgagctgggccattatattcggaggatgtcctagctgcgcgcgtataggaggatcgtgggcgcaatgcaatgcaacaacgagacgtgacgcgacgcgacgcgacgcgaggaagcgggagccgagcctaatttataacaaggcgggggaaggggaaagggatcgagtgttgggtgtgggtcgttggagaaaggaaggaagcgggaatggggaatattcggggtggggatgcgttcgccatggccagccatcgcgcgcatttgccaatttgctgccaccgtccccgcggatcggatggtttatcctccaggatattccggtccaaaggcacgcacccgacgcagacagacgcttccctctgctgctacaactacgagaacgaaccaacgaacgaacacatcaggacagcgctgtttccgttttttcacctgtcctttctgccacgatttttccccttttccttttttaccctccgtgcctcgttttttctctttgaccgaggctgtgttctgtgttcatacagatgttaggtgaaaatttttgacgtgtcacatcagatatatgaacatatatttgaagtattaaatatagactaataataaaataaattatagattccgtctgtaaactgcgagataaatttattaagtctaattaatccatcattagcaaatgtttactgtagcaccacattgtcaaatcatggagcaattaggcttaaaaaatccgtctcgcaatttacacacaatctatgtaattatgtcttttttatattgaatactctatgcatgtgtctaaacattcaatgtcacatagtgaaaagtttttacgtgaaaactaacagagcccgagtcgacgttgtgcgttcgcgtacgtgcaatcgttcaaagccgccatcgtggcaatacaacttgacaagtggtgtcgtccagatggtttggaacagctggtgggtagtactagcttttaccacggcttcgcccgcccaatctgcagcgaactcctgcagcatccgcccgcgcaacgcgtgcgtgcgtctgtgccgttgcttgcgcgcgctcgtcgatcgccgctcgctgcctagctagccgttggtcgagtgtgtcaagtgatatcattcgtatcagccacatcatgcggatgcatcgatcgttctggtggttccgcttttcgtcgtcacttcgtatgcgattctgtttgtccaataaagaagaaatcgtgattctgttccacgacgggttaaaggataagacgattggtttattcctgctatacgtgatggacacgacagattcatcacgagagcacaaaggagcaccttcttttctcggttttatttaggctgaaccctgagaatatgtgcagaggagattgcaagtttcagtttatatatatatatatatatatatatatatatataaaggggaagggttaattaagggagaaggaattaaagcttgcaagttgctactagagtagatattttcttctttcgtgtgtagctgaattcggtatttcagtgccgttttaatttgtttattgtccatgtggtagcaggagtgatcctcctttagtttagtgattatgtccaattgtccattgttggtagttgcatccgattctttatataaaaaaactgcattatactgaggggtcaatgctgctgtcagatcaacacgcgcgagaacgcaatatctcttggaaatagaatcacgagttcatttcatataaaagacgtgaattaatagcagcttattcctcaaaacagccatagcacgtacaaacagcactatttattttgaaaaaaaaaaaggagaaaaaggactagctggctgagaatggcttgggctaacactcgactaagtacagccgggttaattaatttgattaattaacgaggaaaattctttaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcagaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggccttagaagacaagaactgctgatgacatggttgatttggttcgacacactaattgatcaacacttgcaactccccttcatttcatgactaatcctgtatatccagcatagcaacaacaaccttcctttttttctgaaaccacgtacggcaggacggagagagagacagagatcgactgataaagattacagaaaaggcagtttacagtaataattttacacgtcaacttaacaataaatcatcgtcaagtagtccaataatgggagacgcgtcacgcataaattcaggcaactaggccacaaatctcctgttactagtacttgtttaatccattattgcgcacacggccggttggttaactcgcatgactaagtggaatcacatgcatcagcgcattgtccattgcccctgatcgatatactgatctgaatatctgatgcccttgcttgtttggttggatctgatagtagtagaagatgaaatgcaggtgattgcaaattaggacgacggctcatgctgaggtgctcgtcttatcctgcatttgtttagcgacttggtcgatctcttaactttgactctctttttttttttagaactcttaactctgactcaccaccagcacagcagattgatccaacaagggggtgtttcgccaagacgccaagctagcaaggtataggtagcttcctgggctcctgtcctgtggtgtgccagtgccaggtcgatgcgcgctcgtgtctgtcgcctcctggcgtcgcattgactttggataaatggattatggatggatgccatcgcaaaaagcaaggacactagtaaaaggatggccttttctttagggagaggagagaaggtaagagatggcttttgattctgactgttcggtggtgagttggtcgatatcgatctagacatttggtgcgtgttttttcacatctacggtgtcgatgcatagctggtaactagttagatggcgccaaataatctacccatttcgtcatttcgctaaattaatcatgtctaatgttcaccattattgcttatccacgctacaaatgcaatgatagggctgtttttttttaagaacatgatagggctgttgagcctgtcttaatcttccagttggcacgacgaaaatgctgaggaaaaccttaccacgagaggagatatgtgaatttgtaagccatttgctcaatctgttgatagatctagaagacacaggggaggatcacgtgacgtggcggatgtacgaggaagaatattctctggtggttggacaggcaggagtgctggttttgccaagagctttgatgctgatggagtgatgagatggatataccgatagagtggttgctgcgtcggttccacgtcacttcaattcgtctgcatcacggcctcaaatacctgccaccgagcgaccttctctactcgccagtagttctttttgtttcttcctctcatgttttcctcaagcactcacaagttacaacctgcgtatggaagtgtttagttcccttcaaacatccaaaaatttcatcatatcaaatatttagacatatgcatgaagtattaaatgtggatgaaaaaaaaccaattacacagtttgcatataaattgcgaaacgaatcttttgagcctaattacgccatgatttgataatgtggtgctacaggccgtgtttagttctttggctaattttttttaagtatacggatacacatttgaagtattaaacatagactaataacaaaacaaattacagattccgcctgtaaactgcgagacgaatttattaagcctaattaatccatcattagaatatgtttattgtagcatcacattgtcaaatcatagcgcaactatgctcaaaagattcgtctcacaatttacatgcaaattgtgtaattgtttttttcgttcacatttaatgctttatgcatgtgtccaaacatttgatgtgatattttttgacaaatttttttaggatctaaatacacatacagtaaacatttactaatgacggattaattaggcgtaataaatttgtctcgcagtttacatgcaaaatctataatttattttattattagtatatgtttaatactttaaatatgtgtccgcatacttaaaataaaatttagcatatgaaactaaacaaggcccatatcaaaaaaaaagttacaacctgccattgtttgtacatgcgcgagcgcgacggtttagatagagagcgagcgtgaaataattgtgtaatatactacctccgttctagaataattacatttttaccattcaaattttattaaaaaaaatactccatccgtcctataatataagggattttaggtcaatatgtcacaatcccttatattatgggatggagggagtatttctaccaaagtgggatccaattttcctttaatcaagtttaataatagtaattagctgagtttattgtctcaatattacttttagtcaagtgtacgtacgaaatgtgtgtatgcagtgtcgttagtaaatagggttactgtgtttgttgctaatctgtctctattatcagcggatactcctctctattctttcctttcatcgtaaaaataaaaaaaacacaaagttaataaaaaaaataatactctcattcatgtgcatagagtttataccgtaaactttacacgcataaactttatacgcataaactttatctatagaaatattttatatataaaatatttgaatccggatttgaatttaaatcgtgtatgtaagcttttgacttataaacattcgctctacaaactttaggtggataaactttatatgtgtaaactttaggtgtataaacttactaaaagaggaaaatataaaatatttgaattcaaatttgaatttgaatcgggtatataaactttggcaaaatttgctacaggacacgcaaaaaacatgtaattagctgggagacaccatgaaaacgtgacatagctgatggacactacaaaaattatgttattggctggagaacactggtcgcattattttgttatttctgggtcaaaagaggtgagatattttcctaaatgaccagattacccccttctctttccttcgttttcacgtgcgtagtggggcgagggttcacggtcaaaatccctgaattcctcacttattagcgaaggctggctcagctttgcttcgtcgtcctcctccaacagctcgccccagtagtcaagaggtcgccatccttccgacgctagcgaccgccggcgacgccgaccgcggatccggcggcagcggtgtggctggagtagccggcgacggcgctccgtggcgcgccaacgactcaaaccgcgcgggcctcccgaggctggagtggccaccggtgggctccccggctcttcggggtgactctgacgacgacgacgcgggcctagcatgactggagtgtccgccagtgactccgtgcctcttaggcgcgccgacgacagggaggacacaagcctcccatccttggggcttgcgtgtgactgtctcattctcctgtctctactttggattggatggactccatgctcatcttctgatctagatcacaatctttaatttcgttgtttgaattcaaagatttgtttgaaaatttgttcgaaatttctcccagatttccgcaatttcggaatttgataaacccccgaaaatcttccccttctcgatagattgaaccctgcccaccacgcgccttcctttcttaggagaaaacgaaggaaagagaagggcaatccgggcatttaggaaaatatcccacctcttttgacctagaaataataaaataatacaactagtgttctacagccaattatacattttttgtagcgtccatcagccgtgtcatgttttcgcggtgtctcccagctaattacacgttttttgtgtgtcctatggcaaattttgccataaacttttgacttataaacattcgcttcacaaactttaggtggataaactttagatgtgtaaactttaggtgtataaacttactaaaagaggaaaaaacgatcgctggcaacgatcgatcgcccgttagccttttcgatttagaaatgtaattattttggaacggaggtaagtaattttttttatgttgacccttatgtaaaagggaaatttaactatttgacactattaggtttgtcaattatccaaatacctcttttagatttagatttgctctctttttttttttttgcctctctaagatggtggcttcttatctttttaccacttctgcccatctgggatgccaacgtggcaatgtagtgtaaaaagcgacgtgggatgcacttgtcagtctcacaagtctcccttcctctctgcctccggcagtattaaaaatcgacgcggcaaccctctctttcccagcggcggcggcggtgcgacggctcgcggcagaggtaaaggaggagccaagtgacgccgcggtcaaggacgagcatttacacgctggatcggacgtgcgaagccgtgctcgcatcgtttgcgccaacggtggtcaaagtcctcgacgagtgcctctacagctacgagttggtgggtggcgccgccgtcgagacagagcagcgcaacgcggcctccctcgccagcacaccatgggaggaggagccaagcgccgccgcaaatccgacctccgcctcgccatgctccatggcaaccacggactccagtcggccgacgcggcgttcctccctccccagccaccctaagatgacgtgggcggctccgctgctgctgacaactctatcgctggaggcgctgagctcgccacgctcttccttggagaatccgctggtcggtactgacctacgccatctccgtctcccgtacttggctccctttcctactcctccgccgctgcagccaggaaagagagggctgccgcgtcaattttaattggcaaacctaatagtagcgaatagttaaatttccctatgtaaaaacttccatactagttaagtatcacataatactttcccattgtactaagacatagtatcatacttatatatcaaattatcaacaaagaattataagcaatattcaggttttatttggaactatactttcacaactttcacactctcgacttttgtgcgtatgcttctcaaactactcaacggtacttaattaatactgcgttaatatgttttctatgtggaaggtgaggttctcatccccttgattcgaaaatagtctaaggtacaattatgatggtgccccaataatatcacagtgctcacccgcatctcagacaactcagatgtgcaagcaaaacagttttaaaaaaagatgtgcaagcaaaagaaatatgaaaattatcctcaaaagagggggcaataacacatatgaaagaagcccgatactctcccatcaacgggctcactcataacgctatcatacggcctatccgtctcgctgacatgcagcccaaaccagcctacaagacctaatataccacgtgcgcgcgggagcctctcgcggagagggcttgcggcggcacggcccgtccagcgttcatgttcatggaagcacatcccgtccttattctgcgactgattaggattccgaaatccgagtcatctcaaattaatcaggctgccgggaaccctacaaaatcaaacgcccgaaattcgccgattattattcgtttattcgcggcacggcccgtccagcgttcatgttcatgtaagcacatcacatcttaattccgcgactgattaggattctgaaatccgagtcatctcaaggttaaccaggctgccgtgaaccctccaaaatcaaatgctcgaaatccaccaattattattcatttattcgcacgcaaatagggcaggtaggatgttagtaagtctgaacaagtgggataaatattgtgggtcaggaactggacacaaaaaaaaagtattttgggaactaaacaggttataagacagggactgagggtgagggacatagaagtgccggtgcaattgaaagctgaattgagaaaatctgaagtcaatttgaacacaggtatgtctaactcttttgccattttcaattcagttaatagagatgttttagttgatattgtcaatataagtaatattgtgttggagagaaatgagtgtgagattgagacaaatttgacagtcgtttgtgttagagaagaagcaaagctatgttgtttgctgcggaacagagtaagtgcaatgagcatctgagtttgttgagattagtgatgatgttgaagggatggttaaagaggaaggaggcaaggagaggattctgcagggaaggtggagtgatccaataaaaatcaaagactaaagaatacataggatctgagcagaaaaagaaggggaggaaaaaaaaagtaaatcatgagatttttttagaatgtgagagggattagggcgacaaagaaagcttagggagttaatttttgaacaaagaattgatatgatatgtttgcaagaaacaataaagggtttagggtttttgaggagatggctgaggggatggagtgctaatgtaaatagtgtccaaaagaagaggaagaaggaattggagaatgctttggtacagctggataagcagatgacagtggactttttgaaattgaatgaaaaatcagatatgagatggaaaagaagctggaaaacatttacattcagtagcagatctggtgacagagaagaggaggggaaacttggattttacaaggagatgctaatacaacctttttccataaggctgcaaatcaagaaaaaggaaaagccatatcttctctctgcaagaagggatgttaatatcatagagctctcacaaattaaacagcacatctatgcatattataaggggttgtttggaaaagaaaaaagtagggaagttcatctaagtcctgaaatctggcaagataagctgagattgactggggaggaaaaagtttggatggttagacccttctctttagattaagtggacaatgtgatgaagactatgaaaaacaatacaactcctggccttgatggattccctatgggtttttataaacaagtgtggcctcatataagggttttagttaaagagatgtcagatgacttacacatggatgagctggacatagataggatcaattatggggtgatttctcttttgccaaaaatcagggatgcaaacacaatcaaacagtatagacccatcagtctaaaaaatgtgattcttaaaattcttacaaaggctatgaattttaggatgactgaagtggcaaacaaagtgattagttggtctcaaactgcctttatacctggaaggaatattttagaaggttgtgttattttacatgaggtgatgcttgagctgaaaattaaaagggatactgggattatcctcaaaattgactttgagaaggcttatgataggatgaaatgggattttttgtatgaggtcatggacaaaaagaattttgactccataatgatgggatggataaaaaagataacagaaggtgggagagtaagtattaacatcaatggtgacgccttacaggggtttgaggcaaggagaccccttgtctcctatccttttcaatcttgtgggtgacgccttggctgccattttggataaaaccaaacaaaggggagtccttgaaggtctggttccaaacttagtggatgggggtttgactcaccttcaatacacatttgcccttaagaattccgatgagaacatatttgcccttaagttattattctgctttgaagagatattagggatgaagattaattatcagaaaagtgatgtatatgtcataggggtggaggataatgagggattaagaattgctaatatgttgaactgtaagattggtatgatgcctttcacatacttgagtttgcctatgggggtttgtcacgtcctgataaattcatcccgaaataaaaatcattttctaaaaggaataatagaattaattaaaattcgaaaagaaattggcaaacactaaaatacgtgcaagaaaaattcgaatgtggcccggagaatttttgttaaattctctttggtctaaaaagagcactcaaattttacttgaattttcagagcaccggaaataattattaagcaacaacaacaattaagaaagtttattatatttaaaagaaagctaaaaataatcctccttcctcctttgggccgagttcagcccaaagtctttctctcctcccttgtccctcctctctcgggcctcctctcctccccggcccactccctcctcctctccttcccggcccactccctcctatcctcctcccgccttgacctgccctggcccaagccgagctgcagccctcccgcgcacacgcgccgcacgcgcgctgaccgcgcggaccggtgggtcccacccggtcgtcgtcctcctcccgcccagctcctcctctctctcccgtgaaccctagcgccgttcctccctcaaattcgccccattcaagccggctctttccaaattgattagggggaatgaatcccctttccttcctctctcattccccctaatttcccccttaattcatgccctcagtcgcccgtaacagccgcgccatccccggccaccttccatggccgccggccgccattctcagcgccgttccgccctctcctgtgcccgtctagctcccctccgctataaaatgggatccccttcctccgttctctcgttttagcctcctcccacgtctccccgtggccgcaccacctctccccatcaccctcatctctctcctgcaccgccggccacttacagccgtttataccgttgtgcctgtgcgccggccgtccgtgccgtcgccacccgcggcatcttagccgcctcctcttccccgggctgtcccccgtttagcggagagagcaccggaggcgcgttcccgccggcgtccagtggcattgccgccactacaccgtctacggccggctgctgttcgtcgccagagcgccagctgacgtcgccgtctcctcccacgacgtcgccgcatcgacctccaccccggcttgccctcggattcgccggaatgccgtcgtccacgctgcccctccttcggtcacgtcggcacccactttggtagccccttccaccgtgccagtgcgccagccgacgtcgccatctccaccttcggcatcgcagtgggaaggtcgtcctcggcctcgcctcctctccatccgaaccccgccggtcttcgtcgtcgtcctctcgtcgttcccggtcgcgctcgtcgtggcgttcgtcctccgtcaagtcgttctcgtccgccgtccgcgttccgtcaagtgagctgctgcagccccgttgtcatcctcgtcctcggctccgcgtcgtcaagccctatgccggtcgtgtctcgtcttcatccaaggatcgccgccgaagtcgttccctcgccgttctcctccatcgtccccgagccgtctccgccgcgcccgttcgtcgtcgtcgttcccatgccacgtcgcatggtggtaaggatccctccttcgctgtccgcccttgtcctttcggtgttgccaccgtgcccgttgtgcggttgtcggccccggtacccgtgcatcggtgtcggcagttgttcgcgtgcgcgggtggtgaccgtgtagtgttcgtgttagtgtgcccgctcggtagccgcgtggtttccacgtgtgcagcccgcgtggtgtctagtggagtccgtttgtcggccactcgcctcggttgacacatgggtccgcttccgtcgacccgtgaaccgtctctatgtacccggtccaccatggtcctttaggttgacatgtggggtccacatgtcaacggcgcagccttcctatcttttctaggctagcgcttacacatgttttatagttgcaaagcctaattataataatccgcaaatctccatataacaacattaaacttcggatgaccatgtcttggtcatacgaaccccgaatcgacctgttcaagtctcttaatgtttgttataacctaaagaaccctgtgctttccttttatgtattgttattgcttctttataggcttgtagctttgcttgtgtgcttcgcgtagcttctgttgtttcaaaggttcccgaagcatggttcgcggtcgtcgctgaaggttcggaaggccattctctctgagcaaggcaagtcgcatcatccttgagcatattgaatcccagtttataaaattattttgatttaaattattgcattattgctttatttaaattcccgcgttatcactgttttatttagcaatacctattaatccttgttatagctttatcattactattgtttattatcacctcgcttaccctagaaaaaacaaaaccccaactagtgggtactgtattaatggttccactagtatgaatttaggtagatgcttcgctgattaattaggccacactagatggttttataactttagactttgggagttctcatatcatttggacattatggaatggttggcttgtgatggaattgaacacacacctccccctctattcaaactcccaaatggttttaggctgggctcgaggtgcatggttttgctaggagcacctcgaccaccataaggaccggtcttcgggcctctgttgcaaagcactaccgtactaaccacatgtctaatgggtaaggcttaactcggtgctcagtctagtcctgaacaaaaggacacaaatagagatagatgaagtcgttacgacgatggatatctctgaggcaaatgaaggctacgcgagctacggcttggtaatcgagatgtctaggcaaatgaaggctacacgggtcgttgcccgttagtcgagatgccatggcactggactagtacgcgggtggtctcacccctatgtgtgtggcgcacccggtctagatcctgttgctaggggctcaatcctggcctgtctgtccgggataacggccgtaggcagggttgggtcggtacttttgttcacagctaggatgggtgaagggttatgtca

SEQ ID NO: 7544 - DNA, 4334 bp, Oryza sativa
attcgaatagccgtgccctcggatatgggcaagcctagcaatgtacccaagttagtggtttaattcttaaaatttgcttaacaactaaaatatggaaaggttggcctgggttggcttgggacgagctgggactcaggtcgggttgccagttcggtctgaattatcgtaggccttgggttaaggcaggttcgtgtgggtccacggccttgattaataatattgtgtagctctaggatcgtgtttacaaaatagctttgggcaactaagtgacttttaaatgctgttttctgcaaagcttaacccctatactatttccccttgtacccccttgcattaatcatgcatctgccagtgtggcttgctgagtactgtggttgtgctcattcttgctctacctcccccccctcagtaagtggagctttggagaagaagtattaggtggagtcctggcttattccccagttgagcgcctatgaatatggagccgtaggcccgctagtccgctgctgtttattttttttgtcaggcctgaagtgcctttgtaataatgtaaatattatcgatataataatgatgtgtcttttatatcatgtttgtgtggtgtaccccggcttttcctgggacggggattaatacactagcgttctggaaaaggtatttttccgggcgtgacagggttgacagaattgggatgagagacatatctccaatctttcagaaagttgagaagagactttagtcttggaagagtggttacatgacttatggtggcagggagatcaagattaactcatgtttgtctagtgcacccatgtatgctatgggtttctaccttttgcttgaggggtttcaccaaaaaatggacacaattagggggaacttttactggcggggttggggaaaaaaataaatatcatatgataagatgggatactctgtgcaggcccaaagagtttggggcaatgggctttttggatactagagcaatgaatctttacttactcagtaaatgggttatgaaaattggaaagtggagcacctgatgtttgcttggaggtactgagaaggaaatattagagaaattgtaattttttcacaaggaatgggagtggtggctctcaaattttggatgggtttgttgaaatgcaaagagtggctttccaggctagtcacaaaggaagtgcacaatggaagagatgtgagtttttggaatgatgtttggtgttataatgtacctttgaaagttagatttcctgatctctttgaaattattcatgatcaaaatgctactgtcaaggatatggtggtacaaggagaatggagcttggagtttagaagaaatttagaggttggggaacttgtagagttaattggggaagctcagatggggactgataaagacaatgtctgttggcctcatactgaaaaagaggtgttcaccacaaaatcaatgtacaaaattttaacttttggggtattaaatgggggcagtttggaaaggtagaattcctctaaatataaaacatttttttgtatctagttgggagagggagactcccctgtgctgagcaattggtgaaaaggaattggaaggaggaaatgagttctgtaaactctgtttacaaactaaaaatactaaccatgctatctttcgttgctctttagctgttttttcctggtgtgtgcttaaggtggctataaacttgaattccttaccaggatctttgtgggattgttttgggctagtgaggtgtgacaaggaatctagggtttagttgctgatgatggctagcttctgttgggctatttggctaactaggaatgattgggtttttaacaatatcttggtgaaatcacacttgcaggtggcttacaaagctctgtctttctctcagaagtggagtgtgctgttaagagaggaagaaagagcaatcttgggtgggtggcatgaagctgtgctagggaagttggttcaactgaaaccacaacatctaccatcgtctatctaagttgttttgcttgtatctagtttggtccaactccagaagggttctatttggatgatgttcctgtagtgtgctgtgtctagaaagctggatgttcctagcaagagaaaagtacgaattaccccccctcccaactatcgcggtagtccgaattacccccctaaccacaaaaccggacattcttcacccccaactatgcaaactggatgaattaccctcctcgacccaatcagcggtggttttggtctacgtggcgtacgcgtggcaatccagtcagcaatttatttattaaaaaatagttgggccccatctgtcgtactcttattgcacttttcccctttctctctcttctctctctcactcttcctctctctctctcctctccctctccgtctcatgtacacagcggcaggcggggggcggcgagcgccagcgagggatgaggcggcgagctgcggcggggtgcagcggcggcggcgaggcaaggcggcggtgggagctcgcactgctcgagcgaggcgaggcggcagcggaggaggcgaggcggcggagaggggacgaggtgatcggtcagtgtgtgtcgtgttcgatcgatgcgttgctttcgatcgatctacatgtacagatgatcgatcagtcgatcggatcgattgccgtatttttgttgtgtttggtgatgagatggaggttaagtggtatggttagtgtgcgctaatggcggtggtttggtttgggggtggttgtgtgcgtgtggttgcagggtggagagcttcatagagcaccaggatgcgtgtaactctggacgggtgcgcggcgaggtcgtgcccgtggtgacgacgctgccggtcatccgtcccgcggcgctgcggcatcatcatcatcatccgccgctgccgcctgagctgcagctcctcccggcgtccaccacggcgtcgttggccaccgcgttctcgtccaactccacgaccaccggctcctcctcccacgagcaacacgcgacgacgatgacgacgacgaagctgcagctcttcatcggccccgccgtcgtcgtcgtcgcggcatccgacggcggcgccgtggccgcggcagcaggaggggaggaggaggaccagcaggaagaggtgaggcgcgcgctggagaagccgtacgcggcgagcaagcgggcgcgcgaggaagccgcggcgacggagcgcgcgctggacgatgcccgcccccgcctcgcttcgctcgagcagcgcgagctccctctccctcgccgccgcttgccgcctcatcccccaacgctcgcctccgtccttcccgccgctcgcctcttccgccgtcgccgcctagcctcgctcgagcagcgcgagctcccgccgccgccgccgctcgccgccccccgcttgccgctgtgcgcgtgaggcagagtgagagaagagagagagaggaagagtgagagagagggaagagagagaaaaaaagtgaaataggagtatgacaagtgggtcccatattttttaaataaataaattgctgactggactgccacgcgtacgccacgtagaccaaaaccaccgtggattgggttgaggggggtaattcgtccggtttgcatagttaggggtgaagaatgtccggttttgtgattcaggggggtaattcggatgaccacgatagtttgggggggataattcgtactttttcctcacagcaataatgtagtatgttcgtgtttttcttttcgttttgtgtaagactctgttcctgtagtcctttcggctttctcccaaaagccggatcaatgcaagttgatatgttctaaaaaatatagggcatgcagaggaagatacgatgttgagctccaagcgatcgttgtgggatcaacacagcagcaacatcgccacgtccagtaaaaggtcgcggtggagggacgatgataaacacctctacatggtgcttgattgggacatgggatacgtcatccacaagctggacatcgacgagttcaccgattccggcgccggcactggcgtagccatgttccaccacctttcttagccagtcgccgtccacatagaggtgccggtggaccgctccttcctggccatggtcgcggtcggcagcaagatcgtcatcgccacgcatgccttccatgaggattctcccgtcttcatgtacgacacagggacgtcgtttatggccactggccctcgcccaacaacgacgctgatgctgggcatcatggtgcccgtcgacggccggcggctgtatgcgctggaccctcgcagcacgtcgaagcactacctccagacagtggcggagacagcgtgggggcggagggggggg

SEQ ID NO: 7545 - DNA, 7547 bp, Oryza sativa
ccccactaccccctaacaaaccattagagcccccataatacctaatcctaagaaggggctgagatagactttgtctgagatttttagaaggccctaaaggcttagaagtcccataatatccccaacaatcccacccaaccctaatctccttcctcctaccgaagagaggcggagactcacggagtggcggcggcatacaagcgcgagtgcgcgtgcgacggccgacggcttccagttccagccttccaggcgaagttgcggcgaccggcgacactgcagcagttagggcacgcggcgcgccggccgctggccgctggggcctgggggccccgagcggcaacaagggggtgggtcgacgaggggacgcggcggcgcggcgcggcaacaagcagggaagggggcaagggggcaaagggcagctgccggcagcagcaaggggcaaggcaggaactcagcaattgaggatttgaggaagtgaggtatataaaatttctaatttgtcatttaaaatcaatttcaattgtcaagtctagttgttattaatagttcaagttttcaagaaatcagagatattgaattgaaaattttgtttgtgattcctagtttgctacttgttatattgctagattgtgaagatgtcaaaaagaactgatgaggacatcccttccaacgatacatccatgcctaagcacagcaaggaccaatgactagagctcgagcttgtgaacgtaattatcaggtaaagtcattcctagctactcatataagttcttctcagaattgggtgctactaagtggttgttatgatctacttgttgttaggaatatgggagaagatctagatcacaaacaacactagcagcgctgatttgatgaagtcaatgctcttcacttcgatggccaattggggcaaatgagtacttgttggaaagatcttgtcgtctactttcagctatgtgtggtctcaccatcagattcgacccaagctgctcagaatgacgaaaatagttttcacatcagaaacttgggcttgggccttgtatctttacagcccattaggggtccacaaaaactagggtttgctcccacctcctctcctagtcattcctccacctatataaacccctagcagccaccattttgtattttgagttttgtttagatgtaagtttagcttcagctacgtccttgtactcgcgtgtaccagctagtaaacccgaatacttgtattcagaaccccattttcgtttgtttcaatttcatcatttgacaagcgccgtgagctatttccttgtcaacttgttcttgcttgttcttcgattgcttgtaggttcaaggttgttcttggcacggcaagaacaacaacaacgtggagtcggtgcaccggttgctaaggcgtagcacccccgtggtagttgtagtcggaccaccaacgtcgtgtcctcctccaaatcgaagtttatcctcgtctcatcgaaagatcgagaacccccgttgctgcatcaagtggtatcagagctcaagttgctcggtgagagatttttcaatcctttgtttttacctacagcccataaaaaaacctcaaaataggtcagatccaaaatcaccaaaacaagttgagcctttgttgttctacttagtttttgcttgctgagttttcggttgcatcgattggttgagttactggttctggtagtttagtcctttagagtttcatgttctgttgacaatttcgtcaccacaaacacttccaccatcacctctttcatcttcatcccgctgccaccatcatcaccatattcaccacgaatccaccttcatccgcaccaaattttcgtccaccacaaccaacagcaccctcatcactacatcagccacccccaaatgcatttattgctacctccaccaatagccaacccttttgcaactttgtaaagtgaattagcccttccaaagaaagcatttaagtgccctcacttttgacttgttggctgaaccaagtaactccaaccagcccatcattactccattgtgttgacatgttggctgaatgaaaagagaagaagttgttcctgttcctgctgttttgagtaatttcgaaattcattgggaaaaattttcagctttgaactagtttaaaaaaaggaagaagaaaaaggaaagaaaaaaaatcagaagtgaaaaacaaggagaagaagaaaagaaaaaaatagagaagaagttgttgctgttattttccttgtgttcttttggtgcaattttgagtggctacacttgtgagtaggttcgtctctctaacagggttttacctaggaccaacacaataccatcattgagcgattattcaacttgcttgattaatgtggttctagctgtaccttgacattacttgcagtcacctatagctccacaattttttatctactaccatcacaggatcgtgcttgttgtcggctctggtactactaaccattgttgttgttcttgctagttgccaacgccttttacatagcaaagtaagaacatgtaagaactcgtttgcacaagtttggtagaaatggagatggataacacctagctccaatagttgataggacatatctcttgtgaattgttgcttcctactccctccattccataatataaggcacaaccactttccttagatgttccataatataaggcatgcatgcaagcatgcaattaactatgacatcttctccattaaattattattttttaaatcctccactctcatgttatctaatcctattggatgcatgcattatatttattaggatgattcaaactacaagatgataataattatttttggtctttgggttaagggtggttgtgccttatattttagaatggagggagtattaaccatgacaggaggatcaggggagcatcctcaacattcaccacgtacgaggggcatcatacaacattttgagcaccaagtgagggagcatgctgaaggccttgatgaggatgttagggtcgccaatgatcgccttggtcaattggaggctactcaaattgacaccaactccaagctttcctcattggagacaccccttgtggctgtgaacacttctcttgcaggtatcttgaatacgttgaagagaatgagccaagatggtcatgatggaccggctaggcgcaaccacattggccatgaagctaatagcagcgtcgcagcaagggaagaagtggactacgctgctgacaccgagcttgatgaggaggtacttggtcgtccacaacgacaacagcgccaacagcgccatggaatgggcgctccaccacggcaggaggtacatgataatgacgattctttaggcaagatcaagtttaccattccttgctttgatggaaaatatgaccctgatgcatatcttacttgggagttagccattgatcagaaatttgcttgttatgattttcctgagaataaatgtgttagggctgctactagtaagttcactgattttgcatccatttggtggagtgaatttgttcgttccaatccaaataacactccacaaacctgcgatgcaatgaaaagagtcatgcgagctagatttgttccttcatatcatgcatgtgatttgctgcataaattgcaacaacttagacatggaatcaaatatgtagaagagtattatcaagctttgcaaacaggaatgcttcgttgtggtttggtggaaaatgatgatgctggtatggtgttgacggtcgttagcgatcagtttcgaccgtaaatattaccaaaatagaggagaaatagttatacttgcaatgcatatttatgttagaataataatattccactagtattaggtttactaaccttttgcagagaataaccataaagtggaggagaatcgacatcaaatcagacaataaatcaatcgaacgatgtcgagaatcagacttatgtatgaatgggccaagaactcagaattgacacgatgaattgggcaaaaattcacaagtcttcgcagagaagcaatagaggaggccacctgccgagtttgggttaggtcggtccagcccatggttcggccgaacctcccgtggcaccaatggatgtagggttttgatggatggctgggattggtccccaatgacagttggagggtattactgacctttccaaccgtcataatcgtcattacatgcctataaaaggagctcctcttctcacttcactcacacacctcaagcaaagctctctcatattctctcaagtttagtttagtgttcttaagctagtagagcaggaatagagtagaaatcggagtccggaagccttcgggtatggctctagtagctttcctttcctcttttgtaagctttgtacatttattagaatactcttctttatacatttctggtattgaaatactttccgagtatatgaatgccaactttactttatattcatgttatactgattgtactgctagcttatttgggagatgcataggtacaagtatagtgtttgcttatgcaattgctctatgtcatgacgatgatattagagtagtatctggtagtttaggagtggtgtctagattacgggatatcattatttggggttatatgctgcggatgagaggtggaccgctgatggtgacagctcagtacgtgtattcctccacgcgtgtatatagtcctaagttaatttccaggggagggtactcctctgtatttagccccggttgtatggtcatgacgggctgtcgtaaggaactcggcagtcaggggtggcttcttgaagtactaggaggacatcggatagagggtattagctagttaatcagataactagaatgtatgtatactatgtatactagaagtataggaatagattctctttctattttctttccacttagcttaggtaatttagtatgagaatgagtagttcctggcttgtgtgtcactctaccctttgattatcttaacccctgcttagactatgattattatctctctactatgatcttcctacgggattaaataaatacgatatccttggaatactctcaggtgaaatgctacaatggtatatccatgcgcttgcggatgaactctgtaaccataatataacaggagtatttctgcgccattgcctagtaatgtcgttaagaaataccaacatatggctagattcatgggtgggctaaatcgagaaatttagaacattctagcctacaaagaatataattcaattaaccgtttgtttcatcttgcttgtaaagctgaaagggaagtgcagggacgaagagctagcttcaggactaacatttctgcaggtcgtactagctcttggacaccttccaacgctgttgcaccgtcaactcgagcagcagcaccatcgtcctcaagcaacaagctacgttcctccacgacaaactctacaccatgcctgagtgaaccagcaagaggggttgctgctacaccttccaagagttcatcattagtggcatcatcaggaaggacaagcgatattcagtgcctacactacaagggctttggtcacatgtgcaaggactgcccaagcactcgtgtaatgatcgtgagagctgatggtgggtactcctccgctggtgatttagatgaagaaacctatgctttgcttgcaactaacaatgcaggggaaggtgacacgccccaccaagatgaagaacacattggggccgaagctgcagagcactatgagagcctcgtggtgcagcgagtgctaagtgcacaaatggaaagggctgaagaaaatcaacgccacaccttgtttcaaaccaagtgtgtgatcaacaaacgctcttgccgcgtgatcatagatggaggaagctgcaataatttggctagtgttgaaatggtggagaaacttgcattgagcacacaaccacacccgcagccctactacattcaatggtttaatagcagcggcaaggtaaaggtaacacaattggtaagagtacattttgtcattggttcttatcatgattcaatcaactgtgatgttgtgcctatgcaagcatgttctatgttattaggtaggccatggcagtttgataaagattctttatactttggcaattccaatcagtacttctttgtgcataatggaaaaaagcttgtgttacatcctatgtctcctaaagttattttaaaggatgaacttgctagagctagcaagcaaaaacttcaggagcatactaggagtgagcatcatattgtggctaatgaacttgagaagcataagaagaaatgcaccaactctgttcaaaataataaaaatgagattaagctgaagggatcttgtttcattgcaacaaagtcagatttggacgaagtgatcctgacacttctatttgcaatgcttcggtttgcaaagaaactttattttcactcgaggatacttctatttctttgcctcctccggtcactaaccttttgcaggaatacgccgatgttttcccaaaggaggttccaccggggctgccaccaattcgagggattgagcaccagattgacctcattcctggggcctctttgccaaactgtgtgccatacaggaccaacccaaaggaaacaaaggagatacaacatcaagtgcaagaattactcgacaaggggtatgcgcgtgagtctcttagtccttgtgttgtccccatgcttttagttcatggctcatggcgcatgtgtgtggattgtagagcaattaacaacatcacaatcagatatcgtcatcctatccctaggctaggtgatatgcttgatgaactgggtggttcacttgtgttttctaaaattgatatgcgtagtggttaccaccagattcgcatgaagttaggagatgaatggaaaacaacttttaaaactaaattcggcttatatgagtggttagtcatgccctttggtctcactaatgcgcccagtactttcatgagattaatgaatgaagttttacgtgctttcattggcagatttgtgatggtatattttgatgacattctcatatatagcagatcaatagaggatcatcatgataatttgcgtgttgttttttatgctctacgtgatgcacctttatttggtaaccttgagaagtgcatattttgcacagatcaagtctcttttcttggctatgttgtgactccgcaggaaattgaagtggatcaagccaaggttgaagccatacatagttggctggttccaacaacgatcacacaagtgagaagctttctatgacttgctgggttctaccgccactttgtgaagtattttagcaccattgcagccccactacatgagcttaccaagaggaatgtgatattcacttgggctgcagcacaaaggaatgcattcgagactttgaaagataagttaacatacgcaccattactccaacttcctgatttcaataaaacttttgagcttgaatgtaatgctagtgagattggattgggtggtgtgttgttacaagaaggcaaacctgtagcatatttcagcgagaaattgagtgggcc

SEQ ID NO: 7546 - DNA, 732 bp, Oryza sativa
  unsure (1)..(732): unsure at all n locations
tccatgcaagtgaacaccatagtgccaaacaccatgcaaaaatccttagtcatttttggagaaccttgtgggctaagttggggacgaaacttttattttctactacttgtcatccccaaactgatggacaaactaaggttgtgaatagaattttatctacaatgcttagagctattttgaaaaagaatattaaaatgtgggaagaatgtttgtctcatgttgagtttgcttataatcgttcgcaacattctactactaagaagtgccattttgagattatttatggccttctaccccgtgctcctattgatcttttgcccctcccaacttcagagagggtgaactttgatgcaaaacaatgtgatgaactgatgttaaaactgcatgagaccactaaggagaacatagagcacatgaatactaggtgtaaacttgctggaagcaaaggaaagaaacatgttccttttgaatctggtgatttagtttggctggctgttgttgcactcggcctcaaagtagggagacaaggtgaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 7547 - DNA, 700 bp, Oryza sativa
aaccccatagtccgcacatcctcaaatacaaagcacttccctagttagatgtaggttagacttcccgtgcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctattta

SEQ ID NO: 7548 - DNA, 1121 bp, Oryza sativa
ggtacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggtggcc

SEQ ID NO: 7549 - DNA, 1953 bp, Oryza sativa
agttatcaagctagtttgcaaatgtctccgaatgaagcattatatggtcgaaagtgccgtacgccgcttctttgggatcaaaccggtgaacgtcaagtttttgggacagacatattgcgagaggcggaagaaaaagtgaagattatccaagaaaggttgcgcgttgctcagtcacgtcagaagagctatgctgacaatcgtcgcagagatttggcttttgaagaaggagattatgtataccttcgggttacgccgttacgaggagttcatcgtttccaaaccaaagggaaattggcaccgcgttttgtgggaccttttaagattgtgagtcgaagaggtgaagtagcttatcagttagagttgcctccgtcaatgacaggaatacatgacgtgttccacgtgtctcagttgaagaaatgtttacgagtacctacggaggaagcagatcctgatcgtatagagcttcaggaagatttaacttatgttgagaagccagtcagaatcctggaagtaagcgagaggaaaaccaggaatcgcgttatacggttctgcaaggttcagtggagcaatcattcagaagaagaatcaacttgggagcgagaagatgaattgaagtcagctcatcctcatctgttcgccagttcttctgaatctcgaggacgagattccgtttaaggggggtaggtttgtcacgccctaaaaatcgactaaattaaaaatgcatattttaaatcatttttagaaattgttttaaaagcctacaagctaaaccttaattttctaggaaaattttcaacataaaaatgaactagataaaattttattaaatactatgcttgctcctctattttctagaattttctaggaattatttgagcaagggaagtatttttaataattgaaacatcatttcacaaattgtttttatttaaaaagttcaaagaaacccctcctaggccgttgggccgatttcggcccaacttctctctctctccgcgcgggcgaaccggcccagccggcccagccgacgccgcccgcccctcccctctccagccgctgacatgtggggcccacatgtcagggccgtctcctacctccggccgccgtcgcgcaaccgcgcccgagccgccgttttcccccttcaaatccgctccaatccggtctcctcgagtccgattgatttaggggttttgttcctctcgttctcctctttcttttcccccaagaatcaaaacgaatcgttgagtattctctccgaatcgaattcgttttgattttatccctaaaaccgagtttgatttcttcccgaatcgattcctctcgtttggagttcgatctcttcgatccaatgccatataaagcttccccttgttctcctcttccgtttgccccctctcccgtcctctctcgtgcctcgtagcaccgccgcgacgcgcgccaagctcgccgccgccgccggccgtcttcggtcacgtcgcgccgccgtctccgccgttgccgccgcttgccgtcgccgccaagaggtgcgccgtggtgagaggaagctcggccgcccctcctctttcgccgccgaccaccggagccccttcgccgccgtcgacccgagccgccgcgccgctttttctcgtcgccggccgccgtcgtgcatcgtttgtcgtagtggtgagtaccatcgggttcgtctcgatgccctctacgcgtagatgccctccgtttccgcggccgacctccctagctccggcgagctctccaacccgagccggccgccattgccgacgtcagcatgacgtcatcaccagggctgacgtcatcattagggctgacgtcatcgtctccttttctttttctttttcccgattttctaatagattaaaacttcagaaaatcataactaaataaccgtagatccgtattaggtggtccaagtttctaaatttttttaaaatcaagatc

SEQ ID NO: 7550 - DNA, 15374 bp, Oryza sativa
  unsure (1)..(15374): unsure at all n locations
tcagctaaatgccttatgtaagtttgcttatccatgcctagaaacatagctaattaaagggtttaattataaactatattatgtaattgttaattagggttatattcaatggtagctcacgatggtaaatcgtgtgatgataattaattgataattaaaacctggataaggtgggttgtgagcatatggttttgatggttgtgctcatgacaattaaggaccggttctcgcccgactgagaagtggcgagaagtccacgggggtcgctggggagtccatgccttgttttaaagggggtgattatgatccaggaaaggtgcactgtaatgggttatgttgtgcgaggggtattgtcacgactcctgtcacgcccggaaattcactagtaatttccgaacttatttgtgcataaaatcctcgtccaagaatcagccgaggtacacaaactgacaatttaatatacagattcatcaataactaaagcgaataaatacttacttaagaggcacttagtcctcatcaggaagaaaactgcagcggaaaataaaatctagcgaagctccggctccactcccacaggcagctcaactggggtataagccaaacgtcttctccttccggatcctttttcttcaactgaggttgattgattattgcaagaatgagcatatgacatactcaacaagccacacagcaaatatgcaagtgcacaaagattccaaaggatggcataatataggctcatttgcgaaagcagcatttagcaaagagttaagagtagtaaaacagtagagtaattaatcagaaattttaatcaacactgaacagcacacccatgctgtacaggcccaaccatcctgaacaaccatacccggctgaacagatctaactccaaaccaggagctaagcaaattattaccagttaatcatcaataattattgtgagaggtgtgagactaatcacgaaaaacattgctcaacccgcccataaccgcgggcacggctattcgaatagttttactctggccagaggtgtaccactgtacccacaagacacgattccacacatgtcgccatgccctgaaataccaccacggcattgcaaagggggaaatcgtgacaataccctttgcacaacacaactcaaaacagtgcaccgttcctggatcataatcacccccttataaacaaggcatggactccccagcgacccccatggacttttcgccacttctcagtctggcgcactataatgaatcacactatacaaaagataaagcccgtgcccatgctggcttgtggtgggcacggtaaatgtttcacaacagtagctcgcgaaccggtccttaattgccatgagcacgacctccaaaaccatgtgctcacaacccaccattaatcatattttaattaccagttaattatcataacacgattaaccatcgtgagctaccattaaatataaccataaataataatgtagtatatatgattcatcccattagtgagctaatgtttctaagcattgctaagcaattatatatatacttaacatttagctgaaccaaaccaatacataaggttcaagctaatcaattttattaccccaaggtatcaaggaatagggcattcaatgcaaattggccataacaaaggaataggttcacaccacccgatgacattcgaaaataaatgcacagttgaaacaaatagagaatttaaatataggatcaacatgctcaaaggattgtttgggatctgtgtgacttgccttgcaataatcgatcttcaattaatcttcttgatcacttccgacgcactcacgaaccttcgcaacgacggaaacgacaagctaacacgcaaaacgaagaaaaagactaataaaaaccaaataaacagtacataaaaagtaaacaaacatgtaaatcataattttagatgaattatgagacttgaacggcctcattcagacttcaaatgaatttattatgaattttacgagattaaatctatttaaagcccatttaaaaagaattaaataaatttaattcaatttatggacaattttaatatgtagatctttattttagaaaaatttagcaacttgaaccacctgaaacggatctacggttatttagatatgattttccgaagatttaaactattagaaaaaagggaaaaaggaaaaggaaaaagagacgatgacgtcagcatgacgtcacccacggtcggccgattagggttttcgagctcgccggcgataggggccttggccggggaaaaggagggcacctacgcgtagaggacgacgagacgaacccgatggtactcaccaaagtgccaaaagatgaccgacgacggccggcgacttggaagacggcggcggcggctcggcttgacggcgacaaaggggctccggtggtcggcggcgaagggggacgggcggccgaggttgctctccctcatgcgcatctaacggcggcgagacaaggcggcggcggcaacgcaaacggcggcgcgacgcggctggaaggtcgccggcgacggcagcggctagggcaacggcgcggcagcgctacgggcgacgagagagctcgggacttggggcaaacggtagaggacgactaggggatgctatttatagcattggattgaagagatcgaactccaaacgagagaaatcgatccaagaaaatcaaaactcggttttggagataaactcgaaaacgaatttgattcggataaaatacccaacgattcgctccgattcttgaggggaaagatagaggagaacgagaggatcaaaacccctcaaacaaacggaagaaaagaggccggattggaacggattcggaggggaaaggaggcggctcgggctcggcatgggcggcagctcggccggctggaggttagggatgaccccgacaggtgggtcccacctgtcggcggctaaggggaggagggggcgggcggcgtcgggttgggccggcttggactgggccgacttgggccggttcgcccgcggaaaagagaaagagttgggccaaaaacggcccaacaacctaaaggagggtttttaaaactttttcaattaaaataattcgtgaaatgttgtttcatttattaaaaatacttccctacctcaaataattcccaaaaaattctagaaaatagaagagcaagcatagtatttaataaaattttatctagctcaattttatattgagatttaacaaattaaaattagatcttctcttttaagcttttaaaaaattatttctaataattccttttaaacaacaatttataatttaaggattttaaacaagaaaagctcttaacaattataattagaccatttaatgattaatttaatatttaaataattgctgaacttctctttgtatgattaaaattaataattgagctccgaaaaatccgagaaaattccagagagtataattaaccatggagaatttaataaaaattaaatccatccatgctttatatttaggaaattttatttcccacatttaacttcacttgtaaattaatgaacatttaatataaattctattaataatttattaaataatttataaatcctaagacaaaaatcaggatgtgacaactcctttccgaggtaccgtggtggtattgaggcacatggtgacatgatgtggggttgtgtcttgtgggtacagtggtacacctctgatcagagtttaaactattcgaatagccgtacccgcggttatgggtgagttgagcaatgtttttcgtgattagtttcacactattcatcaatgttaataatgtggtaattaatttgactcctggtttggaatggctaattcctggtttgaaggtttaatttgttcaactggggttggttgttcaaatgtggttgggcctatgcaacacgggtgtgttgtatggtgtttatttaatattgattaattatacaactgtttaactattctctcaaatatttattaaatgctgtttctgcaaatgagctatattttgccatcctttgttatcctgtgcactggcatatttgctgtgtggcttgttgagtatgttatatgctcattcttgcaatattcattcatcagaggaggagtatctcagtgaatgtgatgatctggaggattaggcttgttcttggttaagttgcctgtggagtggagtcgccatagctgttccgtagtttgttttagttttgttttccgctgcgtagaatgttatttgttttgagaggaactatctacctctgtaataattttaatttgcgaatatttgatagttaattatttgtactctattatcaaattgtcattgtgtgcctcggttgattcctggacgagggttaacacacatgtaagcgtttggaattttggatagaaattccgggcgtgacaccgtcaacttctcctggatcgtcccgtctaatcttgtatcgtagtgctttgcaaacagggcatgcttctaggttctcatactcctcaccgtgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcctccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccatgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttgaagcttgctcaggcagctggaggaggaagaagacatatatataggggtgggactttagtcccggttggtagcactaaccggggctaaagatcaccgggatctttagtcccggttggtattaccaaccgggactaaagttacgatctttagtcccggttggtgttacaaaccgggactaaagatcccgggggggcctgacagtccctgacagcattcgaaccgggactaaagatgatctttagtcccggttggtaacacaaaccgggactaaagatcaaatatgcccgctacccttttgaaccgggactaaagatcatttttagccccggtttttattgcatccgggactattgtggaaatcggccgaccgacgaaagatggtttctccaccagtgtcgtcacttcgtctcgaggccgtcgttccaccttgaggacgctgctccacctcggactcggactaaacgcggcaagatccaaccatgccagggaggatcttggtggagatcaggcggcccctaccgccgtgatcccatgcatcggtcctcctcgagctccctctcttttatgggcagcagagtcgagcggactcgctagccacctcatattgccaggcaagagaggataaaatgagagaagaaagaaaccatctccggcgcgacgagaaaggacatttatctcgtctccctgagaccctaggcacaagctgccggagaggaagctcgttggattggaggcgggcgggtgcgcacgcgctcgacggggctagccggtcgccactgtcgttgtcttcctttccgcgaatgagcgtgttggaattgctctaatctatcaaattttatcagggaggcaatctgcacagtgaacaccaaacatggatcgcacatagtaaatctttttcacggtgatgactatacttttgatttcggcgaaaatttcgattttttggcgaacgcgcaatttcgttagcaccgatagttacgaaatttcgttattttttacactttttatcaaaattatttaaaattgtaacaaattttgactgtattgaataaactttgactaaattcaacaaaatttcaagaaatcctaaaattttggtccatgtaatgacttgccggttgtccaaaatttagaaccaaaattgcaatcactggcgactgcccattttctcgcaaccgccacgaatccccgctttggactcgaattcccgcctcgtcgctctctaaatcgagcgaggggacgaaacgaacgcgatccgccacattattcccatcccctctctctttcaatttctccctcccatccatccacctccagcgctagggtttgtgcgccgccgccgccaccagagctagggtttggggatctctcgtcgtccgtccgccgccacccccgccaccatccataggggtttcgtgctccccgcgccgccatggccgccgcgcggaaccccctgcgccggtggaagcccttcctcgccgcgttcgcctccgtcgacgacgccatcgagatcgaggccgccgacctggggatctcccgcagcgagatccggcgcgcgagaggccgcatcgtggggatgctccgcggcgcggaggacgaccgggaggcggaggagctctgctcggtgctcgacgaggtgatggcggagtctctcctgacgctgcggttggtgcccgtgacgcccaggacgctggcgaccaccgatctcgccggggtggtcggcgcgctgaggaagcacgactcggagcggatccgcggcctcgccaccgacatcgtccgccggtggagggcggccgtgaagcgagaccttgtcaggatcggggtcgccatggagaagctctctcagacaccggagcgcatcgaggccgccgatcggccagtctccgatctggatgcgaaggtgaagcgcgcactaccggtggcgtcagcacggcgaaggcctcagagccatcgctgcccaagaggagtgctccggccgacatgggctcggcaacaaagccgaaggagccaacccatccgccgaagaagaagccgccggccgccgcgatggtgtcaagcccaatcacagtgacggcggcgagaagctgatgacggctgctacaaagcggaagctcgatgaggcgcagaagcggcgcaagacggccgacatggccgcagcagcaaagccagagggctctaattcgctcccgttgttgaagatggtggcgccggccgtcgttgccagccacggccgccgcgagagcatcgagctccacaacgacgaagagaagatcgccgctgcgaagcggaagctgcgtgagggctaccaagacgcagaggaggcgaagaagcggcgcaagatccatgtgatcgaggacccaaagatgctgaagcacaagcaggagaagatggatatccgatcctgagcgtgcggagccgagcaagccacgcctcctccatggccgagaagaagaagagcttcctcgtgtcgtcccttgggaggctttaggcttactagagatttacctctgaactgtaaatgaactgtgcgtccaaagatcacagtaacatcttgtattggcatgagaaactctctgaccctgtacacaacataccgtttctatgtacgtacgtatgactcgatcaatcaaatcaatcctgttagttaatgtaactggatagtatgtaagagtattaatgtattatcagtgaaatcaatggatcaatcttatgatcctcttaactttcctctgttttttttaacacatctgtagtacaaagtatataaaaaggtcagatgtgtcagttacaattctgttgagtgggtgaaatttccatacaataaattccctctgtagtgtcacaatcctgctgagtgagtgagctcattatttggttgcgtctccacgcctccagggctcaccgcccaaacttgtcgggactagctatccatcacgtgacagattttagatagttggattagactcatttgatcacttgattagaagagtctatacatgtatcaatatatattaattatatatatttcatatattttatttattagatctttgcttcgcaaaaaaaatatcaccaactcatctactaaaagttacaggtgtaactatactgtaactatagtgtaattacagtgtaactatagtgtaattacaatatacttacatgacttacaaatgtaattttagttatataggactgtaattttatattttagtttcaaactagaaaagatgcccgtgtgttgcaacgggtaaatactattttaatcttattattgttatacagtttggctatggtaaaattcactgtgggaatttgcttggatattttttctagaaaatattgagctgcaattaggagtccaaaattcataaattagcatgcaagtgtttttaaagagattttttatacgactccttttatattttcaaaatcaaacgaacttaaaatccgactcaaacatggatctgtatttccaaaagcgaatgaacttaaaaaccgacttaaacgcggatgacgtaccaaaataccggcaaaaatatttttaatttttataatagtagagaagagatagagatatatagtagagattaaaaatttaaaaaaatcaaaaaaaataaaaaaaatcttcgcaacatggtcttcggctacgacaatactggaccttgtctttgtctcccgcgttcatgggcctgcatgcttaatcaatcccgttggcaaaaagaaattgtgggtgaatcgcacacgagattgtttgcgcgggcttgctctctgtttcgctgttaaaaaaaaaacaaatcctatcattgcggcatggatcaacgatctgatgcgttagggggtaaattgatacggagtcgcgatgcaaaccaaaagggatgacgtgttggcaaaaacatctttaatttttataatagtaaagataaaaatataggtacggtataattatatgtaattacattgtaacttacacgtaattatatgctccttgtgctcagtggaggtcacgggatttcactcatttgtatctaagtagagttaacatttaggcatcgttcgtttaggggtgataggggagattggctctcgttttccgcgcgcacgcttttcaaactactaaacggtgcattttttgtaaaaaaatttctataggaaagttgctttaaaaaatcatattaatccatttttgaaatttaaaatagttaatactcaattaatcatgagctaatggctcatctcgttttgcgtatcttcccaatcttctcaatccccttctcctcaaacattccttaatcgcttttgttgtatagtaaaaacagaaaaagatgcgtgcaagacatcacttggcaacatacatgcactgcttccccgtacgtatgtatgtatcacgtacatgcatgtcacgaaccgctgccaccaacgaggatatcacgtacgaacggcgcgctgcaccgttagaaaaatcgacaaatattaagaaaaaaatttgacgacaaatttctagcaaaaccaaacttgtctcccccaaacgccaggccgagccacagcccacgtacggtgcgttcttgctgccgagaagaattagttcatttagttcccttaatttgtcgtgtagtgtaattctcatccctgaactgcaaaaattggatacaacctgtttccagcttaaaaaacagtgcaaacaagatccctcagtagtattatccctagttttggatgacgtggctcctttgactagatcttatcttacgtggcattaacgtggcggtaacatagcactttgatccaaaaaataaaacaggcaacatttaaaactaaaaaattaaaacaaaatattgggggcccataagtcagtcaaataagaagataaaaatattgggacccacctcctccacctcagcctgtctacctctgtctcctctctccgccgcgagagcatgcaaagagagacaaggcggggagggcggcgacgggtactgtggggtggtgccgctgctaacatccgaccacatggcggctccatctgaaggtagtgaccaagctggagttggggtagaggtctttgggtgccatgcctatctcttccacttagcaatccaccgccatggccaccgctgcgggctcctcttcctctattcctgcaagccagtctcaaaacccgttgccccgtgacttcctcgttcatgtcaaggcctacctctctccagccgcgacggcgtcgacaagctcctcaagatctcccgctacaccgcccactttgcccttgccgggtgctcgctgccccccgcctcctctggccgtccgcctcagcaacatgcgatgacgacttctttgtctgccatagagaacgaagaaaaaccccaatatgttagtcgccggtaactctaagtcggcaatggtagttttcgtcgggagtcaaaaaagggaacaaggtggatacaagaattcatttttgcaattcaattctcaaaatgcaaggataaagagaattctctactttcttctaccttggtctccggcagagcttcgtacctgataatgtattatacaatgcccttattcagagtagtccaacggagttgtataatcaaagataaaagtggagacacaaagtttaagggtgagactctctttcttattctaatcatcccatcaagcttgatgtacaaatgagtagccctaaatatagtgcaatcctaaatatgcaaagtttggtgatgactcaataagtatatttgggctaggcatttgtgggccaagcccaaagtttcttttaacaattaccacttcaaaatcaaactgctcccacagcgcagcacgtcagcactcaggacctagggatgaaaacagttggaaaaaccctctaccatttccattttcattttattttctcgaaaatggaattggaatagtatactcggaaacggtaacaatatcagtaatgttggtatatcgaaaacggaatcgtcggaacgggaatctaccgatgtcggtcggaagtcgaaaattcatgtcggaagtagcgaactgtggtatcaatccacatttaactatgtatgaagatgaccttataatttcacccttgcatcatcacgctgccacacaacaccattatatgatgattaataagttgacaataagattgacaaacaatataaataaagttcaactatacttcaacatcaatgtggataaagcatacaatgtggcttacatgataggattacatcataactaatattgtccgacttttttttaggatataaatttgaagtcttcgagaacaccaagctcacaagttggcatggcttcagctgatcagctccttgtcaaacatcattcatcatttcatcatcaattgacatagctacatcgtcgtcctacagactacagtggcacattgcataagaacttttatgttgacactgtatagctaccattgtaattaagttttatgctaaactagacattttggtagtttccaggtcaaggggggtcactgagtggagtcaagttggtggggcccgccagtgggtcccactgtctttctttttttcttttcttttctctctcttatccttcccttctatcggttccttctcttgctctcttgatttcttctttgttctctctcattctcttctctgccttcggctccttcacgcgcgcccgagaggagagaggtgccggagatggcggcctggcgcagggcagtggtgggggaaggagagaggagaaaggggcggcgccaatggggaagaggaggccccggtgcggcggcgctcggcatggcgtcattcggtgcttggcgtggtggcgcttggctcggcggcacggaggccggcggtggaggatgggagagggaaagagggccggctgcgatggaggttgtcggggcgaaggaggctacggccggcgtcggcgacatctactgccggcgtcggcgacatctactgctttagtctcttaatgcctaatgggctgcttctgctccggctagccaggcccagccggctttcttcttcggaattttgtcggaaatttgacggaaattaccaataaaaaacggttaccgaccaaacggtcggaaaaaaacccatatcatttccgctaccattttcgaaagagattaccatttctattttcgatactgataattaccgataccgactgaaacggtcggtgcaaaccggaaacggaagccggaattctcggagatttccgtaccgttttcacccctgtcaggacccacacagaatcgtgcgatcttcgcgtcgccatggaagccaacctgctgtcgccgcggcgcatcatcttcttcgggagcatgttggcggcggcggcccgccgccgcgacccggcctcagcggcctactccatggcgtccatgctcgtgctggtgctcttcttccgctgcatgggcgccgtcgcgcgcgctccggcggggccacggaggcagtggctcagggccgccgtcgtcgcgctctgcgtcgccctcaccggcctcgtccagctccagatctacagccccgccgtgcccctctctgtggcgctcgccatctgggccgtgtccgtcacctgcttctccgccgtcttcctggttgcctccgcacgcccgcaagtcgctcgatgaaatggcgacctcggctttgacgtttctactactggtacggtaccaccagacttgttatcactaccctccctactgctgatgagtcacttgcaggattcagacaatgtttgcatctgtaaatatcgttacaggtgttcttagacttctttataggattgaccgtgaattcgtccaaatctgacaaatgctagtttttgctgtaagtatgcatgatttccgtaaaactgggcatgtgcggtcgaaatttacttacagtaggtgccttgctgctggaattaaaatttcatgtgggcgaagaatatgtccacactgatggttggagacttggagtgtatgataatatctctcattccatgaaacattgaacaatcatgttgcttctcaagtccctacagggctacacctgttgaatacacaattgaacatatctcttctcaaagcatgaccaattctagatttttttttttcctgcacatagcatttccttatcattgttgcatgcttcgatttaccctgtccaactggctactgtatctgggcatgaatcggtaattctgttttatccagcttcgatccatgaagcatatttggttgatactatctgaatagcattgttacttgtctatttattacgttctcttagtatgatttgggaaagtactattaccttttttttcttttgctgaaactggggtacgcaatttgtcacaatctctgattaaacccagacagagttcattttagaaagaacacatggccacatggtactgtagttcaccaaagtacatgttcaggtgatcgttttggtgtaacaatatcaaaattagctcacctaacgccttctcagtcttatattggcaacatggcactgtcaatgacctcaattttctttataccatatcatcactgactccgtactatacagtacggacaaccttaataaatcatggaagaatagtcaaagacaaattaaacatgcgtatcataaattgtcaaagactgattatttttttttaaaaaaatgtctattgtgagattttggagccgcctatgccttgttcagagagtgtaagattttgagaaacggttgattgatagtcaatctctgagaatctaaaaatggctggattcccaattaattttttgaattttatagctgcatattctcaaaatctggagggagaatctgcattattttgaaaaattgaagattctgcgaaacgttataatggctagaatctgtactgtactgtttctggaacatcgtgggggtatttttcattcaaatcttgtgtgtaacaagtaacaacaagatacagaggaccatagatcacaatgtagttgccatctgaaacataactttaacaaattgagacatagatatagagaaaataaaatggtatatacgtacccgaatttttggtgatggaagtatatatcacgacctatatatatactgctactatggactatatatatagatagactctgctaatggcaggggcaaatgacatcggtgacaatgtggagggagtacatgacgacgacgaagtggacggccagcgcgacgaagccggcgatgagcgccgccatgacgtggttgcagtaggcgtgtatctgcccgcacaccggcagccacccggcgtgcgagttgccgttcttcgcgatgtccgatatggcgccggcggaggccacggcaccggcgagcaccatccccaacacctgcgtacatggacggacggagaaatattgatcgaaaactggttctacaatctttttttttaccagatgataccatgcatgcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 7551 - DNA, 837 bp, Oryza sativa
cgggagagggggcaaacggaagaggagaacaaggggaagctttatatggcattggatcgaagagatcgaactccaaacgagaggaatcgattcgggaagaaatcaaactcggttttagggataaaatcaaaacgaattcgattcggagagaatactcaacgattcgttttgattcttgggggaaaagaaagaggagaacgagaggaacaaaacccctaaatcaatcggactcgaggagaccggattggagcggatttggagggggaaaacggcggctcgggcggcttgcgcgacggcggccggaggttgaagacggccctgacatgtgggccccacatgtcagcggctggaggaggagggggcgggcggctcggcttgggccggcatgggccggttcggccgcgcggagagagagagagtattgggccgaattcggcccaatgaccaaagaaggggttttttgaacttttttaaataaaacaatttgtgaaatgttgtttcaattattaaaaatacttcccttgctcaaataattcccagaaaattctagaaaatagaggagcaagcatagtatttaataaaattttatctagctcatttttatgatgaaaattttcctagaaaattagggtttagcttgtaggcttttaaaatagtttctaaaaatgatttaaaatatgcatttttaatttagtcgatttttagggcgtgacaaacctaccccccttaaacagaatctcgtcctcgagattcagaagaactggcgaacagatgaggatgagctgacttcaattcatcttctctttcccaagtagcttcttcttctgaatgattgat

SEQ ID NO: 7552 - DNA, 1814 bp, Oryza sativa
atcaacaccatgagatttaggagaggacacaaagaaagaaacagtttccccattgctactggttaaagtcaccttacggttggcacagtctataactcctctgtgacgagataaccagtccatccctaagataacatctagatctttggattctagcaagataagagaggatgggaaaggaacttcttctatttctatggtagcggaaggacaatactgtgtcgagaaaacttgattgcctgggtattaactagtaaaggtctcccaagactaacaacttccatcccatgtttgcttgcaaaatttttagacaaaaaggaatgtgtagcaccggaatcaaaaagcacagttgcgggtatagagttaacaggaaacgtacccaaaaccacatctggtgcattctgagcttctgctgctgctacatgattaacacgtgccttcggtgctggaacattggagttgttcggggctggaacgttcttcacacgccgaggcttaggacacttatcagcataatgtcctggatcaccacaattaaagcatatcactggcttgcttccctgttccttcctgacaggctggttctgagctgaagttgctacaggacgagcaaccaccttgcggttgtcattgccacgattaccagtattgttgttgtagaactggcgttggggacggacaactgatgaagatcctccttgagggtacgatggaacttgaggtccagtaacgagacgcggcctctggttactgccctgttgtgccctgaattgggctgccctgcgcttcttctgctccatccggttatacttgtcttcctgacgaatcgccttgtccaccaactgctggaaatcccggaaatccgtagacatcaaagcataagacaactcatcattcagtccctctaaaaacttctcctgacgttcctcatcggtgcggacatcctctggagcatagcgagctaaacggttgaaatcatggagatactcagtgaccgaacgagatccctggttgagtgctctaaattctctcttctctagagctacaacacctgacggtatatgcgtcttcttaaaagcagccgtgaactcctgccaagtaataggttctccttcagccctgccttggcgaaaatgatcccaccattcagcagcaggtccatgcaattgatgcgaagcaaaagaaactttctcctgctcagtacactggatcaagtccaacttcttctccactgtatgcagccaatctcctgcttctacgggattggtggtgcttgaaaaggtagggggtctcacacgtaagaaatctgccagcttgttttgaggaggtgggggtggattctgattctgattgtttgcctgctgattctgtgcctgctgcactaacagattgatcagttgtgtttgttgggccagaatctgagctagcgtgggatctcctccattgttagtagctccactaccacttccacttccacttccagtgcgcgtgttcaccatctgacgataagcagagacaacaggaaagaacgacagagagacacccttagaacggagttatttaattaatttaaattctatattgctcttaactgtgtatgattatatttaagttgcattaacactatctcaccaactatcttacactctgacaagcaaaagaactagactcatgctgttacatcccaccattgatgtaagcaacaagtacaacccacacactcacaaacaaacttaaacaagcaatctaacacaacgaactacggcaacgatctaactaagcgactactcccgccttgcgtcggaacgaagcga

SEQ ID NO: 7553 - DNA, 18767 bp, Oryza sativa
catcagagtggcactctcttcaccatcaggacaggtataggttccatagtcttgaccatgaggcttgtgaggatgatactggaaagctgatgaatccaactcttcttcaaaacgttgacgcaactctccaatggccaccaaagctacttcttgacaagcatggcagtacgatcttcctccagcttcaaacttaaaagacggaaggtcttcgctatcactagccaacgtcacacgaacacgacacttctcctcgtcggggtcatgggaaatttggcgatactcaggagcaacttcatagcctacctcaaaagccatcaacctcagctccctgacgaatcctaacaccttgatcaaatttctcggtgaatggggcggcatctaaagagacatggaagagaagaattaattcatatatttctaagttagctgcaccatctagacttaactgattgttgaccaaaaaggaagaaaataaaagaaaagacacatacaaagctattttataaatattttgtagaatttaacttctctttggacagagacaaataattttttttttgacaaataactaaaataaaactaaaatacttatgatctattataagcacggtacaatgtcaccattaaaaatgatgagtagtactagtgcaaacatgattaaatcgataccataataaatgtacagtgccgactaatcaataagatttggtaaagagaaaaggaaacattttgagaagaacaactttttgcttttaaaagaaaagaatttgaattaaataaattttttgtgcataaccttgcatgtgctgccaacttaattaatttataagagaatagagaagagcagttctatttttttttcaaaatattttgaaggctacttaaggtttaccatttggcttatcctaaggtcaaggtggctctgataccaacttgtcacgcccggaatttctatccaaaattccaaacgcttacatgtgtgttaaccctcgtccaggaatcaaccgaggcacacaatgacaatattgataatagagtacaaataattaactattgaatattcgcaaattaaaattattacagaggtagatagttcctctcaaaacaaataacattctacgcagcggaaaacaaaactataacaaactacggaacagctatggcgactccactccacaggcaacttaaccaagaacaagcctaattctccagatcatcaccttcactgaagtactcctcttctgatgaatgaatattgcaagaatgagcatataacatactcaacaagccacacagcaaatatgcaagtgcacaggataacaaaggatggcaaaatatagctcatttgcagaaacaacatttaataaatatttgagagaatagtaaaacagttgtataattaatcaatattaaataaacaccatacaacacacccgtgttgcataggcccaaccacatttgaacaaccaaccccagttgaacaaattaaacctccaaaccaggaattagccattccaaaccaggagtcaaattaattaccacattattaacattgatgaatagtgtgaaactaatcacgaaaaacattgctcaactcacccataaccgcgggtacggctattcgaatagtttaaactctgatcagaggtgtaccactgtacccacaagacacaaccccacatcatgtcaccatgtgcctcaataccaccacggtacctcggaaaggagtcgtgacaatacccctcgcacaacataacccattacagtgcacctttcctggatcataatcaccccctttaaaacaaggcatggactctgtcacgtcctgataaattcatcccgaaataaaattcattttctaaaaggaataatagaattaattaaaatgcgaaaagaaattggcaaacactaaaatacgtacaagaaaaattcaaatgtggtccggagaatttttgtcaaattctccttggtctaaatggagctctcaaattttacttgaattttcagagcaccgaaaataattattaagccacaaaaacaattatcaaagtttattaaaaagaagacctaaaaataatcctcttcctcctttgggccaagcccagcccaaagtctccctctcctccctctctttctctccctcctcctccctctccctcccgggctgcctctccctcctctcctcctgggccggccgcccgggccaagccgcaccccccccctccaggccgagccgcgcctcccgcccgtgctgcgcacgtgcgcgcgctgacgacgcgcgcctgaccgcgtggggcccacgcgtcaggccgccgtcgccttcttcctccagccgccgcccggcttctctctcacccgtgaaccctactccttccctccctcaaatccgtgtgattcgctcatgggattccaaaattaaataggggaaattaatccccattgaatcctcttcaattccctccaatttcccccttgattcgtgccttcaatcgccgggaacgcccgcgtcttcctcggccgccttccattgccgccggccgtggttcccgccgccgttcccgctcctcccgtggccggctctctcccccatcctataaaatgggatcctcatcccccgttctctcgttttagccccctcccgagcctccccgtggtccctatccacctccccgtcgccctcctctctctcccacgctgccggccgcctccagccgcccctaccgccttgcccgtgcgccggccggccgcgccgtcgcctcctccagcgtcgccgccacctcctccaccccggcctgccctccgtttcccgcggagacccccggagctgcctccccgccgtcgcccttctctttcctccttgccggccacctccagccgcacctcccgcctcgcccgtgcaccctccggctgcgccgccacctctcccggcgtcgcagctgcctcctctttcccggcttcgcctccgtttcgcggggaaatcaccggagacgcgtcctcgccggcatccagtggcgtcgccaccacttctccgtctccggccggctgctgttcgtcgccggtacgccgaccgacgtcgccgtctcctccgttgacgtcgcagcgtcgtcctccaccccggctgctcctcggtttcgccggaacgccgtcgccgcgccggcctctccatcctcttcgtcgccggcgtcctttcggtcgccccttcctcctccccggctcgtcggcttgctgcaccactaccacctccggcatcgcagcggcaaggtcgtcctcggcatcgtttcccctccatccaaacccctccgcggtccatcatcgtcgtctccgatcgttctcgtcgtcgacgtcccgtcggtcgcccggctcgtcgtctcgcggcgccgcctccgtcatcgtcatcgctgcggcgtgttccacgccgtcctcgtctccgtgcagccgctgccggcagccctcgtcgcctcctcgccggctccggtcgtcgtcgtcgtcgtcctctcgtcgttcccggtttcgctcgttgtggcgttcgtccctccgtcaagccgttcttgtccgtcgtccgcgtccgtcaagtgtgtcgctgcagccccgtcctcgtcttcgtcctcggctccgcgtcgtcaagccccgtgccggccgcgtctcgccttcgtccaaggatcgccgccgaagccgtcccctcgccgttcgtctccgttgtgcccgtctgtctccgccgcgcccgttcgtcgttgtcgttcccgcgcctcgtcgcgtggtggtaaggatccctctccctcgctgccccgtcctcgtcctttcggtgtcgcccgtgctcgttgttcggtcgtcgaccccggtacccgtgtaccggtgtcggtagtcgttcacgtgtgcggatggtgaccgtgtagtgtccgtgttagtgtgcccgctcggtagccgcgtggtttccacgtgtgcaacccgtgtggtgtctagtggagtccgtttgtcggccactcgcctcggttgacacacgggatccgcttccgtcgacccgtggaccgactctgtgtactcggtctaccgcggtcctttaggttgacatgtggggtccgcatgtcaacggcgcagccttcctgtcttttccaggctagcgcttacacatgttttgtaattgcaatgcttaattataataatccgcaaatctccatataacagcattaaacctcggatgatcataccttggtcatacgaactctgaatcgacccgttcaagtctcctaatgtttgttataacctaaagaaccctgtgctttctttttatgtattgttattgcttctttataggcttgtagctttgcttgtgtgcttcgcgtagcttctgtcgttccggaggttcccgaagcgtggttcgtggtcgtcgccgaaggttcggaaggccgttctctctgagcaaggcaagtcacatcatccttgaacatattgaatcccagtttatcaaattattttgatttaaattattgcattattgctttatttaaattcccgcgttatcactgttttatttagccatgcctatttacctttgttatgaccttattattattgctattgttattattaccttgttcaccctaggataaacaaaaccccaactagtgggtactctattcgtggttccactagtataaatttaggtagatgcttcgctgattaattaggcaacattaggtggttttataactttagactttgggaattctcatatcatttggacactatggaattgttggattatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtactaaccacatgtctaatgggtaaggcttaactcggtgctcaggctagtcctgaacaaaaggacacggatagagatggatgaagtcgttgcgacgatggatatctctgaggcaaatgaaggctacgcgagctgcggctcggtaatcgagatgtctaggcaaatgaagactacacgggtcggtgcccgttagtcgagatgccatggcactggactagtacgcgggtggtctcacccctatgtgtgtggcgcacccggtctagatcttgttgctaggggctcaaccctggcctgcctgtcccgggataccggccgtaggcagggttgggtcggtacttttgttcacggctaggatgggtgaagggttatgtcacatgtttacgacgggttccaaggccatggaatgcggagtaaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatgtggaatggttggcctgggttggcttgggacgagctgggacccaggtcgggttgccagttcggtctgaatcatcgtaggccttgggttaaggcaggttcgtgtgggtccacggccttgattaataatattgtgtagctctaggatcgtctttataaaatagctttgggcaactaagtgacttttaaatgctgtttactgcaaaacctaacccctattattatccccttgtacccccttgcattaatcatgcatctgccggtgtggcttgctgagtactgtggttgtactcattcttgctctatctttctccccccttcagtaagagaagctttggagaagatgtcttaggtggagtcctggcttataccccagttgagcgcctgtgaagatggagccgtaggcccgctagtccgctgctgtttatttttgtatgtcaggcctgaagtgtctttgtaataatgtaaatattatcgatataataaagatgtgtcttttatatcatgtttgtgtggtgtaccccggcttttcctgggacggggattaatacactagcgttcgggaaaaggcaattttcccggtcgcgacagactccccagcgacccccgtggacttctcgccacttctcagtcgggcgcactataatgaatcacgctatacaaaagataaagccgttgcccacgctggcttgtggttggcacgataaatgtttcacaacagtagctcgcgaaccggtccttaattgtcatgagcataaccatcaaaaccatatgctcacaacccaccttatccaggttttaattatcaattaattatcatcacacgatttaccatcgtgagctaccattgaatataaccctaattaacaattacataatatagtttataattaaaccctttaattagctatgtttctaggcatggataagcaaacttacataaggcatttagctgaaccaatccaatatataaggttcatgctaatcaaattataacccataggaaaataaagtcatctccggccattaattaactgggaaaggttcaccacccgatgacattcgaaaataatgcatagttgaaataataatagctttaaatgggttcaacatgctcaaagggttgtttgggatctgtgtgacttgccttgggcttccgcaaacgcttcggaaccttcctcaacggaaacgctctcctccggaacgtcggaaactaagcaaataaacaaaatcaacaaaacagtacaaaaacaagcataaacagtacatgtggatatttttaacatgtagatcttgattttagaagaatttagcaacttgaaccacctaaaacggatctacggttatttagttatgattttccgaagttttaatctattagaaaatcggaaaaaagaaaaagaaaagaagacgatgacgtcatgctgacgtcatgctgacgtcggcaagggccggccggctagggtttgcgagctcgccggagctaggatggtcggccgcggatttggagaccatctacgcatagaggacatcgagacgaacccgatggtactcaccacgacgacaaacgatgcacgacggcggccggcgacgagagggcaacggcggcggctcgggttagcggcgtcggaggggctccggtggtcggcggcgacgaaggggatgcggccgagcttcctcacctccgtgcgcacctaacggcgacgacggcaagcggcggagacggcggacgcggcggcgcgacacggccgaaagatggccggcggcggcggcggctaaatgcacgtggcggcggcgctacggtgcacgagaaagctcgggagagagggcaaacgaaagaggacgacgaggggaagctttataaagcattggattgaagagatcgaactccaaacgagaggaatcgattcgggaaagaaacaaactcggttttagggataaaatcaaaacgaactcgattcggatcaaatcctcaacgatcctctttgattcttgggggaaaagaaagaggagaacgagaggaacaaaacccctcaaaaacccggaggaatcggagtcggattgaggcggatttgagaggagaaaggcggcggctcgggctcggttggcggcggcggccggaggtaggggacgaccctgacatgtgggccccacatgtcagcggctggagaggggaggggcgggcggcgtcggctgggccggctgggccggttcgcccgcgcgggagagagagagaagttgggccgaaatcggcccaacggcctaggaggggtttctttgaactttttaaataaaaacaatttgtgaaatgatgtttcaattattaaaaatacttcccttgctcaaataattcccagaaaattctagaaaatagaggagcaagcatagtatttaataaaattttatctagttcatttttatgttgaaaattttcctagaaaattaaggtttagcttgtaggcttttaaaacaatttctaaaaatgatttaaaatatgcatttttaatttagtcgatttttagggcgtgacaaacctaccccccttaaacagaatctcgtcctcgagattcagaagaactggcgaacagatgaggatgagctgacttcaattcatcttctctttcccaagtagcttcttcttctgaatgattgctccactgaaccttgcagaaccgtataacgcgattcctggtattcctctcgcttacttccaagattctgaccggcttctcaatataagttaaatcttcttgaagctctatacgatcaggatctgcttcttccgtaggtactcgtaaacatttcttcaactgagacacatgaaacacatcatgtattcccgccattgacggaggcaactctaactgataagctacttcacctcttcgactcacgatcttaaaaggtcccacaaaccgcggtgccaatttccctttggtctggaaacgatgaactcctcgtaacggcgtaacccgaaggtatacataatctccttcttcgaaagccaaatctctgcgacgattgtcggcataactcttctgacgcgactgagcaacgcgcaacctttcttggataatcttcactttttcttctgcctctcgcaatatgtctgtcccaaaaacttgacgttcaccggtttgatcccaaaggagcggcgtacggcactttcgaccatataatgcttcattcggagacatttgcaaactagcttgataactattgttatatgagaattccgcgtacggcaaattcttatcccaacttccaccaaaatctagaactcaagctctcaacatatcttctaaaatttggtttactctttccgtctgaccatctgtttgagggtgataagcggtactgaaattcaaacgggtatccaattctgattgtaatttctgccaaaacttcgaagtaaactggctacctctatctgacactatcttcttaggaacaccatgcaaacataccactctggccatatataactctgcaagcttattccccgtataggttgttttgaccggtatgaagtgagcgacttttgtcaacctatcaaccactacccaaatagaatcatgtcctgccgacgttctgggtagaccggttataaaatccattcctatttcttcccacttccactctggaatcttcaacggttgtaatagaccggctggcttctgatgttctgccttgacccgctgacatacatcacatagagccacatattctgctatctcacgtcgcatactggcccaccagaattgttgctttaggtcttggtacatcttagtgcttccagggtgaatggaatacaaagtttcatgagcttctttcatgatagtatccttcaactccttattttctgggacgcaaattctttctcctaaccacacagtaccttgctcatcttctacaaaaccgatggctttacctcttctcatgttcttctttatttcttggatatcaggatcattcacttgagcttctctaacttgatcaaacagagtaggtttagcttctaaaacagccacaaaacctttgctgactattcccaagttcaacctttcaaattcttggcataactcccaaggtaaacgtcgaccttctgacatattacagtagcttttcctgctaagggcatcggctacaacatttgcttttcccgggtgatagtggatctccatatcataatctttaatcaactctaaccatcttcgctgacgcatgttcaaatcaggttgagtgaagatgtacttcaaacttttatgatccgtatatatctctgtacgattaccaaaaagataatgacgccaaatcttcaatgcatgcaccacagctgccaattctaggtcatgcgttgggtagttattctcatgaggacgtaattgcctagatgcataagcaaccacctttccttcttgcatcaacacacaacccaaaccgagtcgggatgcatcacaatacacttggaaacctttcctcgaatcaggcaaaattaataccggcgcagtcactagccttttcttcagttcttggaaactttgttcacaatcctctgtccacttgtacttcacttccttctgaagcagacgagtcattggtctggcgatctttgaaaagttctcaataaacctgcggtaataccctgcaagtccaaggaaactacgaatttctgaaaccgtcttgggttgcttccaacttaacactgactccacattgctcggatctactgccactcctccagacgagatgacctgaccaagaaacttcacttcggacaaccaaaattcacatttactgaacttggcataaagctgatgctcacgtagtttctctaaagctagacgaagatgctcttcatgttcttccttcgtcttggagtaaatgagaatgtcatcaataaacaccacgacaaacttatccaaatattccataaacaccttgttcatcagattcatgaaaaaggctagggcattagtgagtccaaatgacataacggtacattcgaacaaaccataccgagttgtgaaggcggtctttggtatatcttcctcacggattcgaagttgatgatatccagaacggagatctatctcggagaaaactgtagcaccttccagttgatcaaacaggtcatcaattctgggtagaggatacttattcttgatagtgacctcattcaacgctcgataatccacgcacattctctgagtatgatctttcttctccacaaagatgactggtgctccccatggcgaagtactgggtctgatgtatcctttctgaagcaaatcatccacctgtttcttcacctcagctaactcattagctgccattctgtatgatctcttatggaaagggttggttccagggaccaagtctatccgaaactctatctctctcttaggtggcatacctggcaaatcctcgggaaacacgtctgggtagtcttgtactataggtatctcttgtagagcaacttggtttaagatcacaccatgatatttaggagaggacacaaagaaagaaacagtttccccattgctactggttaaagtcaccttacggttggcacaatctataactcctctgtgacgagataaccagtccatccctaagataacatctagatctttgcattctaataagataagcgaggatgggaaaggaacttcttctatttctatagtaacagaaggacaatactgtgtcgaaaatacttgattgcctggggtattaactagtaaaggtctcccaagactaacaacttccatcccatgattgcttgcaaaacttttagacaaaaaggaatgtgtagcaccggaatcaaaaagcacagttgcgggtatagagttaacaggaaacgtacccaaaaccacatctggtgcattctgagcttctgctgctgcaacatgattgacacgggccttcggtgctggaacattggagttgttcggggttggagcgttcttcacacgccgaggcttaggacacttatcagcataatgtcctggatcaccacagttgaagcacacccctggcttgcttccctgttccttcctgacaggctggttctgaactgaagttgctgcaggacgagcaaccatgttgcggttgtcattgccacgattaccagtattgttgttgtagaactggcgttggggacggacaactgatgaagatcctccttgagggtacgatggagcttgaggtccagtaacgagacgcggcctctggttactgccctgttgtgccttgaattgggcagccctgcgcttcttctgttccatacggttatacttgtcttcctgacgaatcgctttgtccaccaactgctggaaatcccggaaatccgtagacatcaaagcataagacaactcatcattcagtccctctaaaaacttctcctgacgttcctcatcggtgcggacatcttccggagcatagcgagctaaacggttgaaatcatggaggtactcagtgaccgaacgagatccctggttgagtgctctaaattctctcttctttagagctacaacacccgttggtatatgcgtcttcttgaaagcagctgtgaactcctgccaagtaataggttctcctcccgccctgccttggcgaaaatgatcccaccattcagcagcgggtccatgcaactgatgcgaagcaaatgaaactttctcctgctcagtacactggatcaaatccaacttcttctccaccgcatgcagccaatctcctgcttctactggattggttgtgcttgaaaaggtagggggtctcacacgtaagaaatctgccaacttgttttggggaggaggggtggattctgattctgattgtttgcctgctgattctgtgcctgctgcactaacagattgatcaattgtgtttgttgggccaaaatctgagctagcgttgggttctcttcattgttataggctccacttccacttccacttccagtgccggtgcgcgtgttcaccatctgacgataagcagagacaagaggaaaagacgacagaaagacacccttagaacggagttatttaatgaatttaaattctatattgctcttaactgtgtatgattacatttaagttgcattaacactatctcaccaactatcttacactctgacaagcaaaagaactagactcatgctgttacatcccacccatgatgtaagcaacaactaaaacccacacactcacaagcaaacttaaacaagcaatctaacacagcgaactacggcaacgtcttaactaagcgactaatcccgccttgcgtcggaacgaagcgatggatcttcttcctctggagtagctggctctctttcttcagggtcttcctcctcttcctcatcacttatgatgtcgatgacaggttcagcacgatcgggcacagcttcacccatcacacgaatcttcgaagctaactggagacgaggtggcggacaggttctctttcttgcgacgaggcgtagcttgggtgttggtggcggcgtttctcctttaagttcagacaattccttctgtagacggtacaccttgctctccaacttgcaaatcttgcctcgattccagttttccctgtcatgagctgctttgtctcgctccacacttactgcatccatagcactaagcatatgcaccacatgcataagagtggcactctcttcaccatcaggacaggtataggttccatagtcttgaccatgaggcttgtgaggatgatactggaaagctgatgaatccaactcttcttcaaagcgttgacgcaactctccaatggccaccaaagctacttcttgacaagcatggcagtacgatcttcctccagcttcaaacttaaaagacggaaggtcttcacgatcactagccaacatcacacgaacacgacatttctcctcgtcggggtcatgggaaatctggcgatactcaggagcaacttcatagcctacctcaaaagccatcaacctcagctccctgatgaatcctaacacctcgatcaaatttctcggtgaatggggaggcatctaaagaaacatagaagagaagaattaatgcatatttttctaagttagctgcaccaactagacttaactgatttttgaccaaaaaggaataaaagaaaagacacatacaaagctattttataaatattttgtaggatttaacctttttttttgacagggacaaatattttttttttgacaaataactaaaacaaaactaaaatacttaagatctattttaagcacggtacagtgtcaccattaaaagagatgagtagtactagtgccaacatgattttatcgataccataatagatgtacagtgccgactaatcaataagatttgataaagagaaaaagaaatattttgagaaggacaactttttgcttttaaaagaaaagaaattgaattaaataaattttgtgcataaccttgcatgtgctgcgaacttaattaatttataagagaatagagaagagcagttctatttttttcaaaatattttgaaggctacttaaggtttaccatttggcttatcctaaggtcaaggtggctctgataccaacttgtcacgcccggaatttctatccaaaattccaaacgcttacatgtgtgttaaccctcgtccaggaatcaaccgaggcacacaatgacaatttgataatagagtacaaataattaactatcaaatattcgcaaattaaaattattacagaggtagatagttcctctcaaaacaaataacattctacgcagcggaaaacaaaactaaaacaaactacggaacagctatggcgactccactccacaggcaacttaaccaagaacaagcctaatcctccagatcatcaccttcactgaagtactcctcttctgatgaatgaatattgcaagaatgagcatataacatactcaacaagccacacagcaaatatgcaagtgcacaggataacaaaggatggcataatacagttcatttgcagcaaacagcatttaataaatatttaagagaatagtaaaacagttgtataattaatcaatattaaataaacaccatacaacacacccgtgttgcataggcccaaccacatttgtacaaccaaccccagttgaataaattaaacctccaaaccaggaattatccattccaaaccaggaattaaattaattaccacattattagcattaaagagtagtgtgagactaatcacgaaaaacattgctcaactcacccataaccgcgggtacggctattcaaatagtttaaactctgatcagaggtgtaccaccgtacccacaagacacaaccccacatcatgtcaccatgtgcctcagtaccaccacgatacctcggaaaggagtcgtgacaatacccctcgcataacacaattcaccacagtgcaccgtacctggatcataatcacccccttataaacaaggcatggactccccagcgacccccatggacttctcgccacttctcagtctggcgcaccataatgaatcacgctatacaaaagataaagccgttgcccacgctggcttgtggttggcacgataaatgtttcacaacagtagctcgcgaaccggtccttaattgtcatgagcacaaccatcaaaaccatatgctcacaacccaccttaatcaggttttaattatcaattaattaacatcacacgatttaccatcgtgagctaccattgaacataaccctaattaataatgtagtataatttatatttaacccctttagttagctaatgtttctaagcatggctaagcaaacttacctatagaaccaatccaatatataaggttcatgctaatcaaattataacccataggaaaataaagtcatcttcggccattaattaactgggaaaggttcaccacccgatgacattcgaaaacaatgcatagttgaaataaaataatagctttaaacgggttcaacatgctcaaagggttgtttgggatctgtgtgacttgccttgggcttccgcaaacgcttcggaaccttcctcaacggaaacgctctcctccggaacgtcggaaactaaagcaattaaacaaaaatcaacaaaacagtaaaaaacaaacataaacagtacatgtggatatttttatcatgtagatcttgattttagaaaaatttagaaacttgaaccacctaaaacggatctacggttatttagttatgattttctgaagttttaatctattagaaaatcgggaaaaagaaaaagaaaaggagacgatgacgtcagccctaatgatgacgtcagccctggtgatgacgtcatgctgacgtcggcaatggcggccggctcgggttggagagctcgccggagctagggaggtcggccgcggaaacggagggcatctacgcgtagagggcatcgagacgaacccgatggtactcaccactacgacaaacgatgcacgacggcggccggcgacgagaaaaagcggcgcggcggctcgggtcgacggcggcgaaggggctccggtggtcggcggtgaaagaggaggggcggccgagcttcctctcaccacggcgcacctcttggcggcgacggcaagcggcggcaacggcggagacggcggcgcgacgtgaccgaagacggccgccggcgctacgaggcacgagagaggacgggagagggggcaaacggaagaggagaacaaggggaagctttatatggcattggatcgaagagatcgaactccaaacgagaggaatcgattcgggaagaaatcaaactcggttttagggataaaatcaaaacgaattcaattcggagagaatactcaacgattcgttttgattcttgggggaaaagaaagaggagaacgagaggaacaaaacccctaaatcaatcggactcgaggagaccggattggagcggatttggagggggaaaacggcggctcgggcggcttgcgcgacggcggccggaggttgaagacggccctgacatgtgggccccacatgtcagcggctggaggaggagggggcgggcggctcggcttgggccggcatgggccggttcggccgcgcggagagagagagagtattgggccgaattcggcccaatgaccaaagaaggggttttttgaacttttttaaataaaacaatttgtgaaatgttgtttcaattattaaaaatacttcccttgctcaaataattcccagaaaattctagaaaatagaggagcaagcatagtatttaataaaattttatctagctcatttttatgttgaaaattttcctagaaaattagggtttagcttgtaggcttttaaaatagtttctaaaaatgatttaaaatatgcatttttaatttagtcgatttttagggcgtgacacctgacaacaaagatttaaaggatgcaattctgaaagaagctcatgatactttatactccattcaccctggtagtaccaagatgtaccaggatctcaaggaaagattttggtgggcaagtatgaagcgtgaaatcgcagaatacgtagcagtatgtgatgtttgtcagcgagtcaaggcagaacatcagaaacccgccggtttgttgcagcctttgaagattcctgaatggaagtgggaagaaatcggtatggattttatcactggtctacccagaacgtcatcaggtcatgactctatttgggtgatagtcgacagacttaccaaagtggctcatttcatcccagtaaagacaacctattccggtagtcgcttagcggaattgtatatggcaaggattgtgtgtttgcatggcgtccctaagaagatagtgtctgatcgaggcagtcagtttacttcaaatttttggaagaaacttcaggaagagatgggttctaagctgaactttagtactgcttatcatccgcagacagacggacaaaccgaaagggtgaatcagattttggaagacatgttgagagcttgtgctttagatttcggtggaagttgggataagaatctaccttatgcagaattttcatacaacaacagttatcaagctagtctacagatggctccttacgaagcactgtatggtcggaagtgtcgcactccgcttctgtgggatcaaacgggagaacgtcaggttttcgggacggatatcctaagggaagcagaagaaaaggtaaagatcatccaagaaagattacgtgtggctcagtctcgacataagagttatgccgacaatcgccgtagagatttgagttttgaagaaggagattatgtgtatcttcgtgtcacgcctcttcgaggggttcatcgtttccacaccaaaggaaaattggcaccgcgttttgtgggaccttataagattgtcagtagaagaggagaggttgcttatcagttggagttacctcaatctttggcaggagtccataatgtgttccatgtgtcgcagttgaagaagtgtttaagggtacctaccgaagaagctaatcttgaacagatagaagtccaagaggatttgacctatgttgagaaaccaatccgtatcttggaaacaaatgagagaagaaccaggaatcgagttatccgtttttgcaaagttcaatggagtaatcactcggaagaagaatcaacttgggaacgagaagatgaattgaagtcagctcatccgcatctgttcgccagttcttccgaatctcgaggacgagattctgtttaagggggtaggtttgtcacaccctaaaaattcaaaatatataaattgttgtttaaatggaatttctagaatttattttaaaagccttgaagagaaaatctaattttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaaagtcctcttttggctttgggccgaaagtcggcccaaaacctctctctctctcctcggcccagtccggcccagtccgcagccgccgcgcgcgcgcgccctcgctgtcgctgacaggtaggtcccacctgtcaagcccgtcgtcttcctcgggccgaaaccctagtttcgcgccgccgccgccgctttccaatccggccgtccctttccttctccggccgaattgatagaggggaaatgatctccgggatctcctctaccttttctcctttggaatctttggctaaatcgttttggaaagcgtgtggattcgagtttgtctcggattcgttc

SEQ ID NO: 7554 - DNA, 11244 bp, Oryza sativa
ggttcggtttaagtacggatggataaatccattctgagagatgagcagcggccatagcacttggcccgttatgatgtgtatctacaacctcccccctggctatgcatgaagaggaagtacataatgatgccgattattattcaaggccccaagcaacctggtaacgacatcgacgtgtacctaagaccactggtcgaagatcttaaacaattgtggaagaaagaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacaatgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttataataaggggtatccttccagacaatgtccgggcaacaataacaaagctatgtgcattcatgaacgcaatttcgcagaaggtcatcgatccggatagattagaagcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcaagaggtacatgggcgttctgaagaagtatgttcgtaaccgtgctcgtccagaggcaagcatcgccaagggttatggaacagaggaggtcatcgaattttgtgtagaatttatcgaagaccttcgcccaatcggggtacttgaatcacgccatgaagggagactacggggaaagggaactctcggaaggaaagcaataatgacggtagacaacaatttattctgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtcgatcgcgacattccagggatatgacatcaatgggtacacattctacacgagagcccaagacatgaagagcacgaaccaaaacagctttgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggtaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgcatcatgcatgtggcatttacatatgttaattagagtttttagcatttaatttaatataattcctacgctaagtatatatgatgattacaatttttattaattttaaatcatgcagtatgtacatacatatcttaattagagtttttaccaatataataatatcattcatatatatgctaagtatatatatatattggaatttttattaattataagtcatatatttgcttattacgatttatccacttaatttattatagacaaaaataatttttcgaagtaattgtcattaatctttgtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttgttcacaacaaccgggagtaaagatccgggggtatatatattcccggtgcgccctcgtcttcttcaccaacacttagacgttttcggccgatcgatctctctcggcctctctccttcgccgccactgcctagggcaaatccccgcgccgacgccgccgtatctcgccgtcgtctcgagctcgtcgtcctcgccgccgcctccgcctcctccgctgccgccgcatctctggggtgagagccgccgtgtcacaccctaaaaattcaaaatatataaattgttgtttaaatggaatttctagaatttattttaaaagccttgaagagaaaatctaattttaattaataaattccaatataaaatggggccagataaaatttcattaaatactttgcttaattctataattcctagatttttctaggatttatttgagctaaggaagtatttttaataaatggaattgcatttaagaaataatttaaattgaaaaaggttttaaaaagtcctcttttggctttgggccgaaagtcggcccaaaacctctctctctctcctcggcccagtccggcccagtccgcagccgccgcgcgcgcgcgccctcgctgtcgctgacaggtgggtcccacctgtcaggcccgtcgtcttcctcgggccgaaaccctagttttgcgccgccgccgccgctttccaatccggccgtccctttccttctccggccgaattgatagaggggaaatgatctccgggatctcctctaccttttctcctttggaatctttggctaaatcgttttggaaagcgttggattcgagtttgtctcggattcgttcttcccgatctttccttcctcgccgccggccgccgtgggcctttgccgccgcctccgagcccctttaaaagcctccccggtgtctcctctacccgccgccacccttgccttcgcctctcgtcgtcggaatcattctagcgccgtgtgccctagctttgccgtcgccgccgccgctccagccgtgcgccgccgtcgtttcagccgtcgccgtcgctcgagaagaccaccgtcgtgctcgccaagtcgtcgccgtcctcgtccaccacttcgccgtcgccggagatcaccagagcagcatcgccgtcatcgacccgaaggtttccgccgcttcctcctcgtcgccgtcgccgcccgttggtcttccgccgccgttttggtcaccggtgagttcgccgcgttgtcctctccgtcttggtgccctccgtttgcgtcctagcgccgccgttcgccggcgagcgtgcgccgttcgagccgtctcctccgccgagccgccgccgctgtcggtgacgtcaccgctgacgtcatcggggtcgtccgccgtgagccgccgtggatccgatcgatctcggccgtccgttttggattggttcgatctcggccgtccgttcgtgtgaaccgccgcccgtgcgcccggtccaccgaaaccctagcctgctgacgcaataagccttcttttccttttcaaaaataattcattattgcgtcataattcaatttaaaccgatataagtgttttaatccgatttaatctttaaaaattcataactaattcatcttagctccgatttagttggttcaagtctctaaatttttctaaaattgagatctacacattaaaaatatccacatgtactgttcatgcttgtttatttgctgttttggtgattttgcttctttctgtttagattccgtcgtttccggagagtccgtttttgcagaagaagagtttgaagagttccaaggccagcaaggcaagtcacacagatcccaaacaaccctttgagcatgttgatcctatttaaagctattgtttctattcaactattgcatttattttcgaatgtcattgggtggaattaacctattctttgttatggcccttttgtacttgattacttcattccttgataccttgggctattacaatttgactagttgagctttatttatattggttcaactagatactagatataattgcttagtcctgcttagaaacattagctcactattgggataactatgactcactattatttaatgatggcttgatgatagttcacgatggtcaatcgtgattagttaattaattaatgtgccaactaaaacctggtaatggtgggttgtgagcacatggttttgatggtcgtgctcatgacaattaaggaccggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtccatgccttgtttaagggggtgattatgatccaggaaggtgcgctgcagtggattgtgttgtataaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtcgaacaatgtctttcgtgattagtttcacacctctcatcctgataacaaatgctataaatggtaacaatttgtttagctcctggtttggaatggtacattcctggtttggagatagaactgtgcagccgggatggttgttcagaatggttgggcctatacaacagggtatgttgtatagtgttggattaatattgtttaattactacttaactgttttattaaattctgaaatgtttgctaaatgctgcttttgcaaatggaaccctactatgccatcatttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgttcattttatttttccgctgcttagatctttattgattgagaggaactatctacctctgtaatgacattttatacgcttattaagtagagtaataattgtactctattatcaatttgttattgtgtgcctcggctgattcctggacgagggttcacacacatgtaagcgtttggaattttggatagaaattccgggcgtgacaagttggtatcagagcccccttgaccctaggttatgccaaatggttatccatagaagccctctaaaattattggaaaagtagaactgttctcctccctttctcttttaattaaaccaaactaatggcacaggcacttcatatttttttttaatggttctcattcaaaatttattccagtgttattagtaccgtacatctattactgtactaatggcttatttatcagcaaaagttttacaatattgttttatttaatcttgctgcaataaaataaagttagcatgttgattttataactttcttttatttcttttgaaacctgttattcaaaagtacaaaatttgtaaccttgtttccaactgttttaacttatcttgcaagtttggtttactttatttacttaccttttactttgaatttctaaactttgttcaaatcaatccaaaaacttgtgctattaattggataaatgtcttaactccctcctttcacttgtctttagatgccacgcttcaagcctgagtacctgtttggtgttgagggttttgtccaggagttgcgtacgatgtcctttgccattggatttgggactgcccctttttatgcccagattcttcatgatcgtcatgaagagaagtgccgagtcaaagtcaccttgaacagcaatagtgaagaggtcccctcagtaatgtttgaagctggaggaagaaactacatccatgcatgtcaggaggtggcaaggatcgccataggagagctccgcgatcgctacagtaatcagttggccgacactgagtatcgctaccatcctcgccaaccccagggaagtgaccgtggcagttaccttgagactgaaggaattgagaataacgctaccacaaggcatttggtcgagatgctgtgggctatggatgaaagtcgtgcggagactgtgttagcagctcaagatcgtgaagatcggaatcgtggtaagatttgcaagctagaagacaagatggatcgtttggagaaggaactagccgcattgaagggagaagcaccaccgcagaaggccaggattcgtctcaccgcaaggaagagagctctatttgtccctcgctaccaattggcgccaaaagttcgtgtggtggagaaagaagttgccccaaccttagcagatcctccggttatcatcataagtgatgatgaagaagaagaatccaagcgcaaccattccaagattgagtgggtagcaactcaagatgatgaagacgagccgaacgagccttcaatcgacctccgatgctcggaagaactagagtgatttgttaagtcgttgtcttagatcgttgtgataggttgtttgctttaagtttgcttgtgtgtgtctcgcgtgtgatttacatcagtggtgggatgtaagtgcatgcgtttgtttgcttttgagtgttaggaagttggtgagtttagtggtgtgagagtcttcagtttgtaataatgaaactcagttaagatcaataaaagttaaagtaattctctgtcctaagtagtttccctcggtttctcttcttatcctgtctatgccagatggtgaacactcgcagcaacgggaatggtcccaacaacctcaataacaacaatggagagaatcccactcttgctcaagttcttgctcaacagactcagcttatgaacatgatgatgcaacaacttcagaactagcagaaccagggaaataatcatgcacctccccagaataagttagcagaatttcttcgtgtgaggccgcctattttctctagcaccactaatcctgttgaagctggtgattggctgcatgccatagagaagaagttggatttgcttcagtgtactgatcaggagaaggtctcatttgcatcacaccagttgcatggccctgcctctgaatggtgggatcacttccgcctgaataggattactgctgaacctatcacttggcttgaattcaccgctgctttccgaaagacgcatataccatcaggagtagtgtctctcaagaagaaggagttcaggtcgcttacccagggatctcgctctgttacggagtatttgcacgagttcaatcgtctggctcgttatgctccagaagatgtgcgcaatgatgaagagcgccaagagaagttcttggaaggacttaatgatgagctttcttacccactcatgactggagattattctgatttccagaagttagtggataaggctattcgtcaggaggacaagtataatcgcatggagcagaagaaacgccggatggctcacttcaaggcacaacaggggagtaatcagaagccgcgtcttactttaggaccccagtctgtgccacaaggaggttcttcgtctgttgttcgtccgcagcgtcagttcttcaacaacaatgctggcaataacatccgtaatcaagtcccacgtcctgttgcagcctcgacacagcaacaacctgccaagagggagcaaggcagcaagcccgtggtgtgtttcaactgtggagacccaggacattatgctgacaagtgtccgaagccccgtcgcgtgaaggttgtccctgcccagagcaactctacagtacctgtgccaaaggcccgtgtcaatcatgttgctgctgcagaagctcaagatgctccagatgtgattttgggtacgttccttgttaactcagttcctgcaacagtgcttttcgattctggtgctacacattcattcttatctatgagttttgcgggaaatcatgggatggaagtagaagatcttagacgtcctttgatggttagtaccccaagtaatcaagcactctctttgcaacgtagcccctctgtcagaatagaaattaaaggagtaccatttctggccaatcttatcctgttagaatccaaagacctagatgtcatcctagggatggactggttagccagacataaaggtgtgatagactgtgctaacagaaaagtaactctcaccagcaatgatggtcgagttgtaactgttcatgcattgtcatctgagtctttaaggtcaagactgaaccagataactttggaagagattcctttagtccgggagtatcccgatgtgttcccagatgatttacctggtatgccgcctaaaagggatatagagttcagaatagatttggtacctggaacaactctgatccataagagaccttatagaatggcagccaatgagttggcagaagtcaagaggacagtggacgatttgcttctgaaaggatacatcagaccgagttcgtcaccatggggagctccggttatttttgtggaaaagaaagatcatacccagaggatgtgtgtggattatcgtgcactaaatgatgtgactatcaagaataagtatccactacccagaattgatgatttgtttgatcagcttaaaggtgccactgttttctccaagatagatcttcgatctgggtatcaccagttgagaatcaaagaggaagatatacctaagaccgcttttaccactaggtatggcatccacaacgtgttccacgtctctcagttgaagaaatgtttgagagttcctgaggaacaggcaagtccggatcacatcgaaattcaggaagatctgacgtatgtggagaagccgactcgtatcctcgaaaccagcgagagaaggaccagaaacaaagtaataagattctgcaaggttcagtggagccaccactcagaggaagaggccacttgggaaagagaagatgagttgaaggccacccacccgcacctcttcgccagctcttccgaatctcggggtcgagattccgtttaaggggggtaggtttgtcacgcccggaagtttccccttttgtttgctttaaaaattggctaaataaatcgtccgaagaaattatcttaattaacctagagctgaatccccagttaataaatgcaaataataatcggaatcggcatgtggaatttttcttggattctacatgtcaaaatatgttaacaggatttttagtggaattttcagagccttggaaataattttaaccaattaaaaatcaccaaagtgcaattttaatcccaggaaaaatcctttcttctttttctttttcctttttcctcctttttttcctcttcttgggccgtcggcccagtccatccctctcccgcggtccctcctccttgtgggccggcccaagccgcccctccctcctctctctcgggacgccgacaggtgggccccacctgtcggtcgtctcccacctccggccgctggagccgaagctccaaccgcccatgccgccgccgaatccgccgcgccgccgccttctccgctccacgtcgcgcctccactccgcgcccgcacctcgcgcccacgtcgccgccgattcccccgcatctcccggcccgcgcgcgcgctcgagagggcgggattcgatttcgaatccacctctctcactctctctcctccccacgtcgccggccaaatcggccacctccccggccacgtccgccccctcccgcacctataaatcgctccccgcgtcttcctctctcgtttttcgcactcgccgcgccttcccgtgcttcctatcgtcgccgcgccgctcgccccttgcgccgccgcctaccgccgtctccggccacgcgccgccgcctctatagccaccgccgtgccgcgcagtcgccgccgtcgcgctcaccgagcccgcccgcacctcggccaccattcggttgccgccaatcgtcgccgaagcgccgtttccctcgcacgccggtgagctctccatttccacccaactccggccggctgctctagccgccgtggtcgctctccctacccctaacccctctttgttttctcctagcgtgccgccgccgcccatccgcacctcggcatcgccggtcgtcgccgccgctttcttccttcgcgccggccgtcgtgctcatcggtgaggaatcccctctcccccttcctttttccccctctcccgtgtgcgccgccggccttcgcgcgtgtgccgtcgccttcagccgctgccgccgcctttcgacagtagccgccgcttcccgcaccgccggtcaccgccgtcggtggccgtgcctcgccgccgcctcgccttg

SEQ ID NO: 7555 - DNA, 1747 bp, Oryza sativa
gcgagaacgagaacgatcgaacgaagacaagcgagaacgagggaacgaacatgaatgagaacaagcgaacgaacgtgaatgagaacgagcgaacgaacgaggacgaacgttaacgtgaaatgcaatatatatatatatatatatatatatatatgttacttcgcatttattctaatacatctttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacatatattattgactacggaattggtgtgactcctagcaattgactattgtagtcttaattagacttagcatatacgcacgaaacacttagcatatacatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttagcatatacatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattaaacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtaacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagt

SEQ ID NO: 7556 - DNA, 11955 bp, Oryza sativa
caagggcaagctatgatggaaagaaacaaagaaaatgccggcaagaagaagtcccatcaccacttggggtcaggaggctatagtgtcgcgatgccgaagagggagcagatggaggctagcttgattgagaggggtatcgaaccggcaacagccaaatggccggaacgatcaaagttctggtactatgctcacggtggaacgctcaacccagctgatggctcactggtcttcggcgatcagatacgagaggctgcgcgacgactaacagatgcagtggaagcctcctctcagggcacgttccgaccagacagagatagggacgagctgacactcgccctgcagactccagagcatccaggacgaacacgagggaaaggggtgattccttggaagattggtttcaaggaggacatccacacgtacaggagtcggatgaggagcaagagagataccgaggcgaagattgcagacctagagttccgggtatcgagttacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttcaagaacttatcaataaaggtaagatttagccatttcgctagttgctgcttatatatgttgattactaataaataatctctcacaacatgaaggtggcgtcgggcatggccatcccaacggacccttcaggtacttaccactgcaggccgattccagcaggatactcgaaggtcgaagttgagttggtcgaaggcgcgtacgaggacctcgagctggattaccctggaggagacggtgagacgcatctacgagacacatgccatgccattattttatggcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaagggcccccccaactccaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtatgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagactatagaaaataatatactcccttttatcgttgtagaatggagattcaaagggcccgacggcagagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtatgaacttgctaagtgtttcatatgtaatgcatcccacgcacattgcagattccactgggtgcttttactcttcgacctggatgcctgcaccgtcaacgtatatgactcaatggataaaaaagagtctacgtttgacaaggttttcgaacttatagacaggtaccgtcataagttcctttgttaattaagaaaatcttgttatgttaattgctactacaaatcatagctttaaactccatgtagggcttggtatcggttccgtcatttggtccgcggcaaatggagagaaagacttaggcggaagttcaaatttcctgtgagtacacatgctctgcatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcaaaccaaatcatcaccacaagagagctcgaagtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgttgctagctaggacatataatggattgtaattaatacatgactacatatgtttctatatacatgtgtacacattttctataatgtaaatatattttggtcatatatatatctatatacatatgcatttgcataacatatatatgtataaatacatatatattatgcatgtatatacatataatataatataatatatatatatatatatatatatatatatatatatatatatatatatatatatatatatatatatatatatatatatatatatatatatatatatatatatataaaccatgcagcaacaaggccatgcaaaaaaaaaaggtcagctcgatctttagtcccggttgataacaccaaccgggactaaagatcgatctttactcccggttatttcacccgggactaaagataacgatctttagtcccggattggtactcccggtttggaaaccgagactaaagggaggttacgaaccgagactacagagggtttctccaccagtggatgacgcggcctcgaggcggagcgatggcatggctcgacctcgacacggagcgatggcggtgcggccctcgaggtgaagttacaattcgaatctcccacctgtgcctatcgctggcacacaaatgcctccaatgagatcgctcatatgcctagtgcgcttctactactcctcgtgtgagacggatttcatccgaatataatttaacacagtataaaagaatgtgtgcgtgctacggtgtaactggcaaggggtttgcatgtattgtcggagaatgtgtgcatggtatcttgattaatgtgatttaaattgttcttttagtgtataaacttataaactccctccttccctaaatgtttgacaccgttgacttttttaaatatgtttgaccgttcgtcttattcaaaaaaaatttgtgaaatgtgtaaaactatatgtatatataaaagtatatttaatgattatcaaatgatagaaaaagaattaataattacttaaattttttgaataagatgaacggtcaaacatgttttaaaaagtcaacggcgttaaatattttgagatggagggagtatttggaaaggagggagtactatttaaggagtcaaagttgaatttttttctttttttcttttctttttctacttcggcggaggcacagagacgccaaggttgaggtattgggggctgaggctttgggctcgttctttttccccacgacgaacgggctccagccagcaggtctccaggtcccaggatgtgggcgacacgcagtgtatctgatggctaccaatcgccgtcaacgtggcctagcgagagggcaaagaatgaacagtcagcaccgggaaaacaatagtacggagtaggagtatatgatatgatgggagaatttaccaaattacaatgcatgtacatatagagtaccttttaccttgtaacctatactatgattttcttttattttcagttttgttcaatattagttaatcaagttacttaattagtttgctaattttgcttgcgtatatacacgaaagttaataaattacagtgcctgtgtgaacttttcacagtgtactccctccgtcaaaaaaaaaaaaaggcaaaccgcgggtttgcgtgccaacgtttgactgttcgtcttatatgaaatttttttataattagtattttcattgttgttagatgataaaacatgatgaatactttatgcgtgacttatctttttaattttttttcataattttttcaaataagacggacggtttggacacggaaaccagggtttgtctttttttgggacggggggagtatcctataacgtaaattttgcaatatatgacagtaattatttaaaattattttttctctcaattaaattcaaattcacactatatatttttaatatatgattatttgtaccctcaaaagaatatatgattatttgttattagtcatctgtgctttggaaatttgatcgcgttttaaccaaaaatatggcacatgatgaaatactgttagttccctttatcttgtgcgttggttttctcatccgagggcaaaaataattcgagcgatctaggttgaaaaaatgggccggctcccacccctgaatgcttcttggattttttttttcttttttgaactctctacgcgtcattttttcgatccgtcgaacagtgaattgcactctgatctatcttttatcatcaaagtttttctttgaatcatcttttaacatatcattttcactataagctaaataagattatatttgttatacattttagaccaccctaattttcttttctagttgtatctatcttctcatctagcaaaggacgattcaagtgtaagtcgaaaaaatcgccggtgtgcaagatgtgatgtgcttaaggtattaatgtgttcgagaaaatattttggataatttaaagtgtaacaaaggcgaaacaatctagaataaattgaaaagtttggttcaaattaaaattttagtaacaaaatgttatgtaaaatgcaattcactctgaaaacaatgcggttagcattaacaaccgttcagctcttaaaaaaacaagaaaacagaatccaagaagcgttcagtggtgggagccggcagctgtttctgcgatccgcctgtttaggtcctcgctgtccaccaaaaccggcgtgtcgtcgactcatggcttttgactgattttggcagcttgcaaagcccaaacagaacttgtactcttctagctgctctatctgaacttctcatcaaacacactgcaaacattacggtatctcttgcgttgatgtcttggtgatcgacaggatgcaaggtttggttcttggtcgaatcatttcagaatttaaattcggattttgattcttgttttgatgtttgcaattggacggtgaaccagtcgttttgatggtttctttctgctttcaggggaacaccatgaccatgtccctgtctacgagtcaggcaccgaggtgagaatctgaacaccaactcagattcgtctaaattttttttaatctttttccagtaagaaaagtaatgttcttgtagagataattagagcagagcacatcaacctcatgctgtgatgattctatgagtcctgaatattttctttcaggtgttccaaaagcttcaggagaaatggaattccaccaagcacaagcgataccgcgcgatgtactccagcgtcgtcggcggaatcatcctcgatccatcgatgatggtcatccccatcgacgatcacatggtccacagaggccatggcgtcttcgacaccgccatgctttccgacgggttaagcttcgtcctctgaacttttatctgaacatttgcttctgatgatgatttgaactttcataatacacgagctggttcttgatttgatcatcagacacatgcaaattcgctcatttggtactgaattttcagtggttcttgatttgatcaggtacctgtatgagctggattcgcacttggatcggctgctgctatctgcatccaaagcaaagatcagctccccattctcccgcgaaacacttcgcgccattttggtgcagatgacggctgcgtccaagtgcaggaatggctcgatcaagtactggctcagcgccggccccggcgacttcctcctctcgccaaagggctgcactgcgccggcgttctacgccgtcgtcatcgcgtccgccgccgccgccgccgccggcgggcacccgcggctcagggagggcgtgagggcgatcacgtcgacggtgccgatgaaggacccgttcttcgcggcgatgaagagcgtcaactacctggcgaacgcgctggccatggcggaggcagaggagcgcggcgcgtacgcgtcggtgtgggtggacggcgacgggggcgtggcggagggcccgatgatgaacgtggcgttcgtcacgggcggcggcgacctggtggtgccggcgttcgacagggtcctcagcgggtgcacggcgaggcggctgctcgcgctggcgcccaggctggtggacgccggcgtgctcaggagcgtcggcgcggcgaggatctccgccgccgacgcgaggaggtgcgccgagatgatgttcgtcggcagcggcctcccgttgctgcccatcgtcgaatgggacggccagccggttggcgatggtaagtgatattcttcagaatcaaaatttagtataatttcgcttgaaaaattcatcaagcagattgaagcatctgaatatatgcaaattattctaattttacaacttgcaaggatgcagtactgactactttgatcatttgttttgctactatttcatagttttttagataatcagtgggaaataggagtacttgatagactaatctctgaattttttttgtttgttgaattgcaatcgaaagaattcaggatatcgagcctctggtggtgttaccctatatatctgcagctcatattcacagcatgttctataagctagcaattcatatttctcaaacaggctaacaattccaaattataaaggacaaaattcaataatctgttcaattttcattatgcaggtcaagtggggaaaattgcccttgccctatctgacatgctttgcgaagacatcaaggccggtctcgacagagtacttgttccttatgatcaagcgagctagacgacgactcatagagctttggaagatcaactttgtataataataataataatgtaatacttccatttatgtgaacgaaatttttccgtattatgagtggaggatccgtcacattgacagaattgaatatagacttattttataaaatcaagttctacgcttcattccaaaagctaaaattttcaccattaattcctaccaaactgggagaaaattatagaacggtcacccgattcaaagaaaagaaaaaagaaaaaatcggatgataaaatgtcgcaattgactaacaagtgaaacattgacttatatatggtgaaaaagaatcaacaactgcaacatttacaaaattaaagcatttaaaattttgtaaaacattgtgaaaacacaccttaaaaagggtcactatcatatatgaaacaatgagttttaacaatttgaacatatttttttattaaaatataaaggataatttcgttgttgcccatactttaatgtacaatattaattttgcccctattttttattttcgtttttacccctactgttttaaatgaatcaaccataaaacaaatcaaccatttacccatgttccgttaattcttgctaatagtgttaaatgtgggggtaaaaagacaagtatagtcttagatattttcctttacttttgacataatcaaaatacaaatctattgatgccatactatagcaatgatttaatttatcaaaaatttgtgaaagtttgccaaaatttgggttaaaattgaaagtggtgtacaaaagtaccaagaaaatatctaaggtatacttgtcatttttaccctacatttaacaccgttagcaataattaacagaataggggcaaacggctgtttcgttttaaaaaagtaggggcaaaaacgaaaacttaaaaacaggggcaaaaacaatattggacatcaaagtagggggcaagaacaaaattgcccaaaaatataatcatgtgatatttttgttgtaaagatttagttgcaaagaatataatggtgtgattgaatcatagatcggatatgtagtttagaagaaaaaaaatattttgaagatcactacacgtatgcatgcatgaatggaatggaggaaaaggaaaagggaaaatttggaaaaatatgacgtagtatggtaggagagagagtaagaacatgtagttgtgtaagttttgtaaaacacaataaaaacatacactgaaatatatcaccatagcatatgaaaactaagttttaactgtttaaaacatatatttttctttcactaaaatataatcatgcgatggtgtaatcgaatcgtagattggattattagtgtaggagaaaaacattttaaagattgatatttgtatatattgttggagcaaaggagtagtagtacagtagtacatgttttatttttattggagatgagctctcgaaaaagtttcttaggatcggtagaccgattagcattattgtgaacagtatgagtgaaaattctgcaaaattatgtgaaattcatgtattctggcggcttgtttggcaacttaagtgaaaatgattgtgagtttagatgagagaattgatggtgagattaatatgagaatttgatatttagtctcaatatcttgtttgatagatttggtgagaattgacatggagtttagttggaaactagatcttaaatgaaaacagatcgcgaatgcttgtaatcgcccgtctgaccaagatggaaaaatcggacaccacaccgatgcctcccacactatacttgctcagtctagaaaactttcgaatcagtccaccgatatgataaatttatcgggtgcttctacctgcaatcaactactctctcattccaaaagtctaagtcctatttctttttcatcaagaccaagaagcaattaattcattcactatgtgataaaaccaatgaacatacaaccaataagcattaaaatggcttattgggttcctatcaagaatttaatttagcacatgaagactacaaatatgacttagatttttggaaaaactaaaaaataaaataggtcttagacttttggaagaagagagtaactgctaactcaattgtattaactattcatttcgaccatacatatgcatgtgtcaatcttcataatattttttctcctaaactacttatccgatctaaaattcgattacaccgttgtatttattgaattaaatctttataacaagatatcacatgattatattccgattaaaaccattagtacttcgtctttcatacgttatagcgacatgtttcagcgtctgtttttattgtgtttcacaaaattcacggaaatacttgccactgccctcccatctctctccacacatcaatgattgcatgcatgcattttagcgatttttaaaatgatttttcttctaaactacttatccaatctatgattcgattacaccgttatattcgttgtaattaaatctttacaagatgatatcgcacaattatattttgatgaaagaaaaatatatgtttcaatccgtaaaatctcattgtttcataagtgatagcgatatgtttcaacgtgtatcttcaccgtgttaaatctcattgtttcataagtgttagcgatatgtttcaacgtgtatctttaccgtgtttcataaaagttttaaatgtttcagctgctgtttttttaccgtaaataagttaatgtttcactcgttggtcaacttcaacatttgtttcactcgttggtcaactacaacatttgaccgtccgattttttttttttagagatcaggcgtttgatgggtagttttctccgaaaacagatgactgagatttgtttaggtaggataaaggtgaaattccctttcaattaccagcacattgaaaaaccaaatagaatcctatatccctctaacctttcaatcccttaaaaaagactcctatcaaccaaacacacccgggagagttgaaggcagcagaagtttttagcgggctaatcggcctgatttatgggcccaaatgaagcccactacgaccagccacacctcctcttcttctccgaactctcaagtctcaactcgtcccccggcaaaatcccccgtgctagggtttccgcaaccgcctccgctgctacccacccaacctgcattgcgacagcgacgcggcgcggccatggcgacggcggcgaagggcggagagaagccggcgctgaggaagccggtgttcgtcaaggtggaccagctcaagccgggcacctgcggccacaccctcaccgtcaaggtcgtcagcgctaaccccgttcctgcccgtggccgtgccggagggggcggcccggccgtcggatctcgccccgcgcgcatcgccgagtgcctcgtcggcgacgagaccggggtcatcgtcttcaccgcccgcaacgagcaaggtgatgttgcctttttgactttgcgtttctacgagtttatttgatttttgcaatgtttgttatttgttaaattttgcaatgtttgttattttgcggatctaacaagagccgtcaaatatgttttcagtttaataattagtgaattaccatcgctttttagagtcaactggataacatgttgactcatgactactacggagtacttgatatgaccaatcgcctgtagtcgaccaatccagactatgacattacgcaaattgacatttggaatatcacaagtattggtgagtcaccaaatattgatttgtagttgaccaaccttgcagcttcaggactcataggtggctgccattgcgcattttaagagaactctattcataccatagctagggttcgattcgagaaatgcaacaactcctcttcttttatctagtacggaacacgacaagagagagtgctctttccttcgaaaaataccaaactgttcagtcttttgaagaaatgagcaggtggagggtgggaaattttttgtatttcatggatttgggtcgaaaggtgttgtattgatggaaattttcttacgttttattcttaagagtcaacctggcagtaatcaatttagggaaacgggtgtatgaatagatgttagagaaaagtgagaagaaaatgggcatcacactacccttctgaccatgatagcgtaataaatcactcatgtggctatccttattgcagattgtcatttgctgcatcatcatacatgaaccttccgttagtggcataatttggctaatagtaaattcatgcgggcctaccaaa

SEQ ID NO: 7557 - DNA, 6554 bp, Oryza sativa
ttatattatgggacggagggagtactgttcagattgtaagtattggcaacttatattccctctcttgtctcaaacggagatggagggaggcactcatccttagcgtaaggacttccagtgtctggctcctttgggactgcctccacccaccagcagtgggaccctccttgccatgttcctactaacctttcctccagtgttttttctagatttgattttattttcttcaaaatcaaagccactagagagggagatgggcatgcacagtgagcaccagtacctagtactgttgtatagtgagcctgtccctcctctcatctccctcctgttcagctatgaacttttaaaggctgattatcagcttatcacctttctctgtcccagttacttgacttacttcatgtcttcaccagatgacggtggtggtagcaactgcttatttattgtctctttccccaactatttttttagatattatctcttattattgcctccctcatcgagggctttgatggatgcttgagcatactgtctaccaactggccatgttctggctagatatgagtgtcatccacaatgtcaactgatcaaactgaattcacgaagggaaaacactgccagggaaaatagccatgcaatgtcggctgctagagaaagcagtatagcacaaagaattagactgggaggaagagcattggaaagggaaaattgataaattctttcttcattgctctgcaatatcaactctatggcatgctttatagactagttgctagcactcagtaacaactcatatgaatagcaaagataattagccaactgacagataactgaactaactaacaactcaattatactcttctctataaccctaatctcccaattctgtggttgcatacatgggtcttggaggcattgatgttggtaatcgatcagatggttgggtatgccgaggtgttccatgccttggttagatgaatgctggagatttcaatcaaaacattcagcacaaaccagcaagcccagttgcttggtgttggtggtggtgattaccaaggactgacagcatgctttcaacgttggctcaagattcatcttttgtcttgtacttttagagactgctgtccctgttgtaatgtgctctctggtctgtgtgatgtgtgtacttgtgctgctattgttatcctagttccttttagggatctctctccccttgtttagttttaaaaacacttccattgtttctatggtctgattttgaggtttctctctaatttctacttggtcaagtatattgttgaacaacgtgtagtgggcctttggctgttaggcaaactagatctttttggcagtgtgggctgccgatttagtgttttcacattgcctattcctaggacacggtctaaattctctgtgtaggcctgtagggaaccttggtcatataattcttgtggctgcagtgcgcacagcctagattaatcataacttaatataactataaatggttagtatttactttggcagtatcgggtattaattgagtatttgagttagctacctaaaggataccttggctttatagctcattttaattaaaaggtggggatgaaaattcaagttgttctgaaattgatttatttgatataccatttggaactcgttccattcgtatggtgctcaacttttaatctctttcctttagtgttgggggtatgtataatgacctgaccctttcaggctgtatatttggacaaattccttttggcattccactcatgagaagttttccattcttattgttttctgaatttttagtgtctaatttgagacacatggttttttattcatttctcagcataccatagtaggcctttttaaccgttttaagggcaaatgaaaaaaaagttaacctctctttccaagaaagcctatcttttaaggcaaaatggaaaaaaaaagggtaccatctattttccaactccctctctacggtgtggtgtaagaacaaaaatagggttctgaaaaaaaagatattaaaagaaaaggttgactttcaaaatcaattttgtgtgtagcggaaaggagttgctgtttcttctttttcctatggaacatctactgataagaatatgaaattgttaatagcaagtaattattgccttgcatggtctaagtctatggatataccaaaaaaaacgcttatacaatttcatctacttggctgaaatgtggatcaaaattggtgtttttctcacttgcataagcacaagttaaaactaaatgctgaccttaacagatgctggacacttatcccttttttttccaaagtaattggatggcatgtattttggtgctacagaagtacttaaaagaacactaagatgaactacaattgcactgtataggggaagcagatttggagatttttcgtgcttttaaattttagtcactaatctctctttcgagatatgaagttttgaagtgcttgagctcatttttttgtgcttttggttctacttttgcagtggacatgctgatgccaggaaatacagcaatcttgcggaatgcgagaatcgatatgttcaagggctcaatgaggcttgctgtcgacaagtggggacgtgtggaggttacagagcctgccagtttcgccgtgaaagaagacaataacctatcgcttgttgagtatgaattggttaacgtgccagagtgattgttccatcaaagtttctactgctagcataaaaagggaatgccaaacttgtagtgatttttgtttaaaagatcgtaggaggggctatggcgttttgttaagagttctcaatcagtgaaattcatataaaatccttgtgtgtgcacccatcaagttgcttattctcgtgacctgataatcgtattgctgctagttgtgggtgtgattaccgaagctgcaggacaggcaagatgcaaatgcaaccgtctcagcaacaattttctccggcttttactctggtttatgaccaatactgtcgtgttacattacctaccgtctgcaagcaagcaggggtatgttactacagtagaatgacatgttagattgctactagtacttgctagtagttggctacagcatcttgctcatcctgcttagctgaaaggcagaagcaaccaagatcttaggccaaaaggcagtgaccagccagccggtagtgtacagcagctatgctcgtgaaacgcaattgtcacatccccttggcaaccaggcagaatagccaaagtttcttctcactcacggaagcatccatccaagtgcgcacgcgcacggtaaagaaggtacacgccatggacggaccatgtttccatgtaacattgtccgtgaagatgccattgccagccatcgtcttatactcttatgatgcgatcgatatatccgttgcaaatggagttatctgagggagcctttgtagcagagattggtaccacgatctactattttcatcctacggaggcggtaactagtcataccacaaattgtttggaagaaatttcaagcagaggtactccctccgtcgctaaatatttgacgccattgacttttttaaacatgtttgatcattcgtcttattcaaaaacttttgtgaaatatgtaaaattatatgtatacgtaaaaatatatttaacaatgaatcaaatgataggaaaataaataataattacttaattttttttaataagacaaacggtcaaaaatgtttaaaaaagttaacggcgtctaatatttagggacggagggagtaaaaattagaggagaaagccagccgaaaatatcatcaggatcagcttaattccatagcacgataacctgataagcatggatcgaagttggaatcggataaccccgatgaacagagcttagcttcgcccttgctaaaacaaccattttatggggaggttacttacactgatcatatcaattagctgaattctcctgaaatgtttacatacgcataaagttaaaatatatcgttgtagaatgtggttagcactgctattagagtttatgaattgagtacttctatgaacaaatgagatgtagtatgtttttttagataacgaaaaatattacatttccggtctctgcactattgcaaccggacataaatcacatcaataggactgtagggaagggacacatgtggcatgttcgtgatccactaaggtgaaggttcatagccccaaatccgcagccgctacagtctcatgatatcagattgacaaatatgtaagttcattgactagattgtgggtacttaccataccatgtccttatgacatatcactaaaacctgcaatttcacactaaattggaacttttctaatgagtaaagattactagggagactatgggtatcaggtgtgtatatgacccgtatatccgattactataggaggagaccataactatggtatttggaattgtatatgtcttagttgctagagttttcctatcggttatgccctgcccatgacggcgttggaagtggagcaggggatgagagagtagagaagatagatgggagtagatcggatcaattgcttgtgttattcataaatcagtagcccttaaataggcttacaatgaactgaattaccgctaatgaggaaacaactaattaacttaatcctatccatgcaagcgtgatcactgttccttgttcggcaattgcggagctaactcatgagccgtcgttctaagcgccgtcctctgccatcttcttgtgattattgcgttcgtagaccataccgaccataacaagtagaatattacttcttatcgagagagtttgaacctgtctaaacctttattcgtacaattcattcactttaagacctcatatgttacatcttttattattgtcgatatagaacatcgataattactctgctcggttcctaacttctttttttttacgatcgcttccatacgttaagttacacatagcttcgcccattgacgatgcacatccagaatggatgtagtggccggcttttaatcaattttatttttttaaagaaatacgtcttcttacgtcgagccaagattctactccatcctccaggaatgtcgctgatgacgataaacaaatcccttcatacactatggttgttagtggatcgaaatatattatgtgatccaaattccaagccgatacatcgtcggtttgtttgctgctcaccatctttatcttgcttgtggtttacgtggcgaccaggctacaacaaaaatggagatcgatcgagacccatgactcatcaatcaacttaacagtggatgcctgattttctcagtagttgatggaaaacccaaaacccagtcgccctctctgacaaggacaacctcccatgctggtcaccgacgcacttaagtgccctaatcattaggttcacactacgagaggaacccctttagcaatacatatatgtattgaaaaagtgaaaataaacattgctaggctctgtatcaacgcatttaatatgcgttgcctatgctactgttgctagcaccaataacaacacatacacaatcgttggtaacatgtaagcataaacgttgctagttagcaacaaagtaaatagttttcagccatacttgtatgcgttggcagtttcggtgatgaacaattctatataatccttgcaatggctataatcaagttgcaccaacactaataagtattgcaatataggcaactattcattccagcatgcctttgcacaattatcttgttgggttagaggcccgtaaactcaaatgatgtacacatgagaaaaaccaagtcattcataaaactaattgtaattaaagagaattttttgtattacatggaaaatcatcctcataagtcatgacattaaattttgttcagaacatcatgcacaaatgtaatctaaactatagaaaaaaaacatgcatatgaagttgccactatcattgccaccatcttccacattacagtcatcatcatattcacaagggatctttagatgacagttgtccaccttgcagtaaccatattgtcccagatcatgatccatttatcttgtcaacttgtaacagaaaaaaaaacaaccattgatacaacattggaagaaagaagaccacatctaaagaaattgagaaatagcaccgtacaaaaattgctggccacgcaatatcaagtcctacgacattgccaataattttgtagcctttgtatggcctgatcatctagctctgttccttatggatgattggatagaacacaaacaattgatatataaattaaatattgtgtattataaactaacaaaaaaagagttcagaaaaagttatctaaataatgctgatgtatattatttttagagaaattatggtaccgtagtacggataatccagactgaaaagaacacgctcttacacccatataagcaagcaagcaagcaagcagagagcaaaacagagcagagcaggttgtgagccagcactgcatcagcatgatgagcagtcgtcttttcaaacgcgcctgcctcctcct

SEQ ID NO: 7558 - DNA, 5010 bp, Oryza sativa
gccgccgccgccgctggctcgccggagtacggcgtgtgagtgacttttggtctcaccggagtaaaaaaatcacatcacatgcatgcgattgcacgagcagctgtggcggatcaacgagacgacgttcaactttcgggcgtcgagcggccggttcgtcggcgccgggagcgacggcggcgcggcggtggtggcggtggccgccgcgccggggccgtcggagacgttccaggtggtgcgcgacgacggcgacaagagccgggtgcggattagggcgccaaatgggcacttcttgcaggtaatttatttaattaattaattaatcagataagaaaccgtgcgcactgacattcataatggcacgcgtgtttatgtggaagaagcactgcctaagaggagctacaccattgtacttcttttttttcgcgattacacgaaagacacacataccagggttggaaatttcggaccgaaatttctcatttcagtcccctccaatacgatattacttcggctgaaattttttatttttttcataaattttggtaatatttattcaaattcaactaaattttgtttaaaatattagaaattttggaccgaaattttcgaaatttcggcatttcggcgaggcccgatcaaatcggcctaaccgataggattaaccctggcacatacacatatctggtatgaacgcatacgtaatttttaacatgctttagaaaaaggaatgtgccaaaccactgatctcactaaatatttatacaaacgcatttaggcgtgtagtgttgtggacatcaatgttcaaacttttacgtggaaaatcatatactcacgacttcatcatcacaccaattctacctttttttaatatgcttttttaaataatgcatatatcacggtgtgaagaggcagagagtttttttctattatctgaaatcttggtttcgtatattatctgaaatcttggcttcttacttaatagtggtcgtatttaaaaacttaacatccatgtactcaatttgattaacacactataaagttacatggtgaatactaggcatcaccctacttcatattaagtgaacatgtacaatgtggtgagtacatgctgttgtacaatgcccctcctattacaattacaattactccttgttaaacaacacgtgacatttcggttaatttggcagatagcattgggatctaactcagtgacagcagattactacggtgaaagcacaagttggggagacgatgacccatcagtatttgtagtaacaaaagttttggagctgcagggagagtaccagatttgcaatggctatggtacagccaaggctacaccaatactcagggtaagatatctcacaacccaagggccccacttgtcatgaaaataggcttatcttcttgttgatacatagctaatgaatcatgatatagcatatacttacttgtttccttaattatatgatttggaatggtccatacttcagggatatgtctgttttgttttttgttgtatctgatgtcaatgtctataggggagaggaaagaaacaagaaaacagtagtagcaagcaatcaatgcaaccgatatatagcccggtgtttactttgagtttggaagaaattgtacaaatcctgacatgcatgtgagagatcagtgatcacatatgagttgcaaattgcatctatgctatgattacctcttgtacaattccggtgggccaattacaggtggaatagtgtttatcttatctgaaaggacctgaaatttactaggcatgcaaacatgactccattctaaacttttttctttttgataatgaaatttaatccaatatccgtgtacatcatcataaactacagagaattgaagcactcctgtgcatcccaaatgtgtgaaggggtctgttcattactacttggcacttgcagaattcagagtaaaattttcacatacatatgctgagttcagcttgcttgaacgaaactatcttgtttttgtcttgcgttctgtcccgtcaaagattgccaatccaaacactatgatttggtcccaattttgttgtcataagtgaaagccgaggccttagcttgtgtgtctgaatgattgagggaaccaattcattaaatgattattggcactggtcctatatatgccaaacagtagcatgatttctttttctgaaatttagtaatagacccagcaaaatcaatgaaaatatgtttgcacgattatggttgctttgtactgatgaattgggatcattttcacttcagttttgtgaatcaattatatattattttctggcagaatcattggagcacatacatagtcgaagacgacttcaagttcatctcagcaagcgggttaacagcagtgcgaattccagttggatggtggattgcgagtgatcccaatcctccggctccatatgtcggaggatccctgcaaaccttggacaatgccttcaagtgggcagagtaagtcttcacaaaattaaatcacaattttgtagctttaaatcgactcaagtaaagtaaagatcaacaaatgttcagatcatgagctaatctgaacatttcagattgtgaattcgttgtaaggattgttatgaatattcagattgtgagctaatctcttgtatctgaatataggaagtacaagctgggcgttattattgatctccatgcggctcccgggtcgcagaacccatgggagcatagctcatccagagatggcacgcaggagtggggaacatctgatgctaacatcgcagagacagtgcaagtgatcgacttcctcgcatccaggtcagggttctcatctttcacaagggaaatttttctcaccagtgccaaaatcataatttaaattgttcaaacttttgtagtcactaaatatttatagatcatttctatgccagaagcaacacactttgagaattttcaaagcaaattggcagatttcattcagtaaaaagaaaaaaaaatccattctgaagtgatgagcatgttgatttacaatggacagaaatattcagagttctggaaatttcagatatttcagtccgaatcacaaaccttttcaaggtctgctactgaacagtgaacagtgaggcagatgttgtaagataatgaacagtaagccagatatcgctgccatgaatttccttagatatttcaggacagcagatctttcattagcatgtagtctagcagtgaatcaaaacatacagaactgcggaactttaagatgtttcagttcaattcgaatcacaattcgttgcatgatctgatactgaacagtaagccccattttgtcatgatgaatttcctcgtactgttttaattcaccttgacgtcaataggtacgcaaagagcccaagcctcctggcagtggagctgatgaatgaaccgtttgcaccccgtgccaccttggagagtctgatgaagtactaccatgatggatacaacgccgtcaggaaatactcatcgacggcttacgtcatcatgtcgaaccgtctgggaccgcatgatccaactgagtttcttcaatttgccaacggcttcccccgtgccgtcatcgatgtgcactactacacggtgttcaatgacctgttcaataacctgactgtgcagcagaacattgattttatcaaatcaaacttctcaagtgagctaaaaaatgtcacaacacaaaatggccctctcacctttgtgggtaagtaataattctttttgggtgaaaagagagctttattaattactcaagaaactggtataattattttgcattaggattcctaaaaatttctaaaataatggtagtaagcaatctaacataatatgagatatgttcttttcctgcaggagaatgggtggctgagtggagagtacccaatgcaacaaaggaagagtaccagagatatgcaaaggtgcagatggatgtttatgggcaggccacctttggatggtcctattggactctcaagaatgttaacaaccactggaatctagagtggatgatcaacaatggctacatctccttgaaaacctaacaactgacatgcctctagctgccattgttacgaggtactggctccgtcccaaaatataacaatctaatagacatagattagactttttctattaataaaaatctggatagaaagtatgcccagatttattataatataatatatctgggttgttatattctcgaatggagtagccaaattttttgagacgaataaattgggccacatagatcagtgagattttaccgtaatgggaagatgcaatgttttgttagaccacttgccacctcactttttagtatcagaatatactataactatttctgcttgacataagcgcataccatttgcacaagaagtttgataacacaactaagaattcatgggatgaaattatgaagaattcacaaggtatctactctagaaaaacggttcataaataacaaaactctgattaaagtacactgaggccatccaaatgtgaattatcataattacacatctgcatgtcttgtttccgggaacttaataaattaatctacggccgtagcttgaaatccatgctgaatatattcttggctttcttcaacttctcccaaggaaagccgtgaagaaaaaaaaagggtaaaaagaatgttttaacttcactctgtattatataattgatttattttggttaaattgctaatgcgcatcaatcagagactaccttatcttgacctgctgcaactttgttgcttttgctcgtaatgacttcataataccatctatcgctggtttcctggttgaacaggaaaattcagacaaattcattattccaattataaatccatatcatatccgtaactcaaataaattaacagaacttataaaaattgccccaaaaaaatgtctgatcaacatactctattttttggttcttcccttgtttttgctgatttgaggtgccacctaatgcttcctgtgtt

SEQ ID NO: 7559 - DNA, 29704 bp, Oryza sativa
atggtcgcctctcccttccttctcatgtcgcagagactgtatagcaaatttaatttgctcgatctcgagcttcagatcacgatattccttgtctagacgttcctcctgtatgatcgtaaagggtctttcctaccttaaaaggtagccaatgatgtgaggggcttctccactacgtatatgttaggtcccttgtttttctacaaccaatgtgagactattcaacacctccttatcacctaattaatcaaagaacacaacatagaagaaaaaaagaccgttaaataaatatcaagactaaaattatatacaataattacttatggtgggaaagcatctatcactgcaatgaatactcgatcatgcatatttgctaggagccaggaaacgtttagagcacagacaaatttaagtatgtgaccatatcgagtgtttgctattattgttctgttttcaatcaccataataacccagtactaaatatgtccactgaacttacagatatattcctgaaaccgtacttatgataaaatacctcaatgaaaccaatttattctagatgttcttgtcgtagtaatcatgatcaatgcaaattaagcataaaatgattaattatatatgcaaattaagtgtgcaaaggtaataatgcgtgccatatacatattggagaaactacttaagcgatgcgatgcgatgatactcacgtaagcgatgcgacgctacccaggtctaacacgctgaggacgagataatcactcaacgcagagaacggtttgctcatactgcttcaaatcatcctcttttaaaagtgaaaacaattaattaagtataacaagctttaaatcaccctctgttaaaagtgaaaacaaatattgagtataacaaatccaaataaatttagtacatgcaaaccattcatctcatcctcgatttaaataattcagaacaagtaattaagatctacaaatccaaaattagtctaaccaataagtcaataacataaacgttgcatggagaggctttattatgccggtggggacatggctactgaaactgctgaagagctgatactactccgtccatcataatatgatataattaaggcgtccacatattttaagatttcacctttaaaacattttgatattttacttgctataaattatattattggattgacatttgaatttactttcatatgattataattttgttattacaaaccttataatatatgaaaaattataagacaagaattagttttggagatcactgtatcaaggttgatcatgccttatattatgggatagagagagtataatccttctatacacaaatgattggcacatataagcaatttttatcacagctacttgccatggaaaaaaaaaatccagacatttttgtgagcttgtcataaagttagctgaataccgttgctgctttatatcctgttaactataaagaaccaagtattgtaagtattgatctgccagcagagtatctacttgtttcatcgaactattattctggcattcaaatatacttaactaatgtgtgattgtctattgtcgccccaattggacatttttgtgcataatttttgaagttgtcaatatgcctacgtcattgtcaattatctctgctgccttttgtttgatcggttaattattaacagtctcatccaatgcaggtaatctcgatgtctggaggatgttgcttatctctcttagattttacttctggttaaaaatgtcttgaaaggagccgtattcatgttgagttttcaagttgaactgctgcatggaagttctccgtagttttgatgtcgaatgtatgcaccacttatattaaattatgtcatatgaagtcagagttggaacttgtaagcttgatttgtcatgtttcacaacatctcgtatcatcgtatcaggtgaagtttcttctaagtggaaagctgtaacatcctgaaaattaactattttctaattatgcattatgccgattcttatgttttcaataaccttttgaacctaggaaaatataattagagagacctcctagaactaacttgcataaaatccctctccgatatttaacttctgttgtgtttttcatttaaaaatatatttggttaaattgaggtatttcttgatttggttttaaattaaaaccttctttcgatgcaattccttttattcaaatttagttcgaaaacccttttcatttgtatgaattatggtccaagaaaaccctccaaaccaactatgtgcaattctaactttaattggaattaattgtcgacccatcctttgattctcgatccaaatatccaaatcctttcttttaatctagccaccaatttaattcttgtggcttgattttcttctcggcacaataaatattattattgcaaatattatgaataattgctcttgtgttaagaaaatagattatatctttgtcatccaaatttcctattagcctcaaacaattttttgaaacccatgccatatattttgaggctaaaaccctacttatccttctccaattatcttcttcccaccttcctatttacacattcaattttattcatatatcccttaccctttcatttgagcgcatcaaataaattccattatatgctacctctaaaatattgcactcaaataattaggaaatctctctttggaaattatctccaaaataaattcatctcaaaggttagccacttaaatttcttccaaatattaatttggatttaaactccatccctcaattccctacacaaattagaaagccttcctattcatttgggccgaattttctctctcttccttcggcccagaccagcccaagtcggcccagcccctcccactcaagccgactccctgctcctcctcccgtgggcgcttccaggcgccgccaccgtgcgccattactgccgccgtgcacgactcagctaccgccgccgccatcttgccgtcgacgcgaaggaaccgccacccgacgtcagctacacttcattccgccgacgtcagcaactgggacgaaccgccatcgtcggccaataagaggacagagccggcgccgtcattcttttctccacgtcgctgcagccgtgtcctcatcgaccttcccctctaaaccgccatcagccaccgcctctcgccgcctataaatataaggcgagccctccccttttctccacacatcaacagagcctcgagctccctttctctctctccatccatggccgatcgtcgacgccgtcggtcgatctccccatccgtagctccacctctcctatcctcgcgccaccggcttcgcctccatccggcgagtccgtttttcccctttcccctcttcctccacctctaagtcaacccaccaccgccatcatccatgccggctcgaggtgagcccttgccgccgccgttccggctatatatctctccctctcggccagccaccgacctccccgggtgcgcgtcgctcgggaacacgcgtggccgctgccgtcgaggccgttcatccaccggagcatcgacgcccctcctctcccttctctctgtttgctcggctggaagagaaaaagaagcagaagaaggaaggaggaagaagaaagagaaaagaagaagagacaaataactgacaggtgggcccctgtacagtactatttcgtaatttccctatttaattcaaattctattctttagaagcccatatctcataaaccgtagatccgattccagtgaaacttagacctaaattcatctaaattcaaaatctacattttgatatcaaatttgctattttaagattttatttgaatttattcaaataccgtttgaatttatatttgacttttcaaatattttcttttatcccaattaccctttagcaactaaaaaactgccggttggaatttttacgccttccatggggacgatcgtggttttctatccccgatgtcgaaccgttggttgtaaagcccggcataaaccaaacccaaggtcgaagtgctgctcctagcaccccacgcttcgatgcgtatagcggtcggagcttcactattccatcgacccccacagcacgccgcacagttgttagctctcgggctctgtgtgatcctagctgctccgccgccacccacggttgttggagtaacacttccaccctattaaacctgcacccacctcctattccctcttgccgatatgctgtctgctgacaccggctagagaagacactaaatctagtcgttatgctgccaactctagcaacgactagcaaacaaccaaaccctagccgataccggattgctagtcaaatcccagttgtcatccaaattccatcccctctacaataccacctatccaccatactctcagccacctactttctgtctaccagaacctatacataaaatatatagcctggccgatatattgccctactccttagtcggcctaaatataaccaaaccctaggtataatcttacccaaacctaccatcagccaataccagtcacatatctactcaaccaattcaattatccactatactccctatccactaaccaatcaaagtctgcaaaatttgtgatatgctaccctgacccacatgtcattggctcatgtgggtcctacatgtcattgagatacgggtggcatatctcaaattttgcaaaattagggtggcatgattccaacaaaccctaaaatataggtgatcttagccacttaattccctctccaccccagctgccaactctttataactgtcacgcccagaaattcccgaatagaattccaagcagaatgtgcattaaaatccccgtccaggaccagccggggtacacaaacgacaatgttgacatacagatccacgtcttacaaacattgtaaaatcttacataaatgcagcggaaaacaaaagaaactggagctaagccttgactaaactgcagcgggaacaccactccacaggcatcctcgacggcacggacgaagcctactcctcggggaaaccttcatctgacacatacccgtcctctggggttgggaaaagtagagcaagactgagtactacccactgtactcagcaagtcataccggaataggggtatgatgcagggaattaacaaagaagagctaaagtggttcatttgcataaatactggcatttataaacaggaatttaatgcgaaaactgttgtaataattaagcagtattaaacatccgctgtccaacgctaacccacgttgcgacaggcccaaccatccacctaaactatccaagttcaacagattacactagggtgagactaatcacggggaatctggttgaccgcccataaccgcgggcacggctattcgaatagttttactctgatcagaggtgtacaactgtacccacaagacacagccccacgacacgtttccgtgcgccggcatgccaccacgacataccggaaagaggccgtgacaggacccttcgcataaccccctctagccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataagttcttccagggcatcccgcgaaccggtccttaactgccatgggtgcgaccagcaaaaccatgcacccacagcccaccatgtgattcattttaattaaccaacaccggagcggtggtattgatccaacattaccattagaaccaacagtctaatcattaatatgattttccccattgtgaactagttgaactaagcatggctaagcaattcctagtccaaactctaatcatgttataacccaagctaacaaaggagcatggtatcaaaatagcatggctgtaacaataggtaaccatcccatagtaatattgcaaaaccaatgcggtatttgaaagaaaacattaggacatttgcaatataggatcaatatgatcaagtgacaagcatgacttgccttgctctgctgctggaggaacctcggcgactatctcgaagtacaccggagcgtcggagggatcggaatctaacgacatacaaagcaaacattgcaaacaggctataagactactgaaacagggaacaaaaccatttttaatggattctacacatttttcttgatttactgagacttgaatgggattaaacggagctcggatgaattagttatgaattttagaagattcactttgtttattactataaccataatccttaaatactttattgcgcaataaattccagggctgacgtcagcacgggggagtgcggcgcctacatgcgggacccaccggtcagcgacccgggagagagaaaggggtggcggctcgcgggcccactggtcagtggcacggggaggagagagggcgccgacacgcgggacccacaggtcagtggcgcgggagagggaaaggaaggggcggcggcactcggcgcgacccggctcaagaccggccgaccggccgcggcgacggcgacggcgcgcgcgcgaacgggttgccggcgacggcacccggcggcggaggcgacgcaaaagcggcggcagcggacggtggcaacgacccaaagcgacggcgagcgcgggtggcggcgacgcacggggaaacggggaaggagaggagaggagatgcctcaccgagggtggccggcgcggaggaagacgatggcgaacggcgacggcaggccacgggaggcgacggcgacggcggacgagcttcggcgtgccctaaggaaggagaagagagggattagagagagggagatagatcccggcgatcggaaaccatggccgaaggcggcggtggagatggagctcacccgtgcgcgtggggatgagggctccggcgacgaacctcgacggaggaggggtggacgaggtggacctcggccgcgcgaagctaacggcgacgacggcgcaagacggcggcgagcctagcggcggctagcggcggccgaagtagcaaaaacggcggcggcggatggttgcacggcgcgggagcgatggggagctcgggagaggtcggcgaaatggggaaaaaacgagagggggtgccggcgatgcttaaataggggatgagggaaccggacgtggccggaagaggcgggattcgccggccgacgtgggggagtggggaggagagagaggcgggattcggttttcgaatcccggccatctcgggcgcgggcgcgagcgggagagagaggggaacgggcgcgggggatgcggcgcacgcgcgggcgtggtcgacgtggcccggggaaggcggagacgtgggcgcggcggcggttgcgggcgcggcggcggttgcgggcgcggcgggaggtgggagacgggcccgacaggtgggccccacctgtcggcgaccccgagagaggagggaggcgggcggcctgggctgggcctcggcctgcggccggcccagcaaggaggagggaaggaaaaagggaaatgggccgacggcccatttgacaaaaaggaggaaaaagaaaggaaaaaaaaagaaaaagaaaaggaaaaaggattttccctggaataaaaatattgcttgctcaattttaattggttaaaattatttctagagctctgaaaattccactaaaaatcctgttaatgaattttgacatgtagaactcaagaaaaattccacatgtccaatccgattattatttgcattactttattagggttttttttcctgatttcacctgcattttcttggggtcatttgtaaattcaatttttggcttgggaggaaaacttcggggtgtgacaataacccacacataaaatatcagcccagtaatccatataccctataaaagagataggctataccctaaatcctaaccgtcccaaccgtttatctctttctttctattttatggcttttattgaatttggttcttcctcttctgtagtagagtctattatattttggatgacaacctgtggtatttcaaggatcagataatcaggttgtctatctcggatttatttacgttggagcaaggcaagttattattcctcccctttgagcataattaattcctatattttatatctctattattccatgcattagacatacatgattttgaatgcataacctgaacatagtaaaccagatatatgctagctttgcttagccctgcctagttagattatgcataaaatttaatgaagttagattgggacagtacaatataaatggttgatttccgggtggctagtactgttccaaccgacataaaattgccaagtacatgtgaaaaacatacgagtacgaccacaattctcgtatgggtatagacctagctgattaagttatctagcaaaagtggtgcctttgtacagtggttctattttaagtcctcgcgcaggaggcaaatttatgtcgcgaagggcaattgcgatatttaccgaggcgcaggtaaatatatgagatttattgatgtcgacttgtttgtgaaccctgattgcgatgacatggtgtcatacaatcagttctctctaaagacctcgggaacgccagaactcctctcgctgctgataacgttacgttcagagcgtatggggactagagttcatggaacatgtaccactgatgttagtaaccaaaaagctttgccatgacaaggctaatgtgtttggcacgtcatggattgcgggtaaagcgtacatttactacagtaaagtataaatgaatctattcgaatagccgtgctcacggatttgagcattgggactcatatggtatttggttagaaacttaattccaaattttattaaatactgttgcatttaaaacattttaggctttcttcctctatattctttgctttctgcaagtaaacctagctttactcagatattaccatttcatgcattcattattgaatataatagattgccgagtacgttgtactcacccttgcttcaacccctttttcagtcattttggagtccttgctaaagttgggagttcaaacacataagttagtttcattctaacttaattcgcaaatatagattagatagatggtttaagtctatagtcaaacattagagttaagtcattctataggttttgctgtaatagttagccacagccttgtaaataccctattattttacataaagaaatctcctttgtagccttgcatgatcaaatgtatgcgatgaagatccagattgttgaacttgtatcaatctactgatccagggcttgatacagttttaatatgtcggttttcgaatcattagtttcgggacccgacaaaagctaaatcagatttgatgtaaactagcatggtcacgtatgttagaaaacgataggcacataaacgatgaagaacaatagatcaatcatagacgacacgagattttaatgtggaaaacactcctaaggcaggagaggaaaaacccacgggcgccagccagcaaatcttcactacatcggatgaggttacaaaaacgccgaacgacggcttacaagaagtatatataaggtgaaaccctaaagtatgacgatccataccgcttcgctccgtcccaagcctccggcaacggacctccacttcgctccgtctgaagtcgccttttatatgtgcaaatgaatttggatcacaactcaacaacgtactccctcaaaatatagcaatctttgcgattcaaatttgtcctaactagagctatctaggattgtaaaaggtgattattttggaacggaggaggtacgtctttggacattcagacgtgccacggaggcatggactgcgttcagacaagcagtgcaagtgcaactcttcccttcggccccagttatttttctgaacttctcgtttttagttaacactctttttaaattgttagatgatacgtttttggcaaaaagtttctttgtagacactgttaaaaaaataaatctattttttaattttataatagttaatacttaattaatcatatgctaatgagttttctcatttcgtgtgagctgaaaatatctctccaaaatcgagacaacaaatggggccaaattacaaagccctcaaatgggccttacacttgcgcagttgggtggtgaggctaatcgagtggcccagtccgatgaggtgggccgacaccatccattagtggcgcctccactgtgccatgcgaaacaagtggcccatcagcgattgcccttctccctgccgctcggaggcctggtgacagacggggaagatagggtagagaggaggaagaatgttgcctaccgcccttctagtttgtagtgaccgttgtccttctagttcgctgcactcactgcccctctctaagtaggcggccgtccctctcctttctattcgctgcccacccgttagccctccttgttggctacccctctccaagttagtatccacccttctccctgccgctcaaaggctagttgagaatatgagagatgctgaagagagggaaggagggagaaaaagagttggccgctgacatgtggggctcactcgttgcgtcagccaaaattgggtactatactatcttgaacctcacaccagttttgcatgttaaagaaatgtgttatatttggtattatggttcaaaaacataattcaaactcagcgtcaagatacgagagatgtaaaatgaacttattccatctacaaatggattatgttcttcaccacgcctgtcgacgggtgatacctgtagaccggatctatagggtattggggtacgtcggtactaggatctacacgatacgacatcaagcaaacaagaagacaaggattatactggttcaggcccctcgtaaggtaatagccctaatccaatttatatgggattaatatggaaaaccacatattacaataaagaacaactgatcccaagattactggcgagatccttgtcgagatggattcgacgagatctctcggcgagtaggcttcacgtcctctggcttgtaggttatggtggtgatttggcacaaagattcgatgatccacacccctcagagggtgtggcttttataccgtgaatcaccttagtctcctagtagaactcggagaccacggaccctgcacgatatagtacaaaccaaatccttttcgagtaggactctattatcaccttgcctgcaaggattatttccataatatcttgtaaattccctgatcatatacgaaacacattgtgtacaaagaggtataccgtatccgtgtattctataagtcgtaggatataaggtatgccttatccttaaccatgacagtagcccccgatttcaactcaaatgagtcctcgttgtcatcccagacttcacggacgatgttgtcatactcacgtggtcgttctcgataagaatcaagaagatatggagtttgcgacatcatcgaaagaagatcaacggtccacaaatgaatttgaattgaagtctaaaacaactgccaataacgggcctcagaaaatttcggcggcaatctctctcctttcctcgaaatgtgaaccgttcggtagtgctcctataaaacttgactctaggatccattttaggtccgtttgcctaaaaaatcctttcgccttcctgttcatcttgcttccaagaacccctaattccttttcttcttcctcgccaccccaagatcgccctcatggatttgggtaaatccactatcgacaccaccgggatgaagaagctgcaggtggagggctcgatccctggacgccaaaacctggagcgctcagaaggaggtactgaaccccaacccgccctagggcaagtcgtagttttagaagatttcgtccgttgtggttttttgcctcctccttccgaattcctcctcttgatcttgaacttttatggcctcagccttctacacttgaatcctagctccattgccttcttgagcatttttgcttatctttgcgaggcctacatcggtgtagtgcctttccttgatctttttcgttattattacgaactctgatggatggagccccatagaatctcaggatgctgtgggttccgcgtccgagatgggatgaaggcggaatatatccccttcaactgcccttcttctcagagcagctagaggtcaaagtggttctaccttcatgtagacgagctcgatcctgttctcgttgtcctagaagatcagcctgagcggtcttctgactagacttcaaaaccatccttgattccatccctccaggcttttttagacatagttagcgacctctgaaaacaagggttggccgggtatgaagttgctgtagactttatacgccgtcgtattcaaccgctctaagctcgtgctcaccctgtgtacgagtacatgggggatgaagacgtgacgcgcgtttctcagtggggtactcgttctcgcgatgtcgcatgctcttcagaaaatatcattgactccccctttactgactttcattgttcccttgtaggtttgaatgacgacatcgtgaaggcaagggtcgggcaagtcctgataagccctccctcaggttccacgcagctgccaacccccgtctgcgacctccccgtcgccgacaaagatgcagccatcaatgtaagtatcttctgcttgatctgtagcaaggacctcggttgccgctttgcactttccgctctttctattccttttcttgctagactctggtgtatccttgttggttgttttcttctcgtcgcccgtttttcctttcccatctttctgacggagggcgtcatctgcatgggcgcatctatccacgatctcgaacagcttgcgtgcgaaggtaattcgccttgttgccaactcttgggtggtgtagcgatcttggacacctgacttgaacgcacgaataacagaagcgtcggcgatttcagggatcgtattctggcattcattaaaacaccgaatatagtccctcaaagattcacccggattctgcattaaggcgtggaggttgtcctcgatcgcgtgtcgcttgtagttccctggaagttggcgacgaattgttgccacaggtcttcccatgacggagcgggagatgaattagccacgaatgagcaaatcctttcaacgtggctagcaagtagttcgcgagtacgttatcatatgccccagtggcataaagaaccgtggaatagatatcgaggaactcctcggggtctgtaatcccatcgtacttttctatcgccactggtcaaaatttctcgggccaccgtacttctcgcagtgttggggtgaacacccttcatccgcccccaggcaatagaggtggtcgatgtccgtgttgtcgtcgaggggcaccagccgaagatgatgatgacgatgacgatgaggggtcgctagggttaggcatgcggtcccaaggttggcgtccttgttgtcaatcccgccgggaatctggagagcacgaatctcggtgtcgtctgtcgtcatcgtgatcgtggcgacctcaaccgatgtcgccctgagctcgccgtccacgttcactgtcatcgcggtggctttggcgatcctcacgatctcggttctcgtctgagcggcctcctcaattgccatcattgttgcgtcgatgcggagaccggcgctgatgtcgatgggtatcatcttgatctcgtggttcccgctggcgcccgttcaagtgatcatgtatgtcatgattgccatgaggcggtggggtctgctgacgaggttcgcgtgcattgcggggattatggcctggatcacagctgggatgatcgctggtagcattgacaatgccgtcaacttccatagcgtctcctcgaggtggaggtcgaggaggttccaaagtcgttggtccagccgccaccgcagaagcgctattgagatttgccactgtggaccgtaatcgttgcacccactgatcgccgtcgtggtgtaggtctggatcgaaagggccttctatcaatatagaattgatgatgtccaagtgctgggtaggcgtacgggtatgatccggggctactcgagtacttgtaccttgctcctcaataacgttcactttgcgtggagtatgagatgttgaagactcttggtcctccaagctgtgaagaaccaagggtttgtgggggtcgatgtcgatgatccccacaaagcgatctggagttccctccgggccctgtccctctgcaacgtttcgagtttgaactcgtcgttgttggatctgagggcacggaggtttgactgtaataccccgagtttcgaattagtatatttcgggagatcttaaaacgaacgcgcaaaagttcagtttttaaaccgtttttcgaataggcgatcaggtaccgtggatgcgtagagctcactgagtagtgtaaaatagactataagtttatagtaatcggagtccgaacgaagtcctggggattgaaacgatgtgggccgttagatcttgtgttttagtctctttatataacttaaaaaaaaagaaaaaggaaaaaaaaggagagatcgctacagaagccctagccaccgctactccagcgccctggcgctgctgctgccattcctgtcaccgccgccgcttttgtgtcgccaccactgccccgaccattgccggtcgctgcagccatcatcctccatcacaaccggtggattctttcggttccgcttcttcccggtgaggtcttactgctgccaatctgatctagggctgttgcttgtttgcttgctgccgctactaaccttcccctgctgctgctgctgctggtggctggtactgcatcggtcagagaggagaagggtgcagagagcagaggaagcaggggaacaggaggaagaagggaaggtaaaggccgagtaattttggggatttcggtgacttcgcaactagtgggtttgtttcgaaattctagtatcctcgctgcaacagtacttttggttactccctagaagtataagattcgaatagaaattgattcgatagtcgcttgtgcaatttttgaggttcttgattatgggctgaaacagtattttaaaatctggcattaaacaggccattgtgattcaggttagttgtcctaaataaagtttgtattcatcatcaatatctttctaatggcgctggtttcactcaattccgataaatggtttgggagaaacaatagaaacagtactaggacaataattcgttttccataatctgggactttcataggcttaatctgatttttttcacccacatgaaagttgtagagaattttgtctagatgtctaaagtgatatcggttgctactttttgttaggtggattgtgaaatatgtatataacattgtatagggctagtataggtggttttgtgtggttgccagataaataccaaatttaggttttgatctttcataatgttttggacatgtatagttagtctcaacgattcctcgatagaggttttacttgtagctttactccacaggtgtggagggggtttcgccaggttgccgtcaaggttaaaggcaagtgcatgacgaactaactgtgtgattcatagattgtttgctctatctatttatgtccgatatatttttatgtgatatgtgatatgtgattgcttatattcagattgtttgtttacgccatatatatttcaactttatcttgtgtttacgatgttattcttatttcaatattccagattatggttctgtttaaataattcaagttccatgcttgacatggatgtttcaatttgtttctttgtttccggtttcaactattcatgttccatgcgagtcatggatgtgctatctagtttttattcaggttcctgtgggtaagcgctgatcacgcttactcggctttgctggcaaatgctaggatgtattcataattgtccgggatggaaactactatttcaattcatgtttgcccgggatgggaactactattttctttaacttggtgtttgaaatgtgtttcttttcaaagaaagaaagtgtcctgttcagactttattgccaataatgtgtatacatgttttctagttctatattgtgcttgctgagtgatctacatatttgtgttcatttattaggtctattcattatttgtgcattggagtaaatgaacattgatgtatgcatccatgcacacatgtatttataacccacatgcaatatcttgatttgctattggctaggaaatagtggggatggtgtatgcattgagtttgttgctagagtaaatatactatgagagagttattagcttttcttggtcttggtgtacctatgaaatatgtagatcaatttggaatggagggaatggagggagtattagttaagcaaattatgtaaaaaaaatgcactctagctctaaataaactaattaaaactagttagaccagagaatctgtacattcatcctcattcaccaaaaacctagatgaacttagctgacctaataatctttaggttaaaagattaagtaacttacatagaatatttccctagcttataaaatgtgaagtaaagttatataatatctaaaatcatgaactaaaattatattggttaacaaaattagtcattttatacatctcaaacaagatagaacatgatctggacattaaactccaaaaccatatacacatgaaacactatatgcctacaacacgttataatttgcaaaaatacctaaagaattcataataactctaaaaattatgaaaccaaatgtgttaaccttataaaacacatctcaacacctaagatggaacatgatctggacattaaactccaaaaccatatacacataaaacactatatgcctacaacacgttataatttgcaaaaatacctaaagaattcataataactctaaaaattatgaaaccaaatgtgttagtcttataaaacacatctcaacacctctgtgaagtcaagtttaataaaaaaaatcactttataaaagtattttacaacactgcctaataaaatcctaaattataccgatataatttataaaattcataactctcaaatggaatgagataaaatagaaattctttcacctaaattcatcctagaccagtacctatccaatgtgcacaaatcatgcattttagagcattttggattttcgcatatttcggtgtttaattgcataacgtgtactttatatagataattgcataacggtgaagaagtgaattaggagctaacatttccaggatcaaggcaagtgtttcctcccttttcctttgatcacattgaaacccatgatttgggagatgaaaatgtttgtttgcaaagatgcatgtgaatttagactatatcgatatttaaaacttggttatggtagctatgacctatttgctgcattccctaccttgaataattgtgatccttgctgtttgtacccctagaatggttagagtacatatcttgtgctcaaatggatttatatatgcaactactagcttagccatgcttagaagtatgcaaatgcttatttcatcaataattaaaatgtgattttactaagtgaacccttgctggaattaaaatgaaaatgatgattatttgcgaactaaaatgtgtaaaagtatggttgtgatttgagcagcaagtggtatgcatatggtgttagttgcatactgatagggggagagcttgctcaagtccgtaaggaccgaacttgtgtcaccaacttaaagttatccgtacatcgacatgtgctcttatgggggggccttagctgattaatctacctagcatctagccttgcattatggtaggccggtgtgtatgaattagtcgataatttataggaacttatttgcccccgaggtggtagtttaggtgactcagtctgtccaatacaccggtattgtgccacgtggtggagtccgttcgatattcgccatcacggcgttaagtttaaggcatgggcccgccacttaacggttctaggtattattcccagtatgcctaggatgggggaacacgtattgtgctggtgcaaggctagatactagtagtgtaaagacttcgttgtgatctctagaacgtactcaatgtgtagagtatggtagtgctttggccggcacaagacaaactagagtgttcatatcatgtgggtaaagctgtacaaactttgcagagttctctaaactaatcgattagccgtgctcacggtcaagagcgctttggtgaagtgtcataagtatagactctatattttaaaattgtgaacatgagacttcatttgaaattggataaaatgtgttgagtattatgagattgatgatatatatattatgacttgttgtcaaggatgacaacaagatatttgaatatgatggaattgtaatgattaaatgatgaaatttaaaacttgttttgttagttgaaattgttaaattcttttcaaatgaattgaaaataaaacctgctttatgctaaaattgaactacatatagccttcctttgagtatatgtcttacatgtagtatgttaggattgacttgtgcttgctagttgttaacgaccaaatttggtaaatcaagtgttggatctgaagacagaactacagcggatttggaaggaagttggcggttacagaaacagagtacaaatcggctgacaaccgaatcggctatggtgtacatcggctgagacagaatcggactaggatagccgatgtaaccggttccgatagagagaaggctggatcattgtcgaattcggttggtgtgcttcatgaggattgccacgtgcggattaagtctggaaaaggcaattatatctattaattaggatattttgttagtttccttattagataggagtcgtgtccgacaaggacatcttatgtaattctgggtataaaaaggacccggggtcgtgtaaatcaataacaatcagttcaataacaaattcggtgcatcgccaccttttactgttttctatttcgacgagttcttggtttcgagttgggctgcatcgactttgatctccagcaggaggtaacacttgtcgtggcggtttgtgttctcgggattagtgcttccatctttatgatactctaatcttgtttatgtaaatcgtctagttatcatatatgctatataatctagaccaacattgccatatgacctcatcggctagcattcgttgccagaaaacagccgatagggttatataccaatattgattcagattatatagtgtatctaccatctcaaaaaggctttcatcgacctgatcgtctagatattgtgtttcttttcatacttagtgctgcatcagttaggtttgatctactaagtcgtgtttagaattataatctctagcctatttatgattgctaatagagatagcatcggggtttcagccggtcttacctgatttggttatcttgttcacttgatatactaaatccgccctttatattgagatcttagcacaataaaatatattaagcttactattaatctgattaggttatcatggttttagattgatgtttgtttagtgtattttgttcatgataatatctttatataaagtagtattggagtattaccgataccgatacatgttaagtttgattaatcggttatgctatgaatatatataatttctgtcttaatgtatatttagacataagtgatttatactgtcttggcgccctatccgatctatcccaatcacttggtttaaacatattttgagatatggactatattctattaatatctacagccaattgattaaatttaatgcatattgcatcggcttaatgttcaatgatatgtcatcggcaagccagccgatcggctatcattgatggatttactttgttttctttctatgtctcaacctatgagcatgctaaccgatttctggcccaatgtggtgaagcatcggctactgatgctctaagagttaggttgtttcctttgtctttgtctggattggctttcacatggttttcttctttaccatacaattctgttcatagatgggccgatttggagaaacagtttcataaatacttctatagtggaattcatgagatgaaactatccgatccgacagccatcaagcaaaaacatgaagagtctgtccaagattacattcaaagattcagagatgttagaactagatgctatagcttggcctagccgatttggctttccagggcttattatcaccaatcaaagaaagattttcggctcaagactttgagagtttagcccacttggctcagaaaatagcagcacatgaacaaaggttccaagaagccaagaaagcattgaaaaaggtttattatatcagctcttatgtctctgaatctgaggacgaagaggatcctgaagtagcagcaaccgaatgggtgagaagcaaaaaggtggtctcatgtcaatgggtgaaaaattccggaaaggaagaaatatatgattttgacattaccaaggctgatagaatttttgatttgttacttcgggagaaacagattcagctgtcgcgtcccaaatcgactctaaaattcatcctcaaaattgtgcaaaagaataagtaaaattcaatgtgaaagcctccaacaattactcctcctccccttcttgggccggctcggcccattccctccctctctctctctctttccccccccggcccatcggctccccgcgcgcgcgcgcgccgctgacaggcgggcccgcccgccactctcgctgacgggtgggacccacctgtcatccccctcctctcgccgcgcccgccgccagcgcccgtgccctagcgccgccgccgccgcgaatcccgccgctcccgtccgccccgcgtgcaatcaagaggggggaattactccccgtaatctcctcccccgtttccccctctttcccctctctctctccctcggattcgttcgaatcaatcccgcgaagttcgccggcgcatctatggcggccgagatttccgcgcgccgtttcctctctccccggccgcgctctccccctctcgtcgctataaaaacgttgcccgtgctctcctcctccgtttccgccgttcgccgctcgctctcgccgtcgaaatcgtgctcgcgccgtgctcctctctctccgccgtcgccgccgagcttcgttccgccgtcgccgccgctccggacctcctcccgactcggcgacccctccgtccgcttcgccgcatcgccgtcgacctcgtccgccgctccgcttcgtccgccgaccgtcggagcgccgtcgccatcgtcatcccgagccgcgccgccgtcttcttcctctccgtccgccgttctcgtcgtcgccgttgtctcggggtgagccgaagaccgccgttcgccttcccccttccctcctctctctcgggtgccactccgccgcgccgttggtcgccggcggcgaccatcggggcgcgggtgcgcgccgctcccgtcggccgcgccggcgaggccgcctttgggcgcgccctcgcggctgccaagtgggcccggccgtcagccgcccgcgcccgcgggtgaggctgacgcgcgggacccacggcgccgaccgccgccagccgcgtgcgcccggtccaccgtggaccgagcggctgacgcgtgggccccacttcccgtggacccggtccgcgcgcccgcccctcggctgacgcaataatgggaatttttaattgaaaattaaatgaagaaattcgcaaatatccatttaaagagcatataaacttcaaatggccatatcttggccatttgaactcggaattggaccgttcaagtctctaatttttccttaagatgtaaagaacccatttttgtgctttgtttctgctgttatgtggagttatttagtgttaaagcctttttcttttccgtcggtcgtgtagacgctgcagcttcggaagatccgctcttcgttgaagtcgaagccgtcgattgggaaaacgagcaaggcaagacacatcatcttgatcatattgaatcccagtttataaaattatgttgatttaaattattgcattatcgctttatttaaattcccgcgttatcactgttttatttagccatgcctatttacctttgttatgaccatattattattgttattgttattattattaccttgttcaccctagacaaacaaaaccccaactagtggacactctctactcatagtaccactagtataattctaggtagatgcttcgcaagttaattaggcaacattaggtggttttacaactctagacttgggaaattctcatatcatttggacaccatggaatggttggcttatgttggaattggacacacacctctcttcctctttcaaaacccctaaaacctgttttcggtggggtttgggtgcatgccagttgtgggaagtagcaccccggccactataaggactaaagctcgggcctctgttgcaaagcactaccgtacttccacatgtctaatgggtaaggcttagtttgtggctcagtctagtcataaacaaaagtacacggattggagatggatgaagtcgggggtcgatggacattctccagggcaaatgaaggctacacgagctgcggcccggtagtcgagatgtcatacggcggagggttggtgcccaatgccaggggctcagttccgtctgcctgtcccgggggtcccggccgtaggcggaattgggtcggtactcttgtctaaggctaggatgggttggaaactatgtcacgtctttcgtctgtataccgtggtggtatgtggcacgtggttacacgtgaggaagatgtgtcttgtgggtaaagatgtacacctctgatcagagtaaatctattcgaatagccgagccctcggatatgggcaagcctagcaatgtacccaagtcagtgttataattcttaaaatttgctcaacaactaaaatgtggaatggttggcctgggttggcttaggacgagctgggacccagggtcgggttgccagttcggtctgaatcatcataggccttgggttaaggcaggttcgtgtgggttcacggccttgattaataacattgtttagttctaggatcgtgtttacaactagctttgagcaactaaattcctttaaatgctgtttactgcaactctaaccccttatgttataattcccttgtactcccttgcatttattttgcatttgtgggtgtgtcttgttgagtacggtggttgtactcagtcttgcttaattttcccaagcccagatgaggagttccctgaagatgaaggcttcggtgtctagctcgtgcctgccgtcaagtgcctgtggtcgtcgccctagtcttccgctgtttttcgttgtctttgagtgtgctgggccttcgttgcccatgtaataattttatatacgcttccgcttgttaaactctgatttgtatcaacttttggtgtaccttgcctcctgggacaaggattaatgcacgcacgtaaggaatgcccgttgggttatttccggtcgtgacaagttggtatcagagcctcctttgaccctaggacgagccgtagatcccaagccttagctatatttttaaaaataaaaatcctttattatttgtgaaaacccgctattctctctctgtcttgctgcttcatttatcgtcaaaatctgatcttttaaatgttgtttttcttttgtttttgtttatagatggccggcagcgttacccgtcgtggtttggacatgactggcttcgtcttggagctgcgaggcatgtgcgtggtcttggggtatccacatggagtggattaccaggccaggccgctcccggagcaggagggtgaggatgcagagcctcacgctggttgggaggtcactgcagtgatcctctccggctctcctgagcggacttcgctggcagtcactgcgggtggagattccttccccgccgcttgccagaacgccgctctcctcgccatcggcactcttcaccagcgctacccggacgagttgcagcactcgccctaccgctaccacccccgtcgcggaggagccagcgacctcgccaccttccgagacgccagctcggaggatgacgctaccgtcgtgcatctggcacgcatggtggaggcgtacgacgcggctcgtatcgacttccatcagatggtgcgtcgtggcatggtggagaacaacctgaagatcctggagctgcgccaagagaatctgcagctcaagaaggacctcgacgcgttggaggcgcagctgcatcagctcaaggtcgcccagggagagatctgccgccccaagcgtcgccgcgtctgccgcagccagaagatcaccgcccgcaagagcacctccaggcccgagcttgttcgtcagtccctggcgtggacttgcttcgtcgagacccctcgtgccgagcctgcgcccgtggttccccaggagggggaagcctccggcgttggtagctcggagggtgcgctgttgctcaccttccgccctggcccgtcgcagcggtagacgagcagttagtaggcctgcgcgtgtgtttttcttcgtttttcttcttgagttgtgtggggcatggttacaccggtgtgtggtgtaactatgtcggagcctgtcttattttgtttgcctaagcaacttgaacattaatgaaccaatttaatagcagtaataattttaagaataatagtagtcgtgggtggttagttttaatcgtcagctcttcttctctgtttgctggttctgtgtggggttttctgatggtgtcgaccaggagaaatgttaacaccggagaaggcaaccaacccgaaggcagcaaccccaacccccaaggcaacccacctccaccaccaccaccagacaccaacgccattctcaccccaaatcctcgcccagcaagccaacatgatgaatgctttcctccaccacctccaaaaatccgccacagcagaatgctcccccaccacctccccaacactccaaactcgccgaattcctccgcatccgtccacccaccttctctagctccaacaaccctgtggatgcgttggattggttgcatgccgtggggaagaagctagacacggtgcagtgcagcgacgaagagaaagtcatcttcgccgcccaccagctgcaggggcccgcatctctctggtgggaccacttccaggctacgcagccagagggacagccgattacttgggctcgcttcaccgccgccttccgaagaacccatgtgcccgctggagtcgtggctcttaagaaaagggaattccgggagttgaagcaaggcaaccgctccgtgatggagtatttgcatgagttcaacaatctagcccgttacgctccggaggatgtgcgggaagacgaggagaagcaagagaagttcttggcaggaatggaccctgagctgtctgttcgtctagtctctggagactacccggacttccaacgtctggtggacaagagcatccgcttggaagccaagcacaaggagctggaatcgcacaagcgccgcttggcgaacttccgcaatcagcagggtgctaaccagagggtccgctacaccaatccctacccagggggatcctcctcgcaacagcagcagcagcagcaacctcgctccgcgccccgacctcaattcgtggtgcgcgtcccacagcagcaacagcagcagaatcagcaagggactcgtgcgccccgtcctcctacgccagttgtgcagcccgttcaaggccgcagggacgcttcaggtccgcagcgtctgtgcttcaactacttcgagcccgggcactttgcggataaatgcccaaagccaaggcgtcagcaaggccaagcgcctccccgctccaacaacggtggcaaggacgtcatccgtggtcgtgtgaatcacgtgacggccgaggacgtgctgacaactcccgacgtcatcgttggtacgttcctcgtccattccatccctgctacaattttgttcgactctggagcttcccactcgtttatatctgtgccattcgtggggaaaaatcagttgggggtagaaaggcttagaaaccctctgctcatcaccacccctggcggggttatgacagcaaagtattatagccctgccgttcctatagaaattcaggggattccttttccttcggatctgattctgctagacacaaagaacttggatgtgatccttgggatgaattggctggcacaattccaaggagtcgtggattgcgcgagacgcactgtcaccctgtaccgaggaccagaacaaccggttgttttctttgcacctccaacctctgtcagaagttcagaactgcatcaggtaggtctgtcagaaatccccatagtcagagagttcggagacgtgtttccggaagaactacctggtatgccgcccaagcgagagattgagttccggatagatcttgctccaggaaccactcctctgcacaagcgaccctaccgtatggcagcaaatgagctagccgaagttaagaaacagttggaagaattgaaagaaaaggggtatatacgtccgagtacttccccatggggtgctcctgtgatttttgtagagaagaaagacaaaacgaaaaggatgtgcgttgactacagagctctcaatgaagtcaccatcaaaaacaagtaccctcttccccggatagatgatttgttcgatcagcttaaaggtgccactgtattctccaagattgatcttcgttccggatatcaccaattacgtattcgtgaagaagatattccgaagaccgcattcactacgcgatatggactatatgaattcacggtgatgtcgttcggcttgaccaatgctcctgccttcttcatgaacttaatgaataaagtgttcatggaatacttggataagtttgttgtggttttcattgacgacattctgatatactcacaatcagaggaagaccatcagcaccatctccgtctggtgttgggaaagttgcgggaacatcaattgtatgccaagcttagcaagtgtgagttctggttgtccgaagtcaaattcttggggcacgtgatatctgctaaaggagttgctgtggatcccgaaacagtgaccgccgtcaccgattggaagcaacccaagacagtcactcagattcgcagtttcttgggattggcaggatactaccggaggttcatcgagaacttctccaaaatcgctcgacccatgacacagttgttgaagaaagaagagaagtttgtgtggagcccgcaatgcgagaaggcgttccaaactctcaaagaaaagctggtttcctcgccagtgttaatcttgccggatactcgcaaggatttcatggtgtactgtgatgcttcgcgccaaggattggggtgcgtgctcatgcaggacggtcatgtggtagcctatgcttcacgtcagctacgacctcatgaaggcaactaccctacacatgacttggagttagcagcagtggttcatgctctaaaaatctggcggcactatctcattgggaaccgctgtgaaatatatactgatcacaagagcttgaaatacatcttcacccagtcggatctgaatcttcggcaaaggagatggttagaactcatcaaggattatgatgtgggaatacactatcatcctggtaaggccaacgtggttgccgacgctctaagtcgaaagagccattgcaacactctcaacgtccgaggcattccgcccgagcttaatcaacagatggaagccctgaacctaagcatagttggtcgcggattcttggccgcgttagaagcaaagcccaccttgctcgatcaaatccgcgaggctcagaagaatgatccggacatgcatggactcctcaagaatatgaaacaaggtaaagccgctggtttcacagaggatgaacacggaactctatggaacggaaagcgggtatgcgttccagatagcagagaacttaaacagctgatacttcgggaagctcacgaaagtccttattccattcacccgggcagtaccaagatgtacttagacttgaaggagaaatactggtgggtcagcatgaagcgggaaatcgcagagtttgtggctctatgtgatgtgtgccagcgtgtcaaggcagaacaccaacgaccggccggactcctccaacctctccaagtgccagaatggaaatgggatgaaattgggatggatttcatcaccggacttccaaaaaacccaaggtggatatgattctatatgggtaatagtggatcgattaaccaaggtggctcgattcattcctgtgaagaccacctatggagggaataaactagcggagctctacttcgctaggatcgtgagtctccacggtgttcccaagaaaatcgtgtctgataggggaagccaattcacctctcacttttggaagaagctccaagaagagctgggtactcggttgaatttcagcaccgcatatcacccgcagacagatggacagaccgagcgtctgaatcagattctagaagatatgctccgcgcatgtgtcctagatttcgggaagacttgggataagagtctcccctatgccgagttctcctacaataacagctatcaagccagcatacaaatggcaccttatgaagcgttgtacgggcgcaaatgccggacaccgctattgtgggaccaagttggggaaagccaagtgttcgggactgacatcctaagagaagccgaagctaaagtcagaatcattcgggaaaatctaaaggtggcacagtcccggcagaaaagttatgcagataaccgtcgccgtgatctggaattcgcagtggatgattttgtgtatcttcgggtcacgccattgcgaggtgtgcacaggtttcagacaaaagggaagctcgcacctcggtatgtgggtcccttccgtatcactgctcgacgcggagaagttgcttaccagctggagttgcccgcctccttgggcaacgtgcatgatgtgttccatgtgtcgcaactcaagaaatgtctccgagtgccatccgagcaggccgattcagagcaaattgaagttcgcgaagacttgacctatgtggagaggccagtgaaagttctggacaccatggagcgcaggaccaggaaccgagtaatccgtttttgcaaggtccagtggagcaatcacgccgaagaagaagctacttgggagcgcgaagacgagctgaaggcagcccatcccgatctcttcgccagttcttccgaatctcggggtcgagattccgtttaaggggggtaggtttgtcgcgtcccaaatcgactctaaaattcatcctcaaaattgtgcaaaagaataagtaaaattcaatgtgaaagcctccaacaattaaaatgtgcaaagataaaagtcaaatgaggcttggaggatttttgtatatttcctaaaagcctaaaatgcttaaataaattttagtggaattttcagagcacaaataataattgaaaagaaataaacaaagttaaaaaggttttataaaaagaaaatcctaaaaagaagtctttttcccctcctcctccccttcttgggcccgctcggcccattccctccctctctct

SEQ ID NO: 7560 - DNA, 10907 bp, Oryza sativa
  unsure (1)..(10907): unsure at all n locations
gagccctcggatatgggcaagcctagcaatgtacccaagtcagtgttataattcttaaaatttgctcaacaactaaaatgtggaatggttggcctgggttggcttaggacgagctgggacccagggtcgggttgccagttcggtctgaatcatcataggccttgggttaaggcaggttcgtgtgggttcacggccttgattaataacattgtttagttctaggatcgtgtttacaactagctttgagcaactaaattcctttaaatgctgtttactgcaactctaaccccttatgttataattccattgtactcccttgcatttattttgcatttgtgggtgtgtcttgttgagtacggtggttgtactcagtcttgcttaattttcccaagcccagatgaggagttccctgaagatgaaggcttcggtgtctagctcgtgcctgccgtcaagtgcctgtggtcgtcgccctagtcttccgctgtttttcgttgtctttgagtgtgctgggccttcgttgcccatgtaataattttatatacgcttccgcttgttaaactctgatttgtatcaacttttggtgtaccttgcctcctgggacaaggattaatgcacgcacgtaaggaatgcccgttgggttatttctggtcgtgacatcagctccctactggtcatgtgattccatcggcagatgaattaggaaagaggaaatattgtaaatggcacaatacagtgtctcacagtaccaacgaatgcaaagtttttagacagtagattcagttggccattgagcaaggtaaaatcaaatttgatgattcaaagaagccgatgaaaattgatggtaacccttttcctgttaacatggtttacacaagtgggaagatagccgacagaaagaacaatcggcttgactctgtaagaatgattaataaatatcagaagagatatgatcgacaggaggagcaatatttcaaggatgatgacagttttgatccacattggagttgtgagtttttcatattttgctggaatgaagggatgaaattgccatcaatagaggattgcccaggttgcagtgatatagacaagagttattcagggaatcctagccgatttcatattagagaagatcagtttgtgcagaggaagttgcctgttcatcagaggttgggcccaattcatcaagattatttccaggaagaagttgctgaagaggttgcaaattcacaatggtgtccttctgggattttttctaagagtcagaagagaagggttcaaaggatgaggaatagggagcaatttcaagaaaatcaacatgatatgggtcatcggctgaaaagagcaaagacaaaacaaatctgcagtgttaaaagcaaagtggtatcagccgatgagattaaagccgatgaagcaaaaagattggctaaaggaaaggccattacttcttcatcggttaacatggtgtttgtgttacctgcagaatttggagttgatcaaagtaatacagatatcatggaagaatcctgtgctcaattgatttcgtcaccagaacaagctatctttgagaagccagaaggaacagagaattggcacctcaagccattgtatgttaagggatttgtcaatggcaagccgatgtctaaaatgttagttgatggtggagctgctgtaaaattgatgccatatgttacattcaagaaattgggtaggagtgcagatgatctcatcaagactaacatggttctcaaagattttggtggcaatcctttataggctaaaggagttttgaatgtagagttgacaatcggcagcaagactgttcctaccacattttttgtcatcgatgggaagggttcatatagcctgtcgcttggaagggattggattcatgctaattgttgtattccttcaaccatgcatcagagtttgattcaatggcaaggtgacaagattgaagtggttccgaccaacaggtcagtaaatgttgccaatgccgatttatctgtttgggagatggatggtattgattgtttatctggaaaaatttggcaaggagattatttgaaagtatttgattgtgatatacaaccagttggagatggagaaccccaattgttactttgaaggtgttgtggagggttcaaatttctacaccaaagacactgtagatgatctcgatggcaaattaggtcaaggtttcatgtcggctgatgatttagaagaagtggatattggtccgggagatagacctaggccgacatttatcagtaaaactttatcatccgaatttaggaccaagttgattgaattattgaaagaatacagagactgctttgcttgggaatattttgagatgccagggcttagtcgatcaaatgttgaacatcggctacccatcaaaccaggatatcggccatataaacaaccacctaggaggtgcaaagcagatatgtatgacgcaattaaagctgaaattactagattatatgatgctggttttattcgtccatgccgatatgctgagtgggtttccaatatagttctagttatcaagaaaaatggcagacttagggtttgaattgatttgagagacttgaataaagccacacctaaggatgaataccgaatgccagttgtcgatcaattggtagatgctgcttcaggacacaaagttataagtttcatggatggcaatgctggatataatcaaatctttatggcagaggaagacattcacaagactgcttttagatgtcctggtgcaatcggcttgtatgaatgggttgtcatgacttttgggttaaaaagtgctggagctacatatcagagagccatgaattatatttttcatgatctgatcggcttgttggttgagatatacattgatgatgtggtagtgaagtccaaggaagttgatgaccatatagccgatctaaggaaagtttttgagagaacaagaaaatatggcttaaaaatgaatcctacaaagtgttcttttggtgtatcggctggacaatttttaggttttcttgtacatgaggggggtattgaggtaccacaaaggagtatcattgctattcagaagatcaaacctccagaagataagaaacaattgcaatctttgattggcaagataaattttattagaagatttattttaatttgtctgggagattagagccatttacatccttgctaagacttaaagccgatcatgaatttgcatggggtgcagagcagcaagaggctttggatagtattaaagaatatctaagttcccctccagttctaatttccccacaaaaggggtgccttttaggttgtacttatcagctgatgagaagtcaatcggctcaattttgattcaagagtttgagggtaaagagagagcaatcttttatttaagcagaagacttttggatgcagagacaaggtattcctcagtggagaagttatgcttgtgcttatatttttcttgtacaaagttaaggcattatttgttatccaatgagtgcaccgtggtttgcaaagccgatgtagttaagtatattctatcggctccagtgttgaaagggagaattggcaaggggatttatgccttaacagaatttgatcgttgatacgagtcacctaaagctattaagggacatgctatagctgatttcattgttgaacacagaaatgattcaatcggctcagttgaaatagcaccttggacattgttctttgacggttctgtttgtactcatggttctggcattggcttggtcatcatatcaccaaagggggcaagttttgagtttgcttatactataaaaccttatgctacaaataatcaagctgaatatgaagcggttcttaacggtttgcaacttttgaaggaagttgaagctgaagctattgaaattatgggtgattctttattagtaattaatcaactagctagagaatatgagtgtaaaaatgattcattgatgatttatcatgagatgtgcaaagaattgatgagtgaatttcgactagtcacattgaaacatgtttcttgagagcaaaacatggaggctaatgatttggctcagggggcatcgggatataagccgatggtaaaagatgttgacatagaaattgctacaattacagccgatgattggagatatgatgtgttcaattatttgaagaatccttctcaatcggcttcaaggaaattaagatataaagctttaagatatgttttattggatgatgaactatattataggaccattgatgggatattgcttaaatgtctaagtgctgatagagctaaggttgtaatgggagaggtgcatgaaggtatttgtggtactcatcaatcggctcacaagatgaagtggttgcttagaagagttggatatttttggccaacaatgttggaggattgtttcagatattacaaaggatgtaaagattgtcaaaagttttgggcaattaaaagagcaccagcatcggctatgaatccaattattaaaccatggccgttcagaggttggggtattgatatgatcggccagattaatccaccttcaggtaaaggacataaatttatattggtggcaatcgattattttactaagagggtggaggcagtcccattgaaaaaagttgattcaggagatgcaattcaatttgttaaggaatatattatttaccgatttggtgttccacaaacaattacaaccgatcagggttctatctttgtgtcagatgagtttgttcaatttgcagagagtatggaaatcaaattgctaaattcttcaccatattatgcacaagccaatggacaagcagaagcatctaaataagagtttgatcaaattgataaagaggaagattgctgattttccaaggcaatggcataaccgattggctgaggcattgtggtcctataggatggcttgttatgggttaattcaagttcctccttataagttagtttatggacatgaagcagttttgccatgggaacgtgtcatcgcctcaagaaggattcaatcgcaagatgagctcacaaccgatgattatcataatctcatggtggatgagtcagaagatttggttcagtctagaatgcatgctttggagaaagtgacaagagataaggagataattgcacgacattataataaaaaggttgtgccaaaatcttttgaggaaggtgaattggtttggaagttgattctgccgattggtactcgtgataataaatttggcaagtggtcaccaaattgggaagggccttatagaatttataaatctgtctctaagggagcttacatgttgcaaggacttgatggagaaatttttggaagggctcttaatggaaagtatttgaaaaagtattatccaagtgtttggattaattcataattcggctatatcatgccgatacatgttagccgatgcgttgacatcgccttgagatggccgatatgagtaatatcgcccttagtcatttttacttattataatcggttgtgttctgaccctatttcttagccgattgtaattttgtgatgattgttatacattacaaaattagggggcaaacatatagttgaaaatatggattttcaaaaacaaatttatattacacaacagggagtttcatattacacaacttgttcagcctattacatgcttatgaatagccgatattgccctttgtctgatttgttctacctcttcaattgcttgggcatcggctgcatctgtgcctggaattggtttcacagtcttgttcagttcgactaagtgcttgattgaagacttcaacttggatttttgtgcttcaatggctctgggtagatctgcaagcttttgctcttctaaggctagctcagcattgcatccttcaagttcaactagcagttcaatttttctattttttagccgatctatgttgaattaaataggattgggtccagaaatcaatgcatcaagcttggctttttcttcattgatggattgccgatttgattggatggtagcttcaaggtcttttctttccctcctatcggctatcctttgtcttgctctctccagtttgtaccgatattgctcaaggaagactgctggagagatgacttcagctgcattatcagggatttgatcttgtatttcttcaaaccttgccctgattggaccacagtccacaactaaagcatctaaggagctctcaagccgatgtgctatgtctttgagtatggttttaagatcatcggctagaggagcttgtgctttgcttgacgtttcttcctcttcatccatgaactgcctaatgtcaaatgaaaacatatccgctaaggcctggaaaggggaaatgatgattttttagtcaatgaagatgcttggagtagccgatttttggttataagaattgtacaagtacttacagggatggcaggaatcggctgatcttcaatgtggtgactgcctctagccgatggagtatgctcgcttgtttcatgctggattggagttggagaatgaattggctaaaagttttgtgaagaaagaattgagttatcactaagtaactgagaattgaagaaaatttgaaataatatattgccgatggagatggtgctggtttctttctggcagctagcttctttttctgcaaataaaaggagttaaagtcaaaatcggcagagggaataagaagaaagatcaggttatagattcatacccgaggttgataagtcaaatgtattggagccggtggagttctttgaggagcaggggtgctagctggaggtgctttagctattgcttcacttgattcagtagctgcttcatcaatggcttcttcaattttctcttcatctaggaacttttccacctctgggtctatagtggccagatcatcggttgctacttttttctgtttctttgaggctctagtttttctagccgatggagtagcagccgatggtttggtccttttctttgtccctacttcataggggatcggctcacgtgtttgcctatgcagaagtgaagaagtttttggggcattatgtcacgcccagaaattcccgaatagaattccaagcagaatgtgcattagaacccccgtccaggaccggccggggtacacaaacgacaatgttgacatacagatccacgtcttacaaacattataaaagtcttacataaatgcagcggaaaaacaaaaggataactggagctaagcctggccttgaactgcagcggaaacaccactccacaggcatcctcgacggcacggacgaagcctactcctcggagaacccgccatcgaacacatactcaaactctggggttgggggaaaatagagcaagactgagtactatccactgtactcagcaagtcatactggaataggggtatgatgcagggatttaacaagggatagctatacaggttcatttgcataaatactggcatttataaacagaagttgaatgtgaaaacagttgtaataattaaccaatattaatcatccactgtccaacgttacaccacgttgcaacagacccaaccatccacctgtactatccaattccattaaactaaactaggatgtgactaatcacggtgaatctggttgactgcccataaccgcgggcacaactattcgaatagttttactctgatcagaggtgtaaaactgtacccacaagacacagccccacaacacgtttccgtgcaccgacatgccaccacgacatatcggaaagagactgtgacaggacccttcgcataaccccctctagccaagcacaccacacctcaggtttcacccccgtccccagcgggcgacgggcagtcccctctcgtgcctaggtgaatccggaagcgacagaggctgtcgcagggcccgccccgctccatcactcccacccttgcctggatgcgtcagctagagaaaagctatactacaagcccagccgttgcccacgctggcttgtggtaagtacgagttcttccagggtttcccgcgaaccggtccttacttgccatgggtgcgactggcagaaccatgcacccacagcccaccatgtgattcattttaattaaccaacaccaaagtggtggtactaatccaacattatcatatgaacctacagtctatattttaaatgagatttccccattgtgtgctagttgaactaagcatggctaagcaactcctagtccaaagtctattcatgttataacccgagctaacaaaggagcaaggtaccaaaatagcatggctgtaacaataggtaaacatcccatagtgttattgcaaaacaaatgcagtatttgaaggaaaacaatagaacatttgcaatgtaggatcaacatgatcaagtgacaagcatgacttgccttgctctactgctggaggaacctcggcgactatttcgaagtacaccggagcgtcggaagaaccggaatctagcgacatacaaggtaaacaatgcaaacaggctataggactactgaaacagagaacaaaaccatttttaatggattctacacatttttcttgatttactgagacttgaatgggcttaaacggagctcggatgaattagttatgaattttagaagattcactgtgtttattactataacaaaaagtccttaaataatttattgcgcaataattcccagggctgacgtcatcaggtgggcggcaccgacaggcgggtcccactggtcagtggctcgggagagaggggaaggggcgccggcacgcgggccccactcagcagcggctcaaaggggggcacggctggcaagcgggccccacggctccggctccatgagccgatgtaccggccaggcccggcaaggcatcaagccaggcccggcaaggcggcatgcgaccgccggcgacgccgagcggcggcgcgggcggcgggcggcggcgtgagcaacgacgactgaaagcgacggcgcacggggaaaaagggaaggaaaggaaggggagggagacctcaccggaggggcggcaacggccggcggcgggaaacgagggaggcggcgaagaccggcgatgccgaggtgtggacgagcgacggctgacacttaaggaaagagaggagaggaattagggcggaggaaaaccctcatggcgaccatccacgccggccggagtcggaggggagagagaactcaccggcgacgcgagggaaatggggtttcggtggaattccggcgacgcagagcggtggccgggaagggtcttgcggctgcgaagctaggggtggtggtggcttagcgcggcggcggctctggtgacggtggcacacggccggagtgcggcggtgggcggcggcgcaagtggcggcggcgcgagctcggtagggggcccgggatggagcggtgagagcggaaaacgagagaggagggcatgggtagcattttataggcggagggggaagcggacgtggccgggagacgctccaatttcgccggcgacgtgggggaggagagagagaaggtggggggattcaaaatcgaatcctgctccatacgagagcgggcgcggccggcagatcaggggagagagggcgcaacgatggcgtgggcgcggggggcgtgacgtgggctcgggtaaatcggcgaggatgggtgcggcgacggtggatacggaggggtggtgaccggcgcgggcggcgggaggttgggggaggacccgacaggtgggccccacctgtcggcgaccccgggagaggagggagtcggggcggcctggctgggcctcggcctgcggccggcccagcggggagggggaaaaggagagaatgggccggcggcccattcgaaaagggaaggggaaaaagaaaaagaaaaggaagaaaaggattttccctggaattaaaatattgcttgctcaattttaattggttaaaattatttctaggactctgaaaattccactaaaaatcctggtagtgaatttcaacatgtagaactcaagaaaaattccacatgccagattcgattattatttgtattactttcttagggttttctcttgatttacatcggcattttcttagggtcatttataaattaaattttaggcttgggaggtgaacttcagggtgacaaacctaccccccttaaacggaatctcggccccgagattcggaggagctggcgaagaggtgcggatgggcggctttcaactcatcttccctttcccaggttgcttcctcctctgaatggtgactccactgaactcggcaaaacctggtgaccttgtttctggttcttctttcgctggtatcaagtatacgaaccggcttctccacatatgtcaggtcctcctggatatcaatatgctccgagtcagcctgttcttcaggtactcttaagcacttctttagttgggacacgtggaacacgtcatggatgccgatcatattggatggaagttctagctgataagcaacttctccccttcgttccaagattttgtagggtcccacgaaacgtggtgccaacttgcctttggtttgaaaacggtgcaccccccggagcggagtgacacgaagatacacgtaatcccctgcttcaaaagtgagctcccttcggcggttatccgcgtagctcttctgtcgagactgggcaatcctcaacctttccttgatggttctgactttctcttctgcttccgctaatacctctatccctaacagttgacgctcgcctgtctgatcccaaaagagaggtgtgcggcacttccggccgtataaagcttcaaacggtgccatctgtagactggcttggtagctgttgttgtacgagaattccgcatatggnnnnnnnnnnnnnnnnnnnnnnnnnnnnnnnnnnnnnnnnnnnnnnnnnnnnnnnnnnnnnn

SEQ ID NO: 7561 - DNA, 464 bp, Oryza sativa
ataccatcactagttattttattacaactatgtttatctttaattctaaagcgcacctaaatgctactatgctattttacagattcagttcatcactaggaagaaaactcaatctaacacacacctacaaaccacgcgcgggaatcaatacaacaaactgtctatagatcatcttgcaaattctatgctcaacacagctttcttctcaaggctataaactccactggttgtgcttcccatctccacaaagctcaaatcctcaagtacaagcggcggttgtgggcattgttgcacttcatcagctagtgctaggcgccggagctccgctgccaccagcaccattgtcgggcttgtcatacctggaacaaccaagcattgacttgctagaacagctgcctgatgcatcactctcatactagcttcatcaaccatgtcactatcaaggagctcaaagagtgtgccct

SEQ ID NO: 7562 - DNA, 139 bp, Oryza sativa
gctattaccgaaccgcccacaaaggcctctaagcagttgaaacattaacaacttcccagcattgcgagaagggttgcggaggaagatggtgagagagaaaagatccaccctccctaattcagactggccatcgcacggg

SEQ ID NO: 7563 - DNA, 534 bp, Oryza sativa
aatttacatgcattttatgtcttagcttacaagggtcccgttgtcgatgtgtaggtttcgcccagttcgctatgatgcaggccgcccacttctcccaggctgcagggtcagcgtctcaggcagctgtgtcgacctcgcactcagcgcagttctggcagtacaccgggacttcgtcacaggcagccggcacgttgagtcagggtccaccactggaccatgctgggacctcgtcggaccgcttgctgccttccacctttctcttagacatcactgacttcgacttcgcttcaggctcgacagaggacgtcatcggcccctcacagttgggaggcgcaccgccggtgcagacgcaggatcaggcgcaggccactcctccgcgggacactcgtgctacccgtgctgtgccaccggatcgtttcacctactcctaggaccacgtgcgagcacaggcccggaggaccaagcgtggtcgcggcgcggggcagcgccagtagagcagtcttctctttgtttacttgcttcactttccagaac

SEQ ID NO: 7564 - DNA, 702 bp, Oryza sativa
ccatatagtgagtgcaagccttgtatcccttgtttgaccgtccatataggttactaagtgcaggccaacagttaatggcaacgaacagcaacgctcgtagattacattgctcctgtttatcctcatcccacacagggatgccttctttcctccacagcacttttagatctccaaccaatggttttaggtacacatcaatgtcgttaccaggttgcttcgggccttgaataatgatcggcatcaagatgtgcttccgcttcatgcatagccaaggaggaggttgtagatgcacatggtgacagaccacgtgctatggccgctgctcatctctccaaatggatccattccatccatacttaaactgaaccttacattcggtgcatactctccgaagtctttaaatgctctgtcgatatttcgtcactgcgacccgtcagcggggtgtctcagcatcctgtcttgttgaagttcttctgcgtgccaccacatcattctagcatgcgatttgttcctgaaataaatgtttcagccgtggtattatagggaaataccacatcaccttagcatgaactctcttcttcaaaggttgtccgtcaacatcacctggattatctcgtctaatcttgtattgtagtgctttgcaaaacgggcatgcttctaggtttcgtactcctcaccgcgatagaggatacaatcgttcgg

SEQ ID NO: 7565 - DNA, 507 bp, Oryza sativa
cactcacggtgaattgaagcagccacctcttcgtaggtccggtgttgcggtggtgtgccaacggctcgagcgggaggtgcggtgcgcgctgtaatagtgcgaaacgtgccgtcagatcgtcctgtcagtccacagccatggtcactggcccaacagcgtctcccgcgagcggtagccccaacaagtacgatacgtcctgtagggtaggggctatctcaccgcacggcaagtgaaaagtgtgcgtctctggcctccatcgatcgaccaaagctgctaggagggacctgtccacagtccatcgtctgggcgggtccgcgtcgccggccgcagcctccaccagccgacacatcggtaggaggccggcctcacgtagcctgcaataacaaattaatatgtaattataaaaaatattacagtgcaactaacttatagtaaaacactgttcgtacctctcgacaaaggagtcgtgaaccgtgagtagctcaccgcacgtccgtgcccggaacg

SEQ ID NO: 7566 - DNA, 546 bp, Oryza sativa
ggtactggttcctgaaattggttaaaacaaaagttgttggtatgaggccaaatgtgtgcctgatacatgataggcacgctggcattctgcgagcgatagaagagtttctgtttgggagcatggaacgaggataccctggtgtttgggacgatgtacagagtaggtggtgcatgcgtcatatgggagctaatttcttcaagcaattcaagaacaaggagctcatgaacatgttcaagaggctgtgcaatcagaaccaggagaaaaaattcaatgagctttggaagagattagatgagttgacagccaaatgcagtaatcagcgtgcagcggctacatcgactgccgttgatgacccttctcaagctcttggacctctcccaacagatagtccaactttggttagaagaactggattggagattcggaaattttcttagtggattctgcatgaaccaaaagagaaatgggccaaggtgtatgacaccggtggtgctagatatgtaataatgacaacaaatttggcagaagtttacaactgggtgatgc

SEQ ID NO: 7567 - DNA, 166 bp, Oryza sativa
actcctagaaaattttgggctgaggctattaacactacatgctatatttcaaatagggttttcttgagatctaaacatggaaaaacttcttatgaacttcgatttggacatcaacccaaagtttcacatttgcgtgtttttggttgcaaatgctttgtcatgaaat

SEQ ID NO: 7568 - DNA, 431 bp, Oryza sativa
tattttttgcacttcaaataagaataacttcatcaaaagaacgcacctcattgtcttcacactctgaatccgattcaccacgtgccataaagcaaacaccggagatgttctttcccttctcttcatcttcactctcaccatctacatcacttaatggctcaaaagcggcatagacttgatcaaacatcttcttgagattctccttagtcttcttccctttgaacactgtcgatggtcctaaaatcataatatttgaccgtcaatacctgcatattatgaactaaaacatagtatccaacttagtggtacggattattactaatcatttccactagtgttggtgaaatacatgtatgcatgtattttgagaagaaaacacattcgtcaagcgacaaactgcacctccacgcattcaggatacatttacatgg

SEQ ID NO: 7569 - DNA, 1460 bp, Oryza sativa
caagtattagagtagtaattaataacttagatgtggtgtctaggttagagattacctttgtttgttgtgtatcccacggatttgtcagaggtagacggcaggtggtgacagccctgaatcccgtcctagtaatcctccacgttcggatatatcatagacctatagccggaaccacgctagcagaccagcaggggtcggtgcctgaagcaacagagaggaaattaccgttaacttagcttagataattaaaacacatagaaagtcctctctagcctagcctgcctaccatcagttgttgtccttggatagtcttaaccttaggtagattacacacgttccttgagttcgatgtccttttggggtcacccgaaggttaagcgctacagcagtattccgtgcgcttgcggatttatctgtggtcgtaagaaataccaacaaacatgctcttgggtttgttgtccttggtcttctcttcaccattgtcttccttcttgcctctcccaagcttaggacaatgcgaatgaatgtgatcaagaccaccacattcaaagcaatgagctggaccatattttttcctgtacctaacattgttcatagcttgagaaatcttattagcagccaaagccaagtcctcgtcctcgaactgttcgagttgctcatcggacatggcatgaatcaaagcaaggacaatagaatttgatgaagaagcacctacatccaaagaagtcgatgaagaaaccaaagcgctagacttagaatcaactttatgagaaagaatattcatctcatgtgttttgagtttgtgtaaagcgaatccaaagtcaaagtagacatatcaacagactcttgaatagatgtgacttttatctcccaaatagacatatcaagaccattcaaaaagtggcgaaaatcctcagattgtgtatagttaatatcctaagcaaaatcaacatatcaaagatcactcaaaatcttattaaatctaccaagataatcatccaaagcttctccaggtttcatctcacattttatgtactcctttttgaaaagatctcgacgaagttctttaatgttggtagttccttgacgaaagtttttcaaagcactccaaatttcattggcagttttaagatgcgaaacacgataaaaatccgtacaaaaaatttcactcaaaagaatattgcgagctttgcaattgttattaaaataagttttcaaagcaatagtgtcaatctgttcaggaatcacatatggctgtgcaacttttttccaaacatcataatcctcagccataatgtatgattgcatcttatcacatcaataagcaaaatccgaaccatcgaaaacatggggcgtagtagtaaacttgttagctatggctaaagctctatatcggttaaaatccaaagaagaaaacaaggctctgataccacttgtagaatcaaatagcaagaactaag

SEQ ID NO: 7570 - DNA, 464 bp, Oryza sativa
ccaattatttaacatgtaaacaaaaaaaagtaatcctcacatttcaagaatattttttgccactttaacagaagagtctcgcgggcttgattggtgcacacgctacaaaataattatggggatttgtgaaggtcttagttaccttcatggaggattggaagaaccaattttgcatctggacctgaaaccggccaatatacttctagataataacatggtgccaaaaatagcagattttggggtatcaaggcccttcggtggctcgcatacacataccactaaagtttgcgtaggttcagagtaagtagagaggacgtcaagagatatgtcctctttctttcttattagtactaaccgaatgatatggtgtttgtttaacatcactgatgatatgatgcaggtactacatggcaccagaatacttggcacaacgtaaaatatcaaataagaatgatatattcagc

SEQ ID NO: 7571 - DNA, 437 bp, Oryza sativa
gcagacaccatgcatgcatggggaaccatgtctatgtgtactcaatcaacaaatgtattgctcatattttgattcgtaggttgcaaataattggaggaataggatcggggacacatcaatgcacgcgaaagaagagtgccagcaagtgaaaaaatgcgttgaaatagctgtacgctgcgtcgaggttgatagacacagcagacctgctataaatgacattatccatgagttgaaacagacagaaatttatactagagccgtgtcgtcatcacaggaccaggtatgataaattcataattatgacgatgattgagatgtatgtatatgttagctttgcgggaggcgggagataataaatactcaattccatttctaattgatccacacattttatagaagtacatgaaaatcaagaaaagccaataactctccatact

SEQ ID NO: 7572 - DNA, 506 bp, Oryza sativa
tttttccttctttcttaatgtacactatttgagttttttatttgcaagctattttcctcttgttaggtcagtatttgatgcattggctcacgagctaaatgatcaagctcgagctttgcaacgagtcgagccgagctgggtatttagctcgtgataataactacttaacgagtcgagctaagccaactcgttaattatcttaacgatttagatcgagttgagctgactcgctatccaccctacgcgcggcacagccatgtggcgcgcgaggagaccctggcggcgggagggcgcgtggtaaggtgacatgtggcggttttttctcgcttttcttttttttctaggtttttcttttttcctttttttgttttctaatatttatatatatagcacatatacaaactttgtataagtagcgttcttttggttttttaatacgtacgtatccaaattttatatacgcacataataatgcatatattttttttacacattgaaattttacc

SEQ ID NO: 7573 - DNA, 679 bp, Oryza sativa
ctatttgaggaataacaagtcaataaagcatatatatagagcatttatagatcaaaccatatgctagcatcgacattgcatattttcttaattcaagtatagaatttaagtgtcatgcatcatctcacttaaaagcaaaatctagatctcatgaaaagactagaatacatacaagctatgctagagacaaataaaccttcaaagtattgctagcatgcacaagaaaataccatatgcataaataaagctctcttttctcaatttttctcattggcatattattgcttgataaaaccatgaggtacaaactccccctcaaaccatgccaaaaggatgaattatgcccaattcaccacgaagaaaagcaaagcgattagaatccaaagatttagtgaaaatatcaacaatttgcaacttggtgtcaaaaaactacaattcaacatctcccttctcaacatgatgcctcaaaaagtgaaaacgaatatcaatgtgctttgtgcgtgagtgttgaccgagattcctagaaatattgatagcactagtattatcacaaaagagaggtactttctcaaaagtaagaccataatctttcaaagtagataaaagccaaagaatctatgaacaacaactagcagcagcaacatattcagattcagcagttgattgagcaacactagat

SEQ ID NO: 7574 - DNA, 795 bp, Oryza sativa
tttgattaattaaaagacactaaatatctggttttatagttggggaacgacgttgttactcgataacaagttgagggaccttgcgtgcactttttccccactgaaggtaccggagaaaattcttgtattccaaggcctaacccgtgttagaatcacagcccttttaacaaccggaggatagcccattccgctgttttggtcacctcccgcacagatcatggtggattcaactttcacttcttcactaagtagccggctacgctactgtggcattgctcgcaggctgtgtagggttgttcagtttggtaccactttccaccttagcagtttttcgtattacgaaaacattgtaagctaacaaactaaatattttattgccattgataccttaccaaaatttggtatttctagaaactcatacaaacaatccaagaattggtttgacaacaaattaaacacatccaatgctaccaaaaatttgttaacgtcaaaatatgccaactttttgacgaagctaaattttagtaaggttgattttgacaccaaactaaacaagcccatatagcccgtggggccgcttcgcatgtgggcagctataccatctagctagtcgtgcactcatactgcttccagtcagttagcgtaagggtagcaggcgacgacatcctcgaattgccactactacaaaataggtatcacctctgttggttcatttaaaacctatacttattagctattaacatttaattctcaccttatcaagataaaaaaaataaaactgacatgtttgagcaa

SEQ ID NO: 7575 - DNA, 694 bp, Oryza sativa
ccccagtggacatagaatctgctttacttcgtatgtcgtcttggacaatgtgttctcaacaagaagcatagtcttcaaaattcctaaaagatctatgaaactcttgtctgtccatccactacttgccttcaacttcattaggttcaaggtcgctgacaactttgtgtgttttgctttgcatccggcgtacagaagcgtctcggaatcactgaccaacctgctaaacttcatgaaatctctctcattctgggctgggtcttcaacgtcacgtaacatgtcttgtagcagatcgtgatccacatttcaccgcccaatggagaaggtataaacatgtcatgctcatcttcatcttcctgattatgcgcaccacttctgtctgttgctgcaccacttcctgattcttgctctccatgcttcacccaacatgtatagtccttcatgaatcctcgttgtatcagatgatcgtgtacaacctcttcgctatcaaacatattctcattcttgcaatctgcacatggacaacgcatgtaatcattgtttcttcttttcctatcctcccctgcggcgttcataaattttattacgccatttctgtactccggaaaatgacgtttcacagttgtcgcatacatccaacttcgatccattgctacaaaataaaaaaataaattagaggcccatattataatatcag

SEQ ID NO: 7576 - DNA, 179 bp, Oryza sativa
ccaggccctttgggatggccgtctggcatcagcctatcccggagcaggtgccgtttgtcgccttccacacatcacctcgccggcacacggacacgcacccgctcatgtacttccccacgtaatcctggtcggcgatgtaggcttgtgtccggcagccaacgaccgtgaacttgttggag

SEQ ID NO: 7577 - DNA, 499 bp, Oryza sativa
ttgctcaaagtaatatcgtatcataggatcgtatcgtagtatcgggatactatgagattttctttttttaagtttaattaatatttatattaattatatgtagccattctatataaaaaaatgtagtaatggtatatgtcatgcaaatataggcatttattaagagaaaccaagttggttttgatatatttaactgatttttatataaatttaagcatatttatttatattattttcataccatgttattttaaataatattttgtagtatcgtagggatcgtagaatcgggataccacctaagatttcgtaggatcgtgtactaatgaatagtaggatcgagatactatgaaaattaggatactaggtgggatcggtatcgtttcggcttggtaggatcgtagtatcgtaagatactaggatacgtatcgggatactgacaaccttgtgagcaagtgagcaggagagagaacagagatgaattatttattccttatgg

SEQ ID NO: 7578 - DNA, 344 bp, Oryza sativa
ccatacgaatcaaaaactttacttccagttttcttaaagtgaacctcaaaattttcatcaacaatttgtgaaaccgaaagaaaattgtactttaagtcctcaaccaaagctacattcttcaattcaaaattttcatttaccttaaccaaacctgtagcgagaacggcacttgcagaagcatcaccaaaaataatcgattcagtcttggatgcctttttgagtgaggagaaccaatttttatcaccggtcatgtgccacgaacaaccagaatccacgatccacacgttctccttccttgacaccaaagcctacacacaagcataataaaaatttaggaatccagt

SEQ ID NO: 7579 - DNA, 537 bp, Oryza sativa
cccattcaacttgcaaaattcatctaattttgagctctacatgtttgtttagtttttatgtactgtttccttagtttttattagagtttttcctcgttttgcgtgccagcgtgtagtttccgtcgtttcggaggtccgcggtcgcgaggaaaagagttcggaagatcaaagtgaagaagcaaggcaagtcgcacattcccccttgagcatgttgatcctaatttataaatgttttaccgtttgcaaataaatatgcatgttttgctaattacatgggatcagggtttacctatctgctcgcttgtgccatgtttacttgatatctatcctttgtcaaccttgggtgataaatcgactagctcatgttacttatgtgacctagctagaactatatgcttagccatgcttaattaccactagctcagtcgatgggataattgcagtattagacattctagtatcttgttgagccgcgtgctcgagacatctggccatgttttatggtcgtaattatccaactaaaatgcgactgaatgg

SEQ ID NO: 7580 - DNA, 2060 bp, Oryza sativa
gatcagagtttaaactattccaatagccgtacccgcggttatgggtgagttgagcaatgtttttcgtgattagtctcacactactctttaatggtaataatgtggtaattaatttaattcctggtttggaatggataattcctggtttggaggtttaatttgttcaactggggttggttgtacaaatgtggttgggcctatgcaacacgggtgtgttgtatggtgtttatttaatattgattaattatacaactgttttactattctcttaaatatttattaaatgctgtttgctgcaaatgaactgtattatgccatcctttgttatcctgtgcacttgcatatttgctgtgtggcttgttgagtatgttatatgctcattcttgcaatattcattcatcagaagaggagtacttcagtgaaggtgatgatctggaggattaggcttgttcttggttaagttgcctgtggagtggagtcgccatagctgttccgtagtttgttatagttttgttttccgctgcgtagaatgttatttgttttgagaggaactatctacctctgtaataattttaatttgcgaatattcaatagttaattatttgtactctattatcaatattgtcattgtgtgcctcggttgattcctggacgagggttaacacacatgtaagcgtttggaattttggatagaaattccgggcgtgacatcagggacacaaattctctcacctaaccatacagttccttgctcgtcctccaagaaaccgatagcttttcctcttctcatattcttcttaatttcttgaatatcaggatcattaatttgggcttctctaacttgatcaattagagtgggctttgcttctaaggctgcaacgaaacctctactgacaattcccaaatttaatctttcaaattccttgcataattccaatggcaactgtcgtccttctgtagcattgcaatagcctttcctgctaagagcgtctgctacaacattagcctttcctgggtgataatgaattctcatgtcataatccttaattaattccaaccatctcctttgtctcatgttcagatctggttgagtaaagatatactttaaactcttgtgatcggtatacacctccgtacgagtaccgaagagataatgacgccaaatcttcaacgcatgaactactgcagctaattcaagatcatgagtagggtagttcttctcatgcggacgtaactgacgagatgcataggcaaccaccttcccatcttgcatcagaacacaacctaacccaagtttagatgcatcgcaatacactcggaaacccttctttggatcaggcaaaatcaaaataggagctgatattaaacgactttttcaactcttgaaaactctgctcacattcttccgaccacttgtacttcacatctttctgaagcagtcggtgtcatgggcttagcaatcttggaaaaattctctataaaccttcgataatatcctgcgaggcctagaaaactgcgaatctctgaaactgtctttggttgcttccaattggttacggattccacgttactaggatcgacggcaactcctccggctgagatgacgtgaccaaggaatttcacttcagacaaccaaaattcacacttgctaaacttagcatacagttgatgttctcgtagcttctccaatgcaaggcgaagatgttcttcatgctcttctttggttcgggagtagataagaatatcatcaataaagaccaccacaaacatgtctaggtattccataaatactttattcatcaagttcatgaagaaagcaggagcattgataagtccaaaagacataactgtcacgcccagaaattctcgaaccagaatttctaagctgaatgtgcattaaatccctgtccaggaccagccagggtacacaaacgacaattgttgacatacagatccacgtcttacaaaaatagaaaggattacaaatgcagcggaaaagattaaagcgagctaaaccgggaagcttgacttcagcagcgagcggctccactccacaggca

SEQ ID NO: 7581 - DNA, 1165 bp, Oryza sativa
aggggtgagactaatcacggtgaatctggttgatcgcccataaccgcgggcacggctattagaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagcaaaaccatgcacccacagcccaccattcagtgtattctaattaactcacaccattgcggtggcaccaatctaaagctatgccaatagacaaagtctatgtaataatgtgatccccatttgtgtactagttgaactaagcatggctaagcatttcctaaaccaacatctagtcattttgatacccaggttatcaatggcatatggtaaacaataaatggctgagtaataggacccatcccacatgatattgtaaaagaatgcaacatttaatagaaatgcgggatatttgtaaattgggtacaatatgatcaaacgtattgcatgacttgccttgctctcgcactgatgagacctcagcaacgtcttcgagaaaccgcggatcgacgaaacggccgaaatctacgcgacaaacaaagcacacaagcaaaacatgctataagtctacagaaacaggaaacaaaaccatttttaatggattctttgcatttttcttgatttactgagacttgaatggacttaaacggagctcggatgaattacttatgaattttagaagataaactgtgtttttactaataaagaaaagtccttaatcactttattgcgcaataaagcccagggctgacgtcatccaagggggggggcggctgcgccgacaggcgggccccactggcagcggcacaaggggagagggagggggc

SEQ ID NO: 7582 - DNA, 2328 bp, Oryza sativa
acactagcagttgagttgtacctggtgttctaaataactacctacgttctttcctaatattcattattcctattttataagagtcgcacgtttcttacagatccccagaagatccggatgcaattttctgcccaatttgcagcaaactcctgtcgaattcagaatctcctatcttttcctgcagctctagaactttctatgattgcgacaaatttgtcggattagacaatgagccctacatacaagaagttcaattctgtaaaggaaaaagatagggatggcatattcatttcttcaagtcttgcaatgctgacttgagagtatttacaggactgcatttaatgcaaaaaggaggtaacttgcaagcatgttgacttcctaaccagcaagacacctttaaatttcaagcaatcggttgattaaatggagaaataggaagaaccatacatggctgcttgcctctgcctctataagcttctgaagcaaaccatccgtttcctgcacatagtgttaggcaatgctctaatttgtggaacaccttgaagcatagtgtacttaacaatctgattatctaattttatggtttcccaccataagtagtcatgattaaaagtttcgaacataatttgtagagttctgtaattgtgtgaaaaaaataagctataaccatgacgatgctctaagtttacctctgtaccccagccatcaacaacaaacacatcgagacaaaagccatctgatggtgagaacacatgagcttcacggatgttcaacccaatatcagacagtatcgcggatagctgtaaaacaatatcttacagttcaagcggcgacacaagaaggtgtggcattcgcatggaggtccctaaacagaaatcacaaagcacatggccttgccttactgaggagccttggccttgccatggaaaaaaaaataatttcatgaacaccgacgaattcgagtcccttctgcaaaattaagagaatggttatggacaaatcatgtaaaaaatgattaaagatgatcgctcaggcaaactaagagaatggttcacgaaaagaaagcatataatacatgagtgctaaactagtctggatatcagaaagaagtccatataaaaagaataggcaaagaagacgttactaatcatttcaaagaattatatgagaactgttgtgcaccgatgtagagagcaaaggctcatatccacaaaactcaacaattcaaacaaggctgattagagcaactagcctgattgcatataactgcagtaacaccaactatttttttttgcggggagcagtaacaccaactataaaggttgctcttaagtatcatgacggaagctttgtaccaaagaggaacacagtgttgttttatggacagaacaacctttcagtcaagttagcacccttctggaaacataatctatgtttatacaaatgaaatggaaatttcgcattcttgcagtttttagatcgaaccagatggttgaaacctgaaactgacgttccggattaattgattgttattatggtatagatatgtcattcgcacagcacaacagcttagtaacaaaaataccttgcagaactggcttcgaagtcatccacaccttttcctctctctagactcaggtcttccatcatcctttcatatggctcggattctgtgaattcatcatctctgtccaatattcacaggcacaatcgatgttaacacgaaagatatactgataagttggcttgatatttacagaagaagaagcatttttgtttggacaaagagataccattccgaacacgaaaagaaaggtacatacactccactgaaatcaactgtgtcctcaactagtaaagtatgtatgtatgtatatatatatatatatataaaagcattggaaagttggtgacctatacctcaaattgatagggagaaagcccccaccattaccgttttcagttggagttgatccagagtctacccctatgtagcgggcatggaagattgggcgcttttcagggtcggcgcagtcggcgagaatcctccggtgcagcagcacttgctctgccttgctgacatccagatcgatcaaatagctgcacaggcaagaagattgcactttgaaaggcgagaaaagcaaaacaactgagagacaggcgagaagcatcgtatgtgtactacctttcgggcaagcgaaggaagtggcggtcgagctcaacgcggaaggaggaagggttggagatggcctcctcgttgcgaatcgccaccaggcgctcgtagatgacgttcctaatgtcaggggacccgtgcacgctaccgccgcc

SEQ ID NO: 7583 - DNA, 2469 bp, Oryza sativa
gggtcccgagctctcggccacgccctcctcgatgtcgtcctccatctcccccgcggcggcgaggtgccgcctacgcgagtccccccatagcgacgtcgtccactacgtctcaggaggaggcggcgagagagatgcggtagtagaagcagcctgagctgaggtatccaatccaagaggtggtgaggaatccgaggggatctttttggcgcgagaatcttctagaggatggcgcgcgccggccggccgggcggtgggctaatatttgtagggtgaaattcctcgccggagcggagattccaatccaaacgccggcgaggcgaagcgagacgacgaactgagcagcgtctcgctctctcgcagtcgcaggaggaggaggagggagattttccttttctcttttttttcctttctttttattatgaatttttggctttggtggaatggaattatggaaaaaaatggaatggaagcaggaggaggaggaggaggatcttctgcgccgtcgcgccacaggagatatagcttcttactgcatccagtagggacccaacgcgtggcggcggagggggtgtccttatccgattccggggggcgagatggacggtctggattcatcgtggagcaatcggacggcggcggaaggggcgcacgccggagagttagagtttgggtggggaccaccagtcctttccgcaagtaccggagattggacaaacggacgctggaaagggtggaatcagagtacggctcgctgtacggtgggcccgccgtgctttccatctccttctctctttgcctggcccaccgggcagtgacctccggtagtagtagttcccctaaacttgcactgattaattttcgagtaaattccatttgataaaactatcactttgctacagctttattcagagtaaaccataacggtgtgtgtctaacatgtggcctgacataattttgtatttttgagtgcgtgcctagcaaataagcctagagaaatcaagctattacggttacagttttatgataaaatcatcagctattgttatagtttgctgaaatttacttttattttttttaatattaatttgcaaacaaaatactcctacaaatcttactccattgatttatggttgttttggcaaaactccatatccttaatccacgacaaatttaaagtttgtaaattaaattataatgatttatttacattctgtcttaagtgatgataaaatgattcttcaaattttatcaatgtgatctcagatttaggatcatgccaaacagagcacaaaactcacgtatttacaagcggagaaatcatgtgtctgctagcctactccaattgttaaatacagtgtactactacttgttataacatcaatatcaatgtcaaaccttcgttttatataatagcaacggccaaaattcactgctagattatgctaacctgatagcaaatcaatgttaagttattagtacttcattactcacatacataagattctagcaactggatccaagataccacgcttgaccgcatccagttagcttctaatttcaacgatgtgccttgcatgcttaattcactaactaagcaattgataaacaatttactagtttgcatcaacagagaaagagatcgtacttgctccaacttgtcccgacgtgtccaacacgttcctcttcgacgtaacttgtgttttaaagttggcaatgacacggagttaattataactgtttttcaagtgataaacacattgtcaatgtcaccactgtgctggggcactactcgagcaaaacgcatcaagttgcaattaaaaaaacttccggtgaaagaaacataaactcagaagaataatcaacctcgatgatattacgatattttcattgattaagagcagcaagggccaaatcaaatcttcaggtcagaagcagcggcagtactcaactgctagagcagtaatcactgtcaattactaagtactccctttgtttatttttaatttaacgttggcgtcaaacaaatgagaatggaggaagcaattaactactccagtagggaatacatagctatagcgtttgcaatgtacggcagcaaacagcaaaggccaaacctttgtttccaagcgtatgtatgctagtcaagaatctaattaagcaatattctgttctcaaaaaaagaaaaaaaaaagaagaaagaaagatccaatattctaataaccggactccagattctaagaaagcagtttcgtcgtatcaatcagaaaatagtagtacaacgcagttgtttctacataccataattgtagcgtacgtcaggctgcacgcttggcttaacttgatggattagtgccaacctacaaatactccttccatgcatacaacgatcatacaaagggtaccgtacaaggtagtaaacacttatgccttctttcaaacgggagagcattttgaaggatcatcttaggg

SEQ ID NO: 7584 - DNA, 5436 bp, Oryza sativa
gctttcagctagcttctgcgtccaaccataacagtttttaaacgtagaaaggaagaaagtcgacccaccatattatgcgcatttgtgctgtaagcaccggaacaaaaacgcatcaagttggaataatcaagttccagacttcctgttatttggcaaagtattgacaaaagctggggtaacctgacctgaaatggatcatgacatcggcacaattaaagcccacgctttgttgtcgccacctacaaagtacgcttatgctgcaagtgcaaattaaaggatattactgtcacttccaaagtaattatgtcacgcggtagtgacaaaagctggagtaaattccgtattatcgcgcagtaagtaaccagtagtgtgaagaagctgtggccggctgcgatagcgatgtgaaggtgaagccgctctgctcaaaacaatccagcagcaactagcagcagcgagtaagttgatgggaaaacaaacaaattcagtagaacatcaaatgcagcagcagcagcttgtgccaatccaatccaggattaggtaagaatagcacgggatcaagtggacaaatcggacagcagctgctgacccaaaagatcacactgccgagtcatcccaccttactatattgtgcatacatcaatattagcagcattttttcatgccaactacagggcttaccacttaatcagagtgggtccttgcatgctcttatgaaataaataatgatggacgcatatcacaagcactaaagccaccagagcgtgttcattatcagatcaccggatgattagcacagccttgccaattatcagccgaccactaacttgtgacatcataaaccacactaacgataaaacttttacagtgtaacaaaagatgtgatgtgaagacagtttttcaaaatttaaagtactattgcttccggtaaccttccttcacgagaacaacaatgaatcggcatggcacatcagaaatattcaatcggttgatcgtcgtgataacaacgcttccatggctttgaatagtagtttgcttacatttgtatgcacgttccaatttttttatactaaccttgaaatagcacttacgtagttcggtgttgattttggcacataccgtacaatacaatattggtagatgacgactggcaaagcatttcaatacaacagcaacaggttcgcaacaataataatgccaccgtgctactgctcatgtggacactttctagatgaacaagtaagcaagagttgctacacatgaggttgtataccagaaatgaaaattcccaatttgatgtaaccagaagacctatgaaatagcttaaatggacaagatagagatctatcagtcccaacagtacgcagattccagtttatgtaattgcttaaaaaaattcaacagggtgttagactgttagttcacctaaggcattctgctaaactgctgccaaacataataaaagtgtccattcgtctcgagcaaactagcatggcttccccagactagcgaacatcaagaacacaggtaaataatactagggagcatgttcatgtacagagaaaaccagacataccaatttatagctttcagatcttagagaacattttgaaacagggaaaagatgcatgaaaattgaaaaggctcacaaaatcagaactctcataactttcttatttcagatcactcaccagctcagtagataccagaaagtaaccatttaagaacaataaaacagaaacagtgaagaagttataacatagactcgcacaaaaccaccaaattttacaagatgtatttagctcaatatcattaacaccaaactgtggtttagtagaatctgaatatctgatgatattcaggaagatgtgacatgcccatagatctgccaaattttcagggatcatatccaaatacatcttgtaaaatttcatattcagtgaaaggcttatagcatggcacagcaacttggttaggcattggagaaatagcagtagattcgttagaaaatggcataagtaagaagcttcagcaagaatgaaaaataaggaatgaaggtatagcagattgattattcattgcttcaagaactacatgcaaagcacaactttgtataggacgagcaggtgcatgacacctagattggcctaatgctaattataagccgtactgcttataatttgtggccaaaacttttatgtgtccttagttttctaaaagccagtgctgaaaaataaaccttaaaatgaacttcaaaattaagttttaaaattcaaattgacagtggcttataagctgtagggaaaatgatgggagcctaattactctagcattatactgtagctacaactttatctataacttaacaaataccaaattctagtttgaaaaatgcatatattatctttacctaaggcaagcaacaaactccttattcatatgccatttatccctgaccccagaccaatgcccataatgtttgagacaggcagatgaatcgtcaacacaaaagatcatatcacttaaaaccttcctccacctaagcaaacaattgtaaaagctgaaagcattcatgaacaaagataatacttattctggaaccaatgttagaacttaatgttgtagtagtcaccaataagcacggtccaaaacgaagataagcaaagcatattatactccttgtgtctttaatcaaagcaaaaataagaactaaataatgtgttcaccaaattaagtttagtaaagcacctcatcacattgcaactagggactaaattagtttgttataacccaaggttgcatgaccatgaactgtttcaatctttggcaaatgggcttccttactacactatatttctaaaagtaccacttcatacagttcataattagtgcagctgtaccctagctttgacttttgtgtagactcctgactttctgaattcaaatatgagatgcttgcatgtcattatgtcaataagagcatgcaagttatcaattatatgaacatgccttgttacgaaacaaaacctgacaaaaccttttctataatgttcaccacctgaacctgcaagcacagagcagaagaggaatgcatgctcttttgtgtagactcctgactttctgaattcaaagatgagatgctcattttcgaggaaaaaaaagttgaggtgcttgcacgtcactatggctgtgttctttgcccagggttcccaacccctctccctcgttttccgcgtgcacgcttttcaaactactaaacagtgtattttttgcaaaaagtttctatacaaaagttgtttaaaaaaatcaaattaatccatttttttttaaaaatagctaatacttaattaatcacgccctaatgaaatacttaattaatcacgccctaatgaaccgccccgttttccacgatcactgttccggttgggatcctgggctagcgaacacaccctgtcaacaagagagcacgcaagttatcaattatatggacatgccttgttacataacaaaacctgtcaaaagcttttctataatttttattagctaagatcaccacctgaacaatgtacaagcacagaggaattcagcaaaagagtgtgttgagatatttgaatccataaggaattaagaaccataacacagcataaaacatataatgttattgctgaattaactaagaacatagacacgtttatggtattggaatacctaaaagctattctgtatgtgaaacatgctgaatgaagatatatatatatatatatgcttgtgttaggacctatttttagcatccctgactctgctggatgatatttcatataaggcatcccaatagcacatctaaggtcagaacaaatgaagcttaagacctaacaaacttgttttcatgttcatttcagaagacaaataactagagtaccaaccaagccctaggaaactataaattcaaaagatcaatagtaagtacagaacacacacacacacagaggaaaaattgtatacttgcctgcccttgctatgactgctgataacattaaagtactgagtagaaagaactagggcacacctgaattcattaactttatatatagtgattccccacttcatgcggccagtaggaaaactaattatgtactgactactgagaactaatatgtaagtagtgtcgcgagtcaagatcagcaaagttattataacgatgtgatcaccttgttcatgtaacaagcagagtgatcaccatacacatattcccccctacgaaatcatcaaaacaaaataaaagtaacctgaattttattgtctgaagcaacaaaccctgaaaagatatttaaaacatttcacttttaacaagtacagcaattgaaagtatctcatgatgctacgaaccaagtacaatgcaaataaaattctttgacatgtcaattccccctgcatgcaatggatagatgtcccgaatcaattaaaatcttaacctgagcgcatttagtcacgcaccggactggtatgtgttctccatagacttcagggcatagcagtgaacccaccatcgaacacaaagccacggtatacgccatcactgtacccaggaacaccatcaacccagtcccacttgccaccgctgttgcctagctcatcctcctcccacattgccagcttccctcgcacccgctttccagcaaaccacaccttgccatcaccgccaaacaccttgaccttgttgttgccaccagcaacagcagtaggcatggcattaccctgtgcagcagcctcacagaggccggtgaagcaacggtacatattgggaggcatgcggccagcttcgtcccactccatggtggccagatctaggcgtaggatgagcaccgtggagcatggcgcgtctatggcgaacgaggacctgaggccgccgatcatcaggacacggcggccgccggcaccagcgaggaggcgcgggcgcttgaggatctcgaagacatcgccccacgcggagcgctcgacgggggcccaagccgcttgtgagcatggagagcgggcaggagaagagcttccactggctgcgccacggggtgccgacatcgcaaagcgcgaagacggcggcagcgccggaggcgagtatagggctccgcggcttgaaggggagcgagaggggatgcttcatccacttgccggatccggatggggtgtaggagagggcggcgagctcggtgagcacgaggacgacgccgccggggccagcgaggacggtgccgtggcgcgcccaggcagatccgagagggggcaggaagctgtaggtccccgcgaaggggttgcagacagcgagcgatttgggcgggtgggcggtggaggcggtgaaaaaacagaataaggaggaggggagggatggcggggaaggcgaaggggactcgagccagaggtagaggagagagggggaggaggcga

SEQ ID NO: 7585 - DNA, 20491 bp, Oryza sativa
ataatactagtactatacggtgggttcacctactcgcgcggtggccccctatgcatgtgggtcccaaggaagactggacccactgtcagtgaagcgtgtaagggaggcgctggtggaagacgtgagtctgacgggaaagccgttgcggctgcggcgtcgcgatcccttgctgcctcccttcccaccgtggggagtagacttggaagccaatggcaggtggggtccacctgtccgtccgtgcccgtaatgcccgtatgcaggccagtacagtgtcgggtgtttgggggagggcttaaaagggaagtgggccgtatgccactacaattggaaaagaggccaagcccatttatgtacaacccactaccctccatctcctttatagtagtctaaaccggcggctttacaagttacaaccgtcgagttggattcagataagtgttgtgactgcattattacccgatcaggttgtttacaggtggtagagacgatgtaagatgggtgctttttggtaacaacggctacggcaattttctatgaatgccagattttgatatatgattttgttaaaatctctgttgagcattgtaatagggaagccaattgtgtggcacatgttctagcaaatcttacttttttaagtttaggaattcttgtaattggtttgatgaggcccatattttcttgttaacgttctaaacgttctagtgaatgttgtaacaatgtttgtatattaataaagcacgccaaatgattccctaaaagaagtgttgtgacagtattctgagaactgtacgtaatctcagccatttatttttatgatcgatggtttagatttactgttacagtaacagcatgaatagtatcccttgctacgatgtttttgctatagtacgatgatgaacagtgtgatcacagtctggatcgtccgatttgcatccgttgatgagaactgcagtcagatccggatcccgtccaggtgcggtgagcacagcgatgttttgtttctggccggcaaaaatctcaatcttttcatgtttcttttcaacgatcaatcgatcatgcgttgcaagaggcagcccttgttgttgtttttttaattaatctgaacaaacaaactgcatttgtgctcgtgcagtgcatgcatgctcgcttgggcgaccccaagggccatcctcaatcagctaaaatgctccattatatgatcgatcaaggcaggaaaatggcattagtcagtctacaatgaaaaagcaagcagggatcagagaaagcgagagagagagaccagtggcatgatacaacaacatagagtggagaatgagatggtaaagcagagatggagcagaacacaaagatatgggcaggcagcagcagccagccagaattcgggataagattgataaaaccgaaagagggattagagtggtgcctttcgtgtggacgccatgcttatcccgcactatatctacatatctatatgtgcttgcctattattaatcctctattgtgtctgtctgaactcttaacccctaatcaatctgatcacttgattaccaattgatgatccatggcgcgtgatggcggctagctcgatcatcatcattcttaatttactctgattgctagctctttccacacgccgttcttcccgtcggctgtttgggcgagccgttgcttgcagcagctacgtaccatttctctgatcgacctatggtccagtggctgccgattcagcactcactagatctcgcccgatttttcacgaataatcaatacaacaaatctctccactagattgtttttatttctccataatctccaacatacatggatgatggatgagtgccatcgagtagcgtacctaacatcttgacctgctctgctgcactttgtcatcgtcctcttcgttttctttgaaaactcttgtcttctcttcttcttctgtcgttgatctttgcccatggcagggagtccatcgagctgccttttcttcttcatctttttttccatttgcaaagttgtgtttccgttcaccacttgtcatctttccctccaaaagttcatgtctaatgtccgctcaaagcttttttcctttattttttgctcggataaaaaaagacaacagtctccacgagagggatgcctgcaatttgattaatttaactgatttgcattgcacaccttgacattaatttttgtactactacatacattttgactaatataaatatgtatagtttttttcttctcttctgtgagggaagcaagatgagagcaagcagattcgtccattgggctcgatcgaagccgttctagaattaatacagaccggtgtcttttctttctttaatttgttccttcttggattctcatgttaaaaaaagtgcaattccactcccaagcactggccgtaaatatgaagtgacaattaaggaaataatgaggtttcatccgacaaggagaacattcccctgtcaacttaaccgaatcccgcacactttgactgtatgagctagctagctacaattgttttcagtataccgtaccgtctttaggaatttaaagccctggtgtagtggcgtgaaataaaaaaagatgtcttaaaattgaaaaactcatatagacaaagaatatttatataacttcgatatatatgtaattgcttacaacgttaaggtagtgttaatttaaggtgggcttttctctgattctaagtatagtacttcatctaccagtagtaaattgagctagcaacatgcatgatcttcaatgcatggcatatgctcctttactttgaaatgcatataggaggagtatatgctaaagagagcgcatatgttgcacagtgaaactaatgtaatcatttcattcaggtacaattaatggcaaacgagtcgatcttctgcttagagtagtccaccaaatgtagtaagttaaggtacgagaggcctcttttgtcttcaagggatcttgcacagttaccttgaagctgaaattaagcatcatctagtacgtgctaggcacttactatatggcttgcactccatggtgttcagaagtcagaacagggaatcgatcagtgcaatcgactggtatgacaaatttcactgaacagtacagtttgaagatataaatgcatgggaaatttattatattattaaaggaatagaaaaaggagcctccacgttcgctctcatgacctggaaattctcacattaatcggagaaaaagaaaaggcagaatccatatagaaatacaatttagaaatagctaaaattctaaatttaaaaaataaggaatattagaagaggagactagagtccatatagaaatacaatttagaaataattgaaattcagaattaaaaaataagaaatattagaagaggagactagagtccatataaaaatacaattagaaaataactgaaattcggaattaaaaacaaggaatattagaagaggagactagagtccatatagaaatacaattatgaaataactgaaattcggaattaaaaataatgaatattagaagtagagtatagagtccatatagaaatacaattaggaaattaggaaataatagaaattcggaattaaaaaaaggaatattagaagtagagtatagaggccatatagaaatataattaagaaaaaaatagaaattcggaattaaaaaataaggaatattagaagtagagtctagagtctatataggtatttaaaactaactaaaattcggaataaacataataaaatgaaaagtagtgtttagagtccatataaaaatgcattttataaataaataaaattcgaaattaagaaaaacatgggaagaagagtttaaagacaatataggaatacaatttagaagtaactgaaatttgaaattaaaagttattgcaaaatttaaaattatgttgtcattgtaatatattttaataaaataatgagaaaatatatatgctaaatatatgagagaaaatataatgatgctagccgcgcaatctgcgcgggctaccgtgctagttcttttgatttctcaaagggatgtccactcgtttgctaaaaagtattatctcctatcaaaattcatacaatgtatatacatacaacttcataaaatcctaaatctatactcaactcacatattgagaaataataccaaaatatggtaaggtttattttggcgacaaatcaaacacatcagctggttatatattggtaatatatatagcctattaagtaattgtcagttaagtcaatgaataattattaatattagatataaatgtaatttgcacatacacaatcggcaagcaccgatattgaagaataggtgactttaaatgttcgtggaaggtggcatcatgtcgaggagcaatacaggggagcaaaagtgaagggtgttggtctagagaggtagatagctaaaaagagatggatcgatcatgcatatataacgatgcactgcactgcagctagtgtagtagctttaaaattagttggcgacacgcaatagccacaccaaaacctcctgaaaaccactataaaacacgccaagaagcgtgctcgccacactgcccatccatccactcgatcgatctcagctaattaattaagctaacaggccagccaatcagccatggcggccatgatgaacaacgagagatcaagcagcaacaagctgcaggttgacgccgagaacccggcggcggtgggcgacgagctggacctggcggcgcgcgccaactggctgcgggcggcggtgctgggcgcgaacgacgggctggtgtcgacggcgtcgctgatgctgggggtgggcgccgtgaaggcggaggcgcgcgccatggtcatctccggcttcgcgggcctcctggcgggcgcctgcagcatggccatcggggagttcgtgtccgtgtgctcgcagcgcgatgtggagctggcgcagctggagcgcgatggcaagcgcggcggggaggaggagaaggccctgccgagccccgcgcaggcggcggcggcgtcggccatggcgttctcggtgggcgccgtggtgccgctgctggcggccgggttcatcgtcaactacaggctgcggatcgcggtggtggtggcggtggcgagcgtggcgctggcggcgttcgggtgcgtgggcgcggtgctggggcgggcggcggtggcgcggtcgagcgcgagggtggtgctcggtgggtgggccgccatgggcatcaccttcggcctcatgaggctcttcaaggccagcggcatatgatcgatcgatcactagctagttaattaagctctctgctctactactaagttcatttttttttaaaacttactgcattaattaaactaaactaaaactgcatatgcatgtggacgacgatgatgttttggcgccatgagcgcatgatatatacgagcgcacatgcacgcgttcttcgtgttcgatctttcctctcctcctcgatctcctctgcttacaagagattgcttgtctagctgctccggctgcctatcgaggctaactaatagtcgatcgacgactttacgtagcaaaagtaaaaccattaagccttgtactcagctccatacatatatataataataataataataataataatccatgcaaattactcctaagtttttcttccttaagtttttgaagctaccaatcgatctctggttaattataatgtttgcttcgcgcgcgcgcgctctctctctctctctatatatatatatatatcgccaaatcgatgccatatataattaacacagcttgaacatacagctgttactaatgatcaagccatgtatatagccttgggaacagcgattaatggcaaaacaaaaccaagcttttttgctgtgggcaatcatgcatgcatgcctgctctcgcttgcttttcgccacattccctttgaacagctaaactagttatatatatctggtatttattctaaacctcatttcactccttttcttttcttaagaaaataagaattttgtcttgtcgcccactatctactactccgtttcgaaatgtttgacgccgttgactttttaacacatgtttcaccgttcgtcttattaaaaaaatttaagtaattattaattttttttctatcatttgattcattgttaaatatatttttatgtaagcatataattttacatatttcacaaaagtttttgaataaaacgaacggtcaaacatgtgctaaaaagttaacggtgtcaaacatttcgaaacggagggagtataacaaagatattttgttttcctttccttttaccatcgcggagatatggatgttctccattatatttgcgaggacgtcgtggctgttgtttgatctggttgtggagaacgggctaattaactaggcccagtttaactttttgtctaggagaagcctgaaggaatgcctgatcaatgggccggcccacctaccccgcacccttctttattagcatgacgtgagatatggctgacgtggccactggagaggccgcaccttgcatacgcatatggcacaagaaaaataatggggaatggacaccagcaatacagacaaatggaaatattgtgcattaattactactctaacttaataaaagtggagtttattttacacgaaactacgtaataggtttactcacacgttgtcagctataattggtagggttcgttattatggttattcacgtaattgcgcgggaaatatatcggttcatttaattatatagtcgtcatactagaatcataacctttttttattattttataaggacttcatccaattgcgcgggaaatggttcacggtgcaatcttgattatatatcactcttatgtttgcacacaggttagtggttgtataaaggttgagagggtgtgctttgcatgtgtacaccatctaggttggaatttgtcagcccgatgcaaaactttctttagtctaacgtactctgttatgttgattttatcagtattccttttcttattacgcgaactatggtaggcaactattgaatattggagtattactcatcaaatcgtggtacattacgatgctgtagtcgtaggagtacataataacataaacaagaaggacaaaactaagatgaactcagtttacatatctagagaagatatttccctcattatattgaacaactgttatgaccttatctactccctccgtcccaaaatatagtaagttttggttggatgggacgtatcctagtactacgaatctagacatgtctcatgtcgagattcatagtactaggatacatcacatccaaacaaaagttgctatatatattttgggacggatggagtatgttttagaaccaatttcatatatagagccatgtagccatgtaaccatgtcttaggggggcaccacaatataaccatagcgattacaatgtagcgtagacacgcagggagatgatggcggcgtggtcatggactcgtagcggctagtagctatattggttggagaaaaatatccataatcaaagccctggggatgtaagcttcagctgaacctcattaacaaattaatgtcgtgtgttcttatgtcgtcatctagcgtgttttaggtgatcaataactgaaacgatcgagaaagttagtcgtcgttctgctgtatcttttataacagaaatcacccgattgatcaattccagaggcaaggcgagttacaaaaattattcgatctctccagctacatattcaatttatcttttagaaaaatccattgcacattcccaactgctagcttaattattagaaaactgattaaaccggtagaaataaattgatgacttctagtaacaacttcaatagctagaaaacatcgatcagcaaagaaacgacagcaacactcatcatctccagctacatgcgtccatcagcatcacggcatcaagctagggtcaatgctagctcatgcatcggcaggaggagccccagcagcagcgttgttgctgttaccgttgttgatggcggcgccgttgccgttgctggcgatgttgccgccggcaggtggcgacggaggcgcctgttgctggtggtggcgacggcggcggcggcgaatgtaggtgtggagctgggcgaagagcgttgatctcctggcgtttgcacggttgatcctcccaatgatcctcagcagcacagcagggcccgggttgtttgcttgggtgaacctgaacagctgctcaagcctcctgatcgtctcatccaacaccctgatctgcatcacacacattttcgatcatcacacttacatcaacacacatatttatctgtgtgtagtacacacaatcatgtatgcataattgcatagacatgcatgatatgtataggagattttttatggtccagcaaattgtaccgctcggtaccagtacgcatctaccgttcgtttcggcatgggtaggatcggaagagagtagcgccagccatgcgttgaagcaatcaagtggcggcgagcggtggattccgacatacgttgaagcaggccgcggcggcggcatcgaactcgtccttcccagcgacagcggcgttgaagcaagcggcggcggtagcgaactcgtcgttcccggtggcggcggcgtcgatgtcgtccttcccggcggcagcggcgtcgatgtcgtccttcccgcggcggtagcggcggcgacgttgaagcaggcgacgccagcagcaaactcgttgttcccggcggcggtggcggcgtcgatgtcctcgttcccggcggcggcggcggcggcggcgatcgatcgagaatcccagcgcttctagggttcgagatgcccgtccatccctcccgatccggttattgcacgtgaagttacgtttttgcccttccacctcagttctccacgtggtactgcacagggacagaattggtaccgccggtaccaaactctaccagccgttggatcgggccagatccaacggccaggattttggtaccgggcagtaccggtaccgaccgctgtaccgtaacaacactctatgtatagatatgttacagaaacaaaaaaaaaggattgatgcaacaagtagatagaagatgagatgtgttactcatcgtatgagagatctctccaagactcggtcgatgtcgttgatctgtagatcaccgtcgccctgcaggccatgatggttgccgttgctgttgccgttaggagcggcggcggcggcggccatgatcgatacgagaccaaacttacagtactgattgttacagatgcaacacttgtgctcaagtttgaagatcgaggggtgctaactgctgcttatataagcgtttctaccaacaaaatagttaataaggctaattaatgtgtgatacacacatatacgtctgcagtgactggccacaagctgacgacggtatcccaagatttgtttttccaatcaatggtaaacataaattccagaattgataaagatctcgatttgattgctttgcttgattgaaatccaagtgtatatatcgtcaaaattgccatcatgtcccggcatagacaatgttaaaatgctccatttttatttctttattttttttagaaaatgtcattgatgcagttcacagaaaattagtaagtacatctagaacaatcggtttcatattcattacatttctcatgaaacaaaagaagataatcatgaaaggatggttaagttcagggacattttctaggttccgatgaagctatgtgtaccacagtcctgattttagttgaaactttgaaatgttgaaacatgtttagtacactaatagcaacgtacccagtcaatttttcaagagcatatatcactttacattggagggtacgcatatagtaataatagtgtacattacataattggattttctctcttgtgtgtgcccccccccccccaaagcgtgcgtgtagttttgtatgtgcgccccccccctccccccagtgcgcgtgtggttttttttgtgtgtgtgtttgggatgaggtgggaggtagtgtgtgggtgtgggggatagaacgtttatgtatgtgggtaaaagtgtatcgtacaattctatatatagaacatatttgagaacatatgtatatatgcacgtttatttgaatcaatgtaggtgcgtgggtaatttatttgttaatcattctttttttaagacaacaaatataatcagaaagagtcaatttaacccatgcactatctgtccacgaagcacccgtgcaattgcgcagaaaattttattatttcgaataaatccgtgcactatctatctagcgcgagatacgtactctgacttcaacaggaacgggagggaggaagagctggactgagaagggaggatatgcatcttctgactttggctaggagcggtaacacataacacgggaaggagaagaggcgagattgacctatgtaacacatgacatgggaatgagaagatgcgagattggaaacgggataagaaacagaaaatgtgtcgtcctgtagcatggacctcccacttcacgcgttgttgtctgctgtcacccgttgtcgcccgtccgttgcaaccgacgagccatcctccctcgcttttgctgccgcccccgctaccgcccgcatcagcttgccaatgttagagcaaggataatagtgggctataaacaagctatatgcttatgtggaagagagagataaataaaagtgtggagtgttggctctcatgcaagagctaactgcacacaaactctaagaaatatgtattaaattcatggtgagagaaagagagaggatgaagaaaataaagatagccttatagccaacctgctatacatgttagctttaacattgactaatagtaactagtgagctctactattaaacttgctcttagcctcctgttaccgtttgttgacgtcgtcctcccgctgccaatgatgccatcccttgcagccgtcggtctcctactgccgccgatgccacccgcgctggcctcctagtgtagttccccgcgtcggatgtcacctcccgccatcagctactcgacgccggatctagccgtgggggcaccggatctggtcggtgcagcactagatccaccacctcacgccagagttcgctgtcgtagcccctccggcttcccaagctccacgtagcctccctcgcgtcggagacggagtgtcgcggaggtctagccagaattttcacaaaagaatttagtaataaatccaaaatttatagttttgcagggtaaaaaaaaacacaataaaactttcattatatgtcatcaagcaatcattttaatagttcatccagaaaataattttaataaagtagaagtgatttagaagttaaaatgggaataactttgtatcggacagcatctaatggacggaactaaatcaatatattaaccttgatgttttattttttttttcgatgggatcacaaaagaagagtatgagctctgcgatgggtttttgcggaatgggggccaacgcgtttgtgcacacttctcagcacgtggtttgacctgctataatcggacgggtgagataagagttgcaagattagaccaaccagtgacggtgagattagagctacacgattaaaataaggatgtgactacacagcgagtggtagctgtattgtctaaaccagctaccactccatatatgagagaccctatccacctatacttcaaataaaaatttttcttaaactacttatccgatctacgatccgattacaccgttgtgttcataacaattaaatctttataacaagatctcacatgattatattttgatgaaaaaacataaattacttttatagtatatctaaattacttttagatttcactaaattacttcttagacatataaaaataaattcaataaaacctaaaattaatttgcatatattatagaagtaacttataacaaaaggagtgtaactttaatgcatgtcttttttttattggacgtgactacacagatagtggtagctggtttgtactccatctcctttgaacttgaaaaatgtaataatatgtatcttttttaatttctttaataacttatatctttttaaaaaggtacactggtgggcaaatgcctggtagtattcatttcaaaaaaaacttatgtcttttagatcacatattacttctaatgtcgtgataaagttacttccattttgttttaagttacttttataatatatgtaaattacttttagactttattgaatttacttttatatgactaagaaataatttagtcatatctaaaagtaacttatatatatatgataaaagtaacttacatatataataaaagtaatttataaatataaatattttttcatcgtaatataatcatgcaagatcttgttgtgaagatttaattgtaacgaatacaatggtgtaatcggattatagatcggataagtaatttaagagaaaactttatttgaataggaaaaagatatacatgtctattgagaaataaggcacacactatatcaatccttctcgttgcgccattacagcgtggccacgtggatggacgataggcgcgatcgatcggctatgaaacgcgtcgcgtgatacgactaaagcgagaagcctctcagtttagattttatgttaaaacaactagtgcacaccgtttagattttcataaattcatacagagaatcgatggtcgacgctctagcaaaatcatcgcactacaattagggtgtgttttagaattgaaaaaaataataaaagggatgtgcttctgtgctctggaaaaaaaaaacttgcacttaattaaaagggagattagcacttaattatcattagtgagggggtaatttcgtgcaaagattttcgagcccatatccagctcagtccatctgaagcgatccccaccccctactaacggcaccgccacgccgattttcgccttgccgtcgctgctctgccttcttcttcagttaaaaggatatctgagtagctatggcttgagtgacagtaaattcagtttcagccttaaattgtctcctcaaagatttgccttcaagttacagaacagagtcaataccttattgctgcaacccgacttgcaaatttggttgtacatatttacaagcaccatgaaaacctcatatgcagtctcagcgctgccacttttcaatagaattgagagaatggcattcgcaataggtgacgatggttgggcgacgccgccgacgcgcgggttgtggaggagcgatggcagcaccgacggtggcggagggaggcaggaagcagcgtggggagggagccgggcggcaaggcggcgttgcgaggggaagaagagggcagagcaacggtggcaaggcgaaaatcatcgcggcggtgcggttgaggagcggcgccgtggtggactgatgggggtggggatcggactgggctggatatgggctcgaaaatctttagacgaaattacccctcgctaatgataattaagtgctaatctcccttttaatcacagccactgattcgctttaactttcgtgcaagtttttttttcggagcatagaagcacatcccgtaataaaaagattgataatatacacaacacaagataagtcactagtacatataattaattaagtatttaattatatcaaacttgaaaatggattaaattttttaaaacttttctataggaaaattttgaaggaaaaaaagcactatttaaccttcaggaagcgtaagtgtaaaaaacgagggatttttctcccccttgtgcttttctcaaacacagccttagagcagatagaaataatataacaagaacagtaattcatgtcaataaacgatccggagggacagaagcatgacacagaacaaattcatgtctgcccaaacttcacttattcataatttgtaagtatgaaaccacatgcaaattgatacacagctggagggtaaaggaaatcatagccagccccatagcactccatttttgtgaacaaagtctctactccagttttgcagttggcacaaatacaatattttcacgataaagatcgggtagcactctactgcctcaagctttgcaagatatattgcgcatacaggtccctgagattaaataaacaaaaatatgtgtcaatatatgccaaaaggaatagtggtatcttcatacctattccacaacacacacaatcacatcttgttatggacttatatttcactgcagaacagagaacttacatggagtactgaatggcgtcacgagcagtgttggcaggcaagaatgcatcaacagcaacctccttgttctcattcttcttgtctaaaaacatattgttaaggacaataacagatgtatgcatgaccaatactatactatatgggatatgcaatttaaaccataaaacggactatgaggatacagtcttcaaagaagcgtttaatctcttggaggcggtgaggagacagctcactgatgtcattgtaatgacggtattcaggatcatcagcacatactgctattatcttgtcatccttctcaccctgatcacaaaatccaatatcgtcagtaaaaaaaaaacaaaacaaaaagagtgaacccgtgcaggtctttttccctttgctacaaacagaacagtagaaaatatacctggtcaatcatgggcataaggccaattgctctagcacggaggaaggaaccaggaataacaggctcctgtgtggattaaaagaacacattaccacgagataatggcacaatatattccacactgtagtaaaaaagagaatggttttgaggtgcaactaaaaaactactggtgcttgttcaaaagtgtcaatgccaaaggacttgcaggctgatcccctgctctcagacactatcagttaataatgcaaaggactgttttgcatgtttaaaagaaaagaagcacaatggagttacctgcatcaggaccagaacatccattggatcattgtcttcacaaagtgtccttggaatgaaaccataattatggggatacacaactgatgagtataggacacggtcgacctgtcaaattatgaagcacaggtacaaaaatgtaatattctttgacaagaataaactcctacagcttacaaatgcagacctatcaaataatacaacacagtaacacaagtacatggtggtggtgcatacttttaattccttacgtaagtacacaaaaaataattatgaaattagtccatattgttcttgaaatagagttgtggtaatgatatgcaagcaatcattttacaaatagaacacacaccttaatcagtccagttttcttgtcaagctcatatttcactttgcttcccttggtgatctcaacaacctgtggtgtgatataaatggaagccattaaccatgtaggttgcatgcactgtcaggaaccgactgtagataaagcttctagaatcgttaaacagaacaatcaaaaccactcgacacacttgttttgactcataagcaattgtttcccagcagactaacattccttgttgtttacccccacaaaaaaaaaatccttgttgtttgcaccagaatcaaatatcagtaaagttaaaatattcagtgaaaatcttaatagtagaaaaagggggaaaggtgaaattcacaacgtgcccatgagtctactagtggttctattttaattcgaatcaaaatcctagctacaatttatccaaaggtataaacagttcaagaagcataaaattcccatggcagcatatggctacacctaccagtctgccacctaatacacatcatcctgctactaccaagatttacagaaggcacatgctgcgcccacaaaagatagatgcttgatgccatgatatcaacaaagttgctgagaaactgatggagatcagcagaaggtttagaaatgttaagaacttataaatgtaagtacttttccaactaggtttatttatgattggcatctgttgttccatggcttgatcaatccacttaaagttccaggtttggtgcaataccaaggatgttgcaactgtctttaatttttgtttaacttaaattcagtggcccccattctcttgcctgattaaattggtatgaagagctgaattctaattattcattcatcatgctctttgcctggtgagtgaatttctttattccttgagagtgtcatgttacttctttgtaactggaaagtacaacacctattgaactgtaaatttagcaaacaccaaaagctgtcgcggacctctacagagtcgatattaattggacagatattatttccgatttcaacatgtttcaacccgtctagcggcaaaattgtgcagcctacagcccgccaaggaaacttattttgcacgcactctggcatcatatgtataggtaaaggcagagatgacacttacaacgttgaagacagcaggagcaccagggcctgttgaaccaaattaagtgagatgatgcatgccacatagtgttgtgggtgagccataaagagagatgggaaagacagttccataccgatctcaagatcatgccacggatgtgcagctactgatctcctcgacaaggaggacaggatcctctcgttgagcttaggggcgcgcctgggctgcccagcagcagcattggtgtcctcttcactcatcctcctatgatcatatcataataggaaccatagatcaagcatcaatatagctgctatcagaatgaaaaaaaaaatatatttttaattagcttgagctgcagcctagcaggtcgagcaaacatctagcaaaaagcagagttgcaacttgcaaagttgctttcttttcccctaccggaactaaatacagtcaagctgtatacagtatacaaccccctgacctgaggctaacatccatgagatgagcatccgaacaagatacagtcgttgatccgattgatcttaacacctacctactacactcagatcagatccagggtcatgtatgaaccccacccaatccctttggaagcagaaaccaaatccgcaacaaactaaactcgatgtaatatagcttccgctcagattggacgcaacccacagaaaataaatccaagtcctgagaaatagcgcggatgaggagggggaagggagaggataccttggattggagtggcggctgaaggggtggaaggtggcggcggcggcgaagaaaaagaagaaatgaaatgattcctgcactgcactgcaccctccgtctgaggaaacagtattaaagacgggtgggatgacaatttctacttaactccctccttccaacgttttaatacaaaatgagcccctaatggaagtacttgtgctaaggctagtgcgcgtcttgtgtgccaatctttggactgggagctcccatgttttggcagcaagtgggaatatccaatatcgcccctgaactttatatactcatcactaagggagaaactttttattctttctttgtgatggtagaaaatcatgtccctttcaaggcttttgttttaaaatgttttatttgagaggaattgcttgaaattacttgcacctgctcaactagtacactactgaattaaagttgacctgatgcggtttgtgttggtcatcgcattcgcagacaggccgatcaacattcgaaaaagggctcgggacattgcctgccgagttggttggtagtacagtgttccaatcgatccccatgtccatccatgtgggctcttgtttgacagcgccaagctcagttcaagtggattcgattagatcgcgattccatatttccatgccgttttggagttaactcggtttttggtcggtcacacaggtaaactagaaggcaggttgaccgctccaagctgcatagtccttctcacgatgctcttttctgatcctcaagacgctcgagcatccaatgctctcttctgttgtccgtagtacttctactcagctatctcagctacaagagtggatatcacacagaattttgactgcgtttgttcgtgtgatataggggtgcgtttttttacaaaaattttctataggaaagttactttaaaaagtcatattaatctatttttgatatttaaaatagttaatactcaattaatcatgcgctaatggctcacctcgttttgcatatcttcccaatctccttttcctcaaacacacccttatactctagtagtaaattattaggattttttttatcttattttctttctttcttgcttgcttgtgtggaaatgtgaaaattgagcgtctcgcttacaaatattacaaaagtatgggcgaaatgaagaagcaaaacggcaacggaaaaaaaatgaaacaaaaagaaggtatagtggtcaccgttgtgccagtaggtactagaccttttcatgtcgtgattcagcaacgttgttggagactcgagtggagaaggcgttgttggagtgcagcctgtcgccataagattggaggaaacgcgcagtttgtcagtgtgcggtgtgcctgagttgcggctcaacttgagacgacgtccgaggtaaagaaagcgtcgacagacgttgccggctcacaacggaggtggaggtaggtatgaaaacggagcggatagtttttagatattttggatacggatacgaatacgaatattttttcccggatacgaatacgaatatgatatcagggtttccgtcggatacggataatatttcggatatccggtgaacagtgctattcggatatccgcaagacccatgagacatacctcatttctttctaactctataaccttcaatatacctttatagattttaatagtagtttatctcttaacactagtccatactattaatattatttaaattttaagaaatatttataaattatacctcattttatataaaatgagctaattatatatgttgatatttgtttctattagaagttgagttggttttcgtgttccgagaaaaatttgtttccatattcgtgtccgatcacattcgattcttattcgtattcgagataatccgtatttgtttccgtattcgagctatccatattcgtttttgtatccggtaaaaaaaaatgaaaacgaatatggtatgagaattatccgaccgtatccgctccgttttcatccttaggtggaggcagagacggcggcccaatgggacggattcgtcgcaaagaaggtaaaggcggggacgtcatttgagttgggtagagtcgccaccacctattgcggacatcgggattagacggtgtcgcagcgctaggtaaagatataggtatttggtatgcttgtgtaatgtatcgaactgttaatgggcctattggacctgctgggagtaattcagtcaatctagttaactgaggttggtaattgaataaaattcggttagttagatcgtaagatcaaatcagtggccgagttttttaattttacaaggatgccacttgaacgataattttgacgatatttttgtaattttatagcggtaatcttataataacgattcaaaccaataataaatttataattgccccctttttttccaccactgggttatagattgagatcctagcgagttggttatgataaacttttccacaagtgatcgagagagagagagagagatggtacagtgaccgtgctagtagtccaattctcatgcccccatgtgggctcattcatgtttgacagcagcaggctttgcctcctcactcctgactatagatagatagctcgaccatactagtactatactgtactgtatatcgattcgattgcgattgcgattccatggcgttttggactcaaactcggttttttcggtcggtcggtcacacaggtaacaacagccaagtttactgctccagggaggctcgcaaataattacacgacgctcgagcatccaatgcagtgctctctcttctactactcttccttacctagctagtactcctacttgcccatctcagctagtacaagcgtggagatggatcatacacagaatttatactccagtactagtcgtaaattaattatcatcttgtcttatttctttctacaaggcgatcgagtacttgcttgcttacagttacagacactagaaaagtactccatgggcgaaatgaagaggtaaaacagcagcgaatggaacagaaaggaagcatggtggtggtcgtcgtggcatggatggcgtctagtgttagtagcaactcttctcattattactgtactggccatcagcttttgctgctaacgctaatagcctctctcatctcagtatattcatcagtaaaaagcaatggactgctgcttgtgcaggtgagggagtgagcgagcactatactagtagtggtaagagaagagagaaatctaagagagagagagagagagagatggatcatcaccagcaccacgagcagcagcagcagcggatggtggagatgcggatggggatggcgatgggc

SEQ ID NO: 7586 - DNA, 4610 bp, Oryza sativa
acctctgggcccccgccggcctcttctccctcgcccacctcgctttttacgccgccgtcgcacaccacctccgatgcctcaacggattcaggtcgctctaattgcctcttgcttaatttgcttgctactacttaattacttgcttacttacttagcagcaattaatggcgcgcgaatgaatatactaggtaccagcggcgttgccacaagctgaccctggcgctggcggcggacaggctgcggatgctcaagtccggcggcgacgtggtggcggccgccgacgtggaggtgccgtaccaggagccgcccgagagctacctggccaagttcaagcgcagctgggccatccacttcgccttcctcatcaccaccttcgccttctccgtcgccgccgccgtcgccatcctctgcttctagctctcagatctcctctcaactggactactcctccaatccaatcttactagtaggagattttgattgatcatcagatcagatgatggaagagtcgttcgttgtttatctctactgtaatccctccctctctttctctttcttgtcgtattcattgtgatttattagtagaatgttctatgttaattgcccttcagcgagaggccctcacatgcattatctcaattgtcagccagtgtcacattcactcgctcaaatcgcggcagcagccagcagccactgtggcaaaagcaactgtatttatccttaactacagtatctagtactatgatctctcttggagattggttagtttgtgagtaaaagctgccaagcttgttgctatcattattgatgtttatgcaaccaacgtcgcttttaagtaccacggcgacgatttcattgtaccaatagtacatatttcttggttccagtcctgctttctcccggccaaatcataacataaacccaaagacaacatgacgccacatcgtccagacaattgtttaggttaatcaaatcgtcattagttagagcttgttacacagtgccgcacaacacatgacacaagaagaaacggcaaacacaggtgataggctcttcaatcaacttttctcatattgtttgtgtaaaagtgtgtttctgtgaacagtgtttgttttattcgctcaaggaataggaaatcaaatcaaatgaaggaatagatgtttgttacagtgattagtagtacgtacatgtttgttacaacagcacaaatccccttccttctctgagcttggtgagttggtgaactgaatgtgtcatccgattgatgctctgaaacaatgcagcagcttcatgcttggccttgtcagctacaagccttgaaatgctgttgctgcgagttcacagcctccagcaactgcaagcttgaaccaccatcgatgcaagaggaaagctaagcagccttgaggacattgcagatagaattgtatgcgttgacacaaagcttaaacttctcttcggccacggcctgggcacatgtaaaacagagtatgcagttataccctctgtttagtgtttaccaacttaccatccgttgttttgcacattgatttgttacagaccaatcagtacattggctgcatcaagacaatgtcgtatgctgttgtttactccaaatcaaacaagaaggaaagggttacctgtgatgagcctgggtgcttgtcagggtgccacctcagagcagatgcccggaaactgcacaccgaaagtaattcaggtgaacgctagtggagcacctacttgtagtgccatacagaaatggtagtgatagcaagacaataattcgaggaatggtacaaaaattcacaacttacgcagttttgacagcatctagagttagtggaccacaagctggtagtccaagaatagcccggtgtgcatgtgacccaatgttggttgtttcatcctcattttcatcgtcactatcgctacaaactctttctctcttcgattcaccagtccttcgaaatctggacgatgaatctctgaagctaaaactctcccacgatatatgggaccaggtaaaacgatgattctcaccgaacatgtcttcaaagattttgtcaggatgcacataatactcctcacggaagaaattgtagaacctctccctgtcttttttacctgcaaaatattataagaacattctcacctatgtgacatttatggtgttctgtaaactaatttgaagtgatctgagtgggtcacagcaacagcacaaatccatgtgacacaacaaactgcagtcgaattatgcatgctctgcaggtcactaaaatatgaagtatgaacagaccagtatgtttttgcaccattttcaagtcaataaataacatcctgatatgtgcagttacagatatgcagaaaaggtaatagcagaaataacatagcaaaaagcctagagctgcatttggtttaaggagcagggttaatatgtcggttaggggttcaacccacacagacacctcctactcctcaacttaaccagttcagacttgtaatcatactaatgcatgataaagttaaccgaccacggatgaccttaagataccactggagcggcagataaattatgaatgcgatacatgatagtatgatacatcagagatgctcaaaaccagacgaatagattcaagtgaaggtagtacgcgtctattttcgttttggaagaggaacatacattttctgtgatggtgtacaccttgtcgcgactttgttgagccatgagactgagatcctttcctaaaggttttgaatcgtgggatatcatgcgaattagcaaagctgcccgtacttccaccctggataaacacatgtaatattgcgacatcaaatgttattgggtgtttttgcaaatatcttatcctaaaagaaataaagtattaccatcaaaagctttttgaagagtaaatagattatttgtgctagttagaggaaggacaaaaatctggaaatgacaactcaaaacagaaattctcacctgtaaatgaggtgaactctttccaaatagaagataatcttttagggcctttttaccttctgctcgtttttgacgaacaacatacctctcgtagttctgttgcaaaattatttgtcagaacaatcgtcttactgagagtttggaaggtcaaaagtattgcaagaatgaaacaaaagtattgcattatcaacattcagaagcataatcaatgtggcttatataataggaagggcagaaaatattgatattattgataagataaataaaaggccagctactcgtgtgctacagttccttaacataattcggcttggctacttgccaacccctctagaagatcaatattatacttgttttaaccatagtcacaggaaacggggtcggtggcagcgatcctcgacccgggaacgccgtccccgtcccgaaaacgcggggtcattttcgtccccaccttgtaaaaacctctcgcaagtagcgtatcacgttcctcgaccccattccttgatcccatcgacccaggaactttgtgactatggttttaacaaaaccatattttggtagtccagctagaaaaccataaaatttaattgaaggaaaaaggttttgattattcatatgagaaagcaggtaccctgaagaaaaatgtcaaattaataaaatacatctgagaaccattccttgtggcacctattagtatcataatggagcactgatattgaatacactagttcttttcttgcatcaagcatcaacccaaactgctaatttgagtttctgtctttcgagagagttgacgttaacaattaatcagttccatcaggtggtcggtacaaaggaagatatcaaatcataccttggatagcttccgcgctccatgttcatgctgaataatgcattggcagcaagaagattgtgttagcacacaagctatgcatatagggaaaaaggcaaaacatgaatgatgtaaatcgtatttatcacactatcaagtaaaatggtcgtgattctagagacaatgaacccaatgttcatgatcacttattgatatcattgacatggtctagttacttaaaatgttattgcaattatgacgtaacagtatagatattttgaatgtctatgggcaaactagatatgtgtgttctttcttactaaaactaacgaggcataatccatggccttatggcttgttccagattccaagtttggcaattaagtgtttggctgggtattgtagcatcccattgagaatttgagatgctttggtttgggaactgaaaataccaagttgcagaataagcatcgatcgattagcacagttgaaagtaccttaacagaatcggagtagccgggcatttctaaagcctaatatcaaagagcagcacgggcacgaaagccgccgggtatgttccttactcctgtgattacaggttgcaatccggtgagctcagtgccatttctttgggcacattgtgcacatggtgaatgaatcggttggtgtgggtggaatagaccaactggattatcacttatgctctcattctggccacatgacattgcttgcagcgcatctttatcctcgcctaacaagatgttggacaggattccgaaacgggtaggggggggggggggg

SEQ ID NO: 7587 - DNA, 16191 bp, Oryza sativa
  unsure (1)..(16191): unsure at all n locations
agggagggaaagaaaggaccttgcaatcgaacttgtccttccacttggcgaagaagacgggtgtggagtgaaagaaggacgcggcgagacgcgtgggatcgacgaggaggtgggtcgtccgtagcacggccctccatggcgccgcggcggcctgcatcgtagcggagaagaggggaacggatatggtggagaagcaaaggaaacctagctaattaggtagcgtgttcgccaactcctcctcctaacccgccattgaaaattggaagcatcttctgctacagtatattcgattctccctctccctcgccgccggccggccgcccgccgccgcttctcgatcggaatctcctctcctccgcgagaagtggaagaagaaattaggttgccttggtttaggcccatctgcctaattcaagtggatcttttatgggccgcacagtctggcccatgtgcttcttcttctctctctcgcttctactttgtcccggattgaagacttcattctcactaaaaaaatgaaatgaaagaaataaagagcaactactacactagcaacagaaatatcggatgatgagaactgagaagagagcatacacttttttgttttcatatctgagttaattgtactgtttttcccgtttggtttgctgatgatatctatagtgggtgagaagttgagggtgcttgcctaatttccaccaaactggcctttcttttgttccaacttatcaataacggttggccacatgcatacatacagaacagctagctagctaatatatatatgtgcattgcatagttatagttaaaagggaaaagggaaaaagggaaaggtagcaaagcatgatacctagctagatcaatcgatcgatcgatatatccataaggcatcagcctagctaactgtctggagatgcctaagctagatagctacatatatactgtaatgcactatccattatattgcaccgtaattatatactataagatgagcttttcatatgcgtcgattagtcgtgtatgcacagaaatgaaatgttatagtgcgtactagctacaaaattattaaagatgcatatatataagcctgcactcgatcagcactccggcctactacatgtttttgtggtacgtaagtgcgtcgctgtcaaataaagatcgatctagatctgctatctcttctagtaagttgtacgtatctatcgatcgatccatcaaggaacactaaataaaatggtgtttcttatggccgattaattagagctgatgtttcttatggccgattaaaatggacggtctgtatagctagagcctcgagataaagtatatagcttcccacttgcatctagctaattatgaaattaagtcagtcccagatcatgcatgaaacaaacgtacacagactctacctggagatcatatatataatatagatatatactatatatatgcacgtactaaccagctgaatctattctttcccatgtttctttctttctttaattcagttttctttcatcaaattaataaagttaattagtgacctggtcaaggctatggtacgttcagtaaagctgctttaccaatacccggaacctagatatgtgcatcgtatacacacgataattgttgggaccaaatgtcatgaagaaaatggggatagctagctaggccggaaaatactcttctccctgtttatccataagataaaagtgaacccgaggagtattcattggtactcatcgctactgtctcggtaaaaatataatctggtcttgctacagaatccagatggcttttatatagcctttcaaagatataatagtatatatctatattattatatagcccttcaaatctcagtaaaaatataattctgcacattaggacgactctctggacctctagctagtatcagcgtgtagaaatggttggagttgtccccctgcacctactaatggaatattaccgccgggccacgtagctatatatcaggcctcctcctcagcctggcaagttctatttgccctcctatagcaagctcaaatcccttctttctataaagttaaggtcaaaagcttaaacctcgtgcttccacgtcatcatcaaattatgaaccgttggatgaatacattagatcgcttctcagacgttcgatggaatgcagcatagagcccaacccatgccattagccaccggatgagtctcttcgcctcctcagtgccaaatgtggcccacatgaacacattggcccatctccacacacatctacatgtatccagcccatcaatccgcataaaagaactttatggctgaacacgtcttcagttgatatgtgctacctaaattatctataaattttggatagggttgctaaaaaaaatttctccaaaaaagctatttgtttctgccgtttcttcttaagattgtacctactatgtaacaaatgtgcggggcattctctagtaatatatgatgggtaaacacccagactcgaataggatttgatgggtaaacacaactttctcttgaacaacttctcttttgccttcatctaaacctgctagggaaacttcaagaagtattagccgttggttaagagtagctcgatgtcgtgttttggtcgaatacgtgaggtgtggcgtctagcctctgctacaataataatatattgtactccttaaatataagagattttggatgaatgaaatatatcctaatactactattactatgaatctatacactgtaaaaattcatagtacaaggatagtttgccggcccttccaaagccagcttgctagtctacatcaaattgaggggaaatgtacagaatctgactcaatgaaatgtgtttaatagtgagtaaaatctacacctcccaataacacacttgcgtggaataaagggatcgtatttttttccaggatttggttctgatgtcagcatatcaatgcgccattgctagctagtagaatatatgccgtttaccctggaactgatctcttttgtggtacgacgtgcaatactataatctctctaaaacttaattaacagggtaacctttcttttcatacggcaaacttgtgcgaataaatgatgaaaatggaggagggacctatgcattctatactctctttttttttcataacttattactccctccatccctaaatatttaacaccgttaacttttttaaacatgtttgaccgttcgtcttattaaaaaaattaagtaattattaattcttttcctatcatttgattcattgttaaatatacttttatatatacatatagttttacatatttcacaaaagttttttaataagatgaacggtcaaacatgtttaaaaattaacggcgttaaatatttaggggcggagggagtaattaattgcatcattcgtggctcatctcatagcatgcatactgcatactatatactagtacgaccacatatgtcgaaattaaagcggttgcaacttccctgaaagccatgggatgaaagctactggtagcacagcatgaagaagaagacaggaacaggaggggagcactttttgtttgaggcagacaagacgcatcgttttcatgctgcaacctcctatcaatcgatctctcaatgcacgcgcgcgtgtactagtgttatccatgtttctatgtggtttcatgtaagtaatctgcgtctatttttttctcttcttggcatgcagttgtactgctactagtgtggtagtatgattgattcaaacacatgcatggtgccacgggaagaaaactagagatgtcgtgtcacctttttttaaaatggggaaaagcagaaatttaacatcggtcggtcggtgtgtgtatcgtgcgtgcatgaatgaatgatgtgtataagcaagaaattaagcatgcagtggatggatggatcatcatgctgaatttggtatttgcaacctatagctcgcaagttaattaaagtcatgcgcgcgacttcagaagaagatcggatcgagcaaattagagcacgagttatggaatcttcacgtgcatcctagctagtccttcgtgttgattggtctgttgttgtttgatttgaataccatctcgatcgatcaccaattatgtacgtacgtatgactaacaaaatcacccggccggccggtcaccatgtacgacgacaccaccccacgtacgccaggtagctatagcagctattgaccaatgaccgatgactaaaattttgtgcacttactttaatacaaaattgacagttagactttaagtgattttgattaaattttagcttaaacgtcaagcatatataaccagagggactatatattatcaacaagatacatgtagacacctagccatgtaagagaacatgtgcatgctatattcatatatatgtccattattttcttcgacaaaaattggacgaagattaagattttcgtggcacactttttaaactgctaaacggtgtgtttcgtgcgaaaactttctatatgaaagttgctctaaaatatcgtattaatctattttcaagtttgcagtaattaaaacttaattaatcatacgttaataccacctcgttttacataaaaaaacataatctttatatttatctttaggagaaaagaacaccacctatggtagtataattgccccacaaaatacactgtattataaactgtcttttctttcccactgagctagtagctcgcaggagatgtcggtcactccataagttttaatcctttttatttttacacgagttaaaaaagacacgttagtacaaaaaatgaaggattccgatcacgggccacacgtgacaattgattttcactaaaaaaaagaccttttacgaggcctgtcctatttttattgatggccctcttagaatcccacctaataaattctaattttcacagagaacacccaaaaaatattgcctgcacactagaaccgcattaaaatagagcgccgcacagtcaaatacaccaagtccttccttgctagctctcactccctccttttctctcccctctcttgaccataatggcacctcctcctttctccagcttcccacctccgaaacgatgctaccagccttccttcacgctgtcctcctccgctctagtcttcctcttttgttgccctcgtttgctgcagaggattggtggccaccacgggtcatacaacacggttcaacggtaatgtgccagggaagatcagatctagcggctgttaatgaccaaatttggtaaattctatcactattggcgttgaaggtggaaatcagatcgaggtggaatccaagatgaagatcgttgcggaaacagagtaagaatcgactgtagtccaaatcggctaaggtcaggttggcagagttcgagtcgggcggggctagccgatacagccgattccgataatatgactcggcgtatgtcgtcgggttcaagttgatgtgcttcaaagatgactgccacgcatggatagagtcctaggaaggcaattgtatctattaattaggatattttgtgtaattttcttagagatatgtttgggcaaaagtctgccgtaaagacttatggtatcttagagtttgttagagataatagtcgtgtccgttatggacgtatcttgtaattctcgggtataagtagacccgagccctatgcaaaaaaaggactcatccaatacaatctcggcgcatcgccaccctttttgctttacttttatttcgacgagttcgtgctctcgggttgagctgcatcggtttcgatcttcaacaagaggtaaaacttgtcatgacgatttatgttatcaggattagtgcttccatccttatgatactctaatcttgtctatataattcgtcgagttatcatatatctcacataatcttcgataatatctctatctaacctataaccggctaacatctgttaatggaaggcagccgattaggttagacaatgatgttaacttagattatgtgatatatctaccactctatgaaacttccagcggcttgattgtctagatattgttcttcttttcatacttaatgctgcatcagttgagtttgatctattaagtcgtgcttagatttgcaatctctagcctgctttctggttgccgattaggtagtatcggagtttcagccgatcttatctgatttaactacttttattctatatgcttgatctatgtgttaaatctgccttttatgttaggatcttgtcgcatctaggtatattagacttatgtttggtatattctacttgctttaacatcttaatatagagtggtatcggagtattagccgatacatgctagatccatttgatcggctatgatataaatgtatctaatcccactattaatatatatttcgatttaagtgatttatactgtctcggcaaggcgaccgatccatcccaatcacttgatttaagtatatatcgatataaggattatatatcattaatatctatagccgatcgagtagatttagttctgatttgcttattgatatttgtcgatcgatgtacgcatgacatcggcttgaaataaatgatatgtcatcggcacctagccgatcggctatcatttataggattaattgcggtttctttgttctatttcttgttgattgcaggatcaaatcaactggcacgctcatacacccgaaggcgagttttggacctgcactggagttaagcagatctcccaggtctcgtgttttctgtcaacacgcttttggcacgcccagtgggacaaattagaagtcagaaatcaatcttcctcatgaccgagaagctaccaccgtcgccatcctcggctagtccgggtactgttaaagagacaatccaaaggttaggatttaacaaagtcaatgaagggaatattgtggctgttgatccggaaaagctcacacctgaccagaagaaggatttcgaagcaatgatgcaacaagcacgagaacagttcttcaggtcattcacacagactcgcaatggaacatttgttcaaaagtacaaggtaaaggtgattcccgatgagccggagaccagtatctctaaggaaggagaagaaaaaagagttttagatggctcggctcaagagaatcagggtgacggctctcagggggtacatgcagttcaaggtgatggtgcttatgagccacaaggaggaaatcttaatcagaatggtgagacagcacaagatttcttcaacaagatttcttcaacaatttccaagatcgagtggactacgccgtacacaacggtttgatcaatcaatctggagtgttagtcaacaccttgtctaacatgatgaagacgatagccgatgggtcaatagccgagcatcaagctgcaggcccggtctacttgccgagaggtgtttttccgaattatcgatctttgattactgatgttcagccgcttgctcaggcagttcttccaggtgcactatcggctcagccgatggcatcgccattgacttctttgcctgctccatcagcgtcgacaccaggtcagccgattaatcctcggctattgatgagggagtagccacagcatagcgggcagacggtaaatcggccagcacaggatcaggtggctgctatgtttccgcccctccaatctactgtcaattcgattcaacagactccactaaggcaataggttgtaccgccagttcagccaacagctccaggacaacaaactatacagccgattccgcagcaagccttgatgaatcaatcggctgggcaatcggctggacacgccctgaatcaggttgttccagagcatttggttcaccatatacagccagatggtacgatgatgcctcaaattgtgccggagcacttggtgcaaagtattcagccaaattaccagaattaccaagggggcaatataaattatcaatatcagcctccttcccctcaagttcagtatcagcaaggagggctaacccaaccccagtttgcttctcaatataattagtttgaaccaatacagcaacaatcgcaaggagcagttcaacaacgaccatgggccgatgtaattgccgatgtgatgagagaacaatttgggcttaagccgagagatactggaaaattgtatcggcaaccttaccctgagtggtttgagaaagtccctcttcccaaccgatttaagagtccagacttctccaaattttcgggacaggatggtgtgtcaacttatgaacacattagtcgatttttagctcagtgcggcgaagcatcggctgtagacgctctcagagtcagattattccgattgtccttgtctggatcggcttttacatggttttcttctttgccgtatggatcagtcaatagttgggctgatttgaagaagcagtttcatagctatttctacagtggagttcatgagatgaagttatccgacttaacggcaattaagcaaaggcatgatgaacctgttcatgagtatattcacaggttcagggagatgaggaacaagtgctttagcttaagtttgactgatgcccagttagccgatttggcttttcaaggcatgattcctccgattagggagaaattctcatatgaagattttgatagcctgtcgcatctcgtgcagaaggtaatattgcatgaacagaggtctgcagaggctaggagaagctctaagagggttaatcatgtctgcccttacatgtatggatcgaatgatgacgacgatgactccgaaatagctgcagtcgaatgggtaaggagtaaaaaggttataccttgtcagtgggtaaggaattctggaaaagaggagagatatgattttgatattaccaaagctgacaagatttttgatctgctactccggaagaagcaaattcaactccccgctggtcatgtaattccatcggctgaggaactaggcaaaaggaggtattgcaaatggcataattctggatctcattctactaatgattgcaaggtctttagacagcagattcaagtagccattgaaggggggaagattaagtttgatgattccaaaaagccgatgaaggtcgatggtaatcctttccccattaacatggtgcataccgttggtcggacagccgatgtgggacgagcgagaggttttcgcgtgaattcggctaaaattataaataagtatcagaggaaatgcgacaaacaacaagagaggcattatgaagaagataatgatggtttcgatcctcattggaattgtgagttctttcggttctgctggaacgaaggaattaggttaccatctattgaagactgtcctgggtgcagtaatattacagagagttcaagccgattgtacaaaagaggcaattggctgaagcaagccagagttcccgttcatcaaaggttgggcccggtaaatcaaaatgattacttggagggagacgagaacgcgaagactcagtggtgtccttctggtttttttacaaaaaatcatgaaagaagggttcaaagggtgaggaacagggagcgctttcaggaggtcgaacaaaaaattggtcatcggctgaggaaagcaaaagcaagaaagaggtggcatgttaagantcaagttcttggacccgatgatatgcaaccgacgaagctaaaaggtttgcaaaagggaaaagtattgtaccaacgccaattaacatggtctttactttgccagccgaattcgggattgatcaggccgatgttgacgaactggaagaggaatcggccaagttggttctatcaccagaacgagcagtctttgaaaagcctgaggggacagaaaatcggcatcttaaaccattgtatataaatggctatgtcaatgggaagccgatgtctaagatgatggtcgatggtggggctgcggtaaatttgatgccttatactacgttcagaaagttaggtagaactactgaggatctcatgaagacgaacatggtgcttaaagactttggtggcaacccatcggaaacaaagggtgttctgaatgtagaattgacagtcggcagtaaaacctatccctaccacattttttgtcatcgatgggaaaggttcttatagcttgttgcttggaagggattggattcatgccaattgttgtattccttcgaccatgcaccaatgcttgattcaatggcaaggcgacaaggttgagattgtgccagccgacaggtcagttaatgttgctagtgccgatctagctctttgggagatggatggccttgattgtttatccgggaagatttgggttggagattttctaaaagtgtccgattctgatatacagccgattgaagatgaagaacccaagctattattttgagggcgtcgtggagggttcaagcatctacgcccaggacacggtagatgatctcgatgacaagcaaggtcagggttttatgtcggccgatgatttagacgaagtggatataggtccaggtgatcgaccaaggccgacattcattagtaagaatttgtcttcagaatttagaaccaagctgatggagcttttgaaagagtttagagattgctttgcttgggagtattatgagatgccaggactcagccgatcgatcgtcgagcatcgattacctttaaaaccagggattagaccacaccagcagcctccgaggagatgcaaagccgatatgcttgaacctgtcaaggctgaaatcaaacgtttgtatgatgctggttttattcatccttgccggtatgctgaatgggtttctagtatagttcctgttatcaagaaaaatggtaaggtgagggtctgcattgatttcagggatttgaataaagctaccccgaaggatgaatatccgatgccagtggccgatcagttggttgatgctgcttcaggacataagatactaagttttatggatgggaacgcggggtataatcaaatctttatgaccgaagaagatatccataagacggtcttcagatgtcctggtgcaatcggcttgttcgaatgggttgtaatgactttcggcttaaagagcgctggagctacgtaccagagggctatgaattatatatatcatgatctgatcggatggttggttgaggtctatattgatgatgtggttgttaaatccagagaaatcgaggaccacatagccgacttgagaaaagttttcgagaggactaggaaatatggtctgaagatgaatccgacaaaatgtgcttttggtgtatcggctggccagttcttgggatttcttgttcatgagagggggattgaaatacctcagaggagtatcaatgcgatcaaaaagattaagcctccgggaaacaagacagagttgcaggagatgatcggcaaaattaattttgttcgaaggtttatttctaatttgtctggaaaactggaaccttttacaccattgttaagattgagagccgatcagcaattcacttggggggcagaacaacagaaagctttggataatattaaagaatatttaagttctcctccagtattgattcctccacaaaaagggattcctttctggttatatttgtcggccggtgataagtcaatcggctcggtcttgattcaggagcttgaaggaaaagagagggttgtgttttatttaagccgtcggctcttggatgcagaaacaaggtattctcctgtggagaaattatgtttgtgtttatatttctcttgcactaagttgaggcattacttgttgtccaatgaatgcactgtggtgtgtaaagccgatgtgattaagtacatgttatcggctccgattttaaaagtgagagttggcaagtggatattttctttaacggagtttgatcttcggcacgaatcaccaaaggcgattaagggacaggctgtagccgattttattgtgggtcatcgtgatggttcaatcggtttggttgacattatgccttgggtattattctttgatggatctgtatgcagtcatggttatggtatcggcttggttataattgcgccttggggggcaagttttgaatttgcctatgctattacacaccatgtgactaataatcaggctgagtatgaggcggttttaaaagggttacagttgcttcaggaagttgcagccgatgctattgaaatcatgggtgattcgttgttggtgattagtcaattggcaggagagtatgaatgcaaggatgatacattgatggtttattacgaaaagtgtcgaacgttgataagtgaatttcggctggtgactctgaggcatatatctcgagaacagaatatagaggctaatgatttgtctcaaggagcgtcgggatataagccaatgacaaaagatatcgagatagagattgctacaattacagccgatgattggagatatgatgtgtttcagtatttacagaatccatctcaatcggctttacggaaattgcgttataaggctttgaaatatactttattggatgatgacctctattatcggacgattgatggggtgttgcttaaatgtttgagtgccgatcaggcaaaagttgcaatcggtgaaattcatgaagggatatgtggtacacatcagtcggctcataaaatgaagtggttgctccgacgtgctggatatttttggccaacaatgctggaggattgtttcagatattataaaggttgtcaagattgtcagaaatttggagcgatccaaagggcgccggcatcggctatgaatcctattattcaaccgtggccttttagaggttggggaattgatatgatcggtatgagatgataaaagtatcttactggtggagctggtttaagggtcgaagtagccgatctcttcctcacagcgattttctttctctatgtttattaaaattgtgaggaatcggctataaagtaaatgactgcaaaagtggacggagaaagttgcttacctttgccaattgagctgaagcagaaggggatggatgagcctgcttaggtgaagccgatggtgttctttcagtatcgcttatttcggctgcagcctggtcgatgtcttcctcgatttcttcttcatccaaagcctgttcaatggatggatctagggcgggcagatcgtcagctgacttagctttctttgttttagtttttttcttcggaaccggggctgaagtatctgcagccgatgatctggttctccgcttcttgctgacatcagctggttctctgatgagcccttgaagaagtgctgaagacttgggggcatttaagccgatggtagaaggagatggcccacctccatttggaattagacccggagcatacttaatgaccttgtcgctattgctctggcgaggaggagaagattctgttgtctgcaaaacagaagaaaagttagtcaaggtttaaatcggctgagtgattattcaagtaagattgaagaaatgaagattaacctgagggatagcatcagggaataagtctatcatgtacatggaagccgattgatggaacagatgcagcttccattcaccgcaccatctgtcaaacgccctactcctgaaccttgccagctttatgttctcgatgctgcccaacggaggtccagggatgttcaacagccgatccatcattaaagttgaggagatgtcacctctgcattggatcttgtcggcaaagtacaggccgattggcaattgtcctattccaagttgtctggccgatgacatcggatgataaaactcataggagacttggatatttctcccttgatggatgccgactgggaggatacatgggttgatagcagtagtaaagatttctctggattgctgaaatttttcatgattaatatcctcgaacctgaaatcggctggcagttcgaaatccattgagtcagcatagaaaaaccaaactcgggcatctttttggaatccatcataaaagctgaagaaccagtccttcagaagttcagccgataactttgctcctgcatcggctggtgtagatgcatattctccgtatgacatacatctgcgatgggtgcgttcttctccatcatcttccacaatcggctccaaccttggaaattcagcttctgtcacagatggccgattgacaactttcatgactaccaggttcagccaggattgcaagagccaccatggtccacctgctccaaccactgagccgataattatcttggccaatgcgttgtttaatatctggtaaagatagccgagaaggattttgcctaagggaaattgtttcttcgttgctagggcctcggctatgaattgccagttggttgtaggaccgcagcttgatccgcagaaaaggaatttttccaaccacatcagcaaaaaagctacgtgttctctaggagtgactggccctttgcccatatatgctgtgatatatcctgaccaacccccaatgctcttagttttgaactcaaaagtgctcttggtgttcaggttcatggggttagctgatgaggttacatctaggctagtgagcatgataatatccagcagcgttggggtcatcggcccttggttgaaaagaaaagcattgagagtgttggaccagaaataagttgcagcagccatcgggggttcatctttggccgaatttgctattgtgagggctagggcttggctgattccgatctcatcccaatgggcttgtttgctagccgatatccgcgtataccatgcgggccagcttttctccagagaaggccaggatttgaaggtgtttttccaatggcttgtgtttggattggccgacctaaaaggggttctgttggtttcggctatgataaactcagtggtgtctagattgccgattggactgagaaagtattgttggtcatgcaacagactgggaaccgcaacaagattggaaagatgctacatgaatagagaagaagaaaacaagataaggtgagcgaaaactggtctgatgaacgcaaaaggggatctagccgatggggacttacctcagcatattcggctgatggtgcggtggtcggattggtggaggtcgacatcgccgcgggtgaagatctggctgggagtggaattgcctggaaatcgccctgcgcgtcgagtaggttgccggagagagagaggacgggatctgtttaagcggtgaagatggaaatcacggtgtgaagatttttgggggcaacggttagtatttaaagtagagcgataacggtcgggaagacaacaagtgcgagtttctttcagagtcggtatatggcaaatccgaaacattatccaatataccggacttggggggcatgtgttaacgaccaaatttggtaaattctatcactattggcgtcgaaggtgaaaatcagatcgaggtggaatccaagatgaagatcgttgcggaaacagagtaagaatcgcctgcagtccaaatcggctaaggtcaggtcggcagagttcgagtcggacggggctagccgatacagccgattccgataatatgactcggcgtatgtcgtcgggttcaagttgatgtgcttcaaagatgattgccacgcatggatagagtcctggaaaggcaattgtatctattaattaggatattttgtgtaatttccttagagatatgtgtagcgcccgttccgtcgtggcgcctagcgggaaaattatctcttaaaaaccctaattgcgaaatttgtttctttgcttgctgtctagtgtccgtgccatctcaaatctcaatccccgatctatcgtcgagtccaattccgaatccaaatccttccaaatcaaatccctccgcagaagtctattttgcctcccccggggtcgagggggcccttttatctaggtccatataggcctctcatctccatctgagactacatcagcctggacttaattgcccatattactatcagcattttgggcaaaaccaacaagtctctaggagtttccaactttcccacatcttcctgtcttcttctgagccctccaatctgtagcaacctctgcctgttgaccagttacaaagttgcttccacatttttgggtgtccctatagcggggccttactgcctcgggaccaatgtactgtattcatcagttctcacgctgctatgaagaaatatctgagactggataatttataaagacaagaggtttaacttactctcagttctgcattgctggggaagcctcaggaaacttac

SEQ ID NO: 7588 - DNA, 2005 bp, Oryza sativa
  unsure (1)..(2005): unsure at all n locations
atctcggtgtggatgttgcagtaaaatttcttagatctgaacatgttaccgattcttcgaaagtggagttcttgcaagaaataatgattttaaagtaagctttcttttgaaatcactttgatgcatagacttgactttgaatcatttaaaattccagataattctaatacagtgaagtcatgtccaggagtgttgatcatgaaaatgttgtccaattttatggagcttgcacaaagcatcgaaagtatctcattgtaacaggtgacacaaatattgctgataatcttgcctgctgatttttttcgtaggaatcaaaatccttgtttctcaagattcagatagcagtgcttgggcatatttacaatctgagtagcgttggtggctaaaagattgagctcatgtctgggtataaccaatgtgcttggtttttcatctccagtttccttggcatctaatgtaaataactgttgattgaacatttttagttttgcattttggtgagcgtcattaggtggaattgttaaaaacaaaaaatctcgaaagacgggggataactcctgtcttttatccattttggtagggacttcaagagcagctaagtctataggagggatactgtaaccattacatttgcttgttgcgtccatgcataaagaattctacaccatgatggaaaatagtgcaagatatgtctggtcagaagaatattgctactctattcctatcaacaggtctctacccacccttcaattagcctgtgaattactactttctaattcatgcatgtgaaataagtcttcgttcctaatgagcacacaaattttcattttctaaattaccagccaaatttctgtatttgtttacacatcacatgagtatttttttctattattgtattgcaaggcgatgagttctgggcccctaactgcaaagttcatataaactcatcctgtatagcacctataaataaagagatgctatccacgatttataagatacatgtatcatccacacgttttaacttgacattaagttattgagattactcccattgcataattgaatagcagtaaagattgttgtgcaaatcttgctgtaattaaaatattagatgttttgagagcttattangaggggttaattcatttactgcaagtgacttgtgttcagaatcccactaaactcttttctagtcactaaaaaaagatattgtgcatctctttactgaatcatcgtttcacatgggagtttggttaaatatttcgtacagtctagtctttatttattcacaagatgacaagaattatactttttttttataatggacaagaattgcatggatagtaaataaataattacttatgtacaatactgttattctgttcccttgcatgccataggatttcttacataatatcaagagccagcgatctagatgagttaagttagtagtagtatcattgtagccatgagatcatttatatatttatcttactgcttttttagggaaaaaaatgtttgtatgtgtcagttccgatttccaactttccaagggtgcactctgttttcttgcttcaatcccacaaacgagcataggccatggattgcttgtttgtatttttatgtattgagttttccgaattgatcaagtcagctcaatgtagagcatttatctatctagggtattattatcgggcaatttcttttctgcgattatttcatgtcaactgatattttgctttgttatttgtgtgtctcatccagagtacatgcccggaggtaatttgtatgacttccttcataagcaaaacaatactttggagcttcctgttgttcttaggattgctattggtatctcaaaaggaatggattatttgcaccagaataatatcatccatagggacttgaagactgccaatttgctaattggctcttgtcaagtatgcatattgtttcgaagttgcttatcaattgaaggatgtcgaagcactgattcaattcttaa

SEQ ID NO: 7589 - DNA, 13040 bp, Oryza sativa
  unsure (1)..(13040): unsure at all n locations
agagttatgcaaagctaagacaatatgcatgtgcaatgtacttattagaatcgcgtgtgttaccaggtaataaaccataagccttatgaccataaggcagatgtcttcagctttgctattgttctatgggagttggtcactacaaaagtaacctgtggctggcaaggcattgagtgacgttttcatagttctcaatttttttaacagcagtgaactatggtcagatgtaataaccactaatacatgtgctatgtagataccatacgaaaatctgacacccttgcaagctgcactgggagtaaggcaggtatgtatttgatgccaataagcttcaacataacacattggatgttaaaaaaagtaaataatattaacaaataatggatgctcaaggatgaagggatgactgtaaacattgacccttatttaattattttagggaatgcgcatggagatcccaccgaaggtgcatccgaggttgtccaaactgattgaacgatgttgggatgaaaatcctcatgtgcggccccttttctcagagattactgtagaattggaagatatcttacggcatgtcctggtaaatttctgaactttgtacactttaggtttaatgaaacgacgatcggaaaaaaataatgaatttgaagtatctaggttcatgcttgagactgctgaaaagctgcatatctgttgtaggtttccaagacaggaagtcgacatcccaaagcaaagatacaaaagaaatcggcgcgatagagaatacatgggctccttgtgacctttgtgaaaacagcttagaggttttcttcaaaactaccaggctactgtttgttgctagcacggcagcatagaaatgattttgtatatatgtcggatgcttgcatgtataatatttttttactcacacctgattggtatgagttttctgttttgtcatataatatgtgtactaaatttagaagaacgctgaacaaggcggcagccactgggatattttaatacagctctagtttttgtgtttccagcctgtgcaattttggctcatgtacatccggcaataacttagttgagacttcagaacttcagatgaagaaccatatctcttttgctgaattccattttgatgcttgtctataggattggagccaaattgttggctatgcccaagcttaatttggtagcatcccaaacccttgtttatactctagttagatttggcacctaactggaagcaattcaaacatattaaaaactagttcctctgtttcataatataagtcattctagcatttttcacatttatattgttgttaatgaatctagatctagattcattaacaataatataaatgtgagaaatgctaaaatgacttacattgtgaaacggagggagtagtatgttttgacacgggtaaagaaagaaaatagcagtttgggctgggcctggcccagttagttgcttgggccaaaatctgatgagatcgaaaactgaggaggaaaaaaaatccaatccatccatttcctttccagtggtttcgcgatggcgagcacgccggagccggagacgacggtgggaggctactagctgcgggagcggctgggcggccggccgccgtccacggtggtgtggcgcgccgtggagcggtcgagcggatcccccgtggtggtgaagcaggtgcggctgactggcctccccagcaccctcggcgacagcctcgactgcgaggtccgcttcctcgccgccgtcacccaccccaacatcatccgcctcctcgacctcatccaggtctccttttgtcttctccatcgtcttcttcttcttccttctctaccaatcctagtgaatttttctccttaattagacccagagcaacctgtaccttgtcctggagctgtgcgagggaggagacctggcggctacatccagcgcaacgggagggtagaggagcgcgtcgccagcaatttcatgagacagatcggtaattcacctagtaatattcgccatatcaatttcatttctagccctagtagcatctcttttctcttgttgccccccaatctatcacattacccgcaaccttagttagttgtgttacaaatttttttttttggatcaaagggccttagtcctccatttccattaagagaaatgtcacagtttacagtagagttgtgttccaattacaacaagaagataatcatgtgtaagaaattatgcttgcccaacaccttgtggtaggagctggcttgcaagtgctccgcagacaccatatcgtccatagggctttaaaacccgaggtccacaaatctctctcttttcatctcttaataacttgtgttattaagctctaactgatttgagacaccattgttgactgataaaactgttgtatgccgcagaatatcctgctctcttctcctgacagcaatgcgatcctcaagatatctgattttggcctgtcaaggtacactgctcaacatacataacctgtaggttgaggttactcagtctttaaaaagctgtattagttgcaaaaggcatcgtgctactcataagacaatctaatccaaattttacttctggtctctagagttcttcgtcccggggaatacacagatacaaattgtggcacttgtttgtacatggccccagaagttatgctgtttcagaagtatgatggtggggtatgttgtatgtactcacatggctaactctctttgccacacacacaaacgggagaaatctgaacatatgtatgttgtgtgcaggtagatttgtggagtatcgccgcgattctcttcgagctcttgaatggctatccaccattccgtggtagaagcaatgtccaggtggctactagttctctcttcaaccttgtttatcttatctaaacttcaataagttctcatcacagatttgtctctgcagctgcttcaatgcataaaccgaaccgtgtctcttccattctcagaagtcgttatttccaagctacgtcctgattctattgatatatgcaccagacttctgtgtagcaatccaggtgcgcctttgatcttgttacaacctctcactgaaaatatggagagtgcgaagctaacaaatttccataattgcttccagtgaaaaggttgtccttccaagagttcttcagccacagcttcctcagaccatagacgccttactgaagagcctatgcaagcttagcaatatcatctgaagttcaggattagttgaattgtttgtttgttgtacttggacatatgcaggtacctctttgtgttcaaaaccttgttttcctgtagtcttctctgtagcctgtagactttttacacgaaaaatgtgaatataagttgggagttctgtacacagcaaccaaaatgcattttcatatccactgtttgtctgtgttgaaacccggtctcctatccaaacatttcaagacttcccccccaatccactgttctgttgccaaaaagacacgaatattagggaatgacctaatattaaataactataaggggtgaggcttcgaacccaaattgtctagctcaccaccttgtggagctagctggaagatccctcggcgtttctcactgttctgttgccttaaaggtattttccgcatttgcaatccatctccttgctagcagcaatgatcaggagcagtgccattcctggaccttcagattcgggcgccgtgttgatgtcgcgtagctgagagcgattgatctactggggttccttccgatggagcggcggaggatgatcgccgatctgctcagggcgagcgcgagaggctcgtccctccgcggcggcgtccagctccacgccgcgctgatgaagctcggcttcgggtcggacaccatgctcaacaacaacctgatcgacatgtacgccaagtgcgggaagcttcacatggccggcgaggtgttcgacggaatgcccgagaggaacgtggtgtcctggacggcgctcatggtgggcttcctgcaccacggggaggccagagagtgcctccgcctgttcggggaaatgcggggttcagggacctcgccgaatgagttcacgctgtcggcgaccttgaaggcgtgcggcggcggcacgagagccggtgttcagatccatggcgtctgcgtcaggacggggttcgaggggcacgacgtcgtcgccaactcgctggtcgtcatgtactccaagggccggtggaccggcgacgcacgccgggtgttcgacgtaattccctccaggaacctcgccacctggaactccatgatctccggctacgcgcacgccggccaaggcagggactcgctgctcgtcttccgggagatgcagcggcggcacgacgagcagcccgacgagttcaccttcgccagccttctcaaggcgtgcagcggcctcggcgcggctcgcgagggggcgcaggtccacgcggccatggcagtcagaggggtctccccagcgtccaacgctatcctcgccggagcgctcctcgacgtgtacgtcaagtgccaccgcctgccggtggcgatgcaggtgttcgacgggttggagcggaggaacgccatccagtggacgacggtgatcgtcggccacgcgcaggagggccaggtgaagaaagcgatgtgcctgttccggcggttctggagctccggcgtccgtgccgacggccatgttctgtccagcgtggtcgccgtgttcgcggactttgctctcgtggagcaggggaagcaagtgcactgctacacggcgaagaccccggccgggctggacgtgtcggtggccaactctctggttgacatgtacctcaagtgcggcctcaccggcgaggctggacggcggttccgggagatgccggcgaggaatgtggtgtcgtggacggcgatgatcaatggcgtcgggaagcatgggcatgcccgtgaggccatcgacttgtttgaggagatgcaagaggaaggcgtggaggccgacgaggtggcctacctggcgttgctgtcggcgtgcagccactccggcctcgtcgacgaatgccgccggtacttctcgagaatctgtcaagaccggcggatgagaccgaaagccgagcactacgcgtgcatggtggacctcctcggccgcgccggcgagctccgggaggcgaaggagctcatcctcagcatgccaatggagccaacagtgggcgtgtggcagacgctgctgagcgcgtgcagggtgcacaaggacgtcgcggtggggcgggaggtgggcgacgtcctcctggccgtcgacggcgacaacccggtgaactacgtgatgctgtcgaacatcctggcggaggccggcgagtggcgcgagtgccaggggataaggggcgccatgcggcgcaaggggctgaggaagcagggcgggtgcagctggacggaggtggacaaggaggtgcacttcttctacggcggcggcgacgacgcgcacccgcaggccggcgacatccggcgcgccctgcgggaggtggaggcgaggatgcgggagcggctggggtacagcggcgacgcgcggtgcgcgctgcacgacgtggacgaggagtcgcgggtggagagcctgagggaacacagcgagaggctcgccgtggggctgtggctgctgcgcgacggcaccggagacgatggcggcggcggcggcggcgaggtggtgagggtgtacaagaacctgcgggtatgcggcgactgccacgagttcttgaaagggttgtcggcggtggtgaggagggtggtggtggtagggacgccaacaggttccacaggtttcagaatggcgcctgttcttgcagggactactggtgaccatcaccatctttctctcaattcaattctacttgcattaccgaattctgaattggagcgaccgtgagaggtagcatagaatgtcatgtacacaatccccaatttagagagtgagtagctctttgacgcggaagacgtgtaaaagtatcatatggttcaacaaaattttcagaaaccgaccttagctcagttggtagagcggaggactgtagtgtttgcagataaatccttaggtcgctggttcgaatccggcaggtcggatagtttttttttctctaacaacttgttcctattgccaagttttcggcaatcctgaagatgctactgctacaccttttcttttggcctgttcttgggaaaacgcgtagtatcagttatcacgaaagtctttctaccataaaattattagtggtatttttttttctaaaaaaacactcatctaaaggattcagtgccaagttgttgttcaagatgtgcagaactccccgtgtttttttcttggattgtttactgccggcaacgctggctgtagctcctagcttgatggatcatcctgccaaggtgatgatgggctgggccttgattgcaaagtatcatctgccgcagcccagttccagcgaccaggcccaaactgggccatatcggttggtttttgctctctacgtctccacggctcgaccagattgtcgtcagtcaccgtcagacatggctccggggaagcaacgaggcaaggccaaaggggccccaccgccgcccgccgcccccaacgccgccgccgccggaggcttcccggcctgcctccgcctgatgccgccctccaccgtcgccatctccatccaagccaagccaggctccaagctcgccaccatcaccggtccgtccccctctttcccctcctccctgaacaccaactttcgccctttacttacttcatacgcgcatccttcgattctgcagagatcggcgacgaggccgtcggcgtccagattttcgcgccgcgagggacggggaggccaacgccgctctcgtcgacttcatcagctccgtaagtgctttcttgcttgctctgcttgtggattttctgattgagatcaattttagttggcatgatgatttatactccagtatggttgtatgcataggaattttggatacagcaaggctctcagaagaaaatacaccatataacttgcttaaaaactacatcatcatatttgtctagtctggaaagtgagacgtggttgaaaactcccccttttcagtcaagattcaaacttcacattaactagtgctgatggaatatgtagctaacgaaaaaaaacatgcctcaagcagtagagagcattgtttccacaacgtctgtaaatgtgcacttctgctgagtttatacatcctgccacaattaattctttcagcggttgaaaactgatagtacatcttagagatgtgtttcactatcgaatacttgaattaactaggtttgccattctatatttctattcatcttctttgccctactgttcttgttagttttgcttatgttcagcgagttgtgttacttcttccaagtagcctatgatatcattggtttatgtcggggtatttggattttggagtgtccactattcagtttaatactctaggctctacaatttttgcatcgcgtaaatggtttgctttgcgtttggttttagagcacagaaaacaacctttttctttacaagaatcgatgcaatgtcatcactgtttagagtttaagtgtgctgaaaaaggtggctcagttccaaattgctcggcgtggagcacatgaaactgttcttcagaccaacttgtctcagatttggtttccaataacattgttttccacctgttatggcagtagtataagagatattcntgatacatcattaacccacttcatcgtgtcaattattatcatccagagcagatcattaccgtccatgctccttgcacggttgcaccatggtttatattgtttttgctctacagatccttgcattatatctgttcagataatttcgatcttattcattctccaaaatatgagataaaaaacggagtctgttattctcgagacttggttgagaatgtgtgcttagtctggactctggagataggttctctaatcaaaagagttattgtacatttcatcagagacgttgatacatatatcggataatgataattagaacagatgtttccagtgcttaaacatttttttagctgggttagtgcttaaacatttgatgttgtatttctatggatcacatcagaattttgagaacctacttgacatattcaggtacttggagttaagaaaagagaagtttctattggttctggctcaaaatcgagggaaaaggttgtgctggtgcaagatgcgactctccagggtgtctttgatgctctgaagaaggcttgtgcttctgcatgatgtatgttaaatgtgcatatgtgaaaactactcacttaactgaatagaaagagtgtcaacttaactagtgcccttttatctgtacaactctgtcctgcaatgaaccctgtaaacggttaattaatttgcctagcgagtttacaagatgaaaactttggtcatcgcatattttatcacgagatggtggtacagcaaagggcaaaattatgagagctggtttttagtttgatatgctaaaactctctctcatgatttacgctggtgactctgcgttgccactctcaggtacaatctgatcctgatatttcaatcggattgtacctttcgttttcaaagcatgtccagtttgggcgtttggagttggaccttttggatgtcgaatttgaaaacaaatgacagcatcatttcagaacgtatgtcttcttttttggatccggtaagaaatggactgatttgtatgattgtttgcatactaagggcccctttgaatcgcaggaatgagaaaacataggaataggaaaaacgcgggattttgataggaatgtaagtgtaaaacagaggattgcaaaacacaggaaaaacacaggaatggtcgtttgattggaccgcaggaaaaacacaggaattagaggagagataaagactcaaaggaaagtttccaagaggttttacctcatgttagaattcctccaaaacttgcatggcattaggcaatccataggattccataagatccattcctttgattcaaatggctatataggaaaaattcctataggaataaaatctctaaaattcctatgaattttctttgaatcaaagggggctaaacaggccagatttaatttcgtcgagtatggaatacgttgaggttatttcttaatcggcggcccccaactgaaagcctaccaaagaagctagtatagcaagttgggcactagctggaaacttttctccatgaaacacgcaggacctcgacctgtttgggcgacacgtacttgttgctaacttaatctaagtgtaaagtaatcggatcggacttcgaacatttcgtggatgggtaatgggattgcaagttccacgatgggctcgatggtagatactgtgtgccagctgctcgagctgttggattccaaaggtactccatttgtgatctaccactagcttctcctacatcggttggcgccaaacattggtgtaaaataggggatcaggctacaagagcgagagaaatgtttgatgtttgcttgctgcttggcttgctcgtcgtgtgctttgccttggcaggtactaggtgcctcgagattggggcacagtgcagatagcgccccatagggcatgcattgcatgggccatggtgcctgcagtacatgtctcatgattggatggatggtcaggtggtttgtcttgtacgaatacgcgctgtctttcgtacagtgcccatctattccaaaatataataatagtttatgaatttttacacattgattaaaaatatatgtaaaattaaatagaaaatagttgtgaccggttgagatgataaagttgttgaataaattgttataatctaagataatattttaacgctagaagttactactccatccgtcttataataagttcagttcattttaagctcctttcagttattgtaaaacaaaattattttttaagtaattattacatcggagtttgtgaaagtaaaaaaataattgtatctagagtaaataatgtggggaatatttgcattatttgataaagtagggtattctagttcttaggttttgtattgatatgtacggaatgtatgagaaatgaacttgttttggaactggggaagtacataatagagtacattaatacataattaattgcatcaactgaaggaggaaagcaatctggaataaagacatgtaaagtattttagctcgagtattcacgatcgatgagatccagtcaacaaacgtacgtgcatgcatatatgcatcctgttgttgatagcgatggtgagcagatgagggaggcatgatgatggaacgaatattcttgcgttgcgctcactcacgggagagttgctttacgtcaagttgcaagagtttcatcaatcgtttccgaattcagagtaaaatctatgtgtgtcaatcagccaattgtacttatacgtgagaaccgatatgcatcataccaatagcatatatgtaatggaacacgaatctatagatcgaacggagtgccatgaaaaagtttaaaatgcatgcatcgagtcgtgtatatataatccatgttgcaggttataccggagatggaatttgcaattttacattggtcaagtggtgagagtgtcgagagtcacgggtacaaggcgtcgcgtgcatgcaaattaaaaaccagtccaggccgatcgacttggtagtagcagtaagagcatgtacaataggagactattaatgagatacaagatgagagagaaaagcagtgtgctacatatttataaccagctacagcacggactcaaaggcacaatgtgtgtatgacaggtgggactatatattaatggtatagtagctatagataaattggagctagtattggactatactattaaatttgctcttaaacggcaacagtatttatgtggtcgctgcgctgttggattgcatttctcgatctgcatggttcattggatgggaacacagccggagatatggacaagtaaagggcaattgtttgccaaaaattaaataaagcacacgatcaatcgacgagaccaccaaactctctcgtcccagtggtgtgagacacagcgcgcattacgcactgcgtaggttgatcgggagacactgagccgccacgcatatataacacgcgcttccatctcttttattttttaacaaaccggtatttagagtgtgccgattttattaaatattgtgccgagtaaaaaaatgtcgcacaagttaaaggatgagctgtcgtttcgcttttgttagggcccaagttttgacctcctccttggttctcgccactagggctatcgccaaaagatccttgtgttggaacactctttggtttctatccttctattacggatggctgagttccatagtaactagctggttggcttacatttttagcagcgtgcgaaattagataagccattaccgtatgattaatcgagtattaaatattacaaaattttgaaaaataaatttgtttgaacattttaacactatactatatcggtccacatttgacgagccgaaatgcttatcacaaatggccttacctttggcgagtccatataaaggtcgtaataggtgaggacatcagccgaggctcatcacaggtaggccatcacatgtgacggggcgtcatttgtgtccgacaaaaggtcgccctctaacgggcattgatccgttagagataagtgaagtcatcactaaccactcatctttgaccaagatcaaacacatcaaggatgaacgttgagcccgtcagaagttataaccagacctggcatagtgtaaaatatttctatacaaatttcttttacacgaaacatactatttagtaatttgagaaatatgctcacgggaaaatggtaactagctcactcaattaaacagctagaaagaacggggctctacgtcgggaaactattttgattctcgaggggatattccctcgttatttgcataccactcaaatggttacgaaaaaataagaaaatatattaacatatgatatatcactcccttccacgtcaatcaatgtatttttgctgtctactagccttctcactacgtaggaatagtagtactctcttctttacaaattgatcatcatatataaaactttatgtttatgcaccaagactaaagataatttaaatcacatcaattaagatatcatgcacacattctaccataatacatgtattgattaaaacaatatgccaattgcaccttagtatgcacacatgtattctctcatgctgtattaattgtattacgatgaaaactatgttcatatggttatatgatgattaatttgaaaaattttaaattctattttacgatgattaattaaaaaaaggagggagtagtacagtatttgcagagaaaaacagatgtggcgatgagttggtgtcaggcagagacgtggtgacctgggttatcagagtcaacgctcaactgaacacgaggcagctgataccctctgaatctgatcgaacagagtttacatgcaacagcagctccctcccctgggacattgccattgccacaaaacagacacggtcttccaccgcccatctcttctggatctgcaccatgcatctgcgtacgttggtcgggagacgggagtaatctgatgtgatcgatggtgcattttattttatgactactagtacagtactactactacatgtgcatacagcacgtccagtcgagtcgagtcgagtcgaggatgccattgccaccaaggatgtgtttagttcacattaagagcaagtttaatactagtatatagccaactactagctccaattcatctatagttaacctaatagctcatttatataatagttacatactacactattaatacatggtcccacatgccatacacacgctgcgtcttggagtccgtgctacagctggctacaaatatgtaacccgctgcccttctctctcctcatttatctccttaaaatatgtttgcagctggcttttagcctgctattgtacctgctctaaggtgg

SEQ ID NO: 7590 - DNA, 63821 bp, Oryza sativa
  unsure (1)..(63821): unsure at all n locations
aacttatgttttttgagagatggactaaagtttagtccctccttcctaaacaccacctaaaattagaagtttggttgaaatcagaacgatgtgatggaaaagttggaaatttatgtgtgtagaaaagtttttaatgtgatggaaaagttataagtttgaaaaaaaagtttgcaactactgcgtaaacacggtgtgagttccgatgatcaacacgtagtaccgtgcagtgcctaggctaggtctggatggacctgactagcagctaagagcaaggataattaagagtgtaattaaggtgactgtaacatgtagagtataggagtactggagtatctcttaattgtttgtgttgaattaactatgttgctttctattcagttatttatttatgaagatattactcacgttatgaaaagaccattatatacgcagcgggttatttgtgccggtcgatatatacatgaacattaatttatgccgccaagactgtgcgtaggtcgggtgagagcctcagatcgagcgtgtgcctgctatgtatggcccgttgccaatctctacactcttgtttttgtccagctcactcgtgtagtactctagaaaagaaaataccacaagtcgcaaattaatgctactcgtatatccgacctgtcaaatgaggggaattcatgcatgattgtagccagcgtaattaaggagtgatctgcactgtttatcgcatgtgttgatgcatgatcaaactgacactcgagtaccaaggtccaatccatcaaccagtcaatcaacctaccctactcgtatgcagtcatctgcagagtagtactgtagcaggcgatttgaggctaacatcatcatagtgacacgatcacgctctgcagtacaatatcacaaccaccaattcaagtgcgagatagtaccctttgttgctagtctatcgcctcttcctaagggctgcaaacaacccaacccggaacctcgtctaaaatattggtgcaaatacacacatttccacagtgcaaatacactcttttatgtggcttaactggttgaatgtactgtaggagtaaactgagcccacagtggacatgacctcacgcgtggacacgggggagtgggacggaattcatttccccacctatcctcagcgagacatcacttctcctagccctcccctccgtcgctctcggcgacggacttctcgaggccgtgtaggcgcgcaccctcgccatggctgccttcctctcctcctcctcctcctcctcctccccctcctcctcgctacagtagtccacgaaggaggtggccacggccgtagcggagaagcgacccgtgtgggggggaggggagggagaggaggcaaggcggcagcaagcgacctgccatggatttctgttcttgattgttctttcaagatggatgttttttcgatctggaattactagcatgtctgatgtcgtggggattatggagggcgatttggggaggtcacggggcagtgaagaaatgctacccacagtgggcgtttctcggttttccccgtccgctcgcgcccttgccgccccgaagttttgcgccgctcagacaagggacgagaaacctagctgaggcacgggcgtttgctccacgtcgacccgaatccgagctggcgcaacaagatcacgcgctagctcggtgcactgtgaaaggcctaaggccgtgaactcatggatggctaggcaaaataggacaaaatggcatcatcaggcaaaaaaccgacctggaggtctaagggcccctttgaatcacatgattaaaaaaatataggaataggaaaaacgtaggattttaatatgagtgcaagtgtaaaacagaggattacaaaactcaggaaaaacacaggaatggctgtttgattggaccgcaggaaaaacgcaggaattaagggcccatttgatttggaggaaaaacataggaattttagaggatttcaatcctatagaaaaatttcctatgaagccctctgaaataaaggattgaatcctatctaatcctttgaaattcctatggaatggacaatcctatagagattttggaggaaatttagcaagagcttcaacctcttgctaacttttcttcgagtctatctttctcatccaattcctgtgtttttcctatggttcaatcaaacaatcattcctgtgtttttcctgcgttttgcaatcctccattttatacttacattcctatcaaaatcctacgtttttcatattcctacgttttctcaatcctgcgattcaaagggggcctaaaggagatatgaagggcccctttgaattggaggattatcatacgaattttggaggatttaatttcctaaggaatttttcctatgaaaccctttgattcataggaaagtataggaaattttccttatgattgtattcctgtagctcaatttcataggaaaataagcaagaggttcaacctcttagaaactatcttttgctttgtttgtttcctatggtgctatcaaagggaccctcttcatatttcctgtgtttttcattcctgtaggattaggaaaacataccaatttaattcctacatttttcctattcccgtgtttttcctatcctgtgtttcaaaggggcctgaagactcataggaaagtttccatgaggtagaacctcatgctagattttctctaaaacttgcatgtgtttaggcattccataggaatttcacaggattttataggattcattcatttgattcaaagagctatatagaaaatttttttatagaaatagaatcctctaaaattcctatgaatttcatttgaatcaaagtgggcctaaatcagaaaaacttgatcgtggaggtgaagggtgatgtacaagtgggaaagagacaaaagaggattgcatgttttaattgacgacagcgatgggatatgcacgcccccttaatttcgaaaactggatcattagcaattaagtactcctcctcattagagtagggtcgtctcatctggacgcatatgcaacgctgaagcttttgtcagaaagctgtgtactactagtagtagtgtatagtacggtactacagtggtggatccaaattgtatgaaatcccgaggcatgcagatgagacgtggattgatccttgctgtgctgtgctgtgttccctttcctttcctactagccgcgcgtagcaatgcaggatgcagtagctgcacaatgcaggagtactacgctggggcttctgtgcagtgcagtggtactgcatcttcacgtttgattcggctgcttgcgttgggctcggcactactagagctatatttccttcgtcacattttaaacgtagagataagttttcgtgtttaaatttaattatttgttttatttaaaataaaaaaacatattttgtaaaaaataaaaaaaccataagtcgcacatatattattatttatttttattacctaataacaataaaatactactccctccgtattttaatgtatgacgccgttgattttttaactaacgtttgaccattcgtcttaatcaaattttttatgcaaatataaaaatatttatgtcatacttaaagaatatttgatgatagatcaagtcacaataaaataaatgataattacataattttttttgaataagatgaaaggtcaaacgtttatcaaaaagttaacggcatcatacattaaaatacggatagagtaattataaaaaacttgaaaataaagcgaacgatcaaatctggcgacggaaactcatggctacactgagtacctagcaatttttagcatagtgctactcccttgtctcatattataaaagattttggatggacaccttatctcaatcaatcacaccaatttttatttaatttattcacctattttcttttttctcaaacaaaaaagtattttttttcaattactttcatctacttttttaactacctgtgctcattaaaaaatgattatgctttaggatggaagagctaagattttagcgatcaaatgctacccatcgttggtaggagtaccatatgagaaaaacttagaggttttttgactggccccacaaggtggtggtgggttcaaagcctgcggcagatgcagcaaaatccccccttccgtttcccgttccaggcgatcgagtcgagctgccgaggcgcgccaagagggagggagagatagagagattaaaaaagaaaaaaaaaagagccggtggggccgggccgacagagctggacaaatgcagacggaatgggggaaggccggggcccactaggttttgccatgtcccaggaatcagtgggcccgttggtctgacgccgacgttaagttcgtccacacacccatcgaacccgaacaaaagcagttcatctcaaacttgaaactgaaagcagcaagcaagcaagaattcgttcgtgtgtgcgcatgcagatgcaggcacctccgcatcatgatgcattcatgtaacgctttctttctccaccccacacggccacgtcgctctctcctcgatctctataactcttttctatatctgcacctgcgcgtgtgccaatggaccgatatcaacttttccgttccattgccgtcgtagcagtattatattttgccttttgcaattgtgtgcaggtaggtaggcgtgattagcttcttttcttttgtttgtttggcacacattaaagctaaagaaaaccaagcttaaaagcgatcgactttgtttcttcttcacaagagaagagaatggattatgtgtgcctgctactgctctgcactgcatgccttgttgcttgtgacattttcggttaattttcgatcagcgccaattcaaaggcagagcgcgtagtagtgacatccgctcattccaaagtcagatttactgcgttccaaaaaagaaaaaaaaagggtcagatttactgagcttttgctttggagagaaggaaagcctcgagtttgttcatgttgtgccttgacaggattgcagttaatctgagaatccgtcggtcgtcttccttcctccgagtccgacgacgagagaagaagcaaattcgaggagagagcggagggaggctgtcctcctctttatttattgaaggaaagaggcagcagaagcactccctgcacgaccccactccctcttcactccaccacctcctcctcctccactccccacctcgccgccgcaagcgcccggccgccaccaccaccgccgccgccctcttggtctctctatcttcaatcttcgcctaccttgtctcctccattcttcaaccttggcttccttccatttcggcgccactattctttctttttcttttcttttcctttcttttctgagtcgctgtgttggaagccagccttggaggcattcatgagcgcccgacgaccagctccatgatgaccggaggccgccgatggaatggcagatcccgtcgatatcgacaaggtactctccctctccctctccctccctccctgcacccgccgctgcctccatctcttcgcgccttttaccacctttctttctcccccatcttataccttgcgtgctgctaaatgccggcaactatcattgattgctgcaaccaaagctctagcctttccttcgctccgacaatctctgtcgttgtagccttcttgctggtgttgttgtagattcaccgcggattattgaggaacacgcacttttgacttttaattcaatgccaacaatcacaacgtgggttgcatgaatgtagccaatgctgcccctgctctctcaaatgttggcctgcctatttgcatttggagatccttccagggttatgcttactgcaatgcccaattttgggaggggaaaaaaatctgttcttttatttttttaaaaaaaaacataaatggaaggggaaattgggaacgaacaaaagaaaggtttgtcaagttccactccacatacttcgaaattttcgatgtgcaattgcaaaccgccgattgagctgtgctgaattcaattattagtcggatggaggattgttactttcactggagaatgctgtggcttatcgagtttgaggcttttttttttgtttaccgaaagagtttcaggccttgttccccctgctcgaattatcttgtgctatgcacagatatagaaaggaggagaagctggtgcattagattagtttctatatatcaagttgaattgatgcttatcgtttctagttgccattcctttcttttttatgggatcctattcttatggggtctctgatgttttgattttactcttattactccttttttttaaaaaaaaaatcgttactctctctggataatgaaaacgacagaatccctgccttcttgctaaaaagaatcatgaagttgaatttcagggtcttgtttacctacttggttcagtgcttaagataaataatgtgtgccatttgtgtgagagacatacaactagtgatgaactcagttttgtcttcttctttttttttgttaggagttagcactatctcacaaatctcatcatttaaagcatcactatctgggcaggttgtgtgattgtgtcctagaaatcttgacgatcaggaaaaagattttgagtaatcttgattatatgtatatgactgcgatgtctgctttccttcagatagatcctactcttgttttggaatctggataactgggttcttggagctaaccaaaatatcaaaatcaaaattttaacaatgtcaaaatgcaatggagaaaacaaagggacaggcagacacttccattagttacttttgttttgagggaatagacaagaagacacttggaattttcccattagcattgatgctatcgaagttttaattgtcaattacatttccaagaaaatgttctaaactctagtgatctgttattgaagttttttgctaatgttttaccaatgttctgcaccagttactctgcttcataattctgttcgtcctaatgcatctggcaggcacttattgctttaaagaaaggcacccaactgcttaaatatggtcgcaaggggaagccaaaatttactcccttcagactatcaaatgtaagtttactgtcttgtgcaaccttttttgataaaggtgatctcaaagtacggttttgaattccacagttccagcctgaaatgtggatgggatttctttttttttaaaaaaaatatctaggtccatattatgttgtttatggtgctacttacccaagagtacaaccattggagcagaaaccacttaaattattgacagctagaaaatttatgacatattaatatgaaactgagagcaatgcaacttccatttgtagttattatatgtacttacgcaactttctttttcatgctccacaggatgaatcaacactaatttgggtctcaaataacaaagagaaaagtttgaagctatcatctgtgtctagagttctctcgggacaaagaacagtaaggacttactttttaactatatggcaatttgtttcatgcatttgatcttcaacctgtttcttttcagttggtttttcaacgttttctgctccctgagaaggaccatttatccttctcactcatatataatgatggcaagcggtctcttgatctggtattacaacaaggatcaattgaactttatttcttctctttcatttctgaatgaatttcatctaatgagccctaatcttgtttcaaagatctgcaaggataaagttgaggcagaagtatggtttgcaggccttaatgtattgatatctcctggacagcatggatcccaacaccaacacattgatggaatacgcaacggtgccctgtcttttgaggtaaactctcttcaacacagaccactttgtgaatatatcattgtttgagtcatgatttcacatcatcattacagcttttttttttaagaaaaaagaaaaatctttgggcagaacgctatcagtatttctagcaacctcagttcaaagtttctgtctgtacactgtgttcaactcttgggtcattatccaccacctatgctctagtagctagtacaagttattgttgttgacgaaattcccacatgcattgctagtagtaatacgcattatccatcatgttctgagaactagcctagcatctaggaacatctcatagaagcagaaccacagttttgattattctatccaattgagcttcttgtttgattaccaactttttgtttggtgcacttttggcctaagctatagggttacatgcatatttatattattgttttacctagttcattcaacatgttcttttactttatcttgttcattcaacatattttttatacatcatattatcttgtactgctgcttgtatgttaaataaccaataatgcattcctgtggtttattaactgtcaagaacatgctccatatctattttcaaccgaatgatctttcaattgttaatcccatgtaaaatagatgaacctcacagttacatcatggcatgctatgcttctgatttgttttttgtttaaattgcttacagtgtggcagagatagtagcctaagcagtagctctgcttatacaacggattcctttgagaataagttgagctcagcgaattctgccaaggatcgttcttcaggagaatttacatattcagaaaggacagatgtgtcagatatgcaagtgaaaggtgcttcttcagacattcgaatcagtgtttccagtgctctcagcacatccagccatggttctggagatgattctgaatcttttggagatgtttatgtatggggggaagtcatgtgtgacactacttgtaggcaaggatctgacagtaatgcttactctgctactgcagctactgatattcttgtaccgaagcccttagagtcaaatgtaatgcttgatgtcagttatgtggcttgtggtgtgaagcacgcggcactggttactcgacaggcagaggtatttacatggggagaagaatgcagtggccgtcttggtcatggggccggcacaagcatttttcaaccacgtcttgttgagtcattgtctatctgcaatgtcgaaacaattgcctgtggtgaattccatacttgtgctatcactgcaactggtgacctttacacctggggagatggtacccacaacgctggactccttggtcatggaagtaacgtgagccactggattccaaaaagagtttcaggtcctttggagggccttcaggtgtcagctgtttcttgtggcacatggcatactgctttgataaccagttctggaaaattgtacacgtttggtgatggcacatttggagtcttaggtcatggaaatagagaaactatttcatacccgaaagaagtggagtcattgaagggtttgaggacaatttctgtttcatgtggggtgtggcatactgctgctgttgttgaggttatcatggcacagtcaaatacttcatctggaaagctatttacatggggtgatggagataaatatcgccttgggcatggtgacaggtcttcaaaactgaaaccaacctgtgtgccttcattaatagattacaatttccataaggctgtgtgtggtcatactctaacaattggattgactacttcaggccatatatttactgctgggagctctgtgtatggacagcttggcaatcccaataatgatggaaggtatccacgcctagttgaagagaagcttggtggtggtggtgttgtggaagttgcgtgtggagcttatcatgttgcggtattgacacagagcggtgaagtctacacatggggtaagggtgcaaatggaagattgggtcatggtgatattgcagatcgtaagacacctacatttgttgaggctttaagggataggtctgtaaaacgcatcgcttgtggatcaggcttcacagctgcaatttgtcaacataaatcggtgtctgggatggagcagtctcagtgctcatcatgcagacagccatttgggttcacccgaaagaggcacaactgttataactgtggattagtacactgccattcctgcagttcaaaaaaggctctaagagcagcattgtcccctaatcctggaaagccatatcgcgtatgtgattcatgttacctgaaactaagtaaagttttggattctggaatcggtcataacaagaacaatacgcctcgcataccaggtgattccaaggctgataaaatggactcaaagggaaacagagttgcatccgctaatagctcagatatgatcaagaacttggatgtgaaggcagcaaagcagacaaagaagtatgactatccaccacagttccctgcgattttgcagctgaaggacatccctttcattggggctgctgaccagcaacctaatgactccacatatagttcacctttgttgaggctgccaaatctgaattcttctagttccttgtcctcagaaagctttgatattcttagagatgcaaatgaacttctgaagcaagaggttcaaaaactaaaagaagaggtattctatattctaattttttgtggtaataactaaaatatccggggaatgcgtccttatgcttatctattatgcaggttaacagcttgaggcagcaacgtgaacagcaagatgcagatttgcagaaatcagaggcaaaagctcatgaggccatgaccctggcctctgaagaagcatccaaatcgaaggctgcaaaggatgttattaaatcactaacagcacaggtgattttccgaatttattattgcacgtcttaatgttaaattggctctagctgcatattatctgccagtttcttcacttaccttatttttacttttatttttgcattgctcattcattgaaacaaaacgttggtaagcttaatttgtgacatggacagttaaaatggcactaatttcagttcttatcaacagcaaccttgtctcttatatgtgccttttgctccatgcacccacacgtgcttggaggtgcattcagcccctataaaatgattgcatattcagttgatatggatgtttctgctcatctcattgttgatcctagttgcaccttgctagtagtcatagatactaggggtgaataaaccaaggtaaacctgatttgttctttttctactgctactgcctagctgtgctttcttcagtggaacagtgacaactgtgcttgtagataattgcatatagataattatataaatcacatatagatagttgcatgttctggacttgttatatccccaactggataatatagaaattaaaaacactccccatttttgcagctaaaagaaatggctgaaaggcttcctccagcatcatgtgacacgaagcaaacacggcagccttatctacctggtggtgcagtttctcctgatacagggagagaaaaccaaaagagatatgagccaggcagcttccagtacccacaaacacctacttctgttgcatcggcccggtttaatgggttccttgctcaagcccatcaaataagtgaacccaatggtaacacgatggttccacatgacagcaggcatgaaaacaatggcaacactaaggagttcccagttgcgcagcagatgaccaatggtgggatgacggggtatcgcccaagaacagaagatcatgatcggcgggaaacagaaaggttccaaataaacctccatggtttcaacatgagaggttctagctcacccagcaaccaagtcgaagctgaatggatagaacaatacgaaccaggggtatacttaacactagtttctcttcgtgatggaaccaaggagctgaaaagagtgcggttcaggtaaccaagattcgctactcctaaagaacatattttattttgttttctctaagctctaacttgtgaaatgcgtgccctgaataagagtagcctgacatggaggtcgaattgtttacagccggagaagatttggagagcatcaggcggaatcatggtggaatgacaaccgtgaaaaagtgtacgacaaatacaacgtgcggggaactgatcggatttcttcagtgatgacagcgtagtgtgataataccagctagaagctaaattctcaaactgattcagatctcagaagagatctttttttccctcgcctaaatgtatttgatgatgctctcttcctgactatcttctcctgtactattgttgtatagaaggaatcagaattgatgatgtgtcgtatgaatagggtaatacagtgcagtgaggttgctctgttgaccatgatacgaggctgtgtatgtctgtatgtatattcgtgggagttagtggacgagtcttgagcaaaagctccttcatttacatgaatgaaacggaatgctcttggaagtggacgatgggtttcttgatctcaaatgtgtgctaccatacgtctgaaatgagtatgaggaactgaaagattatcatgaaatgctgcttttgtctgaactctgaagcgccgaaatgtcggttctagttggtactaatgcactgcccaaggattccgtttgtggacgtgaatatcacaaagaagggaggaattcaattaagcaatggcaccacaataaatgtgtagatgcatttggtgttaattgcaagtgaagtttggcgtcgtggaaatgtaatctgataaggttggaatttgccttttagcaagagaggtcggcgaaagggtgacgcggctccatctcagactgatgagagcagctatacaagtatgcatgcgatgcgatgtcaattttcatcatccaaaacagaaaggcctatatatatgctcccgtaaagtagattatggatcaggtaaggatgacgacgcaagctcgattccttaattggatagatcctgcagctatatactagtagtagaactagattgattcataaagattggttatctgcagtgctggacttcaccgaaaattcgattctattcgatggctggtgatggaaggaacgcacctgctagtagcttgtttcactagcagagaaaactgagcttgactattgctgtgcatcagtcagccaagcaggcagcctaatggcaaggctcctttctctgaaatgaaatgaaatgcttgctcagtcgtcgttctctgtccacaccggtgcagaatgtccactggccgccggccaccgcactgatcttgtttgctggcaacgacgacgacagccgatcgaggtttcgaggagatgcatagcacagcagcaagcaagtcgtcctctccccaagaaatgaacccaaaggtgcagtgcaggttccatcccaacattccagggcaagcctgcctattctgccagtccagtcccctgactgccagcccagcagccaaaatgaactgaaccgtcggcacggcacggaaacattgagcaacagtcaatcgattggcctttttcttccttgtcatccatcgccgttggcactccatcctcgtgaaacatcgcctcacacctggcccccagaccgatcgacctatacgcagccaagcacaaagatttcactccaatcagcacaaagctcgtactactcctgcctagtagtgcctctacccatggtgaggtagaggcagactggaaatttaaagggaggaagtcccatcgatcgattggaactgatctgacaattactccagaaatccacactacctacccgactcatgacacgcacttgcacagtactggctgatagtattattcacttggaggcttgcattgcagcggcaggtcacgtcgtctcaaaaggaaataaagattgtggccatatactatcccgtccctgctgaattctcaccaattaaagacagtttttcactcaccaaatcactccaagctgcctggcacacaacactcgccaccacgatggtactacaaatcaaacacataaaaataattgaaggtacctgcattgcatttcatgacctatcagttgtcagttctactgctactgcaaatactctttggcaaccaaaacagcacgagtaatatttctttttccgattgcgggcagcatcgattgtagtacgacacacttgccctcgctgagggccactttgattcaaagtaaatttatagaaattttaaaggattttattcatatatgaatttttttctgtatacccctttgaatcaaaggaatggatcatatgaaatcctatgaaattcctatggaatatctcttctcatgtaaattttggaggaaatttaacatgagttagaacctcatggaaagaatactttgagtctttatctctccataaattcctatgtttttcctgtggcccaatcaaacaagcattcctatattttttctgtggtttacgatcctctgttttacacttgcattcatgttaaaatcctatgtttatcatattcctctgtttttttattcctgtgattcaagggggcactgaatagtgaatccgtcgtgtaaccgaagaaaatagagttgaccttatagtaggtactgacttgctctcatcataacacaaaagctagtactacgagtagtagtagcagctgtttcagactttcagcaccgagacgggatgttcaacaatgctcagcaggggtacgtcggtgaatccggtcaagaagggtttgtcctactcctaccgaaaaggtccctctggagctaatgatttcatttcgacaggaacaattcggcaacgtttttcttcttctcaagattgatcatgacgaatgcttgaatgcttgtttatagtactaccgatatttcattcttgattccactgtgtaatttaaaccggtgtaccgatacaaagcaagcgaatgctgtacacagttaatccgaatggtgtacctgcaggttgaaacgcagggcccaaaaggtgtgcaggctgatcgaacagcacaacacagcagtacatggagtacatatcctgtttaggactagctgctcaccaatgaattccccacttttcaactgttcaacattctgttaggattccgcgtgcagtgcttacttcattcacgccatacttaattactctaattaattaggctactccttgcgataagctagcaccctttttatcctctccaggatcagattatccagattcttgcacacgcatgcttggtactactttctcattcttctgaatttttacctcacgttccagaccacacatctctctcgtcccatcaagctagccgccgtacgagtatggcgacttcaccctcaccttcgcctcctctctctgtagacttgcagcatatatatggcaccattgtcatcttgctcacgcatactctgcacttccccttccattccttcccaaaccagctcttgcaacctcatctgcatcagcctttcaaactgtgcagtcccaaactatcaaaaagatactatcatcaatcaatggctcagctgcgcagatgcatagccatcgcgctcctcttcctcctcgccgccacattcgtcgcaagctgcgtcgacggtgcaagaaccatgcaggcgagctacatcaacaggacgccttccacggcgccgacggcgatgatgaggtcggggaggctcttcggctacctgccgcgggccaagctgatcccgccgtccggcccgtcggagcggcacaacgccattggaccggagaatggtgatggggatgagctgatcagcaagccatgatggcagagactcaaggtaacctagccacttgtggagaacgtggtcatgatcagagtctgtcatatgatagtaagtaactagctagcagcatgtatgtatgtatgtattggcctgtcagacatatggtttttgcatgtctctgtcattaacatttttctcttttggggttctaactatacattcctcggtccacaactctaacagttgaggtttcagttactattatgtcatctttactttgctttgcttctttggttaaaggaaaagggaaagtgcttatgcgtcatccttgttttgcctactatgtatatttatcattagctgaatgataatgtcagtcccagagaaagggcaaagggaagcaccagttctgatttctgaaggtctggtgcagcaaaaatttggcagaatgattgttcaggcattttgtcatgttacaaccttcattcatattgctgccttactgtttggacctttgatttgatttcatcatatacaccaagcaaattgccatcccaagcacagtaaggccgtatactaaacagtttattcaagaaattgtcaatgaaccaccagtatcaaatctatcctggctctttcattctttttagctacttcgttcatcagcttatttgctccacgtctctaaaagtatgttatcttggcgaaaaaaaaaatccttctactccattgcttaaaccattgttctaaacaatttattgactttattttctaaaatatctaatctaccccataaatgagtagataatcatgtcaataatccaatgaaggagcttgggagatatggaacgaaagaaatcgcagaaccttccaacaaaaggagcttttagctacctcccttttagccaagatcaaggaagagaccaaaactctgggccttagcaggagcgagaagtcttaatagctggctttctttcagttagctcggaccaaaggtcctagctcctttttttttttcctttcgctttgtaaagttctccttctatattcaatgaaattggcgcccgttgattcgttcaaaaaaaatccaatgaagaatccatttcaaacgagttattaaatactatctctatttttaatagaaaaatagatgacgctatgaacttttggacaccatttatttattcgttctatttaaaaaatttacgtaattgtcatttattttgttgtgagttgtttcatcgctaaaaattattttaatcatgatttatatcttaatacatttataaaaaaataaaataagagaaatagtcaaatatccaaaagtcaatggagttatttattaaaaaacggaagaagtaaaaacaatccgtgataggcgaggataacaaatttaaataagtgtacatgtgcgttactttgttttcgctagaaaaatatggacgtgcaaatggcggcaggcagggagcactgtagggtacatcagggctggcttttccttgcttgactagagaacagccagtactacaaggaaaacattaatactgtatactataggtgtactagggctacacaaatcaaacgagtggagataaagaggatgtgatgtatggttgtgaacttgtgaattgcgatggacggaaaaggagagatgcaggggggaggggtgaaaaagtgacgggtcacttgagaaatgacttgtggtaaggtagatgaagtatttatataatcacagcttgagcttgtagctgcagcagtgcagtgcccatcgtgcactgcactaccacagatcgagaagaagaggaaggaagccaagcccagcagcattcagatttcagaatttggatggtgcgtacaggtgcagggcgacaattgatcgtgcttgcatgtctccaaacctcgtacgatttccctttgtttaaagctactactactgccctgcctgatcaaatggcccatgccttgccgccttcttcaattcacccgatcgtgtgctaagcctcagtgaccttaaaatttttcaagtaaaatgaaccgtacaatgatcaaattcaggtgaatatattttattgtcatgttgaagtacattagaaaagttagagcttcccctgaaagagaaaaaaagaagagcttacttgacgttgtagtcaaatcaggagaaacaccgaggggttttccagctaacttcacaagatggtgggctagacgatctggattctaagcctcaccccttttaattatttgatattaggtcattccctaatattcgtgttgttgtagtcaagtcataagttatgatttgggcgaatggatcatgcgagttttcgtccgatcgatttgtactgtaacaaccgaattagtacgacaaccaagcctgagatcctcggtcttaataaaccctgcaattcaggggctactatacaacggaatcctgttgggacagaatgataccggttaggtatcaggtcctgatacgatatttgcaaggtatcaggtgatacctataagatatcaggcgattcctaccatgtatcatgtgatacttgcgaagtatcaggtgaaacatgttaggtatcaagtgatttctcccgcgtatgaggtgatacttacgaagtatcaggtgaaacctgtcaggtaataggcgattcctaccacgtatcaagtgatacttgcaaagtatcagatgaaacatgtcaggtgtcaggcaattcctaccacgtatcacgtatcaggtgatacttgcgaagtatcaagtgaaacctgtcaggtatcaggcgattcctaccacgtatcaggagatacttgcgaagtatcaggtgaaatctgtcaggtatcaggcgattcctaccacatatcaggtgatacttgcgaagtatcaggtaatacctgtcaggtaaggcgattcctaccatatattaggtgacacttgcaaggtatcaggtgatattaaaagagcctctctctccctaatcctgccaaaatcagcctccgcaaaaaaagccccaacatatctcattaccaaggagttaactatgttccttctccactaactctgaaccctagaaaatcaaagacaatcccaactgctattggttatcactgatcggaatagcagccactgaataaatcgtaaacatgcacacaaaccctagaagaagaacctggagtgcactatgggaagaaaaaaatgaccacatgcgtcggcgccggcgctgtcgttgttgacgcaggattcgccgattccttcatccacgccagccttgtctttccttcccaagcctgccttagttttgtctgaaataaaaaaaaaatcccaaaaacaacagtgtcttaaataagatagatgcgaatcggtgcatagctggaaccaaaaatggtttcccgtcgagacggaataccggtaagtagcgtttccgattcggaaaggaaaataaacaactagtaacaaacaatgatgaactaccaaattgatgagagcagagcacgcgtatgtctagtctgtttggttgaaagttttgaaacataatggaagaactgcaagaaaagtagcaatagtaataccctaggctgttgccgttatcgctggcttaatctgcgagggcccggctagagggagacgagcaccaactgccggcgatgggcgatggcggcgtcggcggcggagggttccatccggatacgagaggccgagtcgcgacctttgtctgggcttggctcgtttaaagcccggcccgctaacagttacgtgggctatggtccagtaatattggcagcacgtacgttgccttactgttccggcccaacaactgtttagaccgaaatatatgtgggccgcaaagagttcgtccgggctttctcaactgtattggaccgaatgtctatttcggcgtaaatttacatgggcttcgcatctacaaccatcttggcccaaataaataacatatgaaatcgatggtgtattcctttccaaaaaaaaaaaaaaaaaacgggaagactaaatggctgtcgaatgttttttcatagctaaatcattcatgttcaatatatttagaatctttgtttcatgcattatagaaaaatgtttcattaggtaatttgattgtatttcagtttttaaaaagattgaaactttttcgatctacttggtgaaacattttcggtctacttggtgaaacagcgcccgattggtgtatgatggaagctaaaaaatcatgggaatcccatagactttttctcaatgtactcggatttgtttcatgtttcaatatatttagaagcgttatttcatacgttgtagtaaaatgttttcatggggtgatttgattgtattacagctttttaaaaagattgaaacattttcgatctattcagtgaaatattttcgatctactcggtgaaacactgtatgatggaagtctaaaaaatcatacgaatcctatatagataaccccaaaaacttcaaaagaaaaaaaagaaaaagaagtcgaggaggagacattggtccttcaaattcacggatgaaccggatcggtcagagatttcagcgaatggacagcaacagtttcgctcgatcgattcgtcaacaaccaaacatgcataatttatgcgaccacaagtagcggagcggaccacgccggtttgtctacctgatcattccaatcggatcgctgcagatcagaggagaaatccgatcgatatcgaactatccaattcgctgatcatgttgtatgatctgagccatccaagttctcattaattttccgactctccccatcccgtgccagcaccacctacctatcccaattccaaaccgatactgttcatacatacattcgctgcaatagtccacccgttttttttttcaatgcgtgtcagatttgcaaaatccagctttgattcaacatgtctgcataccagaacaaaagtcgcatcggttctgaatatccttagattcaacagttctgaatgacagaacacaatttcatccttatacttccagggcacagcacagcacattgtatggccgatcgatcaatcttaatttacgcgcacgcaaacgtacgtgttgatgagcgttccactatatttcgttcaaaaaagcattccactatatttattagctaagccagtacaactgaacaagggaagcgatttagtcagagataagctatgtacgtgacgattagtttaactgataaaagtcagacagtcgcaagaagattaggagaagaacagtgcattcgtcggcgtcaacaccaccccatatcgcgttttcagtcaaaatcaagaaagatcaaaaggaaagttcacttctttctcgctgcaagaagacgatgtcggcactatgcatgcgtgctccatcttaataattaatcgcatgattttagacttaattggtgaacccattcttctacttgcttatcagttatcacgtggtgtagaatacggattctctatatcatcctaatgttcttgttagatactccaatattcagttagcacaaatttaaattctctctgaatatcactgcacatttcttggaacgatctggaaaacgattgttgaacttgttgaagatatatacatgaatcacttgcagacaaacacagtggtaagcgaatgttagtcttggtcagattcgtaagcaaacaagtagcaaataccggtgaaatttctatggcgcaactagtcaaatggaagaaacaaaagttcttctcataggatgcttaattagctaatactagtaaccattgccatcacatcgatcgatgaagtatcaataggattacatctagccatgcatctaccgatctacgtgtatagtctcctcgttgctccaaaatttctatcattttcccgtttgtcttagcgtgtactcacgttcgggcggtttgacagagacagcgacctcacgcagcatttcgtctcattctcgatcgcaagtcaaattcacaggattaatcaaccaaaactagcaacttagcgaccattagttaagtgattagccgcagattaattgcaaatccagcactgtacacctcagaccgaggcctaccgtttaccaaagttttggcctttctcatgtcctcatcactagtctttaccctggatttctctttggaatgcatcatgtcctgttcatttgacgctattctttctctgaattttgctcctaacgtttcagctagccgcatacatggacgtaaattaaagtatcgcattcaattcagatgaaaatgaataacaacttaacaagagtctgattattcactaaaaacagtgtgctgaaggcctaaaacatcgccttaatcaagcgttacagatgacaagccgccatcatccgtatcgaataattataattatattccataaactgccccgtgataatgaaatgatctatagtttgggtcagatcagacagatctggagtcggtagaggagattataatctatcagttcagttcacctagagcaagaaaacaatgagcacactgtatcagaaaaaagaagaaacaacaaacaaatgcttagtcttttacttgccacatgcaaaccttccttaattccaagtccaactgtacttgtaaacaattggagggatgagctgcataattaacaagtgtggtcaaagatgccctgctggtcattagaggtcgcctaggcaaatttctcgtttatatctgcctagtaattcacctagacaaatcttacgtctccaacaagaggtgcaggccaaaacattgagaaatccactgtaaattaagcaaattaagtaatagaggagcagcggcctcctaggcgttggagacctcacgtcactggccatttttctctcgataatccaattgttttatctcacctcgtcaactcttttctgcttcatctcactcgcttcacctctagcatcgcgcgcgcacgaactgaaacaaacttatcttataatttggtgcaagctagtttttttttaatttaaaagggtatcatgcaatgctcgtggcctattatgtgcagtactataatcttgatattattcacgaatggagatcttcatctcatttactacaaaagcactatctgcttaggcaaatcacttggatcgaagataatgtttgattttttttcttgttttctgaagattttatttacaaaatcaaccaacaaaatattttcaagttactataaatatttttgacaatgatatgataactccaatatatgtctatggcaatacgatacttcgttatggcatggctagtcaacaacagtggcctggacaaaggatttattagtattgaaaatgaggcatgaggagtgttttttttttacaaaaacaagaaaaagattctgaaaataaaaaaaaatcagttagtgctattactccctccggtttcattttaattgacgctttggacaatgacacgttctacaagatatacatttgagcttattttttattataatatatacaataaataaatgcatgtttatttttattatagtgttttgaaagacaaatctatatatgtttttctagtttctttaaactaaatatttttaaagttattgatggttaaagttataaaagtttaacctcaatcttatccaaaacgataattagtatagaaccagagggagggagtaaagaaaaagtttggggcggtgacaagagagaatcaagttgtaagattaatcaactgaggcgtcaccttcatggaaggctagcaacaaccaaagagctagctagctaccttgaccgaccgaattctttaatattcgggcagctcatgctcgtgctctcgctcatgcgtgtggactttgaatccatccacctcatcctcctcccgcgtactccataaaactactcggattcgatctcttcctccagtactccccatctcccatccaccattgctgccatctccaccacatacaatacaacaactactactcagctcaccatcaccggagcaagagccaagaagacgacgacgacgacgagctagcagcagcattgcaaccgacggcaatggaggagcagcaacaggtggaggtggaggtggaggtgccgtcctacttcgtgtgccccatctcgctgcagatcatgcgcgacccggtgacgctccccaccggcatcacctacgaccgcgacggcatcgagcgatggctcctcaccgccgggacctgcccgctcaccaagcagcccgtgccgcccgactgggaccccacgcccaaccacaccctgcgccgcctcatccagtcgtggtgcgccctccacgccgaccatggcgtcgacctcgtccccacccccaagccccccgccgaccgcgcccgggtcgccgacctcgtctcccgcctccgcgccgccacaagctccgctgccctcctcgacgcgctgcgcgagctcagggacgttgccgccgagagcgagcgtaacaggaagctcctcgccgccgtccccggcgcggtggatgttctggccgccgtcgtcgtcgcgtcgtgtcgagacgccaaggccgcgtgcgacgaggccctcgagatcgtctgctcgctggagctctcggagcggtgcctggcgcggctcgtcgagaggaacgaggagctcgtcgacgcgctcgtcgccacgctgcagcggacgaacaccacgtcccgggcgcacgcggcgctgctcctggaggccgtgacggcggtcatgccgtcgaacaggctggtgtccctcccggaggaggtgttcggtgaggcggtgcagctgctccgcgacagggtatcgagcccggcgacgagggcggcgctgcacgtgctggtcggcacgacgtcgtggggccgcaaccgcgtgaaggcggtggacgccggcgcggtggcggtgctggtcgacatgctcctggacgggccagtcgagcggcgcgggtgcgagctggccctggcggcgctggaccgaatgtgcgggtgcgcggaggggcgggcggcgctggtgtcgcacggcgcgggcgtggcggtggtggggaggaaggtgctgagggtgtcggaggtggcgagcgagaaggcggtgcgggtgctgcggtcggtggcgaggcacgcggcgacggcggcggtggtgcaggagatggggcagacgggggcggtggagaagctgtgcgtggtggcgcagtcggagcagtgcggggagaggacgcgggagcgggcgcgggagacgctgcggctgcacgccagagcgtggaggaactcgccctgcttgcagcctcacctccaggccctctacccttcttgctgatcgaattctgattcatgatcaccggcctcatcactagctagctaccaacatacagcacagagagaattgaacacttgttcgattcttcctttcgctcgattaattttattgagttgagatcgttcgatgtagtcctatgaatcaaagtgtacagatcgacgcaatagatgaactaaatcatgcgcgagctttttttgtttgggtctcgaaatatctccttataatcgtctactgtcaaattattcttaatttcgatcttggaagctgagttctgtacataaaatttagaactatatatagctagtttttccaccatcatcgatcgatcatagacgaccagagtgctggtcaattgacatgcagaaacgcccagaggtctttcagctagctacataaggtggtgggctagccgacctggattaaagtctcgctccttttatttatttgatataaggttattttttaatattcgtattttttttctagtaaatcgacatgcaataatgtttttgtacatcggagattcattcatcgagagctagatcgatcgatcgatcgatcgatgaggataatccagccctgtccgtctgggccttgaactcgcggaacacactgcttgtcctcctccgtgaagcactcaagcatgcaggcatctgcatccatttggtccaccttcatgtcgaggaacaatctcataaatgtaggccaaacgggaaacttaagcccatgaagggcccagtacttctaatctcgagggccatcttaggcttggcatcatttcggcacacagcatttgggcctagtggtactgtcccatgcagccaacatcgaagaaagtctactattcatctcaaatgatggtacacgttttatttgcgtctctcaaccataaaatcaggtacaaagcgtcccttaaattctaaaatcagtacaaatcaagttccttgacgctattaaggacggtttcaactgacgtgacgcctataggacggttctatagtttcgtgggccctaggcgaactcaatgatatgggccttttaggctacttgtgttttggagagaaattactaaatatttttctatatcttaggtggtgttcttttctcctgaagatgaagataaagattaagttttttttatgtaaaacgaggtgttattaacgtataattgattgagttttaattattacaaacttggaaaatagagtaatatgatattttagaacaactttcatatagaaagtttttgcacaaaacgcaccgtttagcagtttgaaaagcgtgctacgaaaatctttatctttatccaactcttgttggagaaatgaacgggaagtgtgatgtacataaaatagttgtttgcatcattccgatagatacgattttcgtgagatcatcgttgataggagagaggaaggaggaaaaagagaaagaaaatgaagcgtacgtaggggaattgaagaaaaaaaaaagagattcaatttggttctggatccgcccctgcgtttgagttaagcacacgtatattactgtatatatttcgtgttgcacgtgtattggcttattagtttggttttccttagttggttaatttgacttaggggtgcggcatgcatatgtttatgcagcattcatggattgatatattctgttggcttgagctaattacatgcagcaaattaatcgtgacatcttcatgttaatcgtacatattggtagatagcttctactggtcgatagtagtctggcagcccaacatgtattatgtatacgtatatgtatatacattatacatcgagtgatctatctagtatagccacaagtgcaagcatatttctcttttttggttgattagcttgctgccgctctgccgtattagttaagcatataaatatacggtcgaataaacggcctacggatggccccctccttaccttctagcctgagccctagtcggtcgcatcacctgtctaggtgcctaagtcagcgctacctatgcggcttgttgacttagtctttatcccatataacttttaggtggcacatattagaagtaataataataaaaataataataaaagatagatcataaaagggactcacgtatcacatggtgccagtagaaaaatactaaaataaaatatgttgggcccacatgtcagtgggtgtctgtaaaaaaaaacactacacattagcaagggcttctatgattacagccaggtcatactaattgtggtactagtgctagctgagtatgttgaatttcaatgaagaggacatggcccctaaggagtcactatggattctcgataagtcactatgggcgctcgatgagcgctagtgcgagcaccacaaggttgcatgagacatcagcaacaagaggttgtgcttcaatgtcatcaagcaaagcatgcgtcacagctacgagttccaacaacccttcctaagctaggcataatctcttcggcagaggttgacatcgcatcccacaacctcgcatctttgacggcgagaagcactaaggcgggtctgtcgatgtggtcatgtgcaacgacctcccggtaaagttgattggcatgtcaactctcttaggacgaacaagttggtgtcattgtcggtgtagtagctcgtgtactgtgacacaaggagccatgcaatggtgagtagagagcgtcaactctcttaggacgaacaagttggtgtcattgtcggtgcaacagttcgtggactgcaatacgaggagtgcaacgcaactaggagatcagtgcatttttctacatcgagaacaatggcggtttggcgttggatgactaccctacatagtaagcaggatttctactagaaggtcacgagccccgtcatcacaatcgacgtccatgtacgagtggttatatacaaggagatcaagttgaaggaggcgtggcatcccgacccgtcatagtggaagtcaatgttggaagtcaatgccaattggagtgctgatgcccaaggcccttcaagcactacttatgtgtccggcaaaaaatattggattatgagaaactcataacacaaacgatagagagatgacggttacatgttgatgaaactacaagtgcacgtgatcaattgcatgatcaggagcgaatccaacatgggtgtgctgggggcccatgccccctatcctggtggatttctatatccaaacatgcatgcgtcatcacgaaaaattagcgcgatgacggacgaaaacgcagacaaaaagatgtgacgatcggaaagttacgcatttttaaattagttaagatatagggtgtgctaaattgtatccatcgtcacatattaatcattatcccatgttatgtaaagctgggacaaagccttttataaataaataaatcatcatcgtatattaattcgtatgtacataatacaataagcctgtcagctgctcgtggaaatgatattatatgtagagataatctaagaaatgctatcgacaagcttccaaatccaagaaatgtcattgataagtgtgagttccaagaaataccatcatacaaacgattttctcctcgttgttagggttccgttcattccgcgtcgttaaatacactgttcatcctatactccctccattcaaaagtttaagacctatttctttttacaccaagaccaatgagtaattaattcaccatcatatgacgaaaccaatgaacatgcaaccaataagtactaaaatgacttcttgggctctttcaaaaaatttaatatagcacatagtgactaaatatgatttagatttttggaaaaacttttggacttaataacacggaatgtacgcaaccctaacggtgatggcatttttgggataaaatcatttctacgatggtatttcttagaactgacacttgtcgatggtatttcttgtatttggacgtttgtcaatagcatctttggattatctcttatatgtgtggatttgctaaacatgaaaaatcaatggcacaatctgaaggcccatgttgggcttgtcggcatgggccactgatagcatttggcccatccatcttctcattcagcagcatgcagcaacatcattactgttccctgttctgcattcctgcatgctgttttcaaaacaaacaaatgctccctccgtcctctaatattagagattttgatattttacttatactgtttgaccactcgtattattaaaaaaattacgcaaatataaaaaacgaaaagttgtgcttaaaatactttagataataaagtaagtcacaaataaaataaataataattttaaaatttttgaataagacgaatgataaaatatcaaaatttcttatattagagtacggaggaagtatatgggcttggctacagatcagagttgagaagccaactcattgcaaggaaaagaaaatggcacacctacagccctacggtattaagaatactttagctcatcatcatgtattggaagaggacatgtatgatagcagggcatggaccacatgcacacaagatccacggaacaaactgcaataatcctcgagcatcgacctagctgccccttgtttatgcatgctctcttttcttctcttctcatctcatatcgtagcaccacattgactagtaatagaatgcatagtatatactactgcataacgaaggaatatagtaatagtgggagtatatacttttctgaacttgcacagaattgttgtcggtgtttataaacaaccgaagtctctctcactctctctctaattttcaaaaaataagcttactgaagtttatattgcacatacttctctgaacttctgcagaaattctgtctgtatttatagctaactgaagtttactactggtatagtatagtatatacttctctgaacttctgtagaaacgctgtctgaatttatagcttgtttcctgagcaaatttttgcagacacagagacggtgtggagaatccggcaaatgcagacgaaaaaatatcaaaaactgaatagaaatatatgtgtagggccaaaagtgatactactaattaagtagtgccacttgacaaccacatgcatagagatgatctgaacgaagaggagttcgtggtgggcttattcaatttcaatctacctatctgtgccaattgttggttagctctcgtgttaggggctgtttggtttccagcgacttattacaagtccctgtcacatcggatgtttggacattaatttggagtattaaacatacactaattataaaacccattccataagtttggactaattcgcgagacgaatcttttgagtctaattacgccatgattttgacaatgtgatgctacagtaaatttttgataattatggattaattaggcttaaaaaaatcgtctcgcggattagctctcatttatgaaattagtttttttattagtctatgtttaatatcctaaattagcgtccaaacatccgatgtgacatgggctaaaaagttttagccccatctaaacacccccttagactgtcagcataagaatatacttcctccgtttcacaatgtaagactttctagcattgcccacattcatttagatgttaatgaatctagacatatactttctagcattgcccacattcatttagatgttaatgaatctagacatatatatgtgtttagatttattaacatctatatgtatgtgaaaaatgctagaaagtcttccattgtgaaacggagggagtactatatatcagcatcagcatgacagcatgggaatataatggaatctcagctgttaaactatgcttatctcatttggataactcacgacgccaccgtggcagatcttgctaccagccagctgcttgctctgacaataccaactttaatgatgattaataatgccgatctttcaaaaaagaaaaatcagtactagcttggttaattaatggcagtcctaatactaatacgatttgaacacatgcttatactgcagtgctaattggagtactccattgtcgtttacactccatatacgtgctggatccattgtcgtttgttccacgtacgcgtacgacatgacacattttgtctgtgttcttcttcgtgggtcagataatgctcgcgtgtttcgtcttatgattgattgtcacatacaagtagcttatgcatcgatcgatcacactatcagcttgcagccgcactccaattgatcaattagccgattggttgacgttgattgattgatcagactggctaaatcctgtgcaaactttatgggtaattagtcactgaacctatgtcctcctagtcctagctagctaatcaattcgatcagtggctgacgatgaacagagatgagggagaggagaggagatgagtgtcggtggagcggcccgggcgtcaggacaccgacgacgcatatgcagtgcagcagatgctggccactggccagtggggacgacgaacagactggactaacgtacttgcggctcattcactccacccttaaattcatttcacccgacaaattaatcagagtctatggctttgcttaattactcctagatataatcaagtacgcactcacccgatccatgcagctttctttgacgagaccgactcttaattggttttgggggcacgttatagcaggtccaatagcatgctataagccagctgcaaacatattttaaggagataaataagaagagagaagagcagcgggctacagatttgtagccagctgtagcacgaactccaagacgcagtgtgtgtatgataggtgagaccagatattaatagtgtagtatataactattgtattaatgagctattatattggttataaatgaattggagctagtagttggctatactattgaacttgctcttactgattccggctgttctgaagactgatgagactgagagagagctggctgtaatcaagaacatttcagtgcaatgttagtaactgaccggaggtgtttcttcagctagctcgtacatccagcaagctgcgagctggctagcatgcgtgcttctgttgaaattttgctactagctagctcagatcttctagttaaactcatcgtactgataaacaattcaaggcgcggcgaagaaaatggaaggcaggccagttgtctcgttgtaagttcaacttcagtggcgtcaaccgtcaagtccgaaactctgaaagttaacttctgaatgcagattcatgcatgccatttactgaattgctacttcatacgccgagattactaaagaacttgatcacacagtgtcacactataaacatatactccaccaattaattcaggtggatctgcttgcatgagcagcatctgtttcctgttactttcacagcaaggagcttcatacgtactgtacgtacctgcagatatatagacagacaggtttcagtttcactggagatagcctgcatggtcagcgtaatcctagtacaaccgatccatctgattcggcaccccatgcatgtgttcttggagtgtagatgcaaattgctcaacagctagctacctagctagctgtattagcgtcttcctggaggcaaatctgcacactggattggaatatttgatcagtaacatgcatagaagcacatagggagagtattaacaatttagtaattgacatgagctagcagcaatatgctgtacaagtgcacaaatccagacaagtggagtacaattgtagcatagcagaatagataaatgggataactgaagcatgagcatgtgctagttcttttgactgtatatatgtatccatagtgcagtagtatggatacatgttgctttctctctttgacattttgcccggtagctgctcgacaacagattaacgctctccattcctcccttttctgcaacacaaagtcacaaagacatgcaagcgtgcctatctttgtcttttgcacaccgactgtatgagcgaacaattattcttttaactgtatatctttttctacctatctagtatttatctactactatgcatgatgatttctgcaccttcagaaaattcagactactcaaggattaacactttcatcttcagagaaattaaagaaatttgcagagaggctggtatgtttttcttttatgcattgcccagcagcagcaggaacatcatatattatacaattcccaggcagttttcagagaaaaggccggtgctgaagaacagaatcattgctccacatggtccttctccttccttggtagactgaatgctaatctgtcaagacaaggacacaaaaaacataagacacaggaaagcaaaaaactgcatgcatgctttgattgagtgatgaaaggaaggaaggaacatgcatggccatcactaccactaccagactaggactgctactatgtccatcactaaaagcctcaaaccccagccggtagtgaacaaagtgcaaacaagaacaaaaagtaaaccggaagcttcactgcaatgtggacttcagctccttgataagttggtatatactgtagctggtaatgccaaattttgtactgatgcaatgcactagtaaaaactgtctatttggagtaccaggttggtagatgagtgggttaggctacatacatttgtgaaaggagagaagcatatttagccgaataatcgtgcaaatagcaaaaactgaaccaaaaacatgtatatatgcagagatagcgaaaaccaatatgtatatggcactagaaatgaatgcaaattgttactctatagggggagggacaagaaggagatgatgccactttattaaggtggagtacatagctgtggaacattcagagccgcgagacgtgagatgtttgtcatcacgcacaatgtatgaagcacgatgaattgcaaacatcatcgacctagctacagtattggcgcaattagagcaaccataatagtaaagtaaggtactatctataaaacatgtacatctcaataatagactagattaatagtaaaccactttaatggtatgtctacatgagtatctatagctctctaatccattgcctcgtttttctctatagactatcttcagattagtagatagctttgctctttctcttcatttaatctctttcaagtagaaaaatacgctgacatagatcttttgtagagagcctataaataaccattgcgggtgcccttagcatgcacgatgcaatgtaattacaatcgtttaattaatctgtgggggaatcgaagaaacatggatgttgatgcgattaatatacttggtgctagctgttcccacgaaccgtaggtaattgcaccattccaagtataaacttggcgtttctttcttcgatgatgccatcaccactttcccaatatttgaccggctggcatgcacgcggtgtataattagaggagatttatactcctatctcacataagaggcaacaattaaatcaaggatttgatgccatggaattgaattgaatgagcataaaaaatatatatctgattcgatcgatattaggagtacaatatatatttactgttcctccgaaaagagaaagagagaaagatagtgctactacagtgttgttgataaccgttggttggttggtccagacaagttaggaaggaaggggggaaatataatgtgggggagccaatcccggcgagtttccgggtgtcctctgttacacccgcaattccatcgatcaacaacaccacactgggggggtgtaaacctttgcattttattttcttttagtatttatttattgtcccaggctgccacgcgcattggcatgctacatcaagacttgcactgtaagttgcaattaatcacctggctggaaggaagaaaacaaaagatcatgatgtgaatattcacatgggagataagatagagaaaaacaaattcaaatgtaaagaaaacaagacaaaccaaaaaacacttcaattggcaagtttagttcaagtcctaaactttatacgagtgctcttattttttaattagtagacgacgcatccgtatttatgattaattattattttagtggtaggtgacgtaccattgaacaacgagatattcgtgatgacttcgttgatacgaagatataaatagagagtgtgtggacgcgttgtgagccccgtgtttgtactatgttactaataaaagcactaaaccctctttgattttgtaagcctttttttgtcattttttcttgaaagtacccctcttatattattgttgtttttaatacataatatatgatgtatttgatattttttaacaaatatttgaccatccgtcttattttttttcacatataaaaacataagtagtgtttaaagatcatttgactataaatcaaatcacaataaaataaaaatgagtattacataattacttttaataatgcgattggtgaaacgtatctaaaatatcaacatcgacatatataaaacacatggaatattgtagtagattttgttggttatttgaagtggtaatatgattccactattaaacttagatttaaaaacttagcaaagtttgataggcacgtcggtgctttaggagttggatctggagtggagttgtggtgttgtctatacccagtttcacctcctctagtacattttgtgagagagctttgtccagctccgcttctatgttagatggtgttgaaattgtttaactgagcccgagctcaagaagagatggagttgagctgaagttgtaccaaatataccctcgtaaaagcaccaacgtataaaagccaaaagataagcctaagctaaaacaaggagcaatctaatcttatcactgctaagattttttcttaaaaatggaaatcattaattaactaaaaatatattttttataaaactgaacaagtaaaacaaaaagaaaaagcaaaaagtaaaaagaagagcgacccagcaaccagcattcattccttcggcacaacaccacgctgaccacagtccaccgtccgtccgtcacccgctccccctgctggccggaaacaatgaaatcgccttcttttgtcccaaactcttcttcttctctcttccccccaaacacaactgaacccaacccaacaaaccaccaccacgctgaccgccctcaccggcgagccagcgagcgacggaaggaggccgcatgcttccacaactacaacctccttctccttctccttccgttttcaatgccctccgcctacactagatggcccgccctcttcctccttctcctcctccacgtatcagacgccggcatcaacccgggcgacctgtccgtgctccacgacctgcgccgctcgctgaccaacgccgacgccgtcctcggctggggcgaccccaacgccgccgacccgtgcgccgcatggccgcacatctcctgcgaccgcgccggccgcgtcaacaacatcgacctcaagaacgccggcctcgccgggacgctccccttcaccttcgccgcgctcgacgcgctccaggacctcagcctccagaacaacaacctctccggcgacctcccgtccttccgcggcatgggctccctccgccacgccttcctcaacaacaactccttccgctccatccccgccgacttcttcagcggcctcacctccctcctcgtcatctccctcgaccagaacccgctcaacgtctcctccggggggtggacgatccccgccgacgtcgccgccgcgcagcagctgcagagcctcagcctcaacggatgcaacctcaccggcgccatcccggacttcctcggcgccatgaacagcctccaggagctcaagctcgcctacaacgccctctccggacccatcccctccaccttcaacgcctccgggttgcagacgctctggctcaacaaccagcacggcgtccccaagctctccggcacgctcgacctcatcgccaccatgcccaacctcgaacaggcatggctccacggcaacgacttctccggccccatcccggactccatcgccgactgcaagcgcctctccgacctctgcctcaacagcaaccagctcgtcggcctcgtcccaccggcgctcgagtccatggccggcctcaagtccgttcagctcgacaacaacaatctcttgggccccgtcccggcgatcaaggcgcccaagtacacctactcacagaacgggttctgcgccgacaagccgggggtcgcctgctcgcctcaggtgatggcattgcttcacttcctcgccgaggtcgattaccccaagaggctggtagctagttggtccgggaacaattcctgcgtggattggctgggaattagctgcgttgcagggaatgtgacgatgctcaatttgccggagtatggactcaatggcacaatcagcgacagtcttgggaatctgagtgaactctcggacatcaacctcatcggaaataaccttactgggcatgtgccggatagcctcacaagcctcaggttgctgcagaagctggacctgtccgggaacgacctgaccgggccgctgcccaccttcagcccgagtgtgaaggtgaatgtgaccggcaatctcaacttcaatgggacggcaccaggatcagcgccatccaaggatactcctgggtcttcgtcgtccagggcgccaaccttgcctggccagggcgtccttccggaaaataagaagaaaagatcagctgttgtgttggccaccaccatcccggttgcagtcagtgtggtggctctggcttcagtgtgtgccgtgctcatcttccgtaagaaaaggggatcagttccaccaaatgcagcttccgtcgtcgtccacccccgcgagaattctgacccagacaacttggtcaagattgtcatggtgaacaatgatggcaacagtagttcgacccaaggcaatacacttagcgggagcagcagccgcgctagtgatgttcacatgatcgatacgggcaatttcgtgattgctgtgcaggtcctccgtggcgcaaccaagaactttacccaggacaatgtgcttggccgtgggggctttggtgtcgtctacaagggtgagctgcatgacggcacgatgattgctgtgaagaggatggaggctgcagtgatcagcaacaaggccttggatgagttccaagccgagattaccattctaaccaaggtacggcaccgcaacctggtctcgatactgggttactcaattgaagggaatgagaggctgctggtctatgagtacatgtccaacggggctttgagcaagcatctgttccagtggaagcagtttgaattagaacccctctcatggaagaagaggctcaatattgcactggatgttgctcgtgggatggaatatctgcacaacctggcacatcagtgctacatccatagggatctcaagtcagcaaacattctcctcggcgacgatttccgagcaaaggtatcagactttgggctagttaaacatgcaccagatggaaacttctctgtggcaaccagactcgctggaacttttgggtacttggctcctgaatatgctggtaagaatcgctttctctggaagtatatggttgttgtgttaatttggatgcttaaattgtactagttctctttgttatgtgttacagcaattatcgttaacagatgacacatgaattagatttgaatctagttatattgtctacctgtcccagtgactaagggtcattccactgttgtagcccatgaaaatgcctttgaggagttaaggatgtgctagatacaactgaattcctgatgaactaatcattcttaaaaaaaacttgtcactactagcttgcaatacactacatctcgaaccacttgacgagatggtatcattgtttctcttccatggaactgtgagaacaaatgtgtgatatcatttgatggaggttgcattagtatttgtcctttccctgtttgttatgctgccttgctattatgactcctgaatttatggttgataagttgctttaatgaccattgcagtgactgggaaaatcacgacaaaagcagatgtcttcagctttggggtagtgctgatggagctgataactggaatgactgccattgatgagagccgtctggaggaggaaacccgttatctggcctcatggttctgtcagataaggaaggatgaagataggctcagagcagccattgatcctactctggatcaatctgatgagacttttgagagcatctccgtgatcgcagagcttgctggccactgcacatcccgggaacccacccagcgaccggacatgggccacgccgtgaacgtgctcgtcccgatggtagagaaatggaagcctgtgaacgacgagaccgaggactacatgggcattgatctgcaccagccgttgctccagatggtgaagggctggcaggacgcagaggccagcatgacagatggaagcatcctgagccttgaggacagcaagggcagcatcccagctcggcctgccgggtttgcagaatcgttcacctcggctgatggccggtgaagcatcatatatctacaatacaaataagtacatgtctcctctggacctctcctgtttccctatagtgttcttgtaggtaaaagagtgcattgtccatgtgcttatgcttctgtagatagacatccatttttctttcttttcttttttggtaggattgctttcctattattccaatcttgagactgaagtttctgcctttttctagtcatcggggtcatataatgcttctttagtttactgtacttgaaaatttttgcaatggcatctggtggcatcaatgatccatatcatgagtcttgtactgtttagggagcaattagtaccaatccaggcttgcatttggcacttttctgaaactctacacaggttgcatcatgccttgataattatcaatgttctatatgatctaagcagatgctagattatctaacaattactagagcacaggtaaaatggtgagcttgcagagataggccaaagtgtgagcttcctcctgaattttgtttgcagttgcagcatgctagtactattcattttcttagtggttgtgctccactgatttggtgatctggtaacgccaatagagtctgtacaaatgtagaattggtgtaaaactagtgatggttagtgtggttagttgtgacacctaaaccctgtgttctctagatttttggcttgacaatgactgcaaagactccatcgagataatgggtgtcattctttcttgaggactcaccgttgatatcaatcgatttgttgtttaatgatgtgtcgctatggccagctagcatgcattaactttgtggccgacggagtagatgtgtcggtgtttgagtgaggttactacatctgtatacatacatgatacatggcttcttgcttcattgcttgattgtatctactgtacgggcatatcattgcaaaattttcgtcgcagtatggggactacttactactatgcacaagtatatgctgtacacccatgtgtaattgttcagtacatcgtgagaaataaatagtacttatgtgggataatcttctgaagaattttttgaagaggaacttgttgctctatgtgatttggtatcggacagtccgtaatctgtgaccaagagctctcacgctcttgtcgtgagccggtgaatggccaccacggcctcatcacgggggtaaggtaggcagcacatctgcatcacgtagagaaggcctaggagcaaaatactcaaacgccaccggtacgattggcattacacgattgcttatccctttatcagcagctgcctgagctaaacttagtttctggtccaaaccaaagcaggtgtcaagtcactgctagctagtgcatacatacagacatgtaaagaagcgtctgtgtatgtagacgacactgcagaggaatagataacatgccatttccccaactcggtgttaataaaagaagcggtaaggacaagatcacaagagggggcaggcagatgagatggaataacacaagtgtgagcttgggcacgaggctttgcatgtgaagagcagcatgaacgccatgtggtggcacagggagttctcgcctgtgtcttctctactcctctttggggcagcagcggcagtggcacggcaattattgaagagcacagccccaccagctaggctgcttaactccctctctgcccggccattgccattggcattgccttccacatggaagatttgccacttgttccagacaagaatggcctcttgttccagccaagagaaaatggcgcccatttgcattttgcatcgccgttcaatctaggccggtcagatgaggtcgttgtgggggtgtgtgtgatgcatgggtccctgataatactccatctctggtcccagattgttcagttactccactcctactatgttagtactagtatccatgattaagcattgaagatacccaaataatccatcttcagggtgtaaatacaagtagtacaatactctacttttgtgttcagttcagttattctgtctaaacaccacagcagttaaatggttcacgaaagaaaaggggtggaagttagtaaggtactagtacactactactagcaggcatcaagcctgcgcaagttcatgagggaaaagaagcagacacacatgaaataaagcagttcatgagggactagtaaattcagtcgacttgctttcctcaccaatgctcgaggtcaacctttattggcatttaagaatccccacacttcatgctgctactggtactccaaatcttgtacaatcagagccacatctggaggtggaggagcaagcaatacatcttcctaaccacatttccttttctctataggggacaatatcatgacacagtacaaagcataaagggcagtttgtcctcgcacaacaaaagccacagcaaccttcatgccttgatatttgttgtcaaagaaactctctggtccttttctaagaattccatactgagaggatgttggaggtagaaatacggtacggagtaaagtaacaagataattattgtatcagtttgcacacttcgatccaatgttgggataataattgtcaggataatgccaagtattcaaagatactagcatccgttaattcatactaataaattattgtggatctatggcaacatgagagcgctctatataaagaacttcaggaaattcgttgcagctatgatgaagttgtagttgctggatctgactgtagatatggggcaaagtgtttcagggctgcctcatatactggttttttgaattcaactgcctgctcaatatgaaattatatcagatactacagaagcagggaatcagaaaaacattgagctggtaaacagacccaccttttcaataacttgctgaggtgtcatccatgtccattcacaaaactccggcctctcagatccgtcaccattaaggttaacctcatcttccttcccagtaaatctaaatagaaacctgtttatttgcacccatatgttcacaagttacttgtggatcacaaagacaagtgggtattatcctttttctattggcatttcaatggtgcacattgcattaacataatcaaaccatgtcttagaaagttgtgatcttgtgatttagtcaagtctatcctaggcctaaataacaagtatgagcccaggcccaacccctggcctaagtgaatgagtgtgaaagatgtaaagtgatggcataaatgggccacaatccttcataaatggttcacaagtcactttggaatcatgaagtgttgaagacatgtgagtaatagtttatagcttacagacacactattagtatttgaatgctgcgcatgggcattacacaaacatacttacctgacaaatttggtgggcttttcacttattaatgtctaggataggacaaaatgatatgtctgggcccaggcctatccttggcgtaaaagtaagagtgtgagatatgtgaagttgataccatacaaactaccagccaccaatttatatcagtaatttgagcttttaggacaggtatctactggaggctaccaaaattatcagattttatccagagatcacacagaaaacacttatataagagttacagccaatctatctgagggatcacgaaccataacaaacactgaactgaaggaccttttccacacttccactaagtatgggactatctagctgtctgagactgtatggtatgctacatatcatggacaaaaataaaaaagaagcttcctaccaaaggatgcaacacagaaacattggctcagcacaagtatgatcctttggagcgagtgtaaacggggtagatagatttggctgtccatctctcacagtttagtggctcttctgatttctgtacccagcccctctccaagaagctttctatttgaatttttgcccctgatagattgaagcttcctatttgaagctgtaagcactctagatagattgaaactttccaatgcgctacagctggagaactggacaatcacatgtgtgtgcacactgtgcaatacaagcgtgtcaagtgtaacatatactgatacacacacatatgggcgcagccaggaaaatatgattcattggcagctcaaggttcaatctatataaacattctaagagcactaggtttaaggtgctggcataggcttccgacaggtatagtatcatttctaggaaagtgaggtgtaacatgtatgctgcagctgtggcatagatgattttccacattttacatatactatttatagtagttatggtgcttataacttaatcaatatcatatttagcacgaaaatcgctaaaccggtacacttcgtggacaagacagtgtttctctagcacagagacttagaacaagagcaatctggcactctttagtcataactgtgagtttctgcctggcaattaccatactatcttaaccatatggctgtttatcagataattcttgtcagactattcttgcaggtctaaacagataccacacaaatgttggttactagcatcattgttggcccaaggaaatgagaaggctaaccatttctgagcctgtcctttccagttcgttcctccccacctagcattcagcttttctttcacatcaacagggaaatcatacgttaaccaaacggggacctacatgaacatatacatgcaactcagtcagcaaaactagttacgagactgattatgacaaacaagtatcataaacacgcagtattaggagagacgctgcaggtttgcaagcaattagcagccgtttgcgtgaaacagaagaagtttgggagtgggcgaaaggccaatagctgacctcagccaccatttctgcagatgtaacacccgtttcctccctcaattctctgaaagcagcttccctcggatcctctcccgcatcaataccaccctgtggcgaacatcgcacttgcggattaacactcaacaacctctcgagacaaaacataggagcagttgttcatcacctcacctgaggcatctgccatgtgttggcgatgtcgatcctggacgcggtgaaaatctggggacagaggagagagcacacggaaaaaattggtcagttgaagcaccgacgaagaggaggggttaggtcgcgggagtggagtcgggagcgccgcttgccttggtgagggaggggtcggcgaggcagatgccgacgttggtgcggtagttctccggcggcgtctccatggaggctacgacggcgagcggcgacgcggagcaggaggaggagagcgggcgggtgaggcggagcgcggaggaggggaggagaccgcggcgagtagcggtggtgcggaatcggatagggctcacgaggattggggggaggcgtgcgacggacaccaccaccatcactccgccccgcggctatggatcgccggggaagaatctctctctccccgatttgccctgcagcttcgctgacaggtgggcccgtcaagagttgggccaggcccacactattttgccacgcgtttcggcctgcaggcctaacagggagacccgggccaatataccgtcgcctgagactttgtttttttctttttctttttgcgaaactttttttaaagggaactttttgcgaaactttgtttcttttacttcatccaatcaataatattttttgtttatgataatatttaatcaaattttcgtcatcaacaatttcttagtttaaaactaaaaatgatatatacatagacttatctcgaaagtgctatagtaatatcgtaaacttattagattttataaatgttaaaagtttgaatacatatttttttgtcctacatggcaaatactcttttaatcagaggaatatttgcctaattgctcgtgcgtgtgattcgtttctctccaagataggggatgatgcaagcatggagcaactaaggtttgagtcttaggcttacctcaaaaatcatgtataaattatcttaaatgataaatcaccatgtacttataatgaaaaataataattcattagttgagtcttaagctagccctggtatttagtctttggtaattttttggctctgtcattgtttaaaaaagaaaataaaatacactgattttttttaactggacccaaaccccgccgctaagcaagtacggagcactcaactgtgttgtgctcccgttttgcttggtactacctgtcaacttgccgctccaacctccaagaagtttccactgttgtgcttgtagcgaagctttaagcacggtcaaacggggcagccaaccaggtggtttaggttaggctccgttcaaacaatttgagaaatttcgtcgaagtattcggcgaaacttgtactgatctaattcggatactggactaaaattgtttcacacaaggaaagggaagggcaggtcggttcattccagaaaagacaagcaaaggggcttaaacagacaaatattgttgggccacactatcatacagtacgttgataggagtgacggcccattgttttatatcctggaggaaaagaaaggaaaaaggtagcccagcccagtcaaagggccccccataacttgctgcgacggccatatgaatccgtccgttatgatatcctttctcctgcgcgtactctctgcttggtttgtattgtctgttggagtccataaacgttttatcacatgtgcatctattttgccatgttttaacccgtttttaaggagtagcacggtaataaataaaatgaaatgaatgcctatttattctaattaaatctttggtagtacggtgtttaacttgcgtactgtacaattgtacatgtattgtcaggatctgctttattaatgttgctggaatttatagtaggatttgaccatagtaaattaatttggaggaattgttttccgattttagatatatatatagacacattgttccactggtctgtatagatagagaaaattaactaggatagggacggataaaaacagccggaatttaaaagtagagtatttacacgcttttttaaccttgtgcgggcatacataagcagaaataaaaaaaaagaatacatctaagctgctattgctacggaggaaggcggaaacggtccgtgtatatagccgccgccttcaacgcgtttatcacgccgaatccatggcggcttcacgtggaccgcggccatcatcatcaggctgcagctgcagggacccgacccgaaccgaaccgagccgagccgagcaggccagccaaacaacgagaacgcgaggcggtcttccgtttcaccgttggcgcacaggtgtcaccgccttggccgaccacgcctcgcgcgtacggaacggaaaccggcaggaaaaatctggtactcgcaaccgtggcggccacgccggcgattgcacccgcgggcaagtaagcgcgcgcctgacgtggcacgccgatcagccagtcaccgcgtgggaccacctcgcccctcactgccgcgtggggcctcaagtaccttggcctgccttggttcccaaggaaagcgaccacttcaggtccgcccgcaccgtcctccccaaattatcatccccacccctcaaccccaaaccgccttatctcccctctataaaacctccccctccgtcccccactccccagatttctttcacagattcacgaattccacccgtttcgattcgattcgattcgattcgatgcttgtgccctccgccccgggagagactcgccggaattcgattgcttcttgctggtagggggagccatgggagagctggcttcctcgccgccgcccgcggcggtgctgcccgtcgtcttcgtcgacggcgaccagaccgtcgacctcggcaccgtcaccgtccagccctccctcggcgtccgcaagctgcaggccgtcgtcgccgacagggtggggctcgcgccgcagcagatcctggcctcgctcgcgcgcccccgccgcgcgcgccgcgtgcccctcgaggaggggaccgacctcgccgccgccgtcgcgcgcgagggctccggctgctacgtcctcgccgcctccgccgctcccgccgcgagcgccgcggcggccgctcccgccgcgagaagaaggcggcggccgcggcccgcgcggcgggggccgcgcccgctgcgccgacgcaggagaggactatcctcaagcgcctccccgcgatggatctggcctccctggcctcgaccccctcgccggcggcggcggccatgttcggcgtctgggactacgaggcgcagctccaggagctgcagcggcagcgcgagtggtacctcatgcacacggcggcggcggatccgtacttcccgctggcgccggagcgcgaggacccgcccttctggtcagcgcagccgctgctgcggcaggggacgccctcgtcgtgccccgagtgcgaggcggcggcggcgatgatgcgggagccggggttccactggtgcgtgcgcgcccggtcaccgtcggattccgctcactggtggggccaatcgagcgcccggcgaagaaatccccctcgccgtcgccctcgccggctcccctgccgccgacccccggccgactcccgccgtcgttcgtcgggatgatgcccgtttactagccgtcgattcgattagaagaaaaaagaaatgtaaaaaaaaaagaggagaaaaaactggaattggggaggcttgcgtgtggaattggtgcaccagcgcagaagaggagttttttttttttttttttttgttatggaggaggaagcggccaagtgcgaacgagtccagaggcgctggacacgttggagcctgcaactagcttagctgttacgaagaaattttcttttttttttcttggggtggttactgcttgctgctagtgctatgtgacaggtggtatgaggtggtacgagcctgaccaatgtggctcggtcgaatccagagatttggaccaacatctctggaaccctctgttttttcttttttagtttttctgagagagcgggagagagagagagagatgcctgctggatgattggcatttgttcctggtatatcaaagtggtatatgcagaacaacattttagtacctacttgagtatgtgctgaattttgtctccagatcagtttttcttccttttctgaattctgatgtgtgtggtggaaaccgtgaaagagctgtatcgaaacgaagaagggtgagagaaaaacgacgagttcaatcggttcccgcaacgaaaccaaccaacaaaccattcgagatttttgggtggtttttgggctggatgcgtgaatggaaaaaaggtggcgaaaattcatccacaagattggccgttccaagtcgtgttttctcgacgccggatattccatagtcctctcgcacgtacgcacgtacgctcgacgacgacgtgaagcgctgtcagctagtacgtatcatccaccacgtcatggatggagccctcaattccatggaaaaatattgctgctgctcctcctcctacatggaactcaattccatggaaaaatattgctgctcctcctcctcctacatggaacggatggataatcatccatctcgtccagccatggaagcagacgattggaggccaggggtacaggacagaggtacgcgtaacgctaaaacgtgcgattttaattgtggcgtgtgcgttaatactaatccattatttaaatgccaattaacactgtagccgccaatgtctcccccaaatttagggctggtttgatttgaggcttaaattaagcttaccaatattttgcaatttcaatagtatttagtgtctatttggtttgaaaccaaattttggcatgcctaagaaaaagactattttaatagtgaacttaggctattttggcttcaatccaaacacaactttaccttaccaaaattagtcataccaaaaattgtcaaaatctggaactgctaaaatttgaaatttggtaagacctatataggccacaaaccaaaccaacccttattgtcaacccgtctcttctctctcgcaaccaaccgaacaagccaatggcagctaccatagcatagcataggcaattaggcatatactagcacggtcatggtccaaaacaatgggcagctgctacttgtttcaggggaggggaacgtatcacgtaggagtatgcatgatcgatgagtgcctgaccgggtcttcgtggccattagcgacctaatcacacaattattagcgaaatcatgtgccatctgtcacgacctgctcctccaaccgtttcaaatatatggctctaatcgaatactactacatttgtcgagatcacggtacgtagagcggatgatgtgattctcctcccttcaggtgacaagtcaaactcgattcctggatttttcaacaacagtggatcaattgattaattaaacttcgtcgagttgttttttttttaacgctgcgataacgtcaatgataaacaaattcaacactgcagtacttttctcaaattccccacgctgttgttttggatcataccaaagacccggttattgctagcaggtcgattgatgttttttccagtatacaaaacagaagctgtcaaaaaccagtcaacctcgccaacaacgacctctagagctggaagcgtcgtacttatatttattatattatgttctgtaattttatatttcttgtttacacgtacttttgtggactgccaaaatctgctaggaatgtaccaatgcctgtctaaaaacgtttccagccatggttttttcaaacatacagagattgctggtatatctaaacaaacatttacaggagcaaaaatttatatacgtaggagaaaacaagagttgatggaagacagaaggtaaagggagttaatttcgtgtttttgattggaaaaaatcactcttattttcctttattacttcagggatgacgcatgaataaaatgtgtaattatatattgttataaatacatgcaacaaaaagaatgcaatttctctaattgggtagttgtgcttagagcaagtttaatactacagcccactaatagctccaattcaaatatagccaatctaatagtcaatttatacaatagttgtttgctatactattagtatatagtcccaactgtcatgctcttctctctcatcttttatctcattaaaatatgtttatagctggttaatagtttgctattatacctgctattataggaccaaactatcaaacgtggattgttgatagacaaaataatggatgcactcaagttgaggagttacctttctctttcttctcttcacccatatttgttcctccactttccttgaaaaaacaagatatttccctctacagaaatacccaatcacatcactctcacgcacacgcacacgcaccaattggtctctctttatgtatgtctcccattcacgtaggcgtgttatccaaacgataaagtttctaaaataaagggttatttgttatcaaatattttaaatactcaaaatacatagtatttaatttacatgattttttttctaaccttagactgctaaaatcctacgttttaagtaaatatcgagggttgtttttgaaagcagaaaacttactgtactttattagcagaaaacttattgttttttgaaagcagaaaacattactaacattgtgtttcataggtcctctgctataaagaagaatgaaaagttggtagagttgaagaagagcaatggacattagggtttttctgatcgttcttgaaacttttttagttttaaatgtaaaggctcgtaaaacttatttctaatttgattcttttagccatgccactacacgcggtagactaatattattgtttcgccaagcagctagatcggcgtggctaaaagattcggaaataagtttttttaggtttatttttaaaattagaaattgtaaaaagcttcaatatttttatattataagaaaaaaaagaaaaaaaatcacattaggggagaggaaatgcagaattgatccatgtgctactacctgcaaagtaccagtaccagtataggacccacccagcagcaagcaagcggtccatggctggactggactggacaatcccgcgtctggcggcccacgcgacagacacttgcacttgctctccgctgccgttccccttcccccctcttcactttccttcccagctgcgctaagcaatccccacccaccaccgctgcagctgcagttgcttcctctcctcccctctcttttcgccgtcggtggggtcctcctccaccctgtctctctcctcccccccagatccacccctcccccttcccgaaccttctggaaccatctggaggaggaagcaaccgcccaagctgtagcggcagcggcggccggcgggggaggagcgatggagacccttgcgcagcgcgcggcgttgctgcgggagtcgctgcagaagagccagtccgtgaccgacgccgtcgtctccatcctcggctccttcgacagccgcctctccgcgctcgacgccgccatgcgccccatccaggtacacctgctctctgctctgctcgctcctcgcccccccccctcctccctcctagggttcttcgccgtttgattccttctaggctgctgttctgatgccgctgcctctcctctgctgctgtgtgcatatgtgtgtgcaggtgaggacgcacgccgtgcggacggcccacgagaacatcgaccggacgctgcgctccgccgatgtcatcctcacgcagttcgatcgaactcgagaggtgctccatcgcttcaaccccagatttccctacttcttactagtactacatatgctattaacaatatgtgtgccccgcccgcttgtggttggttggaacttggaattgtaactgcttgttccgtggctgatgaatgcggggaacgggtagttggtgtgactgtgatcagtccattttctgatctgcatctcctggcactgggcgtatgcttagttgcaagcttgcacggtggattagcccttcattttttaagtttctaaaatgcatctttgctcccgaatatgaaccagcagtgctcaggagtgctgtggagcatgcccaatccttctcattttctcgaaggagcttcactcccctttgtcctttctctggatggtctttgatgtttcgcctgcatgttggtgggggcaattatagcttgaattatagtttgtatacatcactgtgaggcagcgtattgttggtttggtaccacatggtccacatgtatttgttatagatacattaggaaggagaattctccattgcatgtggcggtatgcatataaattgttttcttcaacatgaattacagtaagtatttgtatttcaatatgtgccttgatggctgcccatattgggtttggcaactaaatggttggacatggattttccttttgaccgatttttgaagaccttgaatccaaaaaatgtacctagctatttttcagtgttggattactttggagaaaggtccgatttcagttattgacttattgtcatctgtgcaggcagagcgtgaaatacagaaggggccacatgaaaatcttcaaggttttctagatgcagttgatcggttgagaagtattgagcgtttctttagctcaaataggagctaccgaagcagtgatggtgtgctcaaccatgtgaatgccctcctttctaaggcccttgtgaagatggaagatgaattccagaagcaattgactcagcgcaggttgtgtctcattattagtttaaatgtttttaaccccaacatcatctaacttgcattttgcaccctcctgactgattccagcaaacctatcgagcctgatcgtctttttgattgccttccaagtacgcttcgaccatcatctgaatctcatcctgaaggtggaaaaaaccaatcacattctgaaaatcagcaaaactcggaagcagctgtatacagcccccctgctcttattgagccaaggttcattccttttctggctaaattagcacacagttggtacaagcgggatgccaacaacaatgctcagaaatatacaggtaaaaggaagataaatattttcaggctatatatctattcatcacttcatggatactagacactaaatttgttgtaatatctggaaattttttgttctgtttgtccttttgatgctcacatgaataatgaacggggttgaaaatacatatgtttgtctagattgattgattgaagatagaagcaaggctaggcgagctattttcatacttgtcaatttgagtatatttataaacttttttggcctttgtgaaaaccatgaaaaatgatttttttagtttggactgccagttccagctgaaaggaaaaacaaaatgttctccctgtgaataagtttaaagcacttgtctcctgcattcctttatatatttttcttgtttatatggcctatgtgctaactacctcctatgcggcaaaatactcaagcactttctcctcttgtgcacagcgaagcccgtgcttctgctttagagtcaagtttgaagagcttgggtgttgaaaaactgagcaaagatgaagtgcagaaaatgccatgggaaattttggagtctaaaatagggaattggattcacttcatgcgaattgctgtaaggatttttctcttatctactgtatggtgcaacatgcctctggtgacaccttttgctttaaacaggttaaacttctttttgccgcggaacgtcagctttgtgaccaggtttttgagtgcagtcaatctttgagggataagtgctttgctcaaataactaggaatagtttggctacactactcagctttggagaggcaattgctatgagtaaaagatcaccagagaagctgtttgtgctgctagacatgtatgaaataatgtgtgaacttcaagcagatgtaagtttctgattcataccatagctatctattaattgtttcattggccagccacaacccttttgtgcagaactgcgaaatgataagtgtgtgcatgctgagttaagatctgtttttaagtttctaaaaattttgagctccttatgccatcggaccaatttatggttgacgtaatcctgcagtactgatctcaacagcttgatatttttgggttgataaaattgcaaaagaaacatatgattaaatgatattgtgaatgctttgtgaaaaaaggggcaaaatgccaaacttctcactgcagatttcaaagtatgagaagtgcatggggcattatcatacttatatgacacagtgtggtgccatatttccaaaatttctctgttggtccatctatattgaagttcgccgttttaccagaaatcaattttcaccaaggtctttggaacttggactttcttgtttgcatattctttaatgaaaaacgacttcactagacaaatgttatagtaactaactaactatggagaatttagactgtcaactgaatgtaaatttattttagatatggtgctattttcttgacacggaaataagtaatatctacattttttatggattgtgtagattgacaccatctttgttggagaatcatgctctcaaatgcgtgagtctgcattgagtttgacaaaatgcttagcacaaactgcacagaagactttcagtgactttgaagaagctgttgaaaaggacgcaacaaagaatattcatattgatgggacagtgcatcctttgacgagctacgtgattaactatgtcaaatttttatttgagtaagtatatgatcatgtgcacttaatcttttctgtaagttgatagttgcattgctatactttcttgcattgctttttcatcctatccaccagtatgctgatatttgtgttttgcaatcgttgctgctgtatctcttctattggatagccttcttattcaccaagaccagattattttccccagctgtatacgacaacaaatagatcactccaatgtagctgaacttcttttgtaccgttcttgcaaacattatctatatccaattttgtacctattaaatgctctttcagaatgtcttgttttgtcaagctgcaactggctatagctttgcaaaaaaaatgacaacatttaatctttcgcagctaccagtcaactctaaaacagctcttccaggagttcaaaagggaagatggaacaggttctgagttggccactgtaaccatgagtatcatgcaggctttacagaataatctggatgcaaaagcaaaacaatacaaggatccagctttgatgcacatatttttgatgaataacattcattatatcgtgaaatctgtccgcaggtatgttcttatgaagtaaggtataaacaaattcgcaatagccaataggttagtaactggatgagtgggtatagtttaatgctctcttttctttcttccagatcagaagccaaagatttattgggggatgactggattcaaaggcatcgaagaattgtacaacaaaatgcaaatcattatagaaggattgcttggtcaaaggtccatttgctagacatatttgaacaaaactcactgtttgtttctcttgcattttgttaccattgttgatgtttaataggaagagtgagcctaaagatctatgcattattccgattttacaggtcttgcaatgcctctctggtcaaggtttgacttcatcaggaggtagtggtcaagtaggaagtgagggaggcaatagcagtggagcttcaagagctgcggtcaaagagaggttggtcatgtacactaattattccagcttgcttttcgatgaatgatgttttaccatacaatttctgaaacagtgttttgcccactattttgtaaccagattcaggtctttcaatgtgctatttgaggagatttatcaaaagcagtgtggctggtctgttccagatacggagttgcgtgagtcactaagacttgcagttgctgaaatcctgttgcctgcatacagatctttcctaaagcgctttgggtatgtttctttgaaacttcattacatgtaaataatatattaatgcatggacaaggaccataactaatcctttattttctattcaaactctcctgctcatgtttttgtttctggcagtttgtcaaatgtgagttggtgcattttcttgtttgtgccagttatattatttaattaggtttaaaaaaaccatgaagattatatttacctaccaatttggtgctttatgaattcaaaattatttactagcattacaaatttacaatataaattgcaaaggcgttatccctagaaggctagaacctgatacacttcacggctgtttaggagacactccttattctccttttgatttctatctagacctgaatcctgactgtttaggctggcacttaattatgagtttgttagtagaaataacagcagcccctgactaagatcttagtcagtagtaggaattagagtgttccgggtgctttcaccaggcccagctttggtgcataccacatgccactgatatcagacctggacctgaccgactgtcccttcgcaaaataattgttgcttgcatctcctctgctttgccgtttaagaaagagactttaacaaatttgcctgtcctaaaaccggcgtagccctggtccacagaattttgatgattgagcattgccatctgttcatttgtttaataccatgaattttccctcttttcttttatttctatgtttctatggatatgtatgttcactagactcaagagttcttgtccctggagcttatgagacttgtaatctataggcctctcatcgagaacagcaaggcacccggaaaatatgtcaagcacacaccagagcaagttgagctactgcttgccaatttgtttgaaggaaaacaagagcgtacttgattggggtatgtggctgcttaatatacaccagcgacgatgtgatgtcattctctgtaaattgggaccctggtagcattgcttttgtttgtgtagcgctgctgctcaaaaccgttgctatgtgcacctttccttgctggggtgcatgatttgtatagatactgtcctagttgccatttattgtttttgttgatttggtaggtgctaggttcgttctgatatgttggaaactcgtgttagtgcattcattattcagtatcagcagtgtgcaataattgtccaatgttaatgcaacctctagtgcctccattttgcagttgcgggagtatagtcgcaactgtttcccacaaaggcaaacctgtattctccttgtttgtgagctttcagggtcaactcgattttttttttgacaaattagccattttcaaaaactgatgaaactagaccgtgaaaaaaaaaaaggccgtgggctccatgctcagacccctgccacatcggcgggggggaatggcttggccgccacgctggcaggtgcttagcgtcaagcgtttttttgctaacctcagcgccagaagcattggcgttgaggtcgcggtctatttgcttgaagtatttttttttcacggtctagtttcgaaataagttttataaaatgaccaatttgtcaaaaaaaaacaggagtcaactcttattagtgtcgttttcataaatattattatacatgcccttaatacggagcagtaaataataataagtctttatatttatgggtaattacttttttaacaaagcacatgggtgacttcggtaatatcaaaatatgccgtcagttttttttttacaggtgttcgtaagaaatattatacatgtgtgctttattttcttcttttctggaaaactcaaatgaaaattcactctactcctagttgttactatggaaaacagaagatatgaaccagttgttaggccctctttatttaggttagcttatatcttttataattcggtggatttaaaatcctaaattgaataaaagagacataccttcatcttacgtaagttaaaaatttttcttcaacacaacttttgacttaccgttgtaagagtgacttatagctttaaaaaaaccaaacaaaaaaactgcttcatcttacggaagttaaaaaattttcttcaacataacttttgacttaccgttgtaagagtgacttatagctttaaaaaaaccaaacaaaaaactgcttatttgtttagaattagactaaacaaagagcctataaacaaagatgatctaaatcctggtgtcttgaggactttgaacagatgcgatggatcgaacctggcgtagtggatatatgtccatggtggatacaaaagcgacccgatgttaacgtgcatggactagcgataagaatgtgtacgagagagatacggaaaaaaaaccagcgtcctttcgttcaaaagcgcccttcccttatctctgcatgcagatgcagacaccaccagaccccgcgagtataaagccgtcatttgttctattctgttttcctttcagttcttcttcaactgagagagcagtaggcagagaggggcagtgagatcgatggagcgagcagccgatgaggaggcggcggcggaggctctccgcgcgaagattgagctcctgcgacaggcgatgcagagcagcgaagctatgcaaaaggaggctgccgtgataggcactcgcttgaacaaccacatggtcgccattgacgaggccatgcgccctgcccatgtaagggattatgttcttcctgatctttaaatctatctatctatcaatctcagaatctcattgtgagcgatttgcatgcagaagaggacgtacaacgcgtgcagggttcatgacaacatcaggaggagcctcacggcggccggggcgatcgtgcgccacctcgaccttgtaagggaggtaatctaatgtagcttcaattcgttcctcgatcaggtgcagattagattagctgatgatgagagttcatatttgttcaccccctcctccgtcgatcgatcagtttgttactactacaagtttgaatttagccgatattggacgaggcctgtccgatgggccggcccctggcattgaagcggaggcccacgataaacagagttactagtctacagcccatccagcccataaaccacctcaggcccactaaacaaccccaatccgggcccaatattgcgccctcgatatgcggccggcggcgtgcagcctcctccggcgtggcgaccgccggaggaggggaatgggaggagggctagcaatgccggcggcgcctagcaagcgcgacggagccggcgcgccgcggtgaggcatctgccgtgcgccgccctcccgtactctcctccctttgcttcgcttggcttgtgcggtaaaattgcttgggttttgggcggagagcgattgcggttcccccggcgtggtctcgaatttcaatccgagctttgctgcgggtctacttctgtgcctagtctgttcaccaattctgctcctacttttctgcactgtgtacctacccgcctatttgatctgaggttttgggtcatagtcgcctatgatgtggagtagcaatcgaccggcattgttctcgctttcattccatgattcactttttacattagggcacccgcgggtagtaactaattctaatcactcgtttctgttgcttgatgatgcaaatttctctgataaatgcatgctaggacctagaatactctttggttgttgtcttcgtaaaaaaatctctagtccttttttatgggtgatcatgttagattgcttgatactttaccttttagaattgggttccttattactgacatttgattgattttccatgtgtacaggcagaacatgtgatattattggacagaccaaacgaggatcttaatgcctatcttgaggcgattgataagttgactagtgtcgaatacttttttacttccaagataagatgtagagttggtaatgatgttcacgaacgtgttaacgaattgctttctaaagcaatccatgggttggagaatgaattccacaggctgttaaccaaatgcaggttcggttatctgtttgtttagaccccatatctatttaggaatgttcagaaattaattacttcatcagaaacctctttactatctcattttccctatagcaaacctgtagatcttgagaatattttcaactgtctatcaagtcttaatcggcaattgtcaagtgaggaccttattggcccatcagccggtgattattctgaagcaccgctaaaacagtatgctgagtgcactcttcctacactcgttgatccctgttacttgactttgctctcaaagttagcacagaaatcaattcaacttgattgccatcagaagtttatggaaatatacaggtgcaatctacaaaagttctaaagtcttttctacttgcaatattttgcttctgagtttctgattttgcttgttcacattttccatcattcccacagagaaattcgtagttcaactttggaacggactcttaagcgcttgggagttgaatatgttacaaaagaagaaatgcagcaagttgaggctcagagcatggaagctaaaatcgccgagtggacacaattctcccgaattacagtgatgctcttgccttgactgcataaagtttaaaatgcaagatgttgtttggcagtaatatctgactatttattcgaacaggtaaagttgcttttcggcgctgaacgcattctgtgtgatcaagtatttgaaggaaagtatacatggaaagaccattgttttgctgaagtaacagctaaaagcctttcaattctactcagttttggagatgctgttgttcaatcccaaatattgccagacaaactatatatacttctagatatgtataaggcaacattggaacttcaatccaaggtgaaagaacaatgatatctgacctttgctgtgtacatagttacattttgtttgttcaaagggccaaaatatgagggaaagaagtaagtttcattctgactgagtatgccttctcatttcaaagaactaaccattattcttgggccggttatgttaggttgatgcaatctttgagggtaatgcatgctctgaaaaccagaaatctgcccttactttaactaaaagccttgcacagactgcgaaaaagacaataggtgatttcatggaatacattctgaatcactcggtgacgagtacgactgttgatggggctgtgcattatatgaccagctatgtcactgattatatcaagtttctttttgagtaagtgaaatctggggattgggagttttcttcatatgacctccaatagaatatggcctaataccgttagcaactatctgacttaacagctatcaaactgatgcagctatcaatcatcaataaagcagatctttggagatccctgtgttgaagatgaaaaagatactgatgtggtctctcaaattgttggtgcaatacatgctctggagaccaatctagctatgaaggcaaagcaatacaaggaccttgctctggggcacctctttttgatgaacaacatccattatattgtcaagtatattggcaggtcagtagatatcatataaggaccaaaaatctgattagctgaatgatataactattttcttattctcagatcagaattgaaggatttattaggtgctgattggattgaaagacaacgaaagattgtgcaacaacatgctactcgatatagaagagttgcttggctaaaggtctgatcacaaaaagcttgacagcacgatttaaccgagcatctcttgtatttttacaaggttttttttaactgttctgagtttgcaggtattggagtgtctatcaactcaaggtctcacttcatcagtaggtctccaattgatgtcactcaagaaagttttagaaatattaagaccagtacaccctccagatctgtgatcaagaaaaggttaggctgaaatcccaatataatcaatgtagtatgcactcagttttggtgatccatctcccgattacttatgtttttttttttcaaactcttctcagattgaaatgtttcaacatgcgatttgaagagatttgccagaaacagatgaactggggtgttcttgacagagattaccgagattccttaattcttatgattgctgaaatattgttacctgcttatagatctttcctgaaacactttgggtactttccaatttgctctggttttacgactttgttttatttctttatcaagctcctcaagacatttctcctttggttatgttatggttatcgttttcatcatgtaggcctcttgttgagaacagccacagcgctttaaaatatatgaagtacactccagaatcacttgagcaagctcttggtaatctatttgcaaagaagttacgaagtgatcaggtcatcagggattctgattgcatcaaacatcccatttaactgtaagtcaagagaccttcctgaaccctatctgtactatgcagtgtcatagtgtgttggaacaaaaaggggtgcattttagtttcatagcgcattttacctgttaagtattgtcatcttgttttgattttgttttcagacagctagccaaatccattgtaagcaaatttaactttgggttcaataaccaggtgttctccttgcatttgtttgctgcctgcattgtgcatgtttgcattggactgacatactctttctctaagcctggaggttcagaccaagtctaaacatttatctctttttttatgaaaaagaaacaaaccgtagactgtaaactgttccaagtggctaactgcatgatcagccttgcattcctcttgagagatgcatgttagcgttggctccaatcctgaagactcaaattctcaaaccaagtcataagagtctcctcaaaaactgtaaaagataagtgttaaattggtcctagtggacagtggttatttaatctagtttaggttattgagaaaaaaatcgatcccacccatcaaatatgtggtagctgggtattaggtgttagcctacactaacctgcaaatttttgaacgaactcactaacctgcaaatggagactgtccagaattagatttaacttttatcaaaacaaaaggaagacgctgacttgtaaaaattcctatttcaaacatacaagggaactcttgcacgtggactctatcaccaatagcgtccatgcatgagtggcatgacggtcaatggctagctagtaggataagtataggttgtacctgaagaatatttcacatcttttggagactacttacaggaaagtattcttctacaactcattcaggaagtatagcagtttgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 7591 - DNA, 670 bp, Oryza sativa
catcacatgtatcctcccagtcggcatccatcaagggagaaatatccaagtctcctatgagttttatcatccgatgtcatcggccagacaacttggaataggacaattgccaatcggcctgtactttgccgacaagatccaatgcagaggtgacatctcctcaactttaatgatggatcggctgttgaacatccctggacctccgttgggcagcatcgagaacataaagctggcaaggttcaagagtagggcgtttgacagatggtgcggtgaatggaagctgcatctgttccatcaatcggcttccatgtacatgatagacttattccctgacagtatgctgagtgcactcttcctacactcgttgatccctgttacttgactttgctctcaaagttagcacagaaatcaattcaacttgattgccatcagaagtttatggaaatatacaggtgcaatctacaaaagttttaaagtcttttctacttgcaatattttgcttctgagtttctgattttgcttgttcacatttttcatcattcccacagagaaattcgtagttcaactttggaacggactcttaagcgcttgggagttgaatatgttacaaaagaagaaatgcaccaagttgaggctcagagcatggaagctaaaaacgccgagtggacac

SEQ ID NO: 7592 - DNA, 702 bp, Oryza sativa
acgatagcactgtcaaaaatcaaatcactggatatactttagaattatgtttattataaatgaaccactgccatttccaaccattttcatagcactacacttttcaatactattacagactgcaaaggtaacttgaaccactgatctcatgacttaattaataatatcacatataatcagaaattgtactgacattaggtttcacaataaaaacataaatcatcgttcctaaataaaagtaattgtcttgcactaaggataagtaaattgaagttcctaaccaacataaaacagtgagcactactttgtacaaggataatcaactataactgcagcaacgaacggttcacgagtttcatcagcatcatcatagtttccatcattagcataataattttcactattaacatagacttcatctgtgcctcgcttactgttgccttgattagtagcaggagcagtttgttggctagaataaccaaatgtgctttcatccatgcgttgtaacaccacatttttagagttgtttcccatgtcaccctaaaaagaaaaaggatcaggtgacaatgtatccctccaatctccaatttagctaacagtacaaaaatatcttctaaagatgtttgaaacagatatagtctacttagaaagtgttctatggataggttaatgtctatatggttcagcatatgaaacaatggt

SEQ ID NO: 7593 - DNA, 520 bp, Oryza sativa
catatatcacacaaataaatacctattagttctttttctttgatgacttgtttagcttttttgtcctacatgtcgctcagttgagtagactctccaaatacattttttcctgcaaaatttaacaagtgtataggattatatagtcttttagaaaagaaaatctgaaaatataggtagttacaggccaattccactgaaattacatatgtaatattagatgtgtgcctatgtaattttgagtttatgcattttgggaagattgattttaatcatatatcacacaaataaatacctattagttctttttctttgatgacaagatctgctcctgtgcccagcatgttgctcagttgagtagactctccaaatacattttttcctgcgaaatttaacaagtgtataggaatcaagatgtaaacttacatgatcattgtactataagtactactgttacttcagaaaactgtgtatgtaaattaattatgaaataaaaaaaaataattagttagctggatttaaa

SEQ ID NO: 7594 - DNA, 586 bp, Oryza sativa
aatatatagaagctgtaaaggaaatgaaggacaggagataagcaatttttagtgcaataccaggagtgtagaagctcatgtagggtaagacgctagagtagaccccaggctcttcaaccttcttcacccgccttgacttgagctcgatcgtgaataatccaacacctgtgctcatgaatatgacacccacaccctctgcagagccaacaacaaatgcttcatcaccgcgattggcaacaggtaccatttgctccagctcaatcacccagcactgtacccattctgcagccccttctgaactggcattcctcgacctcacataaaggctggatccctgaatgcaggcataacccagtgagccgttctccatctccatgaggaaaatgtcatacacatctcgtatcggcgggtcaatcttagataagcagttcgcggcccagttgtacttgatgattgcattctcattccgaagcgtgaagtagatttcatctccaacaagggcacctcgcctgggctggacataaggtgtacggtatgattcacctctagtaatggcttgcaaacgctcttgccaggtttgataacc

SEQ ID NO: 7595 - DNA, 707 bp, Oryza sativa
caatgtgagaatgacacatgcaaaatatttgaatatatgaagtgtgcagtatgttgtgtcatgcatgattcatgaacaattaaattactacctgcagggacagggccaaaaaatatcttctttacgatgtcgtccatgaagaggtgtagcttaacatggaatacacgattaataatatcaggcctatctgctgagtgttgcccacggatgatagccaaagcttgtgttacctctgaccataaggaatttgatgtgaaagtgataaacaaatcagggcaaccatattttctacatagagcaactgaatctaagtaattttgatataaatatcttgggcccccaatataagaagaaggcaatataactcgctgcccggcatatgatgcttctgtgatgcctgaatggaccatagtggatacctcactgaatgaagctgttctatacttaagctgaaatgtcttggatctgtagtgactcaagcgagatacttccatacaacaataggcatctatgacataagcctaggatcctctcttgcagcgcataggagtattgaagacatcagctctgtcatgaagcctatatgcaaagtattcaaccatagagccttctttcttttgatagcttgtgatcgagcacaacgtcgggatgtgatattttcatgatagccatcctccccatatggaaatagaattggatattgcatt

SEQ ID NO: 7596 - DNA, 487 bp, Oryza sativa
atcttgacaaagttgatgatgataattttggtcttaggcctcttagagattttaaatctgtgtgttattatcaggtatatttttggtccccttttttgatttattactaggtaactttggtattagtcttcttatagatttcattttttttagcctcatcctactgctgagagaagaatttcatttaaagagaaacttgattctgctctaggttctgtgttgcctcttagtatgaaagagaaattatgttctctgatggaacatcattgttctgaagttcatgctgctgggagtcatacttgtgaagatgttcttattgatgctctagttctggctgctgaagatagtgttacaccctcagataaagttcaaaatgatgttgatgatactaatactgaaggggggaatgctgatccttctagatttgatgataatgctggtatttctaccccaatgaaaacaagttagtattttctgattagaaatt

SEQ ID NO: 7597 - DNA, 803 bp, Oryza sativa
gttaaagaatcttgtgttaaaaccgaagagatatacaatgcaaccaataatctatcacggtatacacatgggatgagctcttcaggcggaaaattacctgctcatggtcctagaagaataattggtcctagcaggcatgcttctgatccatttgttcctgcaatgaaacgtcgttttctagtgtccgatcaagagaacagatattacattgctctctgtcgcttagcagatagttccaagtggcagaggtaatattatcttgatgttttgaggtaatatttcctttttgttgttattttggtatagatttttagcatttcatcaattttgttattagacaatacaagttttaaattttcaggatgttccattttttgttaatctgtttgcactttctattctgttatttatcaatcagtttgcttctatgtctctgtcatgatatgttctgatttgtcctttgctaagcataattcattattagagtatttgcgatgttttttgtctgattctagatttcatccactgaactcagttaatagcatttttacagctgaaccctttgtttacaagttaagtagcagaagcatcagaaacattgccacagccatttttttagattaatttgccatctgtattttttttttgatttttttcttaaaaatgtgttgttcatttatatctattattaatttactatttattcatttttttattatgtagttatgatgctgttgatatcgacaatgtcagagccaagttttctagctttggccattctctcaaaaagactggtgttgttt

SEQ ID NO: 7598 - DNA, 651 bp, Oryza sativa
gtaaacaaggcaatattcgtttctgttgaattttgatctgctttaagatctgcattggatggtgggcctgcatcatggactgtaacgtgatactcccttcatccacaaaagttacacatattatttttgacaccaagacgtaatctttcacattccgccaaagaagaaattagaaaaaaactataggctgacgccaaagattccatccaaaaaaaaccatattttgactgtgcttcaactatatcaactgtacttgaactgttggataatcatagtcgacgataacatcacagttcccaccgctattccaaaaccgtacatgaaaccttagtttcatacggctcctctatgatcagaaaaaaggaaagtactttttcatttcattattatcttcttgggcgtagttagaattatctaagataaaatcgatttcaacgtcctaaattagaccaaaggaattctgtctgctagaataataaaaaacgcttcggaattcatctcatcctttataatataatggtatttttttctttgttcagcaataacttaatcttgaaatgaaacactcgttataacaattaataaacgaagaaattaaatcatcttagatgttacaaaatcaagtagtaaatgtaaacatgcaaccaatga

SEQ ID NO: 7599 - DNA, 720 bp, Oryza sativa
cacaacctcctcggcacagcctctttcgcatccacagtgctcatagccagcctcctcggccacgtaggcctccagagcacagcctcttccgccttcacggtgcagccaaccagcaaacaccagagggcgtcgagttgggacagtggtgttggttttggtgagaggtgagatgcggcggtggaaagggacagcacaacgcaggtcgtcgatgacagtgccacaccatgggaagttgtgatctccattttttctccaaaaactgggagatggggattggcgaggataagatcatgcctagtgatggtgcggtaaggtgttagagcatcaccaattctcctatttcattcccaaaactaatttttcagggattttaaggggtctggctagccatcacacgacaaatttctgacccacaaatcacacagatttctcagccattggattagcatccaacgagcaacagaatcaaatacaaatagacttttttttcttttcacagacataatgggccagatctgtagagaaaaaaaaaattaaaaaacccatccaaacaacaatagatccaaacataagcccaaataaaaaaatagatcaaatagataatttctcagcccaaacaatgatcacgtggtccccatgaacaaagatcaacttacaccacaaggaaacatactcagaaaccacgtgactctaccaaaccacattgatcgaacagaaaaa

SEQ ID NO: 7600 - DNA, 710 bp, Oryza sativa
tgatttatattcccaaggtttgacttaaacattgtcataaatgacttcctttatgagtatggagggagtataacttatcccttctttctataaagctaatgttaattaaatatcacatgcaagcatgtcacattaacccattaagcacaaaaagttcaacatgcaatcatatagtaattatatctacaatttatctatatctatactaatataaaaatgaggagttgcacccctccaaccctaccagccaaatcaacaggtgaattcataccgtccatctatctgcatccacatcgccctgatccaggaaccgaacaggcgcatgcgagaaaacggaacccaacaggcgcggtgacaattgcgagagacgcgagagagacctcactcctcacgagcgagcgagattaccgccgcggggccaccctcatcctcactcctcatgcgacgagatcggtagattgcgcaatcctcaagggagcggcgcgccgagcacccctgccgccgcgccgacgcaagcccggatgtccgctgctttttgcttgcgcaccgactggacctttgaacgaggacaacgatcgtaggttttctgatcaggtgagtcaatttcgcaattgccaatttggcatcgcgtcaaggcccatgtgaaaaattgattcagtaggtggtggttccatagttgctggttctaacttgcttgttgttcacatacg

SEQ ID NO: 7601 - DNA, 733 bp, Oryza sativa
atcgagctccgctcctccgaccgcgacgagctcgaagaccaccttcgcgccgacgccgccgcagcggtcagcacccccaccgcctcatccactccgaccacgaccccgtcgacctccaactacaaccccctcctgcacctcctccacccgacgtctggcgccgagccctccaagtcccaccgcatcggcctccctaccaatcccaatcccaaccccaaaccctagcctctcctctccccccttcgcccgccttgatggaggtcgagatcaagctccgcctccccgacgccggcgcgcaccgacggctctactacttcctcgcgccccgctgcggcgcaccgacgcccagcgcaacctttttttcgacgccggcgcgcgccccctcgccgccgtcaccgacgcgctccgcgtccgcctctacggcctcgacgaccgcgccccctcccgcgctgtcctcgcgctcaagcgccgcccgcgcatcgacgcgggcgtcagccgcgtcgaggaggtcgaggagcctctcgaccccgccatcgccctcgcctgcgtcgacgacccggcaagcctcggcggggtcgagtccccgatcattcggctcgtctccgaagagtacggcgtcggcggggacgccgcgccgttcgtctgcctcggcgggttcagaaacacccgcgccgtgtaccagctggaggagggcgacaccctcgggctcgtcgtggagctcgacgagacgcgc

SEQ ID NO: 7602 - DNA, 1112 bp, Oryza sativa
aaatgatgatttttgatactcttgtttgaattgaaagctcatgtactactctcagatcgcctagctatctctcatgccccccggttagaccggcattggggctctgttcacggtccttaagtaccaaatccgaccatcaattcctgcataaaagtaaatgaaagaatacaaaatggagtagcaaacttagaggtagtggttattagtaaccattttcataagtcttgtgaatatttgtatgtaggtgaattacgaacggatgcgagtacatggattggagggcccacatatcaatcaaaacaaattacaattgagcccaaccaaggtacaacatgtagatggcccaccagatagcttcccaaccaaaggagtaatcgcaaggtgggacaaaggggtcatccgaacccaaggttggccgaacctcctttgtctcccctcgccatcagcttccacgtgtaggttcctgatgactcccaaaagccggttatgagtgattcccatgagttactaactttataatcgtcataggatggctataaaatgaggagaagctcttactctcaaacaacaaaacaagtggagtacaactcacttacacatttaagctactctctagtagagttagaatatagaggagagagagagggaaagctccggaatgagtgccccaaaatcagagttccggaggagtgccatagatgtcggcattcttccaggggagttccggaggagtgccggagatgttggcactctctccgatcttatacttcgacggatgtttcttttataagtaagcattcatgattcttttggtatttacttttttttatttaagatatataatcatcgttgcggtttcatcgctctgcttaagtagagtgttgacagtcgttaagtaccgatttcggccatcaactatctgttaacgaccaaatttggtaacccaacgatcggatgtgaaggaggaatcgagacggagttcgaggtagagattgttccggaaacagagtgaggatcggctgaagtctgaatcggctgcgactaggatcgccagagttcgagtcggacagggttagccgattgagccgaatccgacaatatgatgcggcata

SEQ ID NO: 7603 - DNA, 5772 bp, Oryza sativa
caaataaaataagccaaagacaaagaagcactgattctgtggtggtaaagacgttaaacgtgtatgactccaccccatcaaggtttaaattctgattcccacaaatgtaaagcacatgcaagtgcaaataggtttagtaacatcagaaatttgtcaccagtttctgtctcttatcctttttaagcgtgtggtaaaagactactcgatcgactcattgagcaacagacatgaggctaacgaagcaatcctccaagcataatcccagcatctccgacggaatcatcccctttcgcccgctagccgcgcgtgcccaaccccccaaaagcaattcgttcggccactagcatttcgccacgtggaccggacgctctggggctttttcgtggttttgcactgcctgcccgagttgccttgcccgcttgtactttgcctgggcaccgtgtaacccagctttgtcgcataaatgcctatatttctctgtaactacgaatgacgactagttaagaatttgaaatttggatagagtagagatgagtaaatgttatcatgaaaattttctcgactatatacttattaataatctagccagaggaatattttggaacaaaacttgaaatggcctggaacaagaaatatgtaaaggataaggggcaatttgaagtaatccatatgagagcactgataaatggcgtatccgcccttcccttcctcgccaccttgtagcctccctgccttctctctctgtctctctctcttcgccggcaaacctttcgtaggctcgatccacgagacgaggaggagaagccgccgcccccgccgccgccgacatggtgatctcggtcgccaccccccgccgctccatccgtgacgccgtgctgggtggcgtgctcggcgccggaggccgccagctctaccagcccctccgctgcgccttctacgacggcgccgccgggggcggcctcaccgccgcgctttcggaggatgtagcctggggcggcgtccccctcccgtgcgggaggaaaacggcggcggccatataagcgctgcttctcattagcgactccggcggctgccaccgcgcgtgcgacaaggccctccgcgacaccttacgtcttgaggatggctacgcctaccaagtcggtggggtcgcccgctcaaaggccgctggtccttgcgctccaagcctcggtcctctggtgcccgctgcggaattacaagcgcccccaaattcaattaggtcgccaaaacatttgtacttacaatcacatgaaatgtgtgctaactggtttgatgaatctcttgatttctcgcgaaggaaaattgtgctccaatctcaactgagttgctttcgcgcacgtgttcgtgagagatttggggaaggagtacggcgggtggccactgaacgacatggagcggtcgtacaagttcatgatccgccatgtccggctctggaaggtggcgttccacggcacttcgccgcgctgggtgcacggcatgtacctcgccgcgctggcctatttctacgccaagtacgcacgcacgcagccatcacaacttgatcgtccaatccaaatcacgttctgtttccgtctctgttcatccgatcgattcgcgaaaactgacatggttgatttcagcgaggtggtggccgggatcatgaggtacaaccccgacattatcatcagcgtgcacccgctgatgcagcacatcccgctgtgggtgctcaagtggcagagcctccaccccaaggtgccattcgtcaccgtcatcaccgacctcaacacctgccacccgacatggtaaccagttcagttcaccggagccacgcactctcgccggcctcgccacggcgcggcgcgatctcagattgatcgatagagcttatttgtgcaggttccaccatggcgtgacgaggtgctactgcccgtcggcggaggtggccaagagggcactgctccgggggctcgagccgtcccaaatccgtgtgtacgggttgccgatcaggccgtccttctgccgcgccgtgctcgacaaggtcggtcgatccggttgccgcgcattttcagataatcttcatgagccgcacattgctgcattgcactgacgcagagctgaactgaactctgctcggggtttggggtgacaggatgagctgaggaaagagctggacatggatcccgacctgcctgcagtgctactgatgggcggcggcgaggggatgggtccggtggaggagacggcgagagcactcagcgacgagctctacgatcgccggagacgccggcctgtcgggcagatcgttgtcatctgtggcaggaaccaggtgctgcggtccacgctgcagtcgtcacggtggaatgtccctgtcaaggtaccatgtatatgccgaatctggggaggatgatgccgtgctagatgcgcatttctgctcttactgcgtttggtagtgaccactggctgacatttttacattttcttttctctttttgttttgatctcagattagagggttcgaaaagcagatggagaagtggatgggcgcttgcgattgcatcatcacaaaggttggttcttggactgatggaggagttgatggtttttttttttttactgtttttacttaggaatgtttgtgtcctgtttgcaggctggtcctggtacaattgcagaggccctgataagaggactcccaattattctcaacgacttcatacctggacaggtgtgtgcggatgcaactatactgaattcgttagagtaacaaaattgtttttctgattttaagactatactcaacacaaatttattatgaaaatatatttcaattattaatttaataaaactaatttggtattataaatattactatatttgtgcataaacatagtcaaatttaaagtagtcaaaacgtgtgtacactgttgttgcagcaactgcaactgcattcacagtaatgccgacggaacaggcccaatatgacaacatgcgtgcgtactttatttcgaaaatgcttctcttcgcacgtccgattgaaggggaaaaatcggatggactgagtctgacacacatcctatcaagcctaaacacatatacctttaacgatattcaaaacaatttttctcttaaataacttatccaatctacaatctgatcacaccgttgtattcgttgtaattaaatctttacaacaagatgtcacatgattatattctgattaaaaataatcatatgtttcaatccattaacactctttgtttcatacgcaatagtaatatgtttcaatatgtctcttcagcatgtttcacaaatttcgtggaactacatctcactactctctctcctctctccacctcatacatacatgcatgcattttagcgagcttcaaaacaacttttctcgtaaactaattatccaatctatgatccgaacacatcggtatattcgttgtaattaaatctttacaacaagatatcatatgattatattttgatgaaagaaaaacatatgtttcaatccgttaacactagttgttttatatgtgatagcgatatgtttcaacatgtatctttttcatgtttcataaaatttttaaatgtttcagttgctgattttttgtttcaccatatataatttgatgtttcactcattggtcaactagaacatttgaccaaccaattttctttgggacataggacgttagatgggaagattcctcatgattgaggagtgaagaatgaagtgcagcaatatacacacacatacgctcgctgcggctgggcgtccaatatttggtgagatatcggacgtccgagccgtagcgctctccactttattttggaaaaaaaaagtcatccagtccctgttttagttaagtggagtctggcaattacatcgctctcagaaaaaaaaaatcaaatggagcccttgtttagatggaccggaatgcatgtatatgggccatggttatatatacacgtgagtgggccaaaatattttttgaaagaagggatggccaagatattgaggctaaacaaatatcgtccctcttgtcgtcgcacagaaagtcgggaatgtgccttacgtcgtggacaatggtgccggtgtgttctccaagaacccgaggaaagccgcgagacaggttgccagatggttcaccacacacacaaacgagctccggagatactccctcaacgcgctgaagctagcgcagccagaagccgtgttcgacatcgtgaaggacatccacaagctccagcagcagcctgccacggtgacgcggatcccttactccctgacctcatcgttctcatacagcatatgaaaaaccatcaaggttacaggatgtactatgctatgctctgcaaacatgctttgcctcggaaggttggtccgcttgctgaagaacttgtacatactgaattggatttgttcgtttgtccaaatgtgtaaatgcaataagaacagatgaactgaagatgttgtctaactggcctgctgctgatatgaagatgaagttgtggtgagagtgactgactacgagtgacaaatcatcccctcccatagctaaatatgtcctgatagaacatcttcatcttttgtacaactacagtatagttacgtggctaactggaccatctgcatagtttttctttttcactccttgtcaatcgtattgatactagattgtttggcaccatattctatcttataacttagcgattgtataatgttgtttcatgagagtattgaaatttgaaatttatatatatagttctaaatagacagaaattgtcttgatagtttttcatatgagttggaaagtgcttataaaacaaaaagaccgcgcctgtctagacattgtccacgagaagctggtgaagaagttggagcggttatgtactgccagaggatatgaggatgtgactagttttgctgctccaatttgtctatgtttgtttctttgaatcgcggtagggttaaaggatgagcgtctcatcgtttacaacctctgatggaattggagaacatttatattgagctggtgttcccagtcttttcttttcgtaacttatttctgttttttaaagaccttattacttatcttttatttttttccaaataaccggataatagtatttacctgttggctgaaaaaaatagacagttgagtaacctcttattggaggtttgttagatggcctagcctatatgctaatatattaatataaaagagggtctaataagtgtataattgtcctttgttttgctgcaatattaatgagcaacttactatataattcattgatgacaattaacataatgatgcatgtgtagaatttgcgaacatataccaaaacattgtaacaaaggaacaacagaaaatagagaggagttttaaggaaccgtaatatttacaaacgatataaccagttaaccatccgacactgatcacggaactagctaaaccctaacatattttttttttgcctatcaacttatatccactcaatttttaatcaatcattataaaacatcattttgatttgtacgtgcaacaaaataaaaacgatgcccacaaattaggtgctcctagtcaccctacatcaagtaaaaaaaaaaaaagaatccctaccactaacactgcgagaagctatggctatattgccacaccccgctttagattaagtggtcgtcttaacacaatccacttgatatcgttgacaccgtacaaaacattttgttgcctcatcggctagcgcctatcacgtctt

SEQ ID NO: 7604 - DNA, 2516 bp, Oryza sativa
tttacgccgccaagttctacagggagcccccgccccccacctggcccgcaccacggcagtgcccctctcgcccgatcccacctttcgccgggccctcgattgccgccatggccgtgccctcctccacgcttcggacgatgattggtatctcattgtctgggaccccgtcaccggcgaacagcaccgcgtgccagagcccggcatcccgtggctgatctactccagcgctgtgttctgtgccgtgagcggctgtgaccacctcgactgccacggcggtcccttccgagtggtctttgtggccaccgatgacggggcggatccaacacctacacccacaaaactcatggataccccggagcacccccttcgattttttccctatgaatgaactaaaagtccctaaatggctggaggttgaaaaaactgtgtaattgagcctccctaattttttgtttctgatccacccgtgatgagtacaaagatctcgttaaggcgagcatgtactcatcggagaccggggcgtggagcaccccggtagttcttgatgatggtcttgattcctgggaacagcgatggcgagatgcacagagtagaggtgaattctaccgcgtaccttatgtcatgcctaggcgagttgcccttgtcggagatgaaatctacttcacacttcgggaggataatgccatcatcaagtacaactggggcatgcactgcttatctgaaattgactcgccgtcgccagacgtgtatggcattgccctcatggagatggagaacggttcactgggttttgcctgcattgaggattccagcctttatgtgtggtcacggaaggtgaattcagaaggggcagcagaatgggtacaatgcagggtgatcaagctggacaaaatgatacctgttgccaatctcagtgatgaagcatttgtggttggctctggggagggtatgggtgccatattcgtgagcacaggtgttggcttgttcacgatcgagctcaagtcaaggagggtgaagaaggttgcagagcctgaggtctactttagcatcttaccctacatgagcttctacactcctggtattgtactaagactttgcttatctgctgtatgcattttctttacagcttctatatatcttattagtcataatataactgcaacatttgttatatggattgacaaaggctgttttgtgtatgctagagaatactgaatatatggcattggaaataagaacctaaattttattattgagattcgacttgtgaaataaccatgaccatgcatctggtatctgttagctgctacaaaggtttctgttaattatctggcatagctgaagctaacttctcaggctcagttgattcatggaatagttgatgtaattgataaaacatgaagtggctactacgctaaaatggatattgctaaatatttaaagaaccttcttgatataatattatcctatcgtattgtttcgggttttctttacaaagtattatgttgctctctagcatagctgaagctcacaactcaaacccaattttacaacctttgaaactagttagttctaagtgcatagctcgttaaattgtatactttgagctggaaacagttggttatgagttgttcacttgcctgtttggtgtcttttcagatcgtggcacattgttatcgctagcaaggactcactgatctttgatgtcatgctcaagagtaacttgttgcaaaatggacaaatccattgtcttgactcttgaatctgctgccactgacttcttccagaactactactactactaagctgtttattttttgttgggcagtacaagtacgaacaatgccaagtctgatgttcaaatgtggttgttgtgtcaaattcatcctaccgaccatgaactgtaagcagtctaacatgtctggcacatttcagttactgtttgttttatgttgagctcaggtacatgaaactaaaattatgttgacttatgttgcttccattcagagatcagcaagtcgtgctaagctgaatagctggctccctattctttattgttcgttttgagagcatggtttgcgctttgggtaatatggtttctgtgattatattgagcatcaagacgcccatgatggctccggtgatgtttgctttgattccagccttacaggaatgggccaactatcggaataagcatcaacacgctgatgaggccatgaaggctcaagtatcagaatttctttctctgaattctattttatcaatttctcctaactttattagtgttctctgaacttagtggtcttgcccttgtatatgctatttacctctgacgtggtttcttcgttttggctggctgagtgtttcgttcggcccgtgctgctactgggctgcttctttctggacagagttgtgtatgcttttgcttaatcaggtaacatagttggataataacgtaagtgatgtctatggaaatttctgaacagcatggatgtattacaagttatcagtttttg

SEQ ID NO: 7605 - DNA, 3245 bp, Oryza sativa
tttgaaaacagatcagcacatagaatttttgtgggatataatagagcatggtagtgatcagacaaaagccttagtactccgtagtcagtactcagtactagtctacatccgaaacaggtatcatagtccacaagtattttagaaatggaaacaagcagaaaaaaattcgacagaacaagtaggtttgaaggactgcatgactttcatttattcatgaaatggaaacgaaaacagcaagccttgagcattttttggtgcaagagatcgatgatgctccaataatccatatattccgtccttatcaaaaacattttcctgccaataggacatgatgcaaaaggtttgctaagatggcagttaagatggggtaggagttactacttggtgattttttaaattgtagtaggctcttgatgattcttccaattttaaggaatgaaattaaagggtgaaattttagagtaactttgtggtgcggcatttatacctgcactttaattcaaatattgagattagaagtcatggaaagggatacgagatattgaattaagacggatacaatgagggaattccatggaaaatttaaatgaactttcaacataaaatgtgaactgtactttttattatggtgtttggtctggaacttgattttgggatttgggtttatttttgtattttgtaacttggattagagggaggtaatatttaaattaatttagaagggatttgaatatttgggtttttgaaacatggattggactcgagtttatggagtttgcttttttggagggatgaactgcataacatgagattatttgacacagcttatgagatgacagtggaaaagcaaaaaaaaagtaattaatcttttactaaacaagagttttaacgcctcgtaaaatcaggggcgttactagccagcaatatgtcatgacgtccattactccctaccaatatgatcaatatagtcgttcgactaaaattagagttagcacaattctagcctatccttttatcagtacaaacgtcaattttggaagtcgaattgttaaaattggctagattcattggcaactattaatttgtatatacttatgactaacaaaataaatttcttacaaaatatagacttatcacttcctttttcatctccatagaggtctatataaaggttcttgtaccatcccttgacaaaatacagagaacacatttttgtttaggtgatagtgaagggtaagcagccatgagaaggggaaaagttaagatcaagcccattgcaaatagaaaggctcgtgatgtatgcttctccaagcgccgcaggttgtaatcaagaatgctaacgaactcagcatattatgtggtgtcaatgttgctgttgctgtgctctcacctgctggtaagccctttttcttttgctgccctactgttcaagctgtcactcgtcgctaacttggtgtgggtcctagttaccctaccatgggtgatgggggcaatggtgatgagactgacatagtgcatgagctcaatctgaagtaccagaagttgcaacaagagaatgaagtggagaagaagaaaaaccagcgtggtcaggatgtgaggctagctagtgatgtaaatgcattggggctgcatgagttggaggcattcgacagtaacctcaatgtaatagatgcattgtcgattcaaatgatgtggttaagaatgccaagcaaacagttgagccccagactcagatgagcgtggcatcaaccttgcagttcatgcttgatgggcagagtatcgcaccgtctctttgagcataactctacttctgaactgcttgaagagttccatgtcaactactttactgatggaatgtcaaggcactattcttctataatgtaccgcctctattacccaaaactagtctcctgtttctaatgcaccgtccatttgtatcaagggcaacaggccatccagataaatataactaggacatgttaccatgtgttcagcctttattcattagatcaacaagttgctatgcttttgcatattttttaaacatgccatccagataaatataactggaacttttatgcagataactgctttgatcatatttccaattaatgagatatttgctactccttccgttccaaaaaaatccacttctggttatgtccagatttaaacccagaagtgggtttttttttttttggacggagagaatatgcttttgctatatgtttttgttaacatcagagatttgcaacaaatgagatatttctagtaggtgtaatattgttagtgagatctgggcctgcctcctatgtgccatagccatgtttccgtcgttgaattcccacctttccaaaattgctgctcttattttttagttccaggccttcatactcatttcggtacaacctccatctgataaaaatattagggaaattacttgtttgccacatggactctgttttgattgaagggatatttttaaccctcccttaaatagctcaaatagtccaaaaaaatctaaaagagtgagctatttgagagctatttggaaataacccatccaaaaaaaatatcccactcaaggggtgctaattggggctattttggatggggcccactgaaaacatgtcttctctctatctctctccatgggaaggtaccttaaagaccaaatagctctcaaaataactcttggatccaaacaacttagggctattttattggaggactatttccttgtgctaaaaataagctttcaaaataactctggctagttctccaaacagggtcatagttgagtgacatgcatattcacagtgatattcatttgcatcggaaaagagcatcgtgtattgataagttaactcctatatttattcacacccttatgggtaggggtgggcacaaattaagtgcaatccaaatgttgcaccaaatcagaaagacacaaaggccgtttttattttcagcctttggttttattttccccctactctgggattaagcgttcagtgttttacttggctttaagagctgataaccaaacagactaaggctgtgttagttttgaatggttgggaacaaacttctctgcacgaaaaacggagcagtccattagtgtatggttaattaagtattagctatttttttcaaaaatgaatcaatatgatttttttaagcaactttcgtataaaaactttttataaaaaacgcaccgtttagcagtttgaaaaacgtgcgcg

SEQ ID NO: 7606 - DNA, 563 bp, Oryza sativa
gaatactctcaggctgctgcatatacatatgctgagttcccagaatactttacctggcatggtaatggcaaatattgggctgcacagaaaaattgccgcaagaaaattggaaggatagcacatgtttgtcctgcccaaggagatgtctactaccttagaatgttgctgcacattgtcaaaggagcaaaatcctattctgatctgcggaccattgaaggacatgtatatcctacattccaagctgcatgtcaagccctaggccttcttggtgatgaccgtgaatggtccttcgcaatgactgatgcgactcattgggcacttccctaccaactccgtgagttatttgtaacattgcttcttttctgtgatgttacacacccactgagtttatttgaagagcatctgtcttcaatgggtcaagatgcagcctaccaccttaaccatgccacactaggtataaattcttctgcaccttcagtcatacaatatgtcaagtcctatgttctttccgagatcgatagcatacttagaaatgttggtcgtactttggcatattttcattt

SEQ ID NO: 7607 - DNA, 1109 bp, Oryza sativa
catatataccaaggatagtaaccacttcaattgataagaagtggccttttaaattaaagcgccgacaatttcctgtacgtgtgtcatatgcaatgactataaataaaagtcaagggcaaacacttagtagagttggtgtctacttacctagccatgtcttctcacatggacaactttatgtcgcattctcacgtctaacatcgcctgatggtcttcgtattctaattgagaatagtccaactgagcatgtgaccagcactcacaatgttggttacaaagaaatatttaacgatctggatcaacaaggaatgcatacatgattacaggtaagtcaagcatacgtgttctacctattggtaatttgctgtgttttgttgccttgcccccaatgtgagtcctaggttcttttttctcagacctactaacttgacctgattatattctttgtgttttgatacttaatgtcaaatttacctatgttcattgtttgtaggattctttatccgaaacctctgccttgtcaaagcagcacgcagttggtattgttacaatagttcagttctttcctgtctattttatgtgatcttcacactcaactttcctctaatatatgccttctggtatccatggtttcttcgtaagtttgttttcctctttttatattttgcattctgaccactaaacaagttcaatgtgaaaagaagtttacagcattttacaggttacctatataaatttgaagatccttgcattcctgcattgccaaaaaaaaaaatcttccacaccaaatctagattctctcacagctaatgcttttaagtagtctatcatatttggtcacacacctactcctattaatttagtcttgatacaagttcatagtatgctataattcattaagttttccatccatatatatgtttcataacatgtcttaccacttcatttgtcatctcatcaactgtcacatgatattattttccctgttccaatgtgatcagctactttaacaactgtatatggatgttttacacacatacctatttaccttaaaaattaatctgttattcactatgctaccagtcttgattatggctgatgctcataat

SEQ ID NO: 7608 - DNA, 865 bp, Oryza sativa
agtaatatttttgttgtcatgtgaaatattaaaaatatatgtattcacatttatattaacgacactgcagtttctaatcatatcagctttgacgttggatttatatttcaaaatctacatgaataccttttgtttccgtgcttcactccatgcttataataaccaattttcattatgtcccgcggcaacacgcggggtacatactagttaattcagttgttctcagaattggatgaaccaacgaaggccctagctacattagtgtgttctcggaaaaaaattttgaggtagcatatacaatttttttatataaatattatttctaaatgcaatttaaatgtttatgacaataattcatatattatcattgtatagtttcacacctctacatttagtttcacaccggacccctgaaaagtctcctcgcctcctcgcgtgcaccgttgccaccactgcactccaccattgcccctactgtcgctcctcctcgcgtgtaccgctgccgccgccgcactccactgctgcccccgcagtcactccttctcgcgggtaacgctgcagccgccgccccaaggtactgctctattgctttcgctcctatctttctcttctctttttgaatcaccacctggttcttgatttctttttgatctaccaaaccgagatcaaatccagtgctctcagaacaaacgaatagtttcacaactgtgttatttgatttgattcgaatagaaggaatcattcttggtaatgtatagaacgctcgaatagaaggaatcacaactgctcgcagttgctagcagtcctaattacctgttatgttttaaatcttgttgcactattgaaaagttactttttcttcttc

SEQ ID NO: 7609 - DNA, 1366 bp, Oryza sativa
  unsure (1)..(1366): unsure at all n locations
gcaaaagggcaagccccctttctacccctctttttcccttttcctcctcgccggcgtcatcctccctgtcgccgctttggccacgaccgccgagcgccagctcgcgcccttgaccgcgcaaagtcggttcccaaaccgacattgccgcccctttaaacccccagactcccctttcccttcctattccattcgtctccgctccattgccgccgcccccgtgctctgtctcgcctccgccgtccttcgccgagcgccgggagagccggtgcgttcgaggacgcggaaggggactccgggcgtgccctcgcttcttcctcttcctcggcccgaggccggagagattactcccgcgccgtcggcctctcgtcacagcgcccctcctcttctcggtgatgcctctctccgttcttcctcctcgctccatctcccccctagctgcggtagtagcttgagtagcctccccgtagttagccggcgccgccccgaccgttgccgtcgctccccgtgtgctcgccgccgtcgccgcccgagctccgtagcccccgctcgtcgccagcctcgctcggcgtagttccgcccaatccgacgctagcgtcgagttcccgaagccgcgtggatgctctcaccgccgggaatcgacccctcgtggcctcgtcgccgtttccctcttctcccgccgccggttgccgccgccgcaatccgccgccgtcgagcaacctccggcgaatccgagccgttggctcgtctccccttgtcacgtacaaccacccggtgtgctcgcttttgcccgtatcgccgtggttcactccgccgctcgccgtcgccgcccgccgtccaatcgcggccgggtcgtcgtctacctcccgccggcccgcgaggcagccacgtaggcgccacgtcggcgccagctcagcctagaccgggtcgagccgaccccggtcagcccctccccttgcgcgcgttccaccgcgagccgagaggctgcgcgtgggcccgccgcacccgcgtccaccgcaaaccgcgcgcgtgcaccgcgtccctcccgcgcccgcgcgcgtgcgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 7610 - DNA, 87788 bp, Oryza sativa
  unsure (1)..(87788): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcgggttcttggtctctgcccgaggcatcgaggccaaccccgagaagatacgagctatagagcggatgcgccccccagcaagcttagggatgtgcaatgcgtcaccggctgcatggccgccctaagtcggttcatatcgaggctgggagagaaggcgctacccctatttaagctcctcaaacgctccgggccgtttatctggacggaggaggctgagcgggccttcactcagttgaaggcgtacctcagttctcccccagtcctggtcgccccggagccagatgagccgctgctactttacctggcggcaaccccgcaggtggtcagcgcggcgttggttgtggagcacgacgaggacaaccctcaccccgcgcatccccaccctgtgtcgactcgacccgggagagagcagggaggagaggcccccgagccgaacggcggcccgaggcccccgacggccggagctggccctccgcctgcttgtcagacggtgccaggcgcccccgacccccaggatggccccggggccactgcgggaaggccgcgcctgtcgccctccgaccccgaggtcgtcggcacagaagccgagtgcgccccgcacgacctctcggacgaagagcgccctggagatgcggcccctagcgaagaggatcggccccgccgaaaggtgcagcggcccgtctacttcgttagcgaggccctccgggacgctaagacccgataccctcaggcccagaagatgctttacgctattctgatggcttcgaggaagttgcgccattattttcaggcgcatcgggtcacggtggttacgtcttatcccctcggccaaatcttgcataaccgagagggtactggacgggtggtgaaatgggcaatcgaactctctgagtttgatttgcactttgaaccacgccacgcgatcaagagccaggccctcgccaactttgtggcagagtggaccccggcccctgagcccatctccgtccccgagaccagctcgggcccctcgcagctgcctcccaccgcctactgggtgatgcagttcgacggctccctatctcttcagggcgccggtgcgggggtcacgttaacctcgccaaacggagacgtcctcagatacctggttcgcctcgacttccgggcgaccaataatatggcggagtacgagggactccttgcgggactcagggtggcagctggactggggatccgccgcctcctggtgttaggcgactcccagctggtcgttaaccaggtctgtaaggagtaccggtgctctgacccgcagatagacgcttacgtgcgccaagtgcggcgtatggagcgccaatttgacggaatagagcttcggcacgtgcccagacgggataacgcggtcgccgacgaactctcgaggctcgcttcctcgcgagcccagaccccaccgggcgcctttgaagaaaggcttgcccagccatcggcgcggcccgaccccctagaggagacggacgcgcctgaacggcccccgaggcccgtcggagtccaggcctcgggacccgaggggagcgctcccagctcccttagattgattgcttggatcactgagatctaggcgtacctcacagataagactctacccgaggaccgcgaagggagtgaacgcgtccagcgcatctccaagcgctacgtgctggtggaagggaccctctatcggcgcgcggctaacggagtcctcctgaagtgcattcctcaggaacaaggcgtcgagcttcttgccgatatccatgaaggcgagtgcggagcccactccgcctcacgcaccttggctggcaaggcctttcgccagggtttctattggccgacggctctcaacgatgcggttgacctggtccggcggtgcagggcgtgccagttccacgccaagcaaacccatcagccggcccaggccctgcagaccatacctctttcatggccgtttgctgtctgggggctcgatatcctgggtccgtttaggcgggccccgggcggtttcgagtatctgtatgtcgctgtcgacaagttcactaagtggcccgaggcttacccggtcatcaagatcgataagcacaccgcgcttaaattcatcaggggcattactgctcggtttggggtgcctaatcgtatcattacggataacggcacccagttcactagtgaactcttcggtgactactgcgaagatatgggcatcaagctctgcttcgcctctcccgcccaccccagaagcaatggccaagtggagcgcgccaacgcagaaatcctcaagggcctcaaaaccaaaaccttcaatatcctcaagaagcacggcgactcgtggatcgaggagttaccagcggtgctctgggcgaaccgaaccacgccaagccgagcaaccggggaaacgcctttcttcctcgtctacggcgcggaggcagttctcccattcgagctcaccctgaggtcccctcgggccaccatgtactgcgaggccgatcaagatcagctttgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtactacgccgcgtccaaacgcgtgctggactgagcaaactctcaccaatgtgggagggtccgtatcgagtgatcggcgtcccccggccgggctccgttcggctggccacggccgacggcacagagctgcctaatccgtggaacatcgaacaccttcgtcgcttctacccctagtaggggtcaggtgtcaggtctcgggctcgggccaaccccgcgccctcccaggcgtgcagagttggccgggggctaccacatgcatatccttatcttttttctcttccgtatttcaataaaagcattttcgatttcctaaggactgtgtctgtgccattgtttcctttcgaagaatcttggcttgaattagcacgctcgtgctcgatcctgccctcggtggcccgggccggctaaaatcgccaaacggggcccagaaccgagccgtgccccggggcgtggtgaactccgggggggaatcggcaaaggcccacaatcgggtcatccataatcctcggtcaccacgttcccggcctggccagtctcgacacacggatctccccaggcactagccccgacccgcgccatttgaggctgggacctgggcacgagccctcgttcaagccaagacacagaaggaccgcggcacagaccatcctcatctcatacacacaacaaacagagctgacacaaaaatttcctctttatttgattgcagattgaattagtttatacaagaagggggcccgaaggcctcagaagaagaaagaaaaagctatttaagattggcgggggcctgggggctcacgccgacgcgcccgggtcgccggcctcgtcatcgctgtcgtccgcaccaccgtcaccgccctcctcgtcggagtctggcctcttcccaagcggcttcctcagcctggcgagcccggacagcctcctgggcagcttcctcggcttcccggaggcggtttgcggcttctcgccggtcagcttcccgcctccgggcctccgtggtcgccgtctcctcggcctcagaccggccagacttggaatggcgggaagggcgcgacgggatctcgctgaggcagaagaaaaaccagaagacgaaaaacgggtgagtgaaaacttgccttgggagatgggagaatgaatacggccgcagtgggcgcggggatgaacctgcgaggaggtcggctaaacgaccaccttggggggagatgagctttccccggcatggttcggtcccccctatcttgcggagccgcttcttttttcgctccccctcgggctacgacgtcggcacagcaccctccgggcgcctgctgctggcacgcaccaccccgccccctcggggaggagatggggagggggtatcctcctgtttcctcttcccccgggcgtcggcagggcggctgccccccgggcccccgtcacggggcccagaagcacgactccctcccggggtagattgttcccccctgcggctcccgcccgcgccatcgtggcctcgaggagcccgctcccctgacgccccgaccgcctgcatgatggtcaggatgttggcgcgctctggatcgctgcagagggggaggacaccttgggggatgagggatgcctccacggagctgagattcagcacccgttggatcaccaccttgaagtcttcagggacccagtcccatttgaccccctggtgggtcctcatgtagtcctcggacccggtgtactcccaggcgccccgggcgcgccgctggagcggcgcgatccggcgacgaaggtaatcgccgtacaccatggcccccgtgagcccctgggatcgcagaccagccaggcggtcaagaacggcgtcgtagccgtctcccagatctaccggcgcccgccagctggaggcctgcgccgggggctggctcggaagtcggaggcgcgcttcgtcggcgagaggggtgtagaaccagtcgctcttccagtcgtcccacttcttgcgaaggacgcagggaatgtagcggttcagcaccggcccccgcggctggaagtagcagccaccgactaccgacggtggcgacaccggctgtacggtgaagaaccaccggaacagccggagagatgggcgcaccccgatgaacatctcgcacaggtgcgcgaagatggccaacgtcattaccgcgttgggggtgaggtgcgccatctggagatcataaagctccagaacatccatgaagaaagaagagaatggcgggaccagccctgccattgcgaaggaaaggaagaatacggaccgccccgggtagtgtggcgccgggcgtccctcacccagcgcaaccacctcctggccggtggcagattccggcatgaatcggcgcggcagcccggcttgcctctcgctcacgatgcgagaaggcggcagcacgctaccgtcgagcggtgcggagccccgtgccatgacaccggcggaggaggggtttgagagcgagtgagtgcggcgagggtagggcacaggaaacgagaagttagagcgcaagcggcgaaggcaaggggaataatggcgaagaggaaggaaacgaatctcttcctcggcgtctttatacccttgccaacgctatgcccggctcctcgcttcccgcgcccactatctcgccccctcgtttctcgcgcccactcctccactaatcccgttcgcccgtttgcggcgcacgaggcggatgtgcggccgtggcagtcgagatgggacatatcgtgcgcgcgttaactacgctcgccgaccgatgcaccatcatcacatctctaggcgaaacgaaccggttcgtcccgattcgcgcgctactcaagtaatgtagcggtcttgaagagcccgctcattattgtcgatcggtttctcccttgccgatgcgcgcgatttgcgaccgttgggtttctgcccgcctgtggggaccggccccacctgtcaccgggcctaaggagtggcatctcgcccgatcgcctccctcgaggggggcggtcgccctagcgtgacgccggcggctactgtcggtgacatggggccaggggtatcgtgactagaggcttgggtagccgcgatcactcacgtggcccgaccccctcgggggggtcgggcccaacggtgacatggccacccctccctctgtctccccgaggggtcggccgctcccgtttcggccccgagggctggggcgccccgaccccctgtggcgtcggcgccacgtgtgtgggttaggtgagcaaagcggccctcacctaaccacatttatagcgggttagacgagcgcgtcacgccgcattcaatgcggcgcagcgcatgcttatccggtctgtgaccagtcgcggtatgtgaccggtcacagaccggtcagatcgcgggttaggtggcaacaggcggcctgtcgcacgcctcgctccgtcccgtcggaatgatgagagcctctaggcactcgtccctagacggagccggcgtgggaactcctggagttagcacatcggtctcggctagattcataccaggcttcatcgcaaccattacaaggaagtcattttatgaagaagggctgacgtgtggcatgctaaactgacgcgtggtagacaagaatgaccggtttgtgactggtctgacgccggtcacgtcatcagcaaataaccgtgctcccacgttgcacctgcttccggcggagtggaggttggtatgacccatcccatcggagggtcattcggacagcagccattgcaaatctccgcccattaatgaaggaaggacagggttatcccggtgtcaggcgaaggtacgagccaagttttggtcaaagtaggatgggtccccacccaaaagaagggtaggtagaaatggtgtatgtggtatccccttgagatataaaaggaggaccatgcctaccaagagaggggactggaggaaaaagagagaagaaagggagaagaaaagaaggagagctcgtaaaaggaagagcggagctcgtagaggagagaaagagtgagagggtctctctagagtttgaactctcttgctctccagctctttgtaactccttcatacacagatccaccagaacacaggagtagggtattacgcttctcagcggcccgaacctgtctacatcgcccgtgtcttgcgcatttgctctctcgcgaaacattccacaaatcgagggcttagaatctcacctagcgcccccggccgaaccagcaaaggggggcccgcgcggtctcccggtgaggagccccacgctccgtcatctttgaacaatcttgagaaatcaaaacaccatcgttttgttttgccttatttgcacatgaaacattgactaaagaacttgcacaaaaagccactttgtatttttttcaaaacattctttgtcaaaatcaactcatcaacaacacgagcaagtaaagcaaatccaagagcaaaagaagattccaactttttagatttttcaatttcaaattccaatttcttgcaattaacagaattgacatatcgcaaagcactaatttcagaaaataaaacttcacaagattgacaattatcatcattaggaatcaaaaattttaatctagcaatttcagcattaagaatctcaatagtatgatccttctcatcaagcacaatagaacatgtttgaagtttcttaccaaatttgtaagcagcatattctagttgatcataactaagcttttcttcattatcatcatcagattcatcaacatcagaacttgcattacgagcaataaaaactaaatcaacaacttgcttacctttgctctcatcttcatcttccgattcatcaaaaacttttatgagtttttggattaaccacttgatacaatgcttcttcttctccttctccttcatgttcttcttcttgttcacgtcatcctctttgactctaccatcatcttccttcttgcctctcccaagcttaggacaatgcgagcgaagatgatcaagtgcaccacactcaaaacaatgatttggttctcctcttttcctgtttctaacatttttcatagctcgagaaaatttgttagatagcaaaaccaagtcctcctcctcgaactgttcgagttgatcatcggacatggcattaaataaagcaagaacagaagacttcgatgaagaagcaccaacatccaaagaagttgaagacgaaaccaaagcactagacttagaatcacctttacgagaaagaatattcatctcatgagttttcagttttgtgtaaagcgaatccaaagtcaaagtagacatgttcacggactcctgaatagaagtaactttcatctcccaaatagacatgtcaagaccattcaaaaagtgacgagaaatctcagattgtggataattagcatcataagaagaatcaacagatctaagatcactcaaaattttattaaacctagaaagatagtcatccaaagcttctccaggtttcatctcaaatttaatgtactcctttttgaaaagatcacgacgaaattctttaatgttatttgtaccttgatgaaaattattcaaagcaacccaaatctcatgagcagtttgaagatgagcaacacgatcataatccgaacaagaaatcccactcaaaagaatattgcgagctttgcaattcagttcaaaagcaattttttcagcagcagtattaataacttcaggaatcacataaggaagagaaacttttctccaaatatcataattctcagccataatgtaagattgcatcctactacaccaatgagaaaaatccgttccatcgaaaacatgaggcttagttgaaaacttattagaagcagccatggcaaaaactctagatcggttaaaatccaaagaagcaaaaaaagctctgataccacttgtaggatcgaatcacaagaactaagccaaccagaggggggttaatggttggtatacccaaaaaccaaaaacttttagcggaaataaaagttaccctcgaaatagacggagatcggtctgaccgagattaatctgttggtctgaccgagtggatgccaccggtctgaccgatgtagaacgattggtcgaaccgccgaagtcgcctgccgctcgctgtcgctgctgccggtctgactgccgtactcccgccggtctgaccaccgcaatgccgtcgatctgaccgccggtgagttgccggttagaccgccgaaacccggtgaaacacaaatcgaagaactcttaaaatagatgacaactttattgattctctctgtgtttacaaagtgcaccaacagcactccttataaaaattttgaccaaactcgaaaccctaactaaactagcaactcaattgctctcaaaagcaatacaaaagcgataccgggaagcctcacgctccccctctatttatacatgaggtaggcagcctaaagccacgaaccaaactcatactaagagtcctaaacaccttaggaaactctctagtacaagacacaaactttacataaccaattgtaccaaatttggactccttccaaattcgactccgcatcccaaacgcacacaatacctccatcgtatgccatatggaatcttcaccaaccacgtgcatcaactctagccttagtatcccgcataatatctgaccaccacggacatcgtcttaccaccaagccgactcccggtccatcaccgcaaatactctccctaggcatcgagtcacctacacatgaaacaaataaagaaactatattccgagaccaagctatcaccaacttgactcattgttagcaaacaacagtattacatacgtatagtatccatctagaagccataaccatgaaacaatcacggatatccaaagaaacaacccgaaaccgaaaccgacacagcgtcggccggtcagaccgcgggccggccggtctgaccgctcgatcaccgctggtctgaccggcatacacagcctggtcagaccggtcacataaaataacagtgaatccgatcatcacctgaaaattgattatctccaaaacaacttcgacgataatctccaaatatcaaaaccaataatcacagatgccaattgttcatcacagaataagaattaaaacacacattgatcttacatcttcttcacgagaatttgtgttcaaaaccaaaaacgaaaaaggaaggaaacgggaagaccatatacaaaaggaagcgagacgtgacatggatggaaattggaatcaacagcagcgacggttcggattcgatgatcttcatgggtattcctgctggccgaccggctggtaggaggcgatgaacacgtcgtcgtagacgagcccggccaggccaccaccgatcagtgggccgacccagtacacccagttgccggcgaagttgccggccgcgacggccgggccgaaggagcgggcagggttcatggaactgccgctaaagggccccgccgccaggatgttggcaccgacgatgaagccgatggccatgggcgcgacggtgccgagggaacccttcttcgggtcggccgccgtggcgtacaccgtgtacaccagcgcgaacgtgatcacaatctccatcaccatgccctcgatctcgctaattccggcgatggcgtgcgtcgggatagcctgcgaattagcaagcccgattcacttagctcaagtgcgaagtacaaagcacaacaacgtggcagcatgatggaaaccaacctgtccgtgggtggagaactgcagagcagacacgcgacggacgcgccgagcagctgagcgacccagtagaagatgccggtgaggatggtgatgtggccaccgacggcgaggccgaaggtgacaacggggttcaagtggccaccggagatgttggcggccatggaaactccgacgaacagcgcgaaggcatgggctatggcgatcgccaccagaccagctgggtctagcgcgccgccctttgtcagttgccctgcacaacaaagatttagatgagaaacatagaatgatcactgtgctaagtggtacaagcagagttgggatggaagttttttgaaacataaataaggagctcaccgtaggcaatggcggagccgacgccggcgaacacaaagaggagtgtggcaatgaactccgcgacataggccttgatggacgaggcactgaaagagtcgccgcagcttccaaatgcaagcttcaccatctttctttatgcgagtagaagagcttttaggctaggacttcaaaggagatggttgatcacactgatgcaggtaaagcccttcttcaggcccccttttatacacacaacaggtgactgtaatgacttgatggacagtcctaaatgttcactacaatattatgggtggcgtgaaatgataaccacaagattgataatctaaaaactaatcgtgttttgtggtttatattggccgaccaaccactctgttctgctgaacgcctgaactttgtgtttattgtgattgtttagacatgaaccacgttaggatacaccacaagacaattagaaagaagctatcgggtcatgtattatcttatctattggctaataaacattatggagcattgtaatgactaaactgttgttgggtcatgttcttgatgtattatctaatatcttatcttcttctcttccttgactcctaaatgtaggagaaatcaaatttctgaatattacttgaacaacagtttttcttggctgtaaaggaacttctgcaatcttgtattggaagtgatatactttgttgatctttacttaggtattgcattatgaatagtagtagaagttttccctgcaatggaagttacaaaagacaaccactgaagagtatgtgaacaagagaccacggtttcttggtttcttgtggaagggggatgaggatgcactgggtggatgcaacctagttgcttgggataagctctgtctgccgatcgaaaatggcgggttgggcatcatcaatcttggcagaatgggcattgcccttcggacgcggtggctttggctgcggcgtgtctagccggagcgccactgggtgtccttcacattgccgcaagataggaaagccgaacattgtctagcggccggatgcaggattgtgctgggtgacgggaagagttccttcttctggacagatgactggctcccagatggggggtcgatcctgaaccgagccccaatcctgtgttcctttgttaaaaacagaggcagaacggttcattcggcgctgcaggatgatgcctggaccggcgacatcaggggaggtctttcactgtaagcgatgtttgaatacctccaaatctgggaccttgttgccaccgtttccttgaaccctactcagcctgatttgttttcttggaagcctgccacagatggtggtttctcagtaaaatcagcctattcactcctctgcactgggaagacacgctcggcggttgggaagctgatttggaagtctcgcgcgccgacccgttgcaagttcttcatgttccttgccatacgtggagcatgcctaacggcggacaacctccagcggcgaggatggcacttggctccatactgtcacctttgcgggaaggatgctgaatcatgtgcccatatgttccacgcttgcgagtacacgagggcagtttggacgagaatcaggagttgcctgggactctcctgtgtttcccccacggacgacatgttggattggtggtgtgaagcacgcaaatcagttcacaagagatcggaggacctttgatgttggggttatcttggtaacatggatagtctggaaggaaaggaatgcacgtgtgtttgatggacgagctacttcagcggttcacctttgtgccacaattgtcgacgaatgggaaacatggaaggctgctgggctactgagcgcaatcgctggcggttaatttcctgaggttttagcagctgtgcttgtttattgtctttattgttgtgaagttttttttgtaacctaagccttttctggtttaggggctgctgtaaaactctctccttcttaatgcaaaacttggccggttatctttgccagcctggcgaaaattaattagcccaaacctgaattttgttgttaccaatcattcatgtaatttatgaccgaaggttcagttcaaagagcggtcggaaaagggattgtgacaggaatccaatggacactctggagtaggtaaggctagcaattaaatcaattgagttcgtggctggtccggcaattgaaataataggtttcaacaatatgataatgctagaatgagtggtaatgacttcatggcatgaaggagatgattagacgaccaaaccaggcaaacttctttatgctatcctctgtagttgctcagctcattatttgtgcagtcagcatttgtgcagagtttcttggaattcactttttcatacaaaacagaacggtggatagctcatctggtactggtagggagctaccaggagcaagccctggcctgggttcgagtccctatctcaccattttcttctctctcaaagctaaaaaaaagagtagtatttgataccaagtctctccttattatcacaattttttcatacaaaacttgttcttcgggcatatgaaacaaaaaatttatggaccacagataatcaggaattcatacgagtttcctctgaaatgggaatggggtttctggtagttcataccaaattactaatcaatgtcattagcacttctggcggtggtcatacgagctcaagccaataatggcatagattaggtccttgcaagaaagagaaagagtagatactttgtcatgcccctattcattatgcaaacttcatttggtgtttaggcttaaacaatgccttaatggttctttagcttatctcattaggcatatcattgagaatacccagcatttcagagactggtggatgttttctttgttcatttcctgacctgtttctgcagatacaatcaagccctctgatattctaatgcaagctgcactgagccatacaaccttgtgctcacataatctctataactttttggaaatggttagatatctccaacattacagaaggagataggcacctaaacaggtcataacatttcacctggtttggtgtttcatcagtaaaccagttccatgacattgggaatgtcattttgtcccttaaggggatgtgcactcatcctttttatgtgggcagtgtatcaggtgaaaaccaggcattctgtgtaaacttggaaactctcgatcaagaccacaggatgctcatctgatggctagggatagaggtgggccaattttgcacttaaccgcccacaattagccatagtaatctcatttttttgcaaatcaccctccgccaatcccatcgtcgcttcgtgtggccgctgcgggcgtcgtttcgtctggtcgccaccctccgcccgcgagtcaccgctccctcgtccgcgattcgccgccgccgcaacagccccggccccagccgtgctactgcatagtcattttctggcatttgggagctgttgctgtagattgaagatgttgacaggaatctgttgctgctgtcctagcaagttatctgtgttattatctgtcctagcaagagatacaaaattctgtgaattgtgtcatctgtgttgttacctgtgagcagctctgtgaatatgaatgttgttatctgtgaacttcttgtgaatgggcatggtctaaattcagtaatattttcaagtgttcaaattacagtcacagtgaagattgtcctttgaaagacaaactttttcaatttgccttcttgggtcaaactttttcaacatcgcagtgaactgaaaatccaaaagctgaatgattaactcaaaatttagcacaattgatctgaaaattagcagcaataagctgaatgatgccactagtaaaaaaagtgtttataatagtactttgctcaattgaacttaaaaggttacgggaacttgaaatatcagccaacaacattgtttgggcaattgcgtgcatcatgatccactgcttgcttacattttgacacttccgtttatttgtatccttacttccacttccagccttcttctccttgctcttcctaatgttcaaatgttctttgcaacttactattatactcagagaagattttggctgtggtgtgcttggatgttcaaggtggactccaactccggcgtcgatggtgatgacggcatgatccatggcggtagcctcaacagaggcagaatcaacagtgactacaggttcaccatccactgcatgcaggcacgttagcaaggatcaaaataatttctatcaaagtcaagatgaaagcattataggagaaacgactaacgacggcatgaagggctgccactgccaatgccgaagtgggcgttcgtgcgtgcgtagaaaggatgtcgtgcgtgccagactccatgccgttgcacacgctggactccatcacggtttcgtgaggcgcacctcggcgggcctcacgaaacgatggcgcgtggcgcacctcagcgggctagtgacggagttgagccggctgggcgggcctgcattcgtggccaggcgcgagggagcgattcgcgggcggagggcggcggccaaacgaaatgacgcccgcggcggccaaccggccacacgaagcgacgctgggattgggcggggggtgatttgcaaaaaaaacgagattactatggctaattgcgggcggttaagtgcaaaattagcccacctctgtccctagccatcggatgagcatcctgtggacttgattgagagtttccaagtttgcacaggatgcttggttttcacctgatacactgcctggctatgaaaaattctaaaaacaattataacataaataattgtgtgagatatcattacaccaacatgcaaatttaaatcgaactagacaacttggaatacaaatctgactagtagtattcagtgtgtatttctgtttttcacattttgtaaatcaagtttgaaattagttttttgcaggatgataaataactaattgaccaatagttttatttttaaagtgttctataactatttgattagtatttcatacttacaaacaaacgtggggacatacctttagggaatgaaaaaaaattcaataacatttgcttccatcggaagattttggtgccatatacttgtaggatcaaggaggccgactagaggggggtgaataggcggttttaaaacttaatggcacttaaacaaaactaacctatgttgctaggcaaggtgaggtgcaaggttaactaagcaactaagttaagttttgcaaacataggtgatatgggctcaaatatgtctctatgaaagtaaattgcacaaatgtaaatgcaacaaataaatgagacaagagacaaggaatttttcactgaggttcggaaactcgccggtttcctaatccccgttgaggcgagcccaactccaccgctcaaccacgaagccaccgcacgcccccttggtcaaggggtgggcaaggtgggagccggcccacggagaggactacccaagcctcgatcactagggtagttcttccttcactccgaaggtggtgaactccaaaccactcacaaacggcgccgggcctcctccacaatctcctcggagaggtcaccgggcaacacctccacaagccgtctaggaggcggcaacctccaagagtaacaaatctaggatgcttgccgaggatgatcaggtgccacactagcaatgaagcaatgcacttggattggcttaactcactctctaacacctcactagataaactaagtgcacaagggtgtgagagctcttgcaatggttcaagataatgcaatggagtgccaaaaccttacccttgctgctggggagtaggtatatatacccaaccaccaaaactagccattggaaccgaaatccccaactttgtgctctgccggtcagaccgccgttgtgaggccgatcagaccggaccactttgtaacggctagaacagggaaattattgggcccactcaacctggccggtctgaccgcagtgtagtggccggtcagaccgtccatggctcggtcagaccgccgtcggctcggtctgaccggttgcggctctagcggctctgtatcgccaccaaaaaccagatcagtgcaacagaccagtggggccggtcagaccggccttaccacaccggtcagaccggctaacagacccggtcagaccggcctaaggcccacggtcagaccgcatgtcacttttcagctcaaccgaccgttagtaaaacggcgatatctcttgactcgggtctcggaatttggcgttcttggactctatggaaagcttattcaaaggaccatccaacccatgaaaaatccatccaagaaaaacaactaaagtcaaggataaagggctcacactccaaaggatatccaccggacatacccacaagatgtcactcactcctattggacatgcctacttctctcttggtttaggacttgagaaaactcatcacacttgtttagacaaacccacaaaatgcacctacatgcatatgaactaatatggcacaagatcatcaacaagctcgcttcatagacccctattgatagtacggcgcctatctagcaaatccggtctacaccaaacaccaagaccgggaaaagactaagaaaacattcttagctacattatacctttgccttgtgccatccatcttggggtcaagcttgagccgagatcaacacttgtgaccatccggttgaaccatgtttatgccgaggtcttgtccatcctttgtcaagactttattctcatcacaagcttgacttcattcttgccaacatgacgatgtccttggcttggtgaccactaacccatggtgtcattcattagcctcatcgtagtgggacctattccttttcacacctcaaaggagaacattagtctcaacaaatcggttgtcatccttcacttgatgaccaaccggttgcatatgaaagatatggatatgtttgttgagtattcattaacatcacaagtgtcatatactcgtatgcaagctcaagtgcaaatatccgatataaataataggtgaacaacatagatctagaacatgcacaataaatgtataggatttgctccccctaaatatatgcatacaaataaatatacaagagatgcaagtgtatgcataattagagaatgaccaatggggatttatcctatacatatagagaaggcatatgaagtaatgatgtagaccaacataaaacatataccttcatgatctccatgttctcaatgtaaatgagactaaataagataacattcgagtaaacattagtctcacacttatatatcaattacatggaaatcatatatatgaacctatcaaaaagtaggagataagaagtggtacatatcgttttatctccatgcatttcatccttgtcatgattaaggtacatcacaaaagaatgcatgtcttccgcatctcattatcgggaaataacctagtagacaacttatgcaaaagagaggttaatcccataaacatcggtttatcatgtatcaccaaagtaacaattacgcaaattgtttaatccaagatctttcaatcttttctctctttggtgatagataataattcgatataaacaatatagagagatgagatgaaaaatgatttcaaatcaagatagaaatcttataataaacaaaaatataaaataagctctccctcaagatgtgcatacatatggatatgaaggaacgcatatgcacataatcaataaagatcaaataggaagctcacactatattttggatccacaagagagaccaagttagaatatgtgaagtttaatacatacctctcatcatttttacttttgtatccaaatgagactagtcaaagaaaggctcataaaaatgaaacgattagtctcatatagttagatttgtcattaatcaattaaggcacttgaacttacaatactacaaaaggccatgctcttcggtctccataaatctttggctgtgtttagttcagcgcaaagtttgaattttggttgaaattggagatgatgtgactgaaaagttatgtgtgtatgacagattgatgtgatggaaaaggactgaagtttagatccaaactttggatctaaacacagcctttaaacccttgtctttctctctgagttgattgttgaatcaggcatcctattgcttgctgttatggtctacgcgtaccagtgcagattaaacttttgtgtacttgtatcagttcagtattagggttaagactttgtttaccaaagaaaagaaaagcatgcagtttcgcacatcttccttaattgccaaaagagtaaatttcacgaaactacatataatttgatcaaactatcacaaaactacacatttaagaacgtgtttcacaaaattacaggtttagtgttaaatttatcacggaactacagatttaagatattatatcacaaaactatagatttaacaactattttatcacaaaactacacatttaaaaactatttatcataaaactacagattttataacttttaataaataataatactatgatccaagtctagaatatgtagttctgtgataacttcatcactaaatctatagttttctgatatggtgcattaaatctgtagttccatgaaaagtttgacgttaaatctgtagttttgtgataaacattcttaaatctgtagttttgtgataattagacccccaaagtatctgtaattttgtaaaatttattattgtcaaaatcacttgagaccatcaagttcatactatcggtctcatctttttgcttatacttatacttattagctaaaatttaaagttaattttaaagttttttcattgaagtttatttttcagcttttgcttttaaatcgccaagaacacatatataaaagttttattcataaattatcttttgtttgcaaatatgccgtttcgcttatgcttaaaataagccaaatggcttcctatgaattcacatcagccaaggttggtagttccgttcaccttctcaacattataccaagctttgcagtttgcaccaggaagctccatttcttgcagaaatcagcatggaatctgagcctttagcatcaagttcatcaaggtaagccagtaaggtatcatggtgtatggcctacttggtgctatttgtatgagttgcttcagctgaacccatatcaaagctaggctcctaaaatttgtcatccacatacaaatttcacagagaaaaaaccatgatgtcatccaattccctcttccagcgtctggcaaaatggtgcccgtggttactgagagatgagccgaagaagcctgtcaaggttcttgtcaccggcgccgcaggtaatacagaactcggaagctaatcaaacacttaagcagctaaaccaaaaatacgaccagaagtcgagaaaacaaattcactgacgacattttgtgctgttttttgcagggcaaatagggtatgccattgtcgcgatgatcgcgaggggcctcatgctaggagccgaccagccggtggtgctccacctgctggatctgccggtcgcggccaatgctctgaacggcgtcaggatggaactgatcgacgctgcgctgccgctgctcagaggtgcgtgaccttgtaccttcaagtttccctcgttgcgctggtcgcccgagtataaaacatgatgcttcaattgtgtaggagtggtggcgacgagtgacgaggctgaggcgttcaagggcgtcaacgtcgccatcgtcatcggtggatggccgaggagagacgggatggagaggaaagatttgattagcaagaacgtgacaatctacaaatcccaggcctctgcgctccatcagcacgccgccccaaactgcaaggtgaatgacgacgcatcacgtatacgcaagtacacaatttctatgctaaaacactactgctactacggaacagtaaaaaagaaacgggctagaaccaatatttatagtgattttgccgttcaagtgtgcacccacgaggtactgtttgagacgattagcacccatattcatacataatgccggttggtaatagaaaacgacacctataaactatcagcatgtttacatgtttaccgtccaccaagttgtactgcccggtactggaattggtcggtaccaaaactcatccgaccgttcaatcccggatgggtaggatcgggagagaaaatgagcagggatgcgctcaatcagggcggcagagttaaagtcgtcgttcccagcgctggtgggcggagaaggaggatttcttccctgcgccgaggggccgagaaggagtccttcccggcgccgacgggcggagaaggaggattctttcccggcgccgagggggcgaggaggaggagtccttcccggcggtgaggggcggacgaagcggagttcttcacggcgcagcgtggacgaggttgacacactcttggcggcagtggtgttggtgggaaccatatcaccctatctgcccgactcacatccatctattgcacataattatatttttgcccttccaccttagttcttaggtcggtactgtaccagggacagaattggtatcaaactctaccagccgttggatcgggccagatccaacgactaggaatttggtaccgcccggtacaagtaccggccattggacggtaaaaaacaaataaactatacttcacgcaaattataggtgccggttatttcacccaactagcatcttggtgtgggtccactggttatcacgacgaagtaattgttgatggccctcacttaaaaacaggcacctatatgttgatataggtttcaattgtgtaatcggtactgatgactattattatcggtgctgcctaacggatgccagttaaaacttttgatatttatgttgggttcctaactagtactccatccatttcacaatataagtcattctagcatttttcacattcatattgatgttaatgaatctagatatatacatcaatatgaatgtagaaaatgatgtttaaatttattaatatcaatataaatgtggaaaatgttagaatgacttacattatgaaacgtatgaaacgtatgaagtacctattaggatttctattataaagtcaaaccagcatgatcttgccggagtttgcaggtcttggtcgtggccaatcccgcgaacaccaacgcgctcgtcctgaaggagttcgccccggcaatcccggccaagaacatcacctgcctcaccaggctcgaccacaaccgcgccctcggccaggtcgccgagaagctgaacgtgcacgtcggcgacgtcaagaacgccatcatatggggcaaccactcctccacgcagttccccgacgccagccacgccaccgtctcgaccgaccgcggcgagaggcccgtcagggagctcatcgccgacgagatatggtacggaactcgtcaagtaaaaatgcatgtgtggtaacgagttctgatagtggctccaccaccatgtgtcgacaggctgagggaggagttcgtcaccgacgtgcagcagcgaggcgcggcggtgatcaaggcgcggaagcagtcgagctcgctgtccgccgccagcgcggcatgcgaccacatgagagactggatccttggaaccccaaaggtccatatcccctcccctgcataccttcctccgaattccgatcgatcacatctaataattccagcatttgctcgtcctctcctcatcagggtacgtgggtgtccatgggcgtttactctgacggcagctatggcgtccccgagggcgtcttcttctcgtttccggtgacctgcgagaagggggagtggtctgtcgtgcagggtgagctcatggaatccttgtgattcagatacattgcaggatgagatcagcctaagaatgttcgctttgttcgcactccaggtcttgagattgacgactttgcacgctccaagatggaaacctcggcgaccgagctcaaggaagagaagtccattgcttatgagtttctctgatctgaactgcaaccgaggtccgaagcagagcttcggttaatgtttactaaaaagaaatcgttgcaagggtttcgtcagtgatgtttctcattgtcacgcagtagatgatcccgatgatccatgggtggtgttgttagctggtgatgctatcacggtgcatctcatgatttcatcagcatttgttatgttgtgtatcgatgttgcatacttacatctgtgagtcgaaatttcccccatctgtgttgtatacccagccaacaaggaatgcacttgttgtcatctaccccagtggctgatatttaagaaaataaaaatcaattgactggtgaatagcaatcccatgaaatttatgtttgatgacgatttgattagatttgctgagtcattgattagtactgcacagccatgcaacaaagacgttacattcatattgcttcaaaagaaccagactggctcgttaaaaggaaataaattacacgtaatcaccgcaattttcaatttccaagtttctggtacaatggcatttcccttcagcaaataagttcgttgctgtgaggttctaccagacagaagatgggacgattgaagcacacatccaaataattgatcgtgtataccgtacaatttacagggatagcatatcgagctaatgactacaattatcgtggcagattctttaccacagttttaacaattagtggaaccaaactgaagctgcaaatcagcagtttgtctgtcatcgctgcacactaaccagttctgctgggtctgaaccaccagactaccagagtgccatgagttaaagccggtaagagtatttatccaccacgtctgcttctgtctgattgggtttacatccctgttttctttgcttaacaaacatgtattttccccagtgcagcaagggacgtgctcaatcacccagcattctccgttctcaagttgtctgcctcactacactagagctcacaagttttcagctcgcgctgtgactgatctattgactggtattctttggcagatgcaagatgatggaaattcattgaaatcatctcttcctggtctgatatcatccggttctcccattagtcccctctgcactttctttaccttctgtgaaaatatatcccatcccatctgtttccgtctcttaaatagtaagttgagttttttagcatttgggcgaatggttctcttgtggcccatgtatcgcctacaagtagacagagatgaatgaccattagatgaaacaaaaccaccaacgatagacacatacgaaaaatacatgaaaaagggtcacacgtagcactagggagaaaaatagtataatcaggtggattgcatcatacctgaaggcttatctgtttacattcaactatactttacatttagaacatttagcaaatccattagaagatagatgcataccttcgtccagctaaaaccttggccatgtttccattattgtttgtaacaaaaacatcactcccgtcacatacgatgaaatcaattgcagccaatcttgaagagaacggaaggaacggtttcaaatcattcccagcaagcatttctttggtgtagtagtttggaaagagatccctcagaggctggagagtttcttctcccccatatatttctccagaagcaacatacaggtacgtgtcattgctaaaaccaagagctcggagcatcaaaccaatttcttgaggagtcagtggacatttgcccctactgcgctcatcctcagcgctcaactcctgctaggaatcagtctaaatcatttcatcattcaaatattgatccatcggtactaattgatcaaaagaatacatggacactcagaactaacagcagccattatcactcaatagtttttaagggaaatctgacccaacacatccttatcagtgcaaaagaaataatccacaaaaaggaagtgcaataccgacaaaaatatatccagatcctaagctcaccaagtttcagagtcttacaggtagtgtatcccatcttttcctaatttcacctaactccctccgttctttatcaccaccaccatagtaacaaccagaaaatgcaagcatgtcaggctcaaacctgaggagtcaagcaaaagtaaagaggttattcaaaacactccatatgagtactttcaggggaaaaaaactcagtagtaccattttcaaagaaactaaatcaaaagaaacaagtaaaagcatacctcaagtgaacggcaacgtatcgtgagctcatgctcctcagcttgcgcaccaatttctcacctagagtttgtatggaatttgtaaatcttaatgcatggaaatttactcggcagcgtaacttctgcaattcttcatcaagctcgttagtgagccgataatcaaactttgttagctgcaaagcctgcaaaattaaactgttaagtgcataggcaaacctctttgcttttacatatcacgagcattccacatacgtgtctaatgatttcatatagatgtttccaattattgcatctcctaaactcatactccctctgtcccaataaaagtgcaacctagtatagatgtgacatatcctaggactacgaatctagacatcatagtcctaggatatttcacatctgcactaggttgtacttatattgggatggagggagtgttgaaaacagaaaatcaggaggtaacttcataattgacatatgaagctaccaaactatccatacctcacaaacaattgattcttccaatgttcaagtaaaaaaaaaattcaaatgttcttccaagatgcacaatatgattaaaatgtgtcgaggaaacaatcacaagcagatgataaattgatcaatatgaagcaatgtattacttactcgccttcgcataaggataggcaaaacttcatcaatgtaaaaatcaggcatggatttcctaggcgcacgcatggtccatgggagtttatccattgacatcatcacctcataagggattcttttgacaatagttacatcctttgataggtaagagatgaaccagtccacgtcaaaaatgtcagagaagtcgctgcatatagcacgtaccatatcagggtaagtccatcgtgcaagggggttgatgaacttcagaagttgtcctactccctctgtttcatattacaagactttctagcattgcccacattcatatagatgtcaatgaatctaaacacatatatgtctagattcattgacatatatgtgaatgtgggcaatgctagaaagtcttataatatgaaatggaggaagtataattttaaggtctcaacttacctatcatccttccagaatgagtggtgatctaactcaggtacaacaagtgtggcattcaatattcgggcgacaacaacagcatctgttatctggaaactgaagatcgtaatggtaatacaatggataatacaaagcaacgcaataaaaagttgaaatacagttgtacccctatgcgctgctgatttagtcccccgctagtaccaatcagcaagtaaccagtagaactgttctccggcacagcagctgaaagatgaacatatggaatcactgtgttaaatattcttccactcatctagttataattgtccaaaagggaggatgatttaataagcaaactaacatctgaaatttacgctcctcctgctgcatccatagtacaagttggaatacctcgatttccaaatatttatgggctcgttatttctaacctgcacattgccaacgttgtaaggaagcattgaccaagaactgagacaaataacatgctgataatgacaggacaacagtaaacaataatttaaggacttatcaggcaggtgctcacgtagtgactcgtaaaacctctgactacccacaacttgcatactatttccaggtaaaccgtatgcaacaactatatatatatcccaaaaattaaacttttttccgttcagtagctttcagttagtttccaacgatgctgtggtataggcgtgcccaccccagaaaacagacaaactacgtccatttactcctattgcactcgaatatcacgtgaattctaagtggtgccgataaatcccgtcaaattatacagtacagaccttctaggttgtcagaaaattacctgcttggatcgccaccggctccggatccgggaccagtcggcgtccgtaacgatgtgtcccgtgaagagggacacaaaccctaggacgaacagcgccgttcccaggaaaaccggcgacggctgcgtcctcctcgctgccctcggcgaggcgccgccaccgtagtgtggcttcgacggatcaggcttcctccccatccccccaacccctctcccctaaatcccgtgcccctcgactgcctctgtacggaggcccgccttcctccgcgctccgtcgacgccgggggtgcgagagccaccgcgccgcgctagatcgcggaggcacgggagctcgcggatggtgcggccatggcgagaggacgaggcggccggtggtgttaacggggacgggaggaccagcgataaggtccatgtgctttttgggccctttccattccgtttcgtgtgacggcccaagtgtattctacatgggcctaattcaatccacaccgaaaacgttaggctagaacgcgagctgggccgttcgctttgagcactccgcagacggcaaaccgcgcttagtcgctgttgcagcattggcccatcacggcagacaggtagaatatgcagagggctctggttcactttgctgttaaaatcaacattatcgaattttagcaataccaacatttctcaagttttggtattattaaattgtggtagcgtaggatgtgcgttagtttgatacctttctaattttttgatagtttttttgtgagagggaattccaaaactaccaaattttggtaggatgaagttggtgatatcatgtttagtttttttttaaggaaaggaagaatatttgtcttatatattataatagagatggtgaataaaagcttaaaatgaaacaatgtagtgggcatgcccgcatgggaaagggaaccatgcccataaaagacttttctatatagtgtcttccaagccatcgaactcttttctatgtagtgtctttcaattttactgcccttgctttactaggctcatgcttcctcttttatatttgtgattagagtttgaggggtccatgcaatcttcctgaagattcttgcgttgcgtttagtttattgtcttatcaaaatttgatacggtcaaaatgacaataatacggacaagcctatatttagacgctaggaaaccaagcaaaagtgagaggatttgcattagatggtgtaaagcgtctttaggagggcgctacgatcgtacgatatgcttgcatgggaggaggtatccactttattatacgctacgatctcatcctgttggacacttctacaccacgcctcttgtcctactcccactagtaactgcacaacgtgttactacacgtcacgaaggctgatctgccatctgaaaaagcgatgcatacgcatgcagtgcacagcacagctgttccgatcatcgtctgggcacacatacatctgccaccctaacagcaggcaccggaggcagctagcagccgcttgcaacttgcaacgaatccacccaacttgcaacggagttcttgcagcctgcattgctgcacatgcgtaaaagtaaagagaacatctaggggtagtaaaacgtatagtacagtactgtaaaatgaagaaaggaaacagaacactggtgtcagcggcagtagtacagtgcgcgggcgcgagtaaccaaggacgtgaggtgaggcagccaaaggcagcagcaccgtcgcagggaatggcgcaggaagcggccaaaataggcgtacccgtacgtgctgcaccgtatcctccccaacgcccagcacggggatgttatttcccccaaagcacagacataccccccattccccagccaataggcactgggccgccctgtagctgacactgacaactggaccaccgccgtactgggccccacccccgcccgtcgcgctgcatgcatgtacacacccacgacctgcctcgcaggcttttttttttcactgcccaccaggtacgtaccccatgtcccatgtactccaccgcgtagctctgtggatgcctctatgacatgtggggccatggatagaatgggcccgtcgacaggtgggctgctgcgcggttgtcaactggtgcgttggctgggagaatctatcgtgccgtccggttccggatatgggtgggatctttgcgcaagtggctcccgtgatccgtacggacgcggggcacggctcgccgacaggtggggctcgtccggtggcaccagaggtgttggcccggcgtgtcagtgtcgggggaggcgcgcgctattggttggttggttgacgcgcggtgcgcggatgagcgtattgtcacacagcgcgcggcgtttaatgccgtggcagtcatgtcacggcgcagcagcagcggcagaggcagcggcagcgggcgagggggggcccgccttcgattgaacctgtcaatgacacagctccatgtggcggtggccccacatgtcacgagccacgctcgtgaccccaccacacaccccaatcctgacgggagatcccacatgtcagtacggcgcgtgcttcctcgccagtaggctgctcctccccgggggtgcgcttcgcttcacaaaccctcgctgcctggctgcttcgctttatatggaacgccagtgcggcaaacctactcgctgtacttacaaccgccgccgcagcctttttcccaatcggcgctagttttcgatccgccgccgtcggccggagcgaagccaagcccgcgcgaccaggtggctgctgctgtgtaacgacgctagctagcttagctgcggtacgtttacacataggtccgtccgtgtgcggctgccaccatggaaggaaacggctgcggcggaagcggggcgacaccacgtggtgtcgttgggatgcactgggctcccgtcgtcacctcgccgcctagcccgcagccgccgttcctcccgccggcgccatgcaggcccgacgtccagatgcaacagcaaggcgggctgacctgcctcaagctcgggaagcggccgtgcttctggggtggcgacggcgccggccaggtggcgcaggggaacggcggcgtcgtagccggaggcggtggtggttccgcggatcaggggaagaggaaggagaaggcggcgacggcggtgccggtggtgccccgttgccaggtggaggggtgcgacattacgctccagggagtcaaggagtaccaccggcggcacaaggtgtgcgaggtgcacgccaaggccccgagggtcgtcgtgcacggcaccgagcagcgcttctgccagcaatgcagccggtgcgtcaatcaccacgatctacgtcacatgtctagctctgctacacgcgtgctcatagcggtctttcacttgtacgcgcaggttccacgtgctcgcggagtttgacgacgccaagaagagctgccggcggcggctggccgggcacaacgagaggcggcggaggagcaacgccagcgaggccatggccaggggctctgcgcacccacacggtatacacaaaacaaactcctcccgtcccggccgtaacagttccattaatcatcatactactagtacgtgtagtacgtacgtactactcccagtaatagttagggagaccaatggagaggcaggttagctgcacaaacaggagcgtaccactcccagtagtaggagtactggttggtttgatgccgggaaacaaggggagagctgcaggtgcgcaccaaaaagctcatcgggatgtgtgagacgctgagagcacagattttaatgcacgactttatgtgcactgcgctgcctgcctggccggcccagccagcctgcttgcttggagtggcagtggctgcgtggccactggccaggccgaccgtgcatatgatcaccatggcatcaacaggaacccgcgcgccgggtggtcgctgcgcacgcaacacggcaaacagtggtttcatccatccatcttccactccttatcaagagcctgtatgcttacggaaatctatactactacgtactagtactactactccagtacgcatgtacatacatacgcgtacaactgtacagttaattacgaatagttactgtacgaaggtatagtgctatagcgggactggccgaaagacttggacatacggcggtcgaatttcatagcggcattctaggatattcaagcgtgtattgattgatattgatatgctttcatgagtatagttgtactactgaccttcaaaggtaagcacggctctgcagttcagaaaccttgtatatatgtatactccttttgtcccataaaaaaacaatatagtgtcagatatgacttattctaatactacgaattttgatatacatctgtccagattcatagatttatttttataggaaggagggagtactccttttagtctaccactacctttctcttgttctgagaaactattactcctgcagtagaaaatacagtacatggtactcctgctgcactgacatagatcctgtagatgaacatgccttatattctgtgataacttatgtactccagtatttatgtggactttgatttggagtaggtccttctggctgtcttacagagaaatattatggaatgcaagatttaagttagttgcctcaaacaataaagacattaacaatcgtaaccaccacaaactttcgtgtcaacataatcaacaacagcataatgggcctatcttggttaacaataacattagtacgtattaccatggacctaaacttgacatcaaggtcgagtgcacgtttttactatgctagtgacccaaagcccatcagcattattgaccacttgaaacctgttatttgatcaacacatagacatgatgttgtggaagatcaggtagcgatcagtttgtgtaaagatatatagtatagtatcaattagttgtacccggtgaacatgcatggttggttggttttaaactttgtaaatttggttgcaaatgatcagggcaagcatgcaaaaatgattgcggttgagtaaccacttcgttattaggactgatggtgtgcattatgctttcttgatatgactataacagatggccacatttctgtaggcacaatgatatgcataataacgtgtcgacgttgttgttgcaggtatgccggtgctgggacacggtttcccgccgtacggcctgccgacgtcgtcggctggtgctctctctcttctgtcatcggctagagccaccggcccatggctgatgccgacgcccgacatctccgcccgctcaagcgcggcgctcgacgagctcatcgccgagaaccgcgcggccctcctctcgtggcaattcttctccgaccgacagccgccaccagctggccgtccaacgggccgcagcccgggctccgaaacggccggtggctggcacgcgcacctgcaggcgcggccgccaccgcccggcgccggagggcagcacgagaatcagtcggggcacgtgacgctcgacctcatgcaggccaccaccgcggcaggaggcagcggcgcgccgttccggcccgtgccagcgaggccccccaaggagggcggcgacgccggctgcacctccgacgcgtggacgccgtcgcccatggagggcgcccgcgtggtctgagtgtccgacctgccagccgcgacgtcgccgcgcgtgcaccacggtccctagctcccgtgtcagctgggcgtgggaagcgatcgatcagtggtgggcgcgcgcgcacggctggagctctgtcccgacgccgcgcgcagccgtgcaatcaacttgagttcgttggacaatagtgtctcgtctcgtagcaatctatcccgatgtagcagtactggtgcagtggtggtggtggtgccactagctagcaatgttctattttttcgctctgcttttctgatggattagaggccaattgggtggacattatttggtggtcacgggcgtgtttctgccatgatgtcgtggggggagcgacgaaatgctgtcgttctctgttctcctcttgaggggaattccaacccaagctgcagaccccaaagccctccgcatgatcacagttcgacgtgtgaattgtgaccgatgctacctccggcgccagacactaaaactacatggcgcttctcccgtgatagtcacgtatttgttcggttttcttcagtgacaaaacgtgtattgtgacagatactaaaactatggatgtgataatgcgatcttatcaggtcgtcgcattgggttctagaagacagagacgcggtcactgtgcgatagtgcctactagagcgaatcccccagatcctctcgatcggcggcaatgtcaggcggggtttgttggatgtcatgtcggactacaaagtcactgattagtaaaaccaaacagtgacagtacgtttggttactgttctcttgtccctaacattttgggtgtgtttagttgggaaaaaggaaatttttgggtgtcacatcgaacgtttaaccggatgttggaaggggttttcggacacgaatgaaaaaactaatttcagaactcgcctggaaaccgcgagacgaatcttttgagactaattaagccgtcattagcacatgtgggttactgtagcacttatggctaatcacggactaattaggcttaaaagattcgtctcgcgatttcctccataactgtgcaattagtgtttctttttatctatatttaatgtttcatgcatgtgtctaaagattcgatgtgatgtttttgggaaaaatttttgaggaactaaacgggcccaaagttggttccgaataatttgtgctacccacatcggccattgctttgatgattaacagctcgcgcacggcgcaccggctgatattttcaggaacctaagaccaacacatctttgtcttagatcgatgctcctggcctagctatttgtaccagtgaccctaagaccggctacacttggcacagatcagcaggttcgtcagccctccggaatacaacagtatgttctgtcaactgtcaccacattagatggctcttcaaattaaattttagccaacacagtgaaaaaactctcttccaaacgagttcctcgggtggccaaatgtggccaggctcctctatttaccaaacgaagggtcgcattatcagtcccaccttcaatccgtttctccgtctcctctcttctctgccaacgcccaccctcgcgctgatgcatcgctgtaaaggaagaaggccaatcgtcaatgtctcctttaacctcctcatccctaagcttgactcctcactcggcaatcacctccccacgccaccgacaactcccaccacaagggccgcgtggaggcagtggcctggcttggcctggcctgcacgcgacggtgaagggtgtcagagtggcagaagcgggagccgggagctcggaagggaggtgaccaacaaaggatgagaggatcaccatagcccgtcgttgccaccgttttccccaacctccgccgcattgccattgtctgcatctccattgctggtgcgtgcgtcaccgccccttcttgctcttccctgtgtcgattcccactgctggcggcagcagtaacaccatgacgccttatctcccctcacctgccccgcccttatccctgcttccccttgttggccacctcgtcgttgtcgccccctactgtcgtcgggtggagagggaagatggttgggatgggaaagatagaagaagggaggaagaagtaaagagagggtgacatgtgatacccattgttggattgagagtgaaatgaaaaggttattggaatgaaagataaatttggcaagctggccagatggatatttggagaggtgatagagatgctccaactattgcatgttttgcacatactctctaaaattagcttgagatatgtgcattgatgtgatattaacataactatgttaaattgcaagataagaattattcatgcatgttataattgaacacccaattaaataaccaccatatgatgtgtacgcacacacacacaccatcggtttttcattcattaaaagtgcaactgaaaaagggcattaaagtatggttttgagcctgcatacatctataataacattataatggcaaacatgcaacaaatcccccctgacttttccagaaacaaaaaacaaaccctccccccccggctgatcaataattagtataggaggcaacctagctagttccaactttgctcccgtagctcaaaccaagcatccatgctgggctatatattcgcaatttattaggagtatacaacattttgccctcatataagaaaaaaattaattagcacgtacagacgtttattttgacaatgtttaatttgtatgcaagtcccaaatacaaatgacattgtaatatgatatctcttaaattagggtgctttttcgagagttcatgtgtagatatcattactggagaaaccatctttgcccggtcgaccaaaattcacaatactcccggtctaagtaagaaacaggactaaagaataactttagtcccggttcaaaaagccagggtacattttgatctttagtcccagttctacaaatcgtcaggccggcgtcatgcttacattatctttagtcccggttggtaaagatcaatatttagtcccggttgtttataccaaccgggacaaaataaaaatccggatcagcctctccgcatcgttctccccgccccgttactatataacaaacacttagaaaaatctctcttagctggctcctcagctctccctctctctcagcggcgcggtgacggcggcggcggcctcccctccaccggatccgggaggggcggcggcggtggcggcctcccctccgccggatctgggaggggaggtggcggagcgagctagccggcgggcggcgagccaagcaaccggggaagtggcggggcggcagcagcggcctcccctccgccggatccgggaggggaggcggcggctgcggtggcgctggggcgatgcgagggtggcggcggcctcccctccgtcggatccgggaggggaggtggctgggcggtggctgaaggcgggaggccggcggcgacctgtggagcattttttattttttttaattgatgtgtaggtttttatttttgttgatttggggatgattttgtgatgatttgtggattgtggatggacagtgaattgatgtgtagatttttttttgatttggggatgattttgtgatgatttgtggattgtggatgggcatgtattgtgtatgatttgtaaatgatttttgtggatgatttatgtgtgtgattttgtgtatgatttgtgtgatttttgtgcgattgtgcacgagatgcaaacaacaaaacaacagtggaaacagaaaaaaaatcccttagtcctaccaaccgggactaacaatgatttttagtccggtttattttaaccgggactaaagatggatatctttattcccggatctctagtttcggttgcataaccggaacaatagaggattacaatccgagagtacaaagcatttctccggcagtgtatgatacgaagtcatggaaggttgatgctatctagtatcatttctgacacaatgtcctaccatattattgtgactaatggcattctcatgctactccacaacgttatttgaatggatgactagccatttgtgtttgccttaccaactgtttacaaagcaaccaatatgtgccatttggccaccacaacctatcacattcaaagtggtgaacgggcatgcatagagatgggtattggcatgctatttgttctatcatgcatgctgtgcatactggcatatcatcgaccccacaagaacaagcacaacatggacttgattaattagcttgccaaaacgcttaaaaaaaatctccaacgggcaatgaatgaacacgtagtacatgaatgtgagcatggcactcgatcgaagttatcagggacagggacacatcgttccccatgctttgacactatgaaagatatggtacatggcatagtgcaggggagcactatccaaacgatagattcaagtatctacaaatgcaaatatcttccgtccacgtcgttgggcccggcgtagctgcgattcttatctgctcaaactaatataagggagcaagctaggatagctctagcaagtgcttcaaaaaatcgatccttcctattaactgcttagaaacaaattaataattaaagctcattgtctttggctctctccggccgacacatgtagtaatcactagttcactacacattgtacacttgggatccattcctgatctcttttataaaaaaaaactaattaattgctaggtttgcgtacatacacacataatatattaaaattatttgacacgatcacacattttaaatatgacttttaattattcatcttattaaggtattatatgagctctatttattttgttgtaacttgtttttttacgaagtattttaagcatgacttcacattttatttgcactaaattttaatgaaatggatggttaaacgccattacaaaagtaatcaacaacacattttgagaaaaaaacaaacgtacggagtactaagggcttatttggtttggagcaattttatcggaattttaaaagaatgaagtgtaccctataaaaatcctatgaaattcatgtattttgaatgagccataagtaaattgtcatggcagctagctaaaataattaatgtaatcccggccactcaccacccagtagaattgaaatcacggatggatggagaaatctatagaaacaaaacaaacatgtattgtaagataggtctctatccgagaaacgtctagggtgtttgggcagctccacaggatagtgggctagatgacctaggctcgaagcctaacattttctaattatttgatattaggtcattccctaatatttacatctttagataggtctctatcccaactgcataaaaatacacggtctcttaattaattaggattattttcctttagaaactgcgttcgtagagattagcaattgcgcatccaccagctgcgacagccacaacgagttgttttctagtagtaataagatactaagatatccactgcaccaccattaacacgggaaacaatttttaggttgagtttgtttggacagttagactaggattttttactacaagcatactccatccatccaaaataagcatgcttttagcctctttcatttttacaaaaaaataactttatttccatcttctcacctattccaagtccacaaaacaatgagttcgattcctttaatatcccacaccaaccctcccataaatactacttttgtattaatgtacgacactttagtcgttttccaactagttttgagcatccaagatcaacatgcaaaaagaaaaaaaacatgattgagtttttctttcataactatatagatgacataggagaaacaaggggatatcctcttaagagtccagaatacaatccccactgacgccaattactaagcgcacttgaactccatcgacccgcgtcagcaagatgatggattcgttgcctgggcgcctgcttgttgtagacctagcatagcttccagtcaattccagtgatgctaccggtttgctgctgaagaatagctattccctctatttttgaataattgatagttttgatcaaaccatttgtttcaaaattgttttcaccaccacacttttattactaaaatcccaattttgcccctactatcctatacctctatttttgaataattgatagttttgatcaaaccatttgtttcaaaatagttgtcaccaccacacttttattactaaaatcccaattttgcccctactatcctatatctacacttttgggcctaaataaatcttccaccatagagtaagcatctagatagttgtcttttccctcaattcctttccctacctcaactttattcatttttagcgtcatcttctaacaattgccaagggcaaattggccataaattttgttgtcttgttttatatgctatggtcaaaatgtcaattattcaataatggagagagtaatagaagacaacaaacatctaggtttgggctacaagatccaaaaaacgcactccgcatccactgctacttaggtacactggactatctttccatcgatgtccgcccacggatgataaaggaggcctgacaaactcccacgaccgaggatttcaacacacccccaacaaaagggatgccgcccatggctagctgagactatgagggtcgggttggagattgacaacgattagtagctaggtttcacccatgtgccacccgtgtaggcgatacctacgagtggaatgtctggctagagtccttgtctagttttattgtatgacaacgtatacaagatggatatgattagctacttacactactacagaacaacttattcgtacagtccttttactattggatgaagaaaacctggcactgataaggagtttcgcatccacccacccaatctgtgcccaatatagctaagaaccgacatagataagtagtctacttatgagtgtcattttctattataaatcgtcactgatgattagtcattactcattagtgtggggtctttaagtaaaactggtacttgagccaaccgagctaatggttttttactcgagttgatatctcccttatctcctgcacatccactctctctctctctctaccttatcttctacatatacatccccacaaccacactctcttccctcttggtgtctccattctctctcgatctccacaatcataggagcagcagccttagcctcggcaagcagtgagagctgtggcgtccttgaccttcagcgagaaacaacggcttcgccgaccttggcatgctatccatttgagaactcgagcaatttcttttgttgggacatggatgatgcatgttaggatctgtgattcacatatttttctttttttttatttttcttcttagttggggttccttaacttaagttgacggtggaacccctttgaacaccccgcctaaatgggaaggaagctctagaaaaggagctcacagttcctcaataatagactcgcacctgggagaaggggatcaaatatataaggttgaatgaatggaaaaaaaaaagaagaataagtttgaacccgagtgagtatggaccatacgctcatctttcgtctcaatctacacctcgttccgcgagagccctatcctcgtttcgaaataaaggaccgtagtgaggatcgatcccggataagtgagtcagtgtagggacagaggctaatgattctaaaggtgatttaaaactagaagatgactttatttgaaaacgaaatccaaatatcaacaaaaagatggatgcacaatcttctatttttttttctaattttcttatttgttaggatctgtgtttcacaattttgttgattcatgcatcaatctgtctaaattgatttttttttcaattgctgatctgggcatcgatacatgatatgtgatttggaccgcgtcatctcaattcaagctggctcaacctttttttagctcgtcaatcccattagtgcctattctctacatcgacaatgaggtcgagaggccatcattgcatcgattgttgtgctggttgggaacccagaatagacgagggttcacaaccggcacaatagaccccttttatttgtagtgtttagctgcttgcagtatgtttacaatctttaaagctatacttgcaactacaatcttatataatactctctcaattccaatttgattatcaccaaagcaaagagcatcgagtccaaagacaataaaacctcgatggctctaaaattaattatcactaatcaatgtgttccatcgctttgtgtcccacagcttgcatcacactataaatgttgcatggagttgaaccaatagaaattaatcttaactagttacatgcataccaacacattcagtgatgtccatttactcttttcacaaataaatgaagaggcacttattatataggagtacgatcattttagggataactcaaaaatcatatgtgatgatcaaattggaatgaaaagagtagtccttttagtactcctctagaactctagagataaatctggacatatttttgggacggaggaagtagatgctatgagctagctagcaaacagtgtcaaaagaaataattaaacttcggttatgattaaggaacaacgcttgtttggtagtagtacgtgcaagataggtagctagctaggctagggagaagaaagataactccacatacagtgtagaagacgagggagaaagaaacctagctacgatcccgcgatgtctggtctgtttagctacatgacacctaaaaaggaccagatggtgtacatatgcacaagagtagggtcagctgcaccgctggtactgtgggcgagctagagctagctaccacacacagctaatttggtcctgccgtcatctactattaattccacttaactaaacttcccctcataattaaagttttgtcttatggctacagttcatcccagtagagatctgaatcaatatatagagtactagctaggaattaaataatcgccaagtgatcaggtacggcaagactgactaaaatatttgaataacggacagtgctgtatcaacaggctcattgatcagagattcagagtatttaggagtatcaacgaaaggacaaatgggagaacatgatcagtgatggcattctggagcagcaatgttgctgatactgggctgttgtgcgcatgcagtttgttgctataggtagcagaaggatttgcattgccatccaatcgaggcaaaagcaggggctaaatggatcttggccacaagctagctactcgtagagaggaggccgtgcagagcttgaggtttgtgtaggagcatgtctttgtcggccactttgggtctttgggtacgattcgttgacccctacatcgacatggctcggcttggcagcatgcaacgtgcgtgatggccagttgctcctcagttccccggccccaaaactacatgaagtataaagataaagaaaatgcatgcatgcatcctgttgtttctaacaagttcaggagaaattaatagctcatctgaaatattccaccacacacaaggtgtgatcaaaagatgtagggattacctacatgcatgcatgtgatatgagctactagcaaatcgctgttagaaagaacccgggaagataacaagagatatatatgcagtaaattatccaagatactagaaaagcatgcaagcataacgcaagagaaacacaagccaagagtgcaacatttcaggtaacaggcccccttaaaagaccctaacacacacaactagatacaatatggagtacgcacgtagtatatgcacatcgatcatcaaactagcggctagctaacgagtctatatagcctaagcgatgacgactagtactgggtgacggcatgggtgacctaaacaaacaaactaacacaagacgtccttgagcagcttgtaccttcggccggccgccttggtcccccgccgcccgctctcctgctcgccggcgccgggcttgccgccgccaccccttccggcggaggagctcgacgtcgtcgtggatgactcctggcttccggcgccctgctgcttcccggccgccgacgagtacctcgccttcccggcgacgtcgctcaggcaccagtcgcacatgtcggcgccggccggggcgggcgccgcgtcaccgtagtagttcgtgcagtatctgcacgcgcgccacaagtctatcagacatgcatggatacacagacaccgcacagacacacgcacacacaccccgtgttcgctgctagctctagatagagaagagattacagtggtagagagtacaccggccgggtcgcgcgttacgtacgagtgctggaagcggtagcggcagcgcgcgcactggaagagcttgtcggggaagccgacgtcgccgcacatggagcagacggtgccggcgccagccatggttgggagagctagcttagctagcttgatgaggaggtggggagaggaggagtggagatgcgggcggatgggaatggaggagatggaatcatggaaaggtagggactacgagtccggttattaaatagtatgagagagatatctggagagagaaaaggggggatgtgagtgtgtacgtgcgtgcatgcgaagagaggaagaaaaaaggtggaagggaaggagaggctcgcagtcgtcgcagggggagggggcacgcgacaaccttaaatccagtgaccagggagggagagtacacgtcgatctcaaagcagggattcgatcgctaaaatctctgggaagtttggtaatccgaatcaatcggcgcacgcgatcgaagaagctttaatttcaacttccggagacccgagaccaggagaggatcggaggacaaattaagcgcggcgagaaatcaatggaccggtgtgcgtgcgtgaaacttactggtataatcaacatgcatgggctactcgatctaattatgtttgcccgcctgtgcaggtctgtgtcagcggaaccgtgcacgccggccgtccacccccgcgcgcgtgtacgtgcgcaacgatgagtctcggctgagtcggttctcgatcgcgttacgctttcacgtaaggtcatcgagaaaaagacattccaaggagatcagaaaggtacgagtactcctagctcttagctaacataattaactactatatggagttaactcctagctctcgatcatatcttttcggtaaccacgattcgacgcagaatcatgcatacatatatctagagatcaagtattcaagtactaattaattcccctttgcctttttctgtgggcgcatatactaaggtatgggcatgtttagatctcttgataagttttttcacatatcacatcgaatgtttagacacatatataaaatattaaatatagaaaaaaaaactaattatacagattatgtgtaaattgtaatatgaatcttttaagcctaattactccatgatttaacaatatagcactatagtaaacacttactaatggcagattaattatgcttaataaattcatctcatagtttataggtggattctataatttctttgttattagagtgcgtttaatacttcaaatccaatattacacgataaaaatttttacccctaaatctaaacacagcgtgaacactatacagaaggcacgtagtatatgccgttcgcctgatctatccgctggtatgtactggctggttagctgtgtgcgccggctgtgagcgacgtgcgacggtgtatcgtaattaaattcgtaatactactactaccaggtagctccaggtttacgctcagagaatcagctgatggaggttcggggttttcctgcgcagccccggccggccgcgcgcgtcgctttgctctggaaagctcgttagcgcagctcgagctcatcacatgcacgccacgcgaacgccacgaggtgtacgatgcatggatgcagcctgcactgcacggccggcgatgcacctgtaacgcacctgtagctatagagagggtgaattggcgacccacgcgcgcggcctaactaccagtactactccactgacagggctaacttctagggcagtgtagatcgtggtcggccagccagacgattggcctgatggcctcagcaacgccgtttgctacaaggtaggagtactccattagctttactccctcagtcccaaacatttttaacttttaatatcaaaaatattaaaggtcccttcgaatcatgagaataaaaaaacgaagaaatagaaaacatatagaattctaacatgaatgtaaatataaaacagatgattgcaaaacacaggaaaaacacatgcatgaatcatcgtttgattggaccatataaaaaacacaagaatcggatgagatagactcaaaggattcttaccaagaggttggacctcttgctaagttttctccaaaaactatatgaaataagccattccatagaaattttgtacgttttagaaaactttaatcctttgaatcaaaggttacataggaaaattttctatagggtttcaattctatgaaattccttcataattcatttgattgaaaggggccctaaaaagatcaatcagataaaattgatgttactagtaggtttatcattgaacaaactatcatactccctccatccacaaaagttacacatattacttttgacaccaagaccaaggagaaattaaatcaccttggatgttacaaaatcaagaagtgaatgtaagtatgcaactaatgagtatttagatgactcattgggttctaataaagcattttatttatatcttcatttaagtcttgaatgcataaagactacaaatagaaacaacttatttggaaaaactcaaatatgaaataggtgtaagtttatggatagagggagtaatatgcaacttattaatggcaaagtttaatttaagataatgacataaaaacctaatatttatttacttattaaaagagtatatgtatcctttttttatggtagttcaacgtgttttttcatgtcctatataatatataggaatgttttccaaaactatgtttatcatttaaagaaaatggtacacatacttttttaatatttattaaaatttctatgtacaacaaacttacaaatattataatcacacaacaaatttctatacttgcaacaatatagtttacaaatttctacatattcctcacgtattgaagggtaaaactgactttttgatacttattaaacggtcaactgacaacaagggtatgaaagggatccaaatcaaaattcagaggtatacaagggagtgaagaaaattcaggaaaatagaagggatcggctaaaatttcaggggtatggaagaaattctcttatttcattgtgaaccaaagtaaataagaaggtagaagttaatttattttgggataaagtttaaattccataagttgatttattttgagacggatggagcagttacaaatttattttattttctaataagataaattagtgtgataaatcactccacaaatatgtaagattaaatttaatttctacatgttgtaataaaaaaacaaatttgactgaatatgcgttaattagctacaatctatttatttttacatatagaagttaaattgtaacatgtatggtaatgttacatatcaatacattttctttttaaaaaatatttaaataatgtgtaaataaacgaggtatatctcatgtactatgacaaaacaagtatgggcgagtcactgttatgttatacgtactctcttcgtccaaaaaagccaacatcgtactagattttttagacgagtcccatccaagtacgaggttggttttttttaaggatagagggagtaggtacttgccggcctgcgtgagtgcttacttaacgtactccctccatccaaaaaaaagacaaacccttgatttccgtacgtttgactgttcgtcttatatgaaacttttttataattagtatttccattgttgttagatgataaaacatgattaatactttatgcgtgacttgtctttttaattttttttataattttttcaaataagacgtatggtcaaacgttgtgcacggaaacctaggatttttctttttttggacagagggagtaggcataagccgtacgtacatgacattattgacgggtgtactattgatcgatcctcgtcttgaaccacgtcgacgtcctagacaggggaggatatcatggtcccgtgtgcctaaaaacggggagctactcctgtttcagattaattaggttcttagctactcttttatctaaaaaaccaatctagatgttcattgcactattaagttatgttatatcccttcaaatttgtttttttatggaaggagtagtagctagctaattagagatctccaacttctcgtacgatacttcagaattgaaacctgtttagcagataacctgataagaacatactctaaccggtttactcgtctcgatctaattaaagctggggccatccagcttacgagagccaccagccgtagcgtatcagagtatcaaaagtcctgttcactttgatgctattttcaaccttaacaagttttggtaaagttgctaaaaaagtggctacatttagtttgctgccaaattttaataactatataaaaaattctgtggcaactatgctaatatttggtaaggttttttttaacatcaaagtgaacagaccccctaagtcattgaaaaagagagcacattaagggcgattaatttggaggtgatccaaggcgtaattaggtggctacgtgcggtcatgattgtggcgatggaaaagcggggagatggtagcccaaagcgggatggacatgggcagggagaggggaagagagagagagcagcaggtgcagtgggtggctgctgcagggaaagctagtggctgtacgtgcgcaagtaccaggaccaccactgcggctgccgctggccagttcccacaataaacagcatagagaaaaggaaggaaagaaaaagggcggagagaccccgggccgggggcccgatcatatcatatcatcacggacctgactcagcgagcgtggcgacgatagatggatggccgctccgatccgatcctgccgctgctgctgccgctgccagtttggattttatttccctttcttggggggtacgacagccacgccggtcggccggcccccttgccgtgccacgccatgctcccccagtcgccgccgcggatggagacggatgcggatagatggatcattggagagacgcatttgcgtaggggtgcacagcatagcatgcagcagccgcacctatctgctactatttcctctatcctaaaatataaatatttttaagttagtacgggtattaaaaaattagggataatgattagagaaagtgtgcgattgattgaaaagaaaaggtagatgcaaaagaatggttgtgattgattgagaacgtagatgaagaaatagctttattttagaacaaagtattatgctaaaaatagctatattttgaaacggagtcagcagtacaatgtacttatctcgtggcaggataaatctgctcacgatccactgtcgtcgccgcagaggccgctgtctcaatcatcccctccctccggctggctcggtccgccgtgtcttggagctcttggtgctggactgctggctaccatccgggcggctgcaaaacgcaaagccgttccatctcattatgtacatctatccaatccacatacagtatactcctacgatagtagtagatttgcagtgccgaacggctgttgctttactgtactatactgacagaggataacgatatgccagtgtgctgtgtgcctttcgtctatcagagtatagagacagtgtaaacaaagtacggagtatgatactatgacgcgtgccttccgtctctagagtaactggatcattgaatttgcagcacggattataggatgacaccattcgctctgacgaacatatccgtattgcatgcaaaaaaaataaagaaaaagaaaagaaagaaaagctgtgaacacgttcctgaaaaacgagtaatgatcctcatctaaaaacagaaaaactaataatcctgctcacattcctaaagaactaatataaaaaagaaaaaatggttgctgctagcaatctactactccctcccctgtgtcgtcctcgcgtgggcggctcggggcgaaattctagccacccgtgccgccacatctccacccctcttccacctcgccgccgctggagcatgccgatggtaagctagcggcaagatgggaaggtggctgcgaggccaaagagctcggcgaaaaccacctcggcatgaggaggtggagtgaagccggtcttgttttggtgttgttggtcacgtttagtggggatcgttttggtgttaggctctaaactctcagtggtttatgcttgtgtggttagcgtgtggtgcttgggcatgcactttgttttttagcttttctctttaatatattcaaatggctaccttcggttttttttaaaaaaaagagaaactaataattctgctcccgttaaacatgcacaagctacaaatgttgttcaaatatcctcaatcttgaatatattgtggttgatttgtatggatgcatactttaatcatacttttccagatatgctcaagcattatagctccttttgcaactttaaaatgattaattgatgtcggcacaagcttttctttggaaacatcaactgactttgtccattgtatactagtttattcagaaatatatataaggataccagtaagatcaaaatactactccaccaaattaagtgtcacgcaaaggtttgtggccaccagcagatcatctatagaccagcagtgtgtacgatatactatcttcgttttatcctcagtatttctaagctgcaaaaggtatgtaaactaaccttggattgcttttaagactcgaagggtggaatcagtgcatcactgtccatgggacaccaaatcgcagatgaccacacatggcagggtcatggagcgtcctttttcacatggggagcctttgccttctatcctttgaagtggctccagtacttggtcagggagggcctgctattacaaaagaattgcttcattactaagttcaatccaccttaaccaaatatctcaaggtgaaggaaatggtatccaaacaaacaaaagcaaactaagaaaaataattctatgctggttcgtgatgagctgatgagttcacacgtagcgtacacaaactgcccaacatcacacaatgtagtctggcccagggccatggtccaacctgtcctcctaaagcctcaccatatgttgttcgactgcgactagaacctgcagtagtctagtacaaggaagcaattatcagactagacacttgaaacaagctgttgaaaggagaacttgctattcagttcaacagtaggaccaacgaaagcatttcaaaagtattttgcttcagtgcttctgttcaggcctggaatatcatggagaagtagtgatgttcaatcaatctatcacatagataccttttcacttacttttcttaaatgacagggagcattgacgatgcagcaaaaattaaaccaggtattgagcagaatttttcctagataaagaaacgagcaaacaaaaataaccaggaaaattcagacatggcaaattgaattctcttctcattgcactacaaatcctgccagcattccaagggggcagtagaaggatagagtccgatccctgcaaaaagttgatctgatcttcagtggtcaattgatagatggaatgaaacataacactgtatctgaaacccctagaattagaaatcatgggtaagtggttacagaaactgaatctaatgtttcatatcattaagcttgcgacactacaatgctacttttcccaaagcaaagttggatttgatctcattgactcctcatgagtataaaaggaaaaggaaccctgatacagataaagcaagaccatacatagtttactatcttaatcagatgatggcattcattgacctgatttgctgagaacttgcttcaatgtgaaaaactactacttaaagctggaagcaacaggcaaaacaatactaacaaaaggtactgaaacagtcaacaattccatcatggctcttgatatcgtgggccataacaatatgctgtcaagttcgctaacgtagttcaccgtaatgggcagcatctttttcatatgtccaaaagcacatcaaatacttggcaagtttgtgttctctcacataggggatacctaggtattatttaacctagacaattccttggaagaagaaccttgctgcacatgcattactaatcaaacttaccatctaattccgggagaacatagtattgtctaggaaaagaaatgtcatagcacgatggttaacactttgctgagaaagcacaaggctctgacaatctgcttcttatattcacaaggcacatcacaagactggctatgcattcaatcaactttgaattttaacaactatccattccatgaatatggagcgcgttcaacaactaaatagtcccctcgtatgtcctttgctacgcggatgtcatcatccaaatagacagtgtcaaacctgaaagtagaggcatatattatgtaaatgtcaaaagacctaacacatacaagccaaatttccaaatagatggtgtcaaaccagaaactgataaaacgaaacagaactgataaactgaacaaatgtcaaagacctaactggtaaaaatgtgtttccagtccagctttatttacattcactctctactgatcaggtgaagaaaacatatacaccatccctaaaaatggaggtgggaaaggaaagcccttgtagatgatgatttggtcatctagtaacaaaaatgaaaagtttgttagacttataaattgttgattatgcagcacagttccaaaaactatttctggtcatacatatttgacacttaggacaagattcggttaaacttttaaaactcggatgattaattttagattagaataaatttatgatatatatatttttgagtcaaatctaagtataccccttttttggcttttaaactaagcatttgaccaataatttatggtcaaaattttaaaagtttgaccaattcttatcttacctaaaataattatgactgcgagagtaatgtatttgatttaatgaaatggtttacgattacgtgaacacaatatcaatccatgaatgctagatacgatttcattccttgaaaattgttgcaaacaatgcacaatatctcgtgctatgcttccacatttttttctgtctcctttgtttttgctatttcattggaactcaacttgtaagattattcgagtgaagtgcatgatactaccaattgaagaatatcttccactcaccatcctttcccaaagggcggaaacgggacctcccaattgctccctctcaacatagcgcgtgtaaacctgcaacaagcaaacataaaataaaacaatcagcagttgctctaattaccacaagctgatgaaacaacagacgatgatgtcttctttttggaaagaacagatgattatgttaagcctaaacaaaaagctggaggaagcctgcctaaaattgactcgctggggcggctggatctcgatggagccgttcacgacgaacgcgccagagggcgggaaggtgatcacgttgttgagggcgccaccggggacgtcgattacctggaacacatcaccggcggcggtgcggaagaagggggcgttgcgcacgatgaagagctgctcatgctcggtggtccagaggagccgccacgtaccggaaagcttgtcggcatcggaaacggtatcggatccgggagcagcggcggcgagggcgtcgatgcaggagacgatgtcggcgaggcgggaggggtcggactgggtgtcgaggccgcggcgttggtcggcgatgaggcggaggagctcgtccttctctggcggagggcgggagcgccgtgaggggaagagggcgcggaggaagccgccggcggcagggggcgcgggggcgaggcggcggttgcccctcggaatcggcgcgagaattttcgcgtgggagactagtggcgccatgggcgaggatttggtttgggtggtggcggtgacggggggaaggggaggcgagctcgcgttgccttcgtgaggagtttgggccggtataatgggctgggctcatcaaggcccatcaagtccaaggtccatttcacaaccgcatcgaaccctaacccccgcggctcctccagcaaaaccccccattgcagacgccgacccccgcctcgaactctccagtgctgcctccacagttttcgcctcgccgccgccgccgtcgtcgtcgccatggcgatcaccgcccagacccccgacatcctcggcgagcgccagtccggccaggacgtccgcacgcaaaacggtaactcgtctctccccctcctgcaagcccttccccgccgccagattccgtggagtcgcggcgggtttttgtaagatctagtggcacgactcgccgtccggacgcggggatttgatttccttctctgattgcagtggtggcgtgccaggcggtggccaacatcgttaagtcctcgcttgggcccgtggggctcgacaaggtttgtaccttgcgatttgatctacttggttgcgcataaattgttactgtgtgtgaaggatgcgaacttgtaggtttcaaaattgtgtgatccgctacttagaatgacgtattttctcctttatgagctgctcattgtgatccagatgtagttcagtcgcttactgattcaacggtgtaatatgtgtgcggctaatgttgttatgtgctcgaaataactgtcagtatcactaaactttttatgaaatcatgaaattacaacagtatgtgcatcagtatcactaaacctaatcaggattaatgaagttagacttagatcagttctgcaccacaccaatccctgataattccaaaaggttggctggaatgagctaattgagcatatccttcttgtagatgcttgtggatgatattggtgatgttaccataacaaatgatggagcaaccattttgaggatgttggaagtcgagcatccagcagccaaggtgatgtcaggcagcttaaaggtgccatctcctttttcccctggttgttgttttgtgcttagttgttttttggtcctgttattgttaggttcttgttgagttggctgagcttcaagacagagaggtgggagatggaacgacatctgttgtgataatagccgcagaattgctaaaggtaatgaaatggagctttcgtgtcagtcttttcttccctatgtatttgcctaccattctaaatatgcatttatgacactctttttttctttttaccagcggggcaatgatcttgtgagaaacaaaatccatccgacatctattatcagtggctacagggtgagttttgcacttcataattcagctgcagtacaatttcagatttaaaacgaatgttccagctgcaaacccacattgcttaacatgttttaccatcatttactaccagcttgctatgcgtgaagcttgcaaatatgttgaagaaaagttggctgtcaaggtaagagaatactatctgcttaatgaatagcagcagattacttcttgacacctgacactagtatctatcaacattttcaggttgataaacttggaaaggattctcttataaactgtgcgaagacaagcatgtcctcgaagctgattaatagtgacagtgatttcttcgcaaatctggtaagttcctattgccatatatatacatttgtattttcagctgtaagtttgattttagtgatactttttaaatttaaataaatatttagttgatactctatatctgtatatataggcagtccaatttatttctttccaatgtcgtagcatgctataatgcttcactgttaagtctctatctgacagttaggcatatccgtagccaaatgctagtgctttaattcactttctgtaagctttccttcaaactgtgctgtataattaacatggctgttgtttaataggttgtcgatgcagtccaagctgtgaagaccacaaacgctaagggagaagtgaagtatcctatcaaggtgagttacatgcttgtgattcttgttatacatcaaagcaaaactttgttgtgtgcaattgcaatacactgaatgagatatattgaattgtgcacttgtgcttcactgattgttctctttctgtagcctctattattgtttggaaattgtagagtattacacttgtttgtgagctttgctacatgtgacctttgttcttttctcctggttatgtataacatattggacaccttgagagctaataaagtttaacttctaccttaattatatgctgttatgtcattgactttcttgttaaccaataaccattcatgtatggacatggcattcaagttatttctctaaaagtacttcgcaataaccattttttgatttttatattaacaaaatcgacagaaatttgctggtaactatagctcatctgatctgcagagcattaatattttgaaagcccatggtaaaagtgccaaggacagttacctgctgaatgggtatgcactaaacacaggccgtgcagctcaaggaatgcctactagagtaaccccggcaagaattgcatgtcttgattttaaccttcagaagacaaaaatgcaattgggtgttcaagtccttgtaactgatccaagggaacttgagaaaattcgtcagaggtatgtgcatttactttttccaacgcattctgattcatttgttttgtatacttaatgagtcaacaattggggtgttctcttttatctgatttgcacattttattttttttatatttttattgtgtttttttatttctattgttttgtggaatgtggttggatccacacataattctattataatttatggtctccaattgtaaaacataatcttacttttcatggcagagaatctgacataacaaaggagcgaattgagaaaattctgaaggctggtgctaatgttgtactgaccactaagggaattgatgatatgtcactgaaggtatgttttattcaagtagaaacattcttttattacctaaatataatctattgacttcggttggactggtaagagctctgttattgattgaatactagtacatggacggtattgtgttgatgttgattgagcgtgggtgtttgtggggtattcattatcaatttcctcaggaaacttctttcatcattgaatctttttggtcgtccaaactgagcttctgtttcataattttagttagacttctttttactctgaagagagctgtttcattattgaattggttttgattattttgaaagagctacttggttcatgtggtgtttgtgtgttaatctttgtatatgtatgatgttgatgattcctggctactgtctttaaatctgctttatgactgttcaatggaatatcatttcagtacttcgttgaggctggagcaattgctgtaaggcgtgtgcgtaaggaggatttgcgccatgttgccaaggctactggtgcaactatggtatgcctcaccttttgtttatcgagttgtaacaacattggaatacataattgtgcagatgactaatagaattaataaatgatgaagcaacttcccttgcgataccactgtaattttagtcttaagtttgttgcttctagtcctaatattaatgctacacaaactgtttggtgctgtcctaatttggtagtaaattgcaggtatctacatttgctgatatggaaggtgaagagacattcgattcatcgttccttggacatgctgatgaagttgttgaggaaagaattgctgatgatgatgtaattttggtgaaaggaacaaagaacaccagcgctgtatgtacttttcaattccaatgcaaatcttatattttgtataacaaaaccagcaagagtttaggggaatcacgcctgcatttcttttatgcaggtctcaattatacttagaggcgcaaatgacttcatgctagatgagattgacagatcattgcatgatgcattgtgcattgtgaagagaactctggaatccaatatggtataaccttttgcttctgttccttaacatgttggttccctgcagttgaatatataaagttcactgttatattaagatttttgggagagtaagaaaaaaatgtctttttttttcatttgagcactactgttgtcctgttaccacgtgagacctttgattagacactaacatgttgattagttgtatttagtgccccatcattattcttttgtcaattgcttatgctgtacaatgccaaatgaccatgtttgccattacatttcttcagaggatagcttccatgcttttgcaaaccaaatcaaccaaagcagttaaaattttcacaactgagccacttggtgcaattctatctgtgttgtcacttgtttcagtcatttatgcctgcattccatccacagaacaatgttggcagtgtatacttcatattagccgtgaatgtagttctggcattgtaactttggtggcgctttaaacatgtatgtatcatgcaggttgttgctggtggtggtgcagttgaagctgcattgtctgtatacttggagaatcttgctacaacccttgggtccagggaacagttggccattgctgaattcgcggaatctttgttaatcattccaaaggtttgatcacttgtgttctatgtgtttacatactggatgacataaaatattaatgtgaagtgtgaccttgtgatgtcaggttctttctgtcaatgctgcaaaagatgcaactgagcttgtagcaaagcttagggcatatcatcatactgctcaaacaaaggctgataagcaacacttttcaaggtaattacagaacatgtcttcgttgttatctgaataagatgtggttcttttatcttgtacatatagtatgttctagatctttgaaaagctctccaaattcttttttgatgaacttttgggacaattctagagatattatgttatagagtaaatttcacaaagctacaaatacttgagcaaattatcgcaaaactacagatttaggtgatgtatcacaaaactatatatttaacaataaatttatcacaaaactatatgtctgatgccaagtattgcaaaactacagatttaataataaaattaccccaaaactacaggtttaatgtcaatttaatcacaaaacttggacgttgataactcaaacataccattagtgctaatgatttgaaccccaaaatctgttgttttgtgataattttattattaaatctgtagttttcgcgatacttggcattaaacatatagttaatgttagtcagccatctattaaaaggaagaagttaatgtgttcctgaatgtgtgtaatttatcaatagagtaaccagtaaattcacttctgtttgctgcagcatgggtcttgacctttcaaaaggtatcattcgcaacaaccttgaatatggtgtcattgagccagcaatgagtaaagtaaagattattcaggttggtatacttagcataggtcttatcatgatgtttgactgaaatctgaggcccttacgccatttcctttttttttcccttgcagtttgccactgaggcggccattactatcctgaggattgatgacatgatcaaacttacgaaggaagagagcgggaacgaagagtaacaagcattgacactcatttttgtgatcacgagtgatctgctatgtgtgatggttgtgatagacccctagaatgtttgtaagttttttgtttgtctttaattagacattcacttaggatattgtaccaaggagttccgggagaatgtgtatccgtattgtgtttaatgctattttggaacgaccgtcacggtttactctctaagactgttgcgggcaaagctgctctgtttttaaaacgaggacctcttgcagactgttgcggtaaagatactatgttttcaaaatgaggactaatttcacatggaattcatgctgcgttggttcatgttgtgatctcccttaattccgaaataagcgaatctagggtatgatttgacgaaataaatctgaataaagtcctatctagatataacatttatatgagtttatgtcacattcaatttttcaattttagattggtttattttgagagtgaggcagcatgtctgtgaactctactgtgctgcgtttgctacatttaccagctggaagtaaaaccaaaattacctccagccaatggatatgctggaaacgcagtgaagccagtacggaaaaacccctggtaggcttaggccccaaagctcctgtttcggcctggggaggttaaatgttaatgggctagaatggaaggcccttcagagcaggccggttcacacctgtgattacgtcatgccatacgtgccgtgcagattcaccgggatggcgggatcctcgggttaatggcagaaatcaaggcggacaaaattagccacccgggcactccatcgatttttgacgcgaccacagtactcaaaacagctatcccccgcagttaacactgcacgacgactcgtgcaagttacatgcaaccgtgcctttcgtcatcccacacactttcatgcatatgcattgcacatcgatcgccaacgccaagtcgttgccaccaaccgatcgactgtgtgcagcctacctacattcacgcgtggcacccggagctcgcccgccctcccgccggccaagcgcacatgttggccgccgatggcgtacgtacgaccgcctaattctcgctgatgtagagagccgtagcccgggaggccatggcccggcaaagctgccccgaatcccggtgtttgctcgcgggagccgacggtgcgctcgctcgtcaggagagttgacggggacgagattggcggatttggggatgcggccggggatgaaacggtcgatcggttgacccgggaggaggaagaatgaagctggtgtggtgagagcgaggctaggggagacgtctcgggatgcgcaagcttaagcggtcaccatcgcatcacgcgcgcgggcgtgcgggcgtgcagtgatcaaccgaaataacggccaatctcctgtgcacttttgactttccattttgccaatagtagtaggcaggattcgcaaacgtaagcgtcgtcgtccagcaagttattgacaatgttatgcacaaattataatcatgtacagttaccctctgttgcagattaacacaagctatgcacattaattgtattagcacctttctctcatgcatgccgccctggaggttcagggtgcaatgacacatagcatgtatgctacattcacgagtttgttaaccaaagatgggctccagccaaatggtatggcttcattcactagcttgccagatctagccaggcaggcagaaactgaaagctagtaataataccggtaaaactgccatggtcccgataccgatcgaattgaggattggacaagtgaactacacacaaaaggaccggcctactactacgtaaatagctaattacttttcgactgtacttaaacatgttgaccctagccatgtgcattagcatggatatggaactatccaacagagcaagcaagcagagcgatttgtctgcatacgcatgcatgcacggagggatatgcccacacaaacccatcgtctgctgcctataaatagatcacctcctttccctagctacctcacacacagcccacaccacctctcatcgactcatttgcttgcatcttccaaatccttgcaaagcaacaacaatcctagcaagtttagctaagcaggtatagcagccatggcttccaggttccagctgattttgtcgaccttcgttgtcattgccgctgtcaccatgcttccacgcccttgcgcttccatcgagttccaccgcaagctctccagctggtccaatggcggagctacgtggtatggcgctgcaaatggcgccggaagtgatggtaaatacgttgtcatcagatgagagtttcttcgaaaagaaaattcatgcctatgtatgtcatgtcttaacagtgcaatatctgtgtgtacaggtggtgcatgtgggtaccagggtgccgtcttccaggcaccgttctcgtctatgatcgccgccggcagtccttccatctacaagtctggcttgggctgcggctcttgctaccaggtacatatataccgacagatcagaatatatatctagtataattaagtctgtgcacatacatgtactccctccgtcccaagatgtttgacgctgttgactttttaaaaaatatttgaccgttcgtcttattcaaaaaatttaagtaattattaattcttttcctatcatttgatttattgttaagtatacttttacgtatacatatagttttacacatttcacaaaagtttttgaataagacgaacggtcaaacatatttaaaaaagtcaacggcgtatttagggaaggagggagtatatgcctgtattgcatctaacattggaaatcaacaatataatttttcaggtgaaatgcactggaaatagcgcttgctcgggcaacccggtgactgtcgtcctcaccgacgagtgccccggaggcccgtgcctcagcgagccggtccacttcgacctgagcggcacggcgttcggtgccatggcgaaccccggccaggccgaccagctgcgcgcggccggcgtcctccaaatccagtacaaccggtaagcgagcatctttcacttccgtgcaaaaattgctgcagcagcaatggccaaaagtcggccaagcagcagaacacttgcagttatcacggcttcactcatcttttcttatcaccacgcatggaccaccggccaccggggcacatgcactgcttcagctataacctccatgcatgcaactgtccttcaattcttcttctcgtgttggtttctttcaaacgatccgatcgaacgcacgtgatgtgtgtacagcgtgccgtgcaactggggcggagtgaagctcaccttcgtcgtggacgtcggctcgaaccccaactacttcgccgtgctcgtcaagtacgagaacggagacggtgacctctccggcgtggagctcatgcagaccggcgccggcgccgcctggacgcagatgcagcagtcgtggggcgccgtctggaagctgaacgccggctcggcactgcaggcgccgttctccatccgcctcacgtccagctccggcaagacgctcgtcgccagcaacgtcatcccttccgggtggaagcccggcatgtcgtacatatcgacggtgaacttctaacgatcgcaagcaatatctcaacttgcatgcttgctgcatgcatgtgtctgcagtctgcaggcatatgttagatcggttattcgttggtgcaacaacgatgtgtgctacagggctacaggtttgtcgtaagtgtgaaattaataacggcgagatgcagaggcggaggcgcagatgatttactagttctcccctcctcgccgcagtacgtgtcaatgattatcgttatacgtgtttactgtgtgtattatttgtatcagaacagagccgaccagtgcttataaacgtgctatatatgaacatattcgcattgtgttgttgtgtcttgactgtgcatacatgtctctcggcatgcaccatgaaactattttatccctccttatttacatgtcacttaaatgattatgaaaaaaattaaaaaataaaaagatatattaacatgtgttatatcacttcacaaatatgcaagttcaaattcaacttatacatctcgcaacaaaaaaaaataaattaaactacaactagtaacgcatattcaaagttaaatttatttttttgttacgagatgtgtaggttgaatttaaacttgcatgtttatagagtgatatatcatataacacatgttaatatatctttataatctttttaattttttataattatttgaatgacatgcaaacagcgagtggacatccccactagacaccagtttggtagagtgtacctaaaatggtcccataccattcggtgcccaggctttggaaagtatgggggcagttttgggtttaagccgaggaataagttcatctaaggtcccttaattttacaccgaatccgattttcgtccttaaaccccaaaaccaaatacaaacggtccctgaactgttaaaaccggggtaaacgaggtccctcggtggtttagaaggcggttttggctgacatggcgcctacgtggatggtttgactaggtctccgtctcacgtgacattgacatggcgctgacgcgacgtagacgtggcaattatatctcagaaaaataataaaatccgtgggcccacatgtcatcctcacaccccctttcttccctctcccttttcttcatcttcttcccgtaggcgagcgaggctgcgaggcggcgacctcggcaacctcgccgccgccgccgccgccgccgcctcagttgccaggctcctccctcgccggaccaccgcctccatcctccttcccctgcgccgcctctacaccgacgcaacagccagcacgaggcggcagagcttgttgcgacggcgcttcgcatggaattccggccgccgctcgtggctcgtggcgaagaggcggagcacggcgtcggaaggggagagcacggcgtaggcggcgagaaggcgggtcgccgcgaaggcgtcgtcggcgaggcggccggagacgagcatggcggcgtggacgacggcgagctcacgcggggtcgtgcaacggtcggccaggagggacaggttcggccggcgccggacgctgctgcgggggaggcgggcgttgacgactccgctcgcccgccgcggcgcccctctgttccgtgtcccggagcccgctgcgtccccgtgcctgactcccccccgggcacgcgcgtataggaaaggggaagaggaacgaaggagctaaagccgtggcgagccacgagctcgtgttgtcctgttgcttcaccaaagccggcgtcgtcgcttccccatcaccaacggcctcctggagccgagagcggagggcgacgccgaggtggaggacaacgccggaggggacatcagaacccgattgttctgcaccacgaccaaaatcatgcagcaaccaagcaagagaaacaaattaatcaggatatggtgaacatttgaaaaaaataaaataaaattcatgtcgcgggtgcactgcaccaaagcgtacaccatcgtgcacggtagcgttcaacagcaccgcgacgtgctcccggaacctgccggcgatgaaggtgtccaccacgttggtgttgttcagcggctactccggcttgttgccgtacccggagacaaagtccacgtcggagaacaggagctggaagcagtcgtagtagagcatgacgttcttgcggagctcgcagagcggcctgttcgtcctgttcatggcagcgtcgaacgcgtccctgatgcagccggcgcagaggaagaaatgagaggggagaggaagaagggagaagtgaggatgacatgtggggtctacgtgggccccaccattttgtagttatttttttgtgtgcctgacatgtgggcccaccgtccttttttattttttttaagatataattgccacgtcagcgccacgtgggatgaagacctagtcaaaccagccacgtaggcaccatgtcagcaaaaaccgctttccaaaccgccgagggagcttatttgcaccggttttgacagtcatggacaaattatatctggttttggggttaaaggatgaaaattggattcggtgtaaattaagggaccttagatgaacttattccttaggccgaagcttccaacaattcggattatccaaggtgggctgggatagttgattccagcccgtataggacgagagcccaattcgctcctcccaaagcgcagcaaatttgtgttgggcctaggccgctctctatctacgtcaaccggcctgctatcacaacaactttccgctaatctcgccgacggcaacgctgccaacaaacatgatttgcctttgtccaccccccacccccccaaccaccaccaccacacacacaccacccccaccgtggcgtcgactacatgatcggcggcgtaggagaagaagagcccatcggtggaagacgatgtgatatgcccagatagagacgcgcgggcgcggctgttgttttcacgggacgacgtgcgcccccctgcgcgatcagccgtcgtctgatcactgcatgatgatctcctcggcccgaacaggcgaacagcgttgcctcccacgtccgcctgcccgcccgcgcggttggagcaggagcttcgctatcaacggcgcgttgcacgggagattccagcgattccgcgacccaaaatatccaatacgttaagatgagaccacacgcccgtttcgtcaccctccctgcctatgtgcaccgcacgtttagcgatcgctccggggaatttctcgtggggattgccgattgcgtgcgtgcgtgcgtgggtgcgcggcaacgattcggttggtgtagaggaggattacgtgcgtgccggcgtgacggtctgtgtcgaggggaacagcaacgctctcagctcactacgcggcgcgagattcggggggattgggcctgcagccgggcccacaccaacttctcgcggtaaacggcccatttccttgtcggaaaataacttatactatcatacagccctcatcatctatctattatctatctatctatctatctatctatctattattattaagacagctcgaaacgaagacaccacgttcgctgtgggggctagaaaatcctacattaatcggagaaaaagaaaagaagagtcaaagtagaaatacaattaaaaatagctgaaattcagaattaaaaatatgcaatatggaaagaggagtccatataggaacccaatatgtgattaatcaaaattcgaaataaaaataaaataaaatccaaaattagaaaaggaaaggagagtccaaatagaaataaaatttaaaaatagctgaaattcgaaattaaaaataagcaatattgaaagaagtttccatataagaacctaatacgagattaatcaaaattcaaaataaaaataaaataaaatccaaaattagaaaagcaaataagagtccaagtaggaatacaatttaaaaatagctgaaattcggaattaaaaataagaaatattaaaagaaaagtccatataaaaacccaatacgaggttaattaaaattcggaataaaaataaataaatataaaattagaaaaagaaaataaaagaagagttcaagtaggaatacaatttaaaattagctgaaattcggaattaaaaataagcatactgaaaaaagaatccatataagaacccaatatgagattaattaaaatttagaataaaaaataaaataatatccaaagttagaaaacaataaaagagagttcaagtagcaatacaattttgaaacaactgaaattgaaaataaaaaataaaaacattaaaataacacaatacagtattaaacattttttttaaatttttttctaaaattagaaaaataaaaataagatttcaattaggaatacaatttataaataactaaattttttgataaaaataaagattattaaaataaaagaccatctaaagcacatgacgagatatattaagtaacatgcctataaaggagtagagtggtggcggttgatatgacatataaaaattgttaataaaacaccaaatagaatcctaatgacgattaaaaggagagacgtcagggaggccgtgaagcaataaaatttagaataaaaaaaataatatccaaagttagaaaacaataaaagagagttcaagtagcaatacaattttgaaacaactgaaaatgaaaataaaaaataaaaacattaaaataacacaatacggtattaaataattttttttaaaaaaaattctaaaattagaacaagaaaaataagatttcaattaggaatacaatttataaataactaaattttttgataaaaataaagattattaaaataaaagaccatctaaaatatatgacgagatatattaagtaacatgactataaaggagtagagtggtggcggttgatatgacatataaaaattgttaataaaacaccaaatagagttctaatgacgattaaaaggagagacgtcagggaggccgtgaagcaaacgaataagacggttgccgggacttctagaaagtaaaaaaaaataatttttagaatcacaatgacaataaagagtaggtgacagacgggctgtagatcagggacacagtgacatcgtttggtggcacttctaaaaattattaaaaataaaactacaagttcaatttttaaaggttcggaacttctgaaaagtaaaaaaaccaatgataatcatgttcgattttaaaatcaaaatgaaataaagaagggaggcagcgggcgagccgtagaggattacaatggcaaagccgctaacggtttggcgggacttttaaaaagtaaaaatgaacttaaaacgataattacgttcgatttttaaattctcaatgacaataaagagataagacagtagacgtgtcgtagaggagtataatagcaacgtttgacgggacatctagaaattataaaaatgaaacccaacgtgacaataaactctaaaaactataaaatccaatttttaaaggttccaataagaatgaatagaaatagtggtagatcgagcaatcaaataaagaagaagctgagacataaggggtagcaactagtgtgacttttaaaaactatattattagaaacacgatgatgataaggtttggtctttcaaattcttaagacaatgagatagatatttaataaattttaagtaaaatcatacttaaaaaaatatatgattttgtttgggtgctagccgcgcaattgtgcgggccacccagctagttatattattaagacagctcgaaaagaaggcaccacgttcgctgtaggggctaaaaattcccacattaatcggagaaaaagaaaacaaagaaaaggagagtctaagtagaagtataatctaaaaatagctgaaattcggaaataaaaataagcaatattgaaagaagtttccatataagaacccaatacgagattaaccaaaatttgaaataaaaataaaatacaatctaaaattagaaaaggaaatgagagtccaagtaggaatacaatttaaaaatagctgaaattcagaattaaaaaaagcaatattgaaagaagattccatataagaacccaatacgagattaatcaaaattcgaaataaaagtaaaagaaaatacaaaattagaaaaggaaaggagagtccaagtagaaatacaatttaaaaatagctgaaattcgaagtcaaaaataaggaatattaaaagaagagtccatataagaacccaatacgaaattaattaaaatttagaataaaaataaatccaaagttagcaaaagaaaataaaagaagagttcaagtaggaatacaatttaaaattagctgaaattcggaattaaaaataagcaatattgaaagaagaatccatataagaacccaatatgagattaattaaaattttaaataaaaaataaaataatatccaaaattagaaaaattaaaagagagttcaagtaggaatacaatgttgaaacaactgaaattgaaaattaaaaataaaaacattaaaagaacacaacacggtattaactaatttttttaaaaaaaataaattctgaaattagaaaaagaaaaataagatttcaattaggaatacaatttataaataactaaaatttgtgataaaaataaagactattgaaagaaaagaccatctaaaacacatgacgagataaattaagtaacaagcctataaaggagtagagtggtggcggttgatagttgatacgacatataaaaattgttaataaaatatcaaatagaatcctaatgacgattaaattgagagacgtcaagcagaccgtgaagcaaacaaataaggcggttgccgggacttctagaaagtaaaaaaaaaccattgatagtaatattcgatttttaaaatctcaatggcaataaaaatgagaagcggtgcgcggggtgcatataagtaactcaattttttgataaaaataaagattattgaaagaaaagaccatctaaaacacatgacgagataagttaagtaacaggcctgtaaaggagtagagtggtggcggttgatacgacatataaaaattgttaataaaacacaattgccgcaaaggaggaacgtcaggtaggccgcgaagcaaatgagtaaggcggttgccgggacttctagaaagtaaaaaaacaaaccccattgataatcatattcgatttttaaaatctcaatgacaataaaaaggagaagcagcgggtggggtgtataagagtatagttgcagagccgtcgacgggacttctagaaaataaaaaatgaattccaacgatagttatgttcgacttttagaatcacgaggacaataaagagtaggcggcggacgggttgtagaggggcatagtggcattgtttgatgggacttctcaaaattataaaaaatgaaactacaagtctaatttttaaaggttcggaacttctaaaaagtaaaaaaaacaatgataatcatgttcaattctaaaatctcaatgacaataaagaagggaggcagcgggcgagccgtagaggagtacaatggcaaagccgctgacggtttggtgggacttctagaaagtaaaaatgaaccaaaacgataattatgttcgatttttaaaatctcaatgacaataaagagatgagatagttgatgggccgtagaggagtataatggcaacgtttgacgagacatctagaaattataaaaataaaacccaacgtgacaataaactctaaaaactataaaatctattttttaaaggttccaagaagtatgaatagaaatagtgatagatcgagcaagcaaataaagaagaagatgacataaggggtagtaattggtgtgacttttaaaaactatataattaaaaacacgagaatgatatggtttggtctttcaaagtcttaagataatgagatagctatttaacaaattttgaataaatcatattaaaatagataattttgtatgggtgctaattgcgcgggctacccagctagttcgattgaattgctgccactaagtgttactatacaacattctcctctaaaagaactatatatatttctccaaaagaaaaaggaactatatatgtaccatatgtacaaacattcgagtggccgggcatgatactcgctactttgctaggcacgttgcgcacgtacagctcacgctcaagtcgtacacattatggagtagccatttgacaaacgtacggatgacacaagacgaatatcaaattgcgaattttcaaagcgtttctaaccaacacaactaccttgtgagaatagtttatccaaacccttgcggctgcgtgatcacctccttcatgcaaggacctccgtaaagtccacaagtatactcttcgatcccacacacacatagttgacatacacatcaacacatgtacaaattcaagttgccacgttcacctcaataatgcttgggtacacataatttgctaccacgtttgtgaccgctaatcttccctataaataccaaccaaatcaaatcatcttaaaaatcaccgagcaatctccgcttaacaatcccagctacctaaccgattgcccaacaagaaaatagcaatggttagccggggcactttcgtttttgccgtcctagtggcgctaccgatactgtcactccccgtctctggctacgagcagaactacactgccggcagacggagcaccatgtcgctgggcagaggctacggctggtcctccggcggcgcgacgtggtacggcggcccgcaaggcgacggcagcgaaggtaattaagtcgttgtcaagtggtagtatgaactgcatgcatgtgcgtatttgacctcaagtactcacgttgccatgttggttaattaatccaaatgcaggcggcgcgtgcggttaccagagcgccgtcgggcagcgcccgttctcgtcgatgatcgccgccggcgggccctccctcttcaagaatggcaaaggctgcggctcatgctaccaagtcagtagtgtatttgtatgttttaccagtcaaatgcatgggacgtggagcattcctaactaaattagatgtacagattaagtgcaccggcaaccgggcgtgctccggccgcccagtgaccgtcgtgatcaccgactcctgccctggaggggtatgcctgaacgaggcggcgcacttcgacatgagcggcaccgccttcggcgccatggccaaccgtggcatgggcgaccgcctccgctccgccggagtcctcaagatccagtataagaggtgccccgccattgaatttgcaaaattatttctggagttctggtccactctgcaatgtacaagtgcagatttttactgaatttttacttttgcctgcagggtgccgtgcaggtttgccatgaacgtggccttcaaggtggacgcgggctccaacccgtactacctcgccatcctggtccagtacgcgaacggcgacggcgacctcgccgcggtgcacatcatggaggcccgcggcggcggcgggtggaaggcgatgcagcagtcgtggggcgccacctggcgcctcaactccaacaccgggaagccgctgagcccgccgttctcgatccggctcacctcgggctccggcaaggtgctcgtcgccaacaacgtcatcccctccgggtggcaggccgggttgacctaccgatccaccgtgaactacgccgcctaatgcggcggcgtcgtgcgcgactacgtacgcgcgtgtttgttaacgtcgccgcgatagatccatcgcgaggcagaagctcgcctcgtcgaagtgagttcggtgtgtgcgcgtccgggaatcgtgcgcagccgcggtaaaagaggagttcgatctgttagtgttaagtgttcgtgatgtgtgttctccctccgtggccgtttgcagagctgcttctagtgacgtctcttgcttggttataacttaaccgaattctgcgttgcgatttgcacttgtataattgcgttgacatggttggagacatcccgggcctgccccaaccggcaaccgtagctcggttttgacgagcccggccgtgtgacggcctctattcttgctctgttttagctaccggcataatcgtatgcagtaagcgatttcttattttccaacgtccatatatatacatgatacgtcttctgttctctgccgaatcagcttacgtcaatctatacgccgtgatctgactttgccgagatggcaaccgccgaaccggatactacatatacctctcgttggccacaaataagggcaacgacaccagtagttgcgatccaagtcggggaaggcccacgcgctagtcattctaagaataagtccattttccatccctcaagtttacaccgagtctacatgacacccataatctccaataccagaaattatttctgaccccctcaaaccttcaaaaccgtgaaaaattggttccatgaaaatatagaccatatttcccattgtttttgttgacgtggcatacggtggggcctacttgtcagtgtgtcgtcagtgccgttgtttgacaaatcaacagcaaagaccagtttccggcgagcacgaggctgcaggagctggcactggtggacaactggccctccggcgagctgccggggttgttcggctgcctctctccctccttcctcctctcttccccttgttctcggcctctcctcccaaaccaggtgaggctagctgagcgacgcagcgacggagatggcgaggtgagcggctcggagatgagggacggacaaatggtgaggtgagcggcgcggcaacagagatgatgatgaatggcggaagaggcgtgatgtggtggtggcagccgctgctgtagccacggcagcgagaaaagtggggtggaggtcgaggcggatcagggacgatttcttcgagggccttcgaccgccgccgcggtctccactcgccgaaggagagtgcacatcatccacatctccccctctcccaagtctgcacactaagaccacttgagacgatggttgtgcccgtcgagggctggcggctggaatagctcgctggggaggaggttgtccgacaggttgagaaggtggcgggtcatgagctacatgcggtgagacagagagggggaggttgtcagctcagcttccatgtgaggggactggaggcggaaaaggggcgacgtggccgacgagccccactgagcttgagcttgctcggcattggtgcaaggaaggtgaaggtggaaaaggaaagggagactaccggtgagcccctccgcgggggctcctcaatcgactgcagcaggtgctcctctctctttccctcatctcccagtgacaccaacgacaccctgacaagtgggacctccatatgccatgtcaacaaaaaagggggaaaatgatctataccgtcatgggaccaactttgcacggttttgaagactaggatcaagatatctggtattgagggttagggatatcatacaaactcggtgcaaagttgagggatgacaaatggacttgttcctctattctaatacgaagccttctccattccgaaacagcgctattacttgagcccagaagacccaagttgagaaaaagcccaacacatcagcaccccgtccctccgccccttctgtctccaatggcagccgcgccgccgttgtggccccagtcgtccaatccctccacggctccacctctgtgccttccgtgctccggcccagctcaatcgtacatcattgcagctccacgcttgagatggcatccccatgtgtcgacgtttgatagtcacgactagggtatttggatggtatggggatcgttggtatcagggtatgtgcgagattaagataaaagagatggagacatgaatttttatacaggttcgggcctcttatctgacaggtaataaccctacatcctgttagccgaaaccagtgttgctctttatttatctggatcacacaaatacaatatttgggataacctatatagctgccatcgtcttggcttatgtgtatgttatgtcttgtggctttgtggcgtgtccccttttctcctaggggggcttgtatttatacccataagtgcccccttgtccaagtaagattaaggagataaatatggatacaatccgagtagtccttcccgttttcatatagaactctatttattcttccttatccggaactctttttatatacgaggtttgtttccgtataagacatgatatgtggtgggtcctgccgagtttagtcaactactattagatatgtggtatccataaccatgacaccatgacaccatggatgttacatatcttcgttgaaccatagcttttgttattatgcttagtcctttatatgatgtgatcgttcatgaactttttgaggaatgtaaaagagtaaatatgcattaccggtatacggacttaagttagtgtattaacttataatacgtttgttttgggtctgatacgtctagacaagttgtttgttttggtgaataaacctttttattgtgtaccagacaatttcattcaccaaacatgcacttgcttgaaactagcttatcccttcattccaaaatataagcatttttagagttggacacggttattaagaaagttggtagaattaaatgggggagtgctctgactggagaataagtggagatatgtgagaaaattgaatagtggaggttgtgattggttgaaaggagaatgttaatgaagaaattattatattttaggacaaattctaaagactaaaagttgttatatttttggacgaaggaagtacttgataaatacgtattctatttgcaaaaatagtgtaaatcacttatatactgaaaacctgaaaattatcgttggattaaaataaaatggacataagattcgtccacgtgcgcgtgaacaaatcttaggcgtccatttttaatctaacggtagttttgaggtttcaattatatatgtggtttctgctacgtattatgacaacccccccccccccccccccaggctgtcactctgctctctaacattactctgtcccgttcagatgatctttgtcctggtcaccgtaagcaagtgaagagcagaatgtaaaacatgcttcaatgaaaaaaataataaatctcgcaaaactatatattggtatacattaaccaaactatcgaaaaaaatgtaattttaagacgttgaattacaaaactttagatttatcactaaagttatcccaaaccaaaagtatcaaaaaatacagatttagcaacaaaattatcctaaaactacaagtttagcatcatattaatcacaaaactataacatttatagttcaactataaaatatataattttatgttaactttaatattaaatctatagctttttatgtactttaaatatgtggttttgtgatatggtgccttaaatttataattttggatagtttagttaaaacacctatagtttcatgaaatttatttttaaaaattctctagtaaacacatgcctcaatttgtttaccatccgctcgcatgagcactgtcgcaagccatggccgattgattcgatgtcccagagtggaatctcttggcaaagatcatgctgtacattatcacgcctgacaataataaacaaaagctacttgtccagtgggagagaaataccaatatccaatcaagatcaggagttcaaaaaaaaaatctaagatcaggggcatgataactttgatcattattatcagaaagcaaagcaaagttctgctttattcctgcaagctttatgtgcgtgcatataccaaccagacatctctttccaaaaaatgatcctcacaaatgaaataaattaacctttggcaactttaattattttcgatgaagcagcttattgcaacctaacctcatcattctgcaagtagtactgatgatgaagaaaaactatcagcagatccatttttatatcctctctggatcttcatgtcaacacctcgatgccgctgtcctatgagtacccaagaacagtattcccactgatcatccaacctactaaaatagtgcaaatctgtcggcagaaagggccactcctctccagcaactccaagaaccggttgttacaacgccgcggccattgtcgtctcctgcatccatcggtcgcttcgacgtcttaacagaagttcccattaccatcataaactagcttatcaaccggcaaggcaagactaaaaagatcagaggcatctgttcttcacttgcccacaagccacgcgtctcgccgtgacacaagacgccgtacctgaacagcaggtagcacgtacgcgggaaaagtctcgcatagttaaatgtgtacgggttcgccgggcaccgacgcgataattcgccactcgcgcttgtttttccctcataaatccagcctcgtcgatcacggatgccgcccccaaccgcagtagtgcagtaccagccatcaatcagatctgcccctggatgcatttgtcgtccgcttgatcataaataagctcgggtgatcgggtcaggggcctcaatggaaggtgcctgaaggcttcatctccgtgtctcgatttgttttagctccagtttgcgtgtacgtgctgagtttttttatgccgatatcttttgtttctttgctccttcctcgtgtcgccttcagctgttcagttccgccattgttaatagcttctttttgcccccacgcttgcctccctctggtgtataaagtgtctgcatttgcaagagttctctgtgtacttgtgtagcataggttttgtgaagaaccaagcttttgccattgaattcttcaggagatggcgtccactgagttagcgtcggatgtgtacgcgctcccgtgcggcgacgacggcacgacggcgctgtcgacgccggtggtcgtgtcggtcctcgcgtcgctgctggagcggcacatcgcccggaacgagagggaccaggcggcggcggcggacggcgaggccgcgaggagggcgcgcgccttcgacagcggcacggtgctggacatgagccttcacgcgttcctggagcggttctcccggtacgcgaacgtctcgccgcaggtgtacgtcgtggcgtacgcgtacctggaccggcttcgccgcggcgacggcgtgcgcgtcgtgtcggccaacgcccagcggctgctcaccacagccatcctcgtcgcctccaagttcgtcgaggaccggaactacaagaactcgtacttcgccgcggtgggcgggctgaccgccgcggaactgagctcgctggagctggacttcctcttcctgatgcagttcaggctcaacgtgagcgtcagcgtgttccagagctactgccggcacctggagagggaggtgagctacggcggcgggtaccaggtggagaggtgcctcaagaaggccctcgtctgctccggcgaggcgcaggcgcagcagaggcaagcggcgtcggcggcagcccagtagacgtcagctccggagccgccattcgcgcgtgatctgccagttgcccgccacaggcggccggcacagcagccgcacgatttgatcgccggcagctgccactcgagtgcccagaaagatcaaggatgtaaatagttatggtttgctcgtgtacttaggataggagtaagaattgtgcaatgcaattgttcctctctacctcgattggtaaaagaactgatgcggggacaagtaaaattgattttctttcatgttgtcacgaccgatcaactttgctttccggcaaatcaagtctttaaaacgctaacggaatcgatagcgacaaggtagcgagattacatcaaatcaactccagtagggaccaaatatgactaccaattaacactttaccttaactcatggtccatgccaatgggcgaacatagcacgcaaaattttctctgttgcgatatgcgaatgcgttgtcggtgcacattaaaaacttttcggataataagagttatttttaatgaattactcgacgcagcacagcttgcaagctgcagcaactcggccgcccccacggcagcgtacgtacgcggcggcccatacggtacgggaaagggttctgtgcaggtgcaggatctgatttctggcaacgcggatgcccctggtccatggaccatggctgagtgaggagaggactgaggtccttgtcagcattccatggcagcatcttgtgacggaaataatttacccacagactagagcgatgacaaagctttgcccgttcttggagggcaccagtgaccagacactatatctgacgagatgaaattgcccagatgcaggaaactacgtggagtacatgaggaacatttcaggcgagtagctctgggcagctgacggggagtcggtgtgggggaataggatgagcgtgcgacggcgacggcaaagaatagaatcgaggcagcgggacgaatggaatggccgatcagctgcgctgtctcggcccacattcggaggcacgtcggctgtgaatctgtgattggaataagttggtcccttaattttcaaaattcgtcccttgaccataaaatcaggtacaatgcatcatccaacttacaaaaccagtacaaacgagatccctcagtgatactatccccggcttcgactgacgtgacgcctacatggttcatttgactactacgtctcacgtgacgttggcatgatgcttacgtgacaatttaatatgggtaataaaaaaaagcatgagcccacatgttagttacaccacaaaacaattaaaaatgatggggcccatgtgggccccaaatgtcatccgcgctcctccggtccacccttttgccctctcccctctctctcctctctctattcttactcatcctcactcctcccttcttccatctcccctctcttcatcatctcttccaaggtggcggacgggggtgggggtgggggtgggcagcgaggagaatggcggagcaggcaagcgaggcaggtggcggacggagctaaccgatggtgggcggcgacctcaccggtgccttccctcttcgaccgtgcctccaaggccaccacgctcctggtgctcgtggtgctcttccgcattatgacccccaagtgcgtagactagaagtggattccgccggttttcttcttcatttgttgtctctctgttacttccaaagaccaaacaaaacatgggtaggaaagagaagaggagagaggggaaaatttgggagccctagatttcgacaggttggctatagtgagggggagtggatgtattggcgcgcggatctggtgggtgcaagaggttgggtggggcggtgagatctatgtggcagggaggagacgagaggaggaggaggggagaagggtgagaggagaggggaggcggttgagttgtcgttgtccgcggactccgtggtggtgatcgtggtaattgtggcggtggtggggcatgtgctcatggcatggtggaagttgaggtgcgacgcggttttggagggaagaaggtgtggcggctcacgcggctggcctaggagccacaggaggagtcggagttggtggaaatgaagttggcgcatgtgtactagtcagagctgttcccgagcacagtgcacgccgcggaaatatggatgaggctttgtgggcgttgccaacggtggtcatcttcagctcctctgcgccacccactaccgctatgcccttctccttgcagtgtaggggaaggagagaggggatagggagaagagggaggagtgacgataacacgtggggtcacatgggcctcaactttttttttattatcttgtgtgtagctgacatgtgggtcccacgtcttttaatttttacagaatcaaattgccacataagcgccacgtcaatgttacgtgggataaagaccttgtcaaaggagccacgtatgtgtcacgtcagttaaaactgaggacaataccaccgagggatctcgtttgtattggttttatatgttggggatgcgttctactcagttttgcgctcaagggactaattttggactcggcgactgagggactcaaagtgaacttattcctctgtaattcatgttgcgcgttcgtgtgaatacagtcccggcccaactaattgcggcagatgggaatcccgttccggcccatgtagttgggcacgtgtgtggggatccagttacagcccaactcgtgttgacggacctggcggtgcgttacttgcccggtcgattgatcagcaggttgacgcaggatggcgaaaggagccgaaaattccccgggaaggccttattttagaatcgccaaacaaggggagggtggtaatcgtaagaatttggatcgctgccacttattgcaatccaacatacggcgctctctggaaacttccgaaacaagagtgtacaatctcatctaaaaaaatgtgcgatctagagtatagcagccgtcgcatattcagacggatttgctattcagatgtgcatacgcgaatgatacttacatgattatcatttttaaaattacgaccaaaatttgctactccctcctttccatattataagtcatttgattaatattatcaaaatacattcaatgttaaatttaacaaaattaattttagattctgcaatccgaaggagccccaaggtacactagtgcacgtgcgctgttgttaaaaaactaacaactccaatcctacatatatgtcaaatggcatccgttggacgaacatgattcgtgggctggtcccttgactttcagattcagagatatgtagcttattatcaccggcacgtgtcactcctaggcgttgtcaaacgtcactagctaaagcggccgatgcaccgcgaaacacgcctatgagaactatatatgtctatggacgtgcagtagtgacgaagtttttaaatttggatggctgttttggaccttcaggttcaggagaactcgcggcattgctgcgatcgtgagttcgtgacaccggacggaggcgcgcacttgatcggcgctcccatctccaggtcgaattcgattccgccgcggcgaaccaagcgcatgcatgtgtgaatcttcaccgtctttggtacttagtcgattatcacatatatatatgtctcgcaccgaaagttgatttgatttttcgtcgagacatgttgacattgtgattttccatacaacgattgcatcttcttgagcatcatggccagatgcagccgtcgccgtcatcacctcgggcaccgccgccgacggcggcgcaggcgtcggggtacaagcacttctgcagagtctgcaacaaggggttcacgtgcggaagcgccctaggcgggcacatgagggcccacggcgtcggcgacggcgatgggttgggtgccgatgatgacgacgacgacgacgacgattcgctcggcgatgaggccgtgcggcgtgcgcgcggcggggcagatgatccttggaacgcgggcggcccgtcgtcgtcaggggcagcgacacacgtctacgagctccgcaccaatcctaaccgggtcacgaggagccgccaggtgtgcaagaactgcgggaaggagttcacgtcgtgggagcatttcctcgagcacggcaagtgcagctccggcgaggacgacgacgacgaggacgacgtggatcactcgctgcaaccgtggtcgccttcgcccgaggccgacggcgaagaggattctgcaccggccgccggttggttgaaagggaagcgctcgcgtcgctgcaagggcacaggagtcgatttgtcaccgacaccctcagcgtgcgctgccggcgaggaggaggacctggccaattgcctggtcatgctctcgtcgtccaaggtagatcaggcaggcgtcactgaagcagaacaacggtcatcttcttccgcgagtaaggaacataagagactgatcacgttcatggagccgacgacgtatgtactggatacagtgatggcgcttcccccgccggcgccggcgccacagtatgtctcgaccgtgcctcgaggcatgttcgagtgcaaggcgtgcaagaaggttttctcttctcaccaagctctcggcgggcaccgtgccagccacaagaaggtgaagggctgcttcgctgccaagctggagagcaacgccgcagaggtggctgagccatcacaccatgcagaggtcgctgatcggagcgaggacaatcccgccaaggccacttctgatgccaggaggaacgtgcacgcaagcatcgacggtgatggaaacgccggcacgagcgatgccgcggcagaactgtcgatggccatcgtgcccatagaaccgccggtcgccgcgctcgccgctgcaccgttgaagaagaagggcaagatgcacgaatgctcggtctgccatcgactgttcacctccgggcaggcgcttggaggccacaaacggtgccactggctgacgtcaagttcggcggatcacaccgcctcagtcccacccctagccgacgaccttgtcccgctctcgttccggccaatgttggacgcaccggagcccgctctcgacctcagcatcgcggcgaacccgccactgctggcctcggccgcaacagtccgtccgaaggtcggcggcagctcgtttcatctcgacgcgccaccaccggtatacatcccatcgtcgccggcgatacccagccaacggaacaaggctaccgcgacaaccggcagccagaacgccaacgacgcggtcgggttaagcaccgccgcagcagaggacgaggcggacagcaccaccgtcaagagagcgaggcttagcgatctcaaggacgtgagcatggcaggggagacgacaccgtggctgcaagtcggcattggctcctcgtctcgcgggggtgctgatgataacgacaaggagtgattgatctgcgaattgatcagtacatacatatatactgttacattatttccatgcgtttgcaattgcatatatgttgttcgcatgagcatataagtatttgccttcttttttgtgactttttcttttcttttagacttgtaggtttttttttcttctcaagatagtgagtatgttttacaaagaggtaacatatgaatttgggaagaggcagtagacttgtaggatttttttttcttctgaagagaagcaagtagtgagtattttttcacaagaggtaatgtattaatctgtcaagctgcgtgaccagaaatttttttaaaaaatagttgcttctcttgttttttcacaagaggtaatgcattaatctgttaagttgtatgaccagaaaatttaggtaatgtattaatctgttaagttgtatgaccagaaaatttttaaagaaatagttgcttctcttgttttttcacacaagataatgtattaatctgttaagttgtatgaccagaaaattttaaagttatagttgtttctcttgtttcttctcgagagaagcaagtattgagtatttttcacaaaagaggtaatatatgaatttaatctgttaagttgtatgaccagaaaattttaaagaaataggtgcttctcttgtttcttctcaagagaagcaagtattgagtatttttttcacaaaagaggtaaatactagaaaattggtgcgccgttagcacaccatccatatagcaaaccatattaatactacatatactgtttattgttatttgtaaaagcgtaaaattttaaagagatattttagcagtttttaattttatgcctacaagtctgagtaaacattatatttgtaaatatttaaattacagaggaaaaaatgatgtcaaatatatgttggttgatggtcgatttaattattattaataagataaggctaaaaggtgaagccttatatgaaaattgtttgggactatactaattgagaaaatcccttatatacccctgaaattttacctaatctcttctatacccctgaattttgcttacttccttgtatacccccaaaatttgattttgatcccttgcatacccctcccatcagttgaccgttagttgaccgtctattttccataaaaatgaccattttacccttggatgaacaaagaaattcatgaattacattattaaaaatataaaagcttctcgcatgagactattatagttatgagtttgttgtgcgatgcattatttatcccaaaaatatttttagatcatgaaataaaaaacacgtatttatttttttaaaaaaagtcataaaaatgaggagcattcatataaagataggactaccaatgttcacaacattttttttatgaatgctcccgataaaaaaatccattgtcctattaaaatttgaaataaaaattttaatttattacatttattttattttcaaaatttatgtcaaaattttctgcactaattatttagtttcattagtcttataaaatgcacatactgtgcacccaaacaaaattttttcaattgttttttaagcttatatttaaacctaaagcatctagggcaaaaaggatatttgcaaccaaacgtaacagtgaaatgatggaaaatgtaacggtaggggcatggaagggatcaaattgaattttcaggggtatagaagggattgggtaaatttcaggggtatgaaagggattgagtgagttttcaggggtacacagggaatttactcataataactagaggtttcttataatagcactaacagttggaattgtttttttaactggttatgaaaaaaaagggaaatgattttttctttttcttcttcccatatttttattttctttcagcctaagtataacattctaaattctctttatttattttacttttacattattaaatcctcgatggttaaaaatcttatcatttgtatctctaccgcgctctctgttttttccaaatatttgcttatcttctcagtagtcgaaaatagtcatgactcatgactacgagaggaccacatagttcacacactatttgaagagccacatgtgaatggagagggacacgcctccatatcttctattgcgagtagtacaccatttagatgtcacaattcgtagcctcatatgtataattcggaaaactatagctataccacctctcttagggcgttcgtagtgcaagaccctcctcaaagtatcacgtaggatgagttagcatatctcaaatttgtttatcctataatgcaaagtaactctagagatattcttgatttttcatgccgggccctcatatttcttactttagttcttatgtttttcaaatttatagaatagtccaacattacactaaataccctaaaaattagaaacaaatatacaaatctcacctccctatcctttcccaattccctgcttccatatcctagaaaattggcgcaccatcggcacaccaacttatagctggatatatttactcatttagaaaaattattgttgttgttgtctagagtttcaaatgcagtagatttacaagaacctatttaatgaattttgaaaagactgaggaacgattaacttatagtaataaccatatttatgtaaagatttaagcgttgtaaaagaattaatacataaagcaaaattatgtataaaaattatgtatagtacttgcctatttgctttcaaacctttgtttttctcttccattagacagagtaattaacacctattattaattggtaagattagatcattagtggaccgaaaactaaaggatatattttttgacaagtctctctaagagaaatttcttctgctaacataccagtgtcacctactcctctctgtagtctcatatacgatactccctccatcttaaaaataatacaagctaatcataggtacaatcgaacatagttagagcaatattatcaacaaatagagtaatatggttaattagtgtatgcatggctaattaattcttctctaccacatttagatagccgtacttctctgctgtatattataattcaacttgaaaaaagttttgctaatgaaagattaacttgtttaagcgtctataagtacctttggacaaatactttggaagatgtgtcttttgaattagtataatttacagaatttgttaacctataggaaaattacgaaatttatgtaaggcataattttttaggctaatgactctaattgtcagcttaatatccaaagccagtctttgtattaaaagattactctttgtattaaaagttaaaaccagtcttaaaaagttaaagcatcaaaggtcttggaaatcaatatgtgactatgtgagtactgacatagtttgtgcgtataaatacacgtgaagaaccatgttatattttaatttttctagagacttcggaagggttacatatccaacttctatcttaatttttctagagacttcggaagggttacatatccaacttcttcacaagggttaggcaaggtgatttattgactcctgacttttcctgagagttaagtggacagaagaatgcagtttaattatgtatacgggaggacacgtggcataatttcagagtagccctggaaaattttgtagagtgccacgtgggccaatggcagcctggatgctgcaccctgaaatcgttatttaagatatgaatttttgaagctgtatgcctgcatgaccagaaaatagaaaatcaaaaatttccgttgccgggactcgaacccgggtctctcgggtgagagccgagtatcctaaccagctagactacaacgaatttatccgtcgatgtgtaaaaaggtctttcacatcacctagttttactttccctcacgtcaaactaccgaatatatttaccgttcttatatcagtagctatatttatgacgccatatttttcaccaaaaaatagtcgatatgtatttacatcgtaagttcttaaattacatatgtaattttagtgtatttataatgtaagtctcaaaattacatatgtaagtcccaaaattacatatgtaattttagtgtatttacaatgtaagtttcaaaattgtatatgtaagtcataaaatagtatgtaattatagtgtaattagtatgtaatcgtctatcatcacgcgatatatgtgtgaaaataatcttctctctcatggaagcacatgcagtgggaagcctgtgcggctgtgtgaccaataggcatgtataccgactgtaatcaacgaaaatttatggcgacataaatgtagcaaatccgtctcaaaaagaccaagtaaacatgtaggaatatcataaaccctctttaacgaaactttccgaaccaacccggcattaaaggggacaacaaagctatggctgtgttttcacaccaaaactaaaagtttggttgaaattggaatgatgtgacggaaaaattggaattttgtgtgtgtaggaaagttttgatgtgatgaaaaagttggaattttgaaaaaaaaattacaactaaacacggcctatatgtttgatcctttttcgttttctacacgatgcactacaggtctacagcaaatgcatcagcattcggtagcttcttcttcgcttcgttcatcggtttacgtgtcgaacagccagctagctgctcacaattaagcttgatggcgcacgcggctctcgtcagctggcgagcgccggcgcatgcgatgcgaggctgccgagcgagacgacgacggcggaaacgacgggggcttcgcttcgttcggcgcttgactcggatcgctccactccaattcgagcgcgaggcaggcagccaccgggacgcgacgctgacttcttccgtaatcctttctgacccaatcccgttcgtcctcgcctgacgcgctcccgtccatccagccttgctgaatccaaggagttgtgcgagtggacattactgcacgctagccc

SEQ ID NO: 7611 - DNA, 582 bp, Oryza sativa
  unsure (1)..(582): unsure at all n locations
nnnnnnnnnnnnnnnnnnnnnnnnnnnnnnnnnnnnnnnnnnnnnnnnnnnnnnnnnnnnnnnnnnncattattgaccacttgaaacctgttatttgatcaacacatagacatgatgttgtggaagatcaggtagcgatcagtttgtgtaaagatatatagtatagtatcaattagttgtacccggtgaacatgcatggttggttggttttaaactttgtaaatttggttgcaaatgatcagggcaagcatgcaaaaatgattgcggttgagtaaccacttcgttattaggactgatggtgtgcattatgctttcttgatatgactataacagatggccacatttctgtaggcacaatgatatgcataataacgtgtcgacgttgttgttgcaggtatgccggtgctgggacacggttttccgccgtacgggctgccgacgtcgtcggctggtgctctctctcttctgtcatcggctagagccaccggcccatggctgatgccgacgcccgacatctccggccgctcaagcgcggcgctcgacgagctcatcgccgagaaccgcgcgggccttctctcgtgg

SEQ ID NO: 7612 - DNA, 705 bp, Oryza sativa
tcctgcagcccattaattagctacttaatcactactagtgaatatatgccagctatattttgttttgatttattcaggtcttgccctttttttagtgaaatcgacggaagaaggagatgacgtcgttgtagacaaggtccttggcgcagacgccgatgacgaagtcggcgtgggcgagctggggaaggtactgcacggtgagccggtcgccggcgtggccgccgcggcggaggtcgtcgaggaggagggcgacgtcggcggggtcggacagcgagtcccggccgccgtagctgaggaagatggggaaccacgccgggatcgccgccatgtcgtacgccggcgggtcggcccccttgggaccccccgtacctggccacgttcgcgtcggcatcacgtagtcgtacttggtcagaaccccgtctctcaccgctgcatccagataattaatatcaaattatcatcaaattaacatgattggggttttgttaattagagggtataagatgactgatgagactagaatttgattggtttactttgagcgagatggatcaaggtttttgtggacgttggctggggctcgtacttgatgaagatgtcggctgctgaattgttcagacaatagttttttttttcccctttggaaaccccaaatttttttgcatgggagttagcatggagtgaaatgtaatgtagagcaaatta

SEQ ID NO: 7613 - DNA, 1147 bp, Oryza sativa
attcaatatgagagggtgaaaaattttaaacagggccttagctctgggtcatactccggacctttgggctttaatattttaaccatatcactaattaagtatgcttagtactgcttcatgtaattaagatttggggtctctaattgctaaggttctgaatagtgacggcaccccccgcactgacaccatacgacccttataccgatgatggaggttatccaatatacttcttgcgtcctataaaagaaccactttctaaacatgaatctgaacgtagaaccaatttctaaacatgaatctgaacgtaggttcttagtctgaagttgcttttttaataaaacgaaagtagtatatatactttctatataattgatacccactgataattattagaagctaaagttcaacatgcatacatgctgtatcatcatccacgtagcattactattatagcccatttaaaaacctatacaagcatgccacatcttcacttactaccaattactattctagcctattttaaatctcatgtaagcataacacatcatctataatattatactacagagatcaacaaatatgtgtcaaatcatcttcctcgcattattttctcaacattaactttcatcatttcgacatatttaacatatactcatacatgaatcccgcagcaaagcgcgaggtatcacctagttttatatatgttgtaatacagtgtactgtacgttagatacacagtatatatgtctccttacatctataggtttagatcgatcctactgttaggtgttgactgcctacaaagaccggccgttaatttgtatctatctcagacatgcctgtgtccgacttttggttcgctgcttcctcctttttgctacatgcgtgatttgccggccgccaatccaaattcatcatccaccgagacctatgatcgatcgatcaattggtcgattccacagtgcacgccgctgtgcctcgttagtgattcatggcctgcttagatcacactctaaacttttacatcctatcacatcaaacgttcaacacctgcataaagtattaaatatagactaaaaaataactcaacacacagattacggctaatttgcgacgcgaatcttttatacctaatcactccatgatt

SEQ ID NO: 7614 - DNA, 822 bp, Oryza sativa
gagcatagtgtctctgcccaacatttttttccacgtctagtgcactgtgtgcaccagtaattgacaatcactaccacattaagttgccatagactgggtcagcgtaaaaaaaaagggctactagtggatattgatacttagtagtaatcaatatttcaggtgctgcttgtgctaaccattctgctttaggaagaaacaactatatgaatgtagcatgtttactacagtgcagcgtcagtacagaaaatattatattatatttaatcacatctaaaataaagaaatggttatatctcagcatatgtaattttgaataaaatagtgtgctagataatattataatggattaatagcacaaactcaaaaagggagaccggagaaataaacataagcatttgcaaagtcaaacattttgagaaattctaaaccgcatagggaaagttatcaattttcatactaaaagaaaaaaaaacaatgttctttcacctctccgttcatttcgtatgcaagtaacacatcagcttcaggatctgttgcctgctttaggggaaaagaattgatgccttatagggaccacctttttcttcctagaaacaaatggcttgagattagttcggtaggctaaaagaacttctgcgggtagataaggacttacatactcactttgcacctgtcaacactgacaaactcaacatgcttgcctcctaaagatgtgactgagctgagtttaggtattccaactaggtcaaggacatcagatagctttgctcctccccatgttgctgggaacaatatgaaataagaaaacatagtacgattatt

SEQ ID NO: 7615 - DNA, 1287 bp, Oryza sativa
tcactttccgtaccttactcattgcagtcctcctgttgcctgcacactacaaattcgatgttgtatcgttatgttactaacaatgtcaatattatccatcagataaagatttggggagagggatttgtggcaaacctgtaacgttgcagttacatcatactttgggagactcctgcatgtgaaagtttgcatcaattctcaaaacaatattttgtttagtcataacaaaacataaaatgaagtacttacctaatgtcagccatggacagctgcacattcttgttgacaataccagtaatggaaacactgtatctgttgattcagtcaaactgaaaaaggtaaggtttgttacaaaacataatgataaatggcaacttatagttcatgctgacaaccttgagaggtcatccacaattggtatcggtccatggtttctcttgtagaagaaatccaccggggtaatataagatgaaactaatgctgatcgatgaggctcagcattaaatggttcctgccaacagttgtagtaaagtaagacttgctaactttatatatataccgtgcacttgtatactatgatagtgacagaccatatagaaaagcaaattgggttattctttccctcacatatttatcctaatgtacaatcctaatcaacaatgtaagagttgttctcgattggctggttacataataactttatagcatggaacaacatcacaatttgaataaagttctgacttagaaggaagattataatgaagataaatatagcttgtctctttcttatcttttcttttaagaatcagtctgttgtctgcaatactgctgaccaaggacaagcgcaaaagtatccgagcgtgttccaataaggaatcgacaaatgcgatagcaatgttcatccaagttattacgaaatatgtagaaaaaaaatcagagacttgtttacttcaatatttaggatccagttccttgtcaaaggtatattcagaaggggatcctctcggagagtgaaccgattaaacagaacgaaatgccccatttctatgtcttgcaaaacaatccatgaacagctgaagctaatctacacgacagaaggcccgcagagcagccttgtagcacagcacacccgagtgaattgtatcgtgaacaaacagaacaacatcgcaaaatcggctaatcctaaaacccacctgctttcgctcaagccgggaaacggagaatcggagatccattcgtccaccgagccagcgagcaatgacaagccaaactaccctacacatcccc

SEQ ID NO: 7616 - DNA, 1521 bp, Oryza sativa
cgatggatggatggatttgcaacgggctccaactccaagtgggccggagtttttttggttgtgtggtgatcgactcggccggcaattgcgaggctgggtgacggctgtcacttgctgacctaacattttttcaggtccatgacatgtgggccctctccaaatcctttgtgctgttgtgttttgctcaggccacatcgtttggcttttttactgataagacaaaacggcttattaaggaataaaaataaatttattggtaaaatttatatatatgtgttcttgtgacttaaaagctaatgctgtaaaagaaactccattgaaaatatctcaaaattaagtttgaaaatctaaaatttggctttttctttgactgtttaggccatccgatgggaggcctcaattgttcgttctggagcagaaaaccaggagaagtatttctaaaggaaatattaattcttttgcaataaacattatttatacattcggttcataggattcaaaagaagatttttcataggaaagctatgccaattctccaaaatgtactaattccatatgaataaaaacatccactccatcctctcgtttagctcagtgtagaaaaaattaatatgttccaatcattttttttgcacgtgcattcctacattatttctatgtttttcctattcttgtgattgggaaatcccgtgaaccgaataggcctaagagattttattttgcttgttttttcgcagggccggcgacgaagaggagcctcatgtaatgagatttagatagagttgttacaaattacaataagcactgtgaaacataggaatcttttatgtcgttcctgcgtgagccaagccaaaggatcgaaaagattgtaattgagtggattcttttttcctctgttttggtgaagggatagcaagttttactgtagttttccttttggtggattcctttggattcactgtggtatagtgtcaattccaaaggattgcatatttatgtactttaaaaaaaatcctttcaaccaaatgaggcttgaatcttcttggagaaaacaaggctcacagtacttgtttattactctcttttatcacaaacatttgatgttcggtgttagatttggtcaaaattaaaaactttgattataatttctctaatgcttagtttttttaataaaaaaaaggtatgcctagatttgcctcaaatactttgaaacttattggtttttataaacttattttaatataacattgatggccggatttttaaaggtttgattgaatattgttctaaatgtcaaatattcatgaccggtatttggcatgacaaattcaaaacgacgagccgcaaccagagtaaggccttcatgtctcaaacttccaggcccagcttatacacatggatcctcccccttagaatgtatcataatgtttgacctaattctttttatgataatcaattcaacctcaaacatttatgggtaagattttgtttttcaattatttcctttgaatcagtagaaca

SEQ ID NO: 7617 - DNA, 13974 bp, Oryza sativa
ttcgttgcgagatgtataaattgaatttgaacttgcatgtttgtggatgatatatcacatgttaatacatcttcttaattttttttacattttttcataactatttgagtgacatacaaacaacgataggatatcccctagagggatcaaaatagtttcccccaatatattattcttgcaataaccatcagttgatcacacaaatcttgagccctgttctggcaccaatgctggcctctagcattatacaacttcagaatacaaatttttgaatgctccttaaggataagtattcataaactgaacaaaaattttctgaatgttcttgcattagtttagtaactgggactagtttcatttgcagagatgcagtcccttcttccaggtcttgttcgcttcatttccgttttgctgtcgtccgaagattgaagcaacaatcaagcctcctaaacaaagttgggcttttttttagcagaatatatatgctctctcttttacgactgcattgtttttctaagctttttttaagaggactgatcgattccaactggtggcagagggggataatggggctaagcccgtgtatttccagcaaatgggcagttcgtttcaaatttctcaaacagactagtttggggtattggtggattgtgtgtttttaagtcagcttgttttttgggcaatttttactggacaaaacacaaacgagcttgatgccaatctgatccacaagactgggcaagagaagcgcgcgtgaggtcagcatgcgcgacacgatgctgacacgtgttttatctgatggccccaaattcggctgaagacacacaagaattcagctggatgatggctagacagtccctagctattatttaacttatataaacttttaaattcaatacatgtgtttagtatttcaagctgtgcacctgttccaagcagggcctaattaaattgtatttaggggaaaagtacatgtacaaaaggtttctatgtttctataatactcttacaaacgacgatgtggaacacaagggtgttgattttctataactccgagcaaactaaaaatcaaacggttataactatgtattttttcatcatgcattgcacagctgattcaattatgttcatagcaaaaggggggaaaaaggtgaatttgtattatatgttatgataaaaagaacacttttacaatgctcctgatatcaatcagtcccacttagatcccaacaagagggaaacaagaaaatgtacacacgcactgactactcttgaccagtacgtaaaacaatcacagtaataactactttatctgttttatatcataaaactttctagcattgtctacatttatatagatattaatgaatctagatatatgtgcatagattcattaacatctatataaatatgaacaatgctataaaattttataatctgaaacggaggtagtaataaacagtggtagcagcagctagctagctaggctaaaagcttaaaattaagctagtagcaagcagctgctggaggtgtcagcggatgcacttgcccggcgtggtccatccgaagcctccccggcgcctcgccgccggcggtgccgccgtgtagttcctccagtcgcggaggacggcggcgaggtcgtgcaccttgttggcgaggccggtgcagcagttggcgtggagcgtgcagaccctggccatgtcgcggctgagctggcagaagccgccgcagtgcgccgtgtcgaggaactgcatccggacgtcggcgcggcggctgagctccgcctgcgcccgctccaggacgtgctgctcgttggtccccggcgggaagcgccgccgcgcgtcgcgccaccgccggtagaagtccaccgtccgcctcgccgcgcgcacgtacaggaagccgccgttgggcctgttccggaggctctccgggtcgccgttgtagtagtcgttggccaccgcgatgtccgacgtgatcgcgatgtgccgcagcgggttccggaaccacatgatgtcaatgtcctgaataattaatgcactactattaatactactttcgagttacatgcatcggccagttcgccgtaaaatttggaatattatgtactatcttttgtagtaaatatttaacgtttaggataatatttgatcaaacttttaaaatttaaaccatcaatattttaccaaatgcttagtttagtttcgagaaatggtatacatcgaaaactactatcataattccacaaattacttttttcttagataatgagaaaatctttataaacttactacttcttccgtttcatattataaatctttctaggattgctcaaattcatatatatgttaataaatctagacagacagacatacatacatacatacgtacgtacgtacgtatacatatatatatgtatgtgtatacatatatatatgtatgtgtatacatatatatatgtatgtgtatacatatatatatatatatatatatatatatatatatatatatatatatatatatattcattagcatctgtatgaatgtggataatgctagaaagtcttataacataaaacggaggaagtagattttataaacgtattctaatatataaaattgattgttgaaaatataaaattttatccgaatctttgtcctaaacatcaaatgtgtttacgaccgaacgatgatttgagttgcatgcgatcgacaaccagtttatgctgtgaagtttgtccaggtaaggtgatcatgattattcataccgtgaagaggaagttgaagccgagctggaggatggtctgctggaagaggttgcgcccccacatcatgtcgaggtagtccttgctcatgaagcgcttctcgtcgctgtagtccacggcgccctccggccgccggaggaggtagcagtgcgggtgcacctggcggcaccgggcgagcgccgcggggtccatggccacgatgaggacgtgcttcagcagcggctccgtgccctcgccgagccggaagctctccaggaagaggtccagcagcgaccccggcgccgcgtacgcccggttgatcgacgtcatgatcaccgtcctgtcgtccatcgacgcgttcctcagcacctcggtcaattctgacaatgctttcatctgcaatcattattattatcttttttcagcctttttccattagatgtttcaaatttgaagatcgatcttgttgttttaagaatctgaactgaaagttagtagcaaatctttccattggatgttgcaaatgtgaagatcttgttgttttgtctaagaatctgaactgaaagttagtagcaagtctttccattggatgttgcaaatgtgaagatctatctcgttgttttgtttaagaatctgaactgaaagttagtagcaagtcgagctgtaaaatttcatagaaagttcactcgaatcatttggctgagttgtaaatgatgtaatatatcctatccccacaaggctgcttggacaacaggttagcatattcgttacctcatcagtagtcagtttcagctttaagcttttgggctctgtggatgtgacaaagctacaggaagcttatctcaggctaatgttggaaaagtagaattggcactttggcttgttgatgattggcttttaaaaaaaaaggaaattctagacttggctaatgctgtggaagatatctgcagcattatattggatatggatttgcttgtcgttgcgtcttagagacttatcagctcactgaatgaagatgtagatagaggaataatctaggacgatagaaagggagaccagtagactacctgaccactaatacccgtctattatgcatagttgcaacttccaactatttgcaacgaaatgaaacagtcccaattaattgcacggccattatctattagaattttgaagcatcttgcaagacaataagaacaagaaaattgaaatgaaaaaaaaggtataaaaaccctttttttattatgtaaaagtataattcggcattactcaaggaaactgcactgaagatgttctcatctcatgttcagaacttcagattgttaagcagaaaacgcagaaagcagcatcggtagatcactgacctcgtcggtgacggccggtggagaatcattgttgttccaggaggccagggcggagagcctccagttgatatccatagtagcaatgacgaacgccgccgtcagcgccgcgccgaggaagaaggagatcaccgggatgagcttgcccatgtcccctctcaccttgcaagccatgttcttggcttcttgctgctgctccctgaacaaggtgatcagaaacaagatggatcatcagagaagagttgtgtggtatgatttatatatgcatgcaacatgtagcttttaccactagtttgttggctcgtttgttacaagaccctgatgaatcccctaatgattttggtaaaaatcattaagttaaggtggatacacatcttgtcatatgatcaaatggtttcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatctctcagtacaagacctccaaggaagcccacaggttgagccttttctaaagaagagaattttttagccttaatgttgatgattagggggccttgaattggaatctagtacaaaagaattgttctgaaatgttgatattatgcatgataacaaaaaatcaggcatacaacttgcgagagtagtggaacgggaaagaatatgctgcccaaatgtccaagcaaatgagtttgtgcaatgccaatggatgaatcaaatttgcgaagctattctgacgttggaactcaaaaatgaaagatgatgcgtcaatttgaacaaaatctgtattaactgaatgtaatagctaggtagcgaagccattggaaagtcaaaaggagtttttccttgttgtcgctttgcttcgttggtatttgaaaaaaatgaaacgatattaaaaatcttttgcgtactccgtaaaagtgagttgtttgcaagaatttgaagggacataccaattggagaaataaaaagtcagagtcaatgcaattcaaaagacaaaaaatgatgccttcaattcgaaataaaaaccatatgggtttaacatcctattgaaatcctcaatagagaaattcaactccagattcctatgggtgattcgcaaaactgatattgaaacccaaaaggcacagttgatctctgaaaaactgaattcagaaatttaccgtgaagcagttcatccataacctatttatgttaaattctgttggaaacattgtcatgcaagtgtgatattattagtgtgaacaagtttgtatgtacggaatcatgtacgacatgcatgtaggagatgtattacttggtcagctatgatgcatgtgcttgcatgagttagttgagttggttaattagtggctgagccatgtgttcgatgcatggccagcagagttagtgcatgcagagtacgttgtggtcaaggtaattactactaatttagcatttgtatttaaggaggggttcaggaagcttctacagttgaggttgagtcttgaaataaacaggacaaaaaaaatatggtgtttggaaccacagaaaatcagtgtctattcatatttgcgttcatcatgtgtatacatttgaagttgagcgatcaaatcccaacaaaattcagagatttcagtcaaaaataaataaattcagaaatgtcactacacttgtgtaatgtactacttaccggccccaaaaccgtcgttttgtactttgtctgaaactgatgtaaaaacgataaattaaaacgccttccctgaattaattaatcacgacgatcaaacgacctcgtatcataacaaaaataataataaataatcatacggaattgtatgcgattgtgagcaataacatcctaatgatggtgattgaagatctcgaagtcaagagagggaggactcgcggttgatttacctaccgagacgggagttaaccgctcgcggcgggcggcggcggcggcctgcgacggcgagggagtggaggcgacgagagaggtgtgggcgagcagccaccgcggcggcgatgaggagggggtgcggcggcggcggcgtgccggcgtgggagtgcgtgtgttggcgagagacgacgacgccgcggcgccgcctttcgccctctcccccgcgtgcgcggttgggcttgggctggctcgcatgtctctggccgaaacggccgtaattgggccgcgtatcgaaggagttgggccgaattgacgtaaaccgagtacggctccgggccgaaactaccgcgttgctgggattttattgcgaacaaacattattattacctgaaaaatatacatgcataccaatataccatgctccctccaaatctaaaatataaattggacaatatctttctattataatatactctctcggttccaaaatataagtgccaaaataaacatttttaactttgaccgctaatagcaaaaaaataaaaataaaaaaaataaatcatgtaacattgatattactagattttttattaaacaaactttcataatatgcaactctttttatttaaaacataatattgttggtcaaagtatattttggaacagagggagcatccaataaacaaaaaatatatttctatttttattgcagtattttgtaagacaaatctatatatgttgttctagcgcctttaaactaaatatttttaaagttgttataatagttaaagttataaaagtttgatcttaatcttatccaaaacgttaagaattataaaaccgggaggattacgtgcataccaatatatcaatttgaaatatatacatgcataccattttcaaccctcctaaattttaacgttatcgatggtttatttagtttaaaggcctaatttttaccatatcaaaattaattttggcaacttcaatagtatcaattgaatgtttggttggctaccaattttgcacacactagtttaaattctatattgtctcaaaaaaaagtttaaattctattctatgctaaaacttgttaagattttgaaactaataaaattttggtttggcaaaaatttggctccaaacaaaacaagctcaaaatgcacaggcatcaccatgtttgcacatcacatgctaaaacacaactttatgtgcataattatgagcactagaatttacaatattatgtgtctacggactcatatcctctgcagcagcaacgtgcatatgggctcaaataagagtggagtaggacctaaatgtcagtggctttcatatctcgtagagaatttttgttcggcaccccttttctcagcccctctcactcgttttccgcacgtacacttttcaaactactaaacggtatgttttttgcaaaaagtttacatacagaagttgcttaaaaaaccatattgatccatttttgaaaagaaaataacaaatacttaattaatcacgtgctaatatattgcttcattttccgtgcttagtgcacgttgggagccggctgtagcgaacacacccagccaacaatgctgcttccacgatgcgcaaacaattgtcaggaccatatgcatggactttgcagtacatacatatgtaagtttcattagcatgcagttcaatcacaactgaaagtgaaaccacacggcatctgccgcattcaggcccgagaagtgggctctacatgtcacaaatttttcccttttttcacacgccgctgtaactagcgacaggggccttcaaaattcaacacccgaagtttttatcacagcagcaaacactaacacacgaaatcgcacgatttcggtacctccaatggtataccacaaacaaccaaacaccagtatatatctctctcacggtaatgttagctctaatgtgatcttttcacatcgccaaagaagccagtatcaatccctgattagtctgtaccgaagtagcgatcaccatactctcctaaccctgggatcacccggtactcctcgttcaacccagtttcgatctctgaggttacaatcttcagacgagggaatcgcttgcagacacaatggaccccttcaggagcctgttcatcgaaatgccattaccaagtttgcacaaaatgaatcatgtactatatcagtattaaccatgtcaaagagctggagtattttaccgagatgagattgagaaacatgatccgctcctcaggaactccactacttataagaagttctatagcttgatttgccgagttacctgtacagttgaatagttatgataagaaactttagctgtgacttcagtagttctcattccgacaagcaagcaaacatcactatgaaaggagcattggataaattcaacactacctgtaccaagcacaggatccatgagtagaacatgtcgttcagcaatatccaagggaaacttgtggtatatgagctggacaaggggaaaaacaaggtccgttcaaaatttcgcagaaagtgaactatttccatggtattttcaagaaaactacaaagcatttcacctgttgtccattgtccccatcccgatgtattagaattttgcctattttaatccccttacaacaagcacgtaatgcattctccatgctttctccactgcaaaacaacatatataccaagttatttcatgcagtaagtacataaggataaaaataaatcaaagaaatgggtcgtaagtctaactaaactacactgctggtcagcatgggctgagttatgagtaccaaatacatacccctccgtcccaaaaaacagaccaatcctacctacgaacgtggacacatgtgtatccaggttcgtagctaggaattcgtttttttttgggacagagtagtattgaataaagattttcatcactgaacactaaatcaatgtatacacaataatctgcaaaagaacttatatggtatagaaattcactcaggttttattaaccattaaaggaaggttcaacactagaagctgcagataatccaactttttttttgcatttgaagctattagttttcaggaaagcaatggcttaccttcgaataattgacacaccacagagcttcttacaaaagtcaactcccatgtaagtagaccctggacaaaagaacagaatgagtatgacgtcataaatgtgcaaccttccaacatttgtttacattaacataaatggacagtgctacgtgcgtgaaactgtagacaaccagtaattgcagcgctttgctttctctttattaatacaatgccagtgaagctggacctttataaaaaagaataattcatgaagtaattgggtgatcagacaacaatcttttagaagccccagattcaagatttctcttggcaatgaatattgaaccaagatggttagattcatttgattcacagctgcttacattccatatttttccactttgaatggagaagctcctttatcgccataaaattaaaatcagtagtaaaattgtaaaggggttattggagctcttgttgctccttgttatttttcaggacaaaagataataggtaagtgtttgttgaaatttagatgcacaactttatcattttagacctattttattggagcggtgcaaaaacatatttcccattgcttgttgcaaagacacaaaaatggttcttagtaaaaccaccatggattcaaatggctctgggcaaaaccataaacatgcaattggaaatgtcaaatcccacactttcataatggtatatatagcagatccagttttgccaaaactgtccttccatttctacagttcacaaacactattcttagataccatagaaacattgttaagaaaacctccagagcatatactaagttgctaccactaagagataattccaaacatacttaaggtgttactttttctttttctggctggcatatgctaatggatttatatagggcaaattccaagaacaaaaataaataggcgcaaagtataatggaaccagcaaagcacctgttggtgtaacaatctgcttctctgtgaaaggcaaatgccccagtccatgctcaactacctagcaatatatttattttccacatgaataacacatcaataaacagtcagacacattcagtagctatgtagaactagagaagggtacagaggccaaaaagaatgagtgctaccagacgaatcagacgatctgaataaaagacgaaatctggagttgcaatgtcccggtcgcgaataagagtatgcattccacgtatctgttaatcgagtgtttataaccatgggttgggaataaaataacattatgaaacttaggatcgagagaaactattgattgtacctggaaagttgtattaaccacataaacatttgggtagattttgcataagtcatgctgaccaagttttgtacgaatatgttgcacaattaaatctatggcaacatggttatctccccctcgcggtatgatcacatcagcatattttttggaaggaagaacaaaatcatcgaacgcaggcttcacaaacctcccatactacaattcaataaggttcatcaaaagtgtcattacatatgtattacaaacatcagggcatgcagattttgtgacatatttaaatagaaaaagactaaaataacatagacgggtgtttaaattacctgctccagcactgagatgacatctctacctctttcaactgtatcacgccttatacgccgggcaagtctaatatcggcatctaaattgatgcataaaatacaaagggataaaggtgaatgatcacaaacgatattgttaccataatatctattatattatacctaacaaagaggagcaacaaacctgtgtcaacaaaaattttcatatccatcaaatcacgaaccctttgatcatgaaaaactaaaatgccctccaaaatgatgacatctgatgcattaacctaagaaaacaaaatagtcaaaaggtttttaagcctaattaacaatcataattcattaggtttcactaccattaaagaaatccagaaaatagaccaacaacgacactgaacagaaaaagaaataccacccataaattattgccatggcgaaactagggctgggttggttatgaaaaaatttcatgaatcataactgctacataggttgagcaaggtccacagtagcttcttagacatatgatgtactctttatattgcatatccttatatcctttccccgcccacaaaaaaggtcactttatagtatactcttttagcatgtgtagctcatttattaatggagacttcatagtacactacttaactatgtgcctatagattcaatattttggcaccaaatttctagaacagaatgtgaaataaggcacaccagatgccatcaatctacataagacctttgcatacaaagttatcaaccagtaattaatcatagataaaaggtgtaataacaatagataaacaggaattatctttttcacaccaaaggtcaacaacgacattactacctttctaaaactttcagagcatcgacggtggttcttaaaatcatatataggaatatttacagatagcccacttttaagctgtcccatgcactctaaaagttgctctgtatcaaatgcatctgcaaaaaagaaagaacgaaaatatcttagtctcttcccaacgtaaagcagattgaaacctcgagaactcaaaaggcaatcaatttttatcaaatcaagcacctgggtgatcaaagttgtaatcttgcacacggtcagattcttcctcagttaaaccacggtagaatgaatcctgcaaaattgaaactttagctgaagtatatagaataattgcagaaatgatctatcagacatagtcaacaactagtctttgctcttttgatgaagctcttattcaaatgacagcaacttgcaagtacccagatcagcattcacccaactgagcaagaaaccacagccaaccatacaagacacacaactgaatacagatgcgaatatgaaagcaatttcatgcttctagcttgccaatacgcaggcaatgatttaatcaaatgcacattttgttcaagctgctccgaaagaagttcttttcacaacgcatttccccttttgacaacttgcacaaatagcaattctgcctgcttgccttaaagaaaagaaacaagctatgaatggtacagagaagaaaaaatataatactgcacgaaaggccctacatgtttaggcattaggatgcatacaaactgcacatacaagaaagtggagtaccatactcatcctcgaccttgactgttcaaatcatgtcatttttggacctaccgcatcacaatatgttccactccgtaagttattttgtactaacaacaaaccatacactgatcactgcaacaacggattggctgattgaacaaaacgctcgaaacacgaaatctcactactaggcaagcatatgcatatagcaaccaaccaagcagacatgatatgcatcctgacgatgcaacgaggcacaccacacctggttgacgagcacgacgcggtggtcgtgcagctgctggatgatcatgtcgcagaccgtcgtcttccccgacgccgtccctcccgacacaccttcgccaaccacaaccaccaaaattcaaaacaaacaccaccaaggattacgattacgagagagagagagagcgggcggaggagtgcgtaccgatcacgaagggctgcttgctcccctcctccgcggctgcggcggcggaggggggtggcc

SEQ ID NO: 7618 - DNA, 14898 bp, Oryza sativa
gactccatcgcggcgtccatctctccccttgctgtagccgccgccgccgccgccgccgacgtgatgagctggcgcgcacggtgcggaggccggaggttttgacacgcggattgggtgggtttttgggggacgcgtggacccggtttatgtagacccttcgccgagccgctgctgacgtcatcacgcggtccaccaaggataggtccagggatgtttcggttcgccctctctgtggactaggcgaggaggaatatgaggggtagattcttttttttttcttcttttgttttttttcccctgctctgcttaactgctttgcagaaatcgcagtcttgtgttgtgttgcagttgctggtcctgtttggattttgcaaatttgtttccttcccattgtttgctcgtgcgtatttatgagctaccagtattcagttttttttttccttttgtgtaatgtattcaatgttcatgaatgtccattgaccaaatttatgcgtttttcccgctacattgatacttccgatgctattactccccctctgtttataagtgcatttgtggtttatgtgtccaacttattttaccgtccatctcattttaaaatttataaaattaataaaaataataaaccacacctataagtattattattcatgtttttattatctaatatcaataaaaatactaattataaaaaaattaaataagatgttaattaaatgttggatatacaaaccacaaatacatttaaaatgagagggagggagtagtagagttaatgggacatgaatcctctgcagtactgtatttgcagtagcagtggctgacaaatagatccggttccacatgtcaatggcagctactacaagtgcagtactacaaacaatcccgacagcattggttgagctggtaacgccgtaagaaatactaaacttattatggatgaaaaaccaaggtagaaagaagcctaaaatcaaatctaaaattaagttttaacatttaagttttagttgtggttgataactaatacaccaactaacaaactggtatttttcatcttaaaagaatatcagggatatgccatgcaagttgctataattattaggccttgaaagtgtgattagtgcagacttgcagagaatggatggagcaggaccagcaggtgtgtcggtgcatgattgattagagattagtcactctttctttttttggacgaaagattagtcacattaaaaagacacaaaaatacatgtgtcttgattcctggggcgataggtttctgttcacacatcaaattatcaaatggacactgtgatctgatcgaaaatgaaataaacaatgactctgaactctcgacagacactgtggataagatcaagtaaactggaattaataattaaaaaaaaactacttggaagactagcatccaagtcatggcatcaagaattaatcgaatattataatgtaaatccaacgtggctagcatcaaattaaatctaccaaagcatcgagtcatggtcaagtgattaaaaaatacacgagacaattacgtgcactcatcaacttggttgcaagtagcagctactgatatagactaccaaattttcaaaaaagcaaaacaaaacaaatgggctctgtttctttttcgtcaggcctaaattgggccggagcaatgcatgatgtttattatctgggccgtaatttgtaatggacttcaaattgggccggagtaactgaggctggttgatttgggccataattcgtaaaggactcaaattaggccgaaaataggacttcaaattgggccgtagcaatggacgaggttgattactttgggccgtaattcgtaaaaggcttctaattgggccgaaaagagcccaaatcgccatagattggcctcccttctccgtcagactgaagtactgaagcagctggcctgcagccctgcacgcacaagttcagagttcagattttcagagaagtgttcgtgtggacactggacagtattagcactgaactgctgctgctgctccaatgtcaaaagggaggagaccagctagcgatgctctcatctcaattctcacctcatcttctccaagaatctcgcctttattctcgcttctgttgctgccttgcttgcttcatcagttcatctcatcgccatcgcaggataagtcaaacataggaccattctttctttcttccttttctttccttgtgctagctcgcttagaacagaactgatgggcttgatcaataattgagtgatatatgcagcaaatgcgtgcgtgcactcatcaactgcttggagggatcgatctctgctagatagatacatgatgtggatctgatcgatgatgcaaatgcttgcatgatcctaggctcatagctacacgcgtggacatctagggttcgaggctgagattaatggattcgatccatatccatgtcagataagcgaaaacttcagttcttctgacggtggtctgaatttttgcctgaagaatgaaacggaatgaagagttcagtgaggttcagaaggagaaaatgcattgattttttgcaaatgcaaaattggaaggttacagaaaacaattactaggtgaagtagtggattgattagtgccaactagagattgccaactgttggcagaccactaatcctttttgtaatggaaaaaccaccaatccttttataggctactctgttgatgtgtttctcctaattgttttctttttgtgggaggatatctaatgatggctggctagctagctaatctgaaaaaaagaatgaagaatgcacaatgcactaaccattgcaattacacgttttgcactctttaaacgataatgcacccaagcagtagtgccgcagaaacccaaaatcaatacactgatttcttttctgaataaaaggcaacaaacactgagatatgtgtcacctaggcactgaagaggattgagtgactggaccactatcttctgcactaaggaagacaggaaggtgtgaacatttgagcgcatatgttcacttctcctttttccaaggacaaagatcgagaaatgttcagttgttcactagtgcagagttcttgagtaaactgtactagcgcccatgctgcgttgcatgagttttcaataccgataggccatatacggtactcgtcgtatatatctatcttgttattgggtaggggagcttgctagctaatgttctacaccgctctgtacgtgccatattcatgtcatgatctgtataaaaggacaagaagtttggattggtaggacatgcatttttcttggctctttgtatggatcaggacgagaatgtagtattacagagcggtgcagatcacatagcttgttttctctgcaactgcatgatactatagtacttaggccgtaggccgtgtttagttccatgccaaaattaaaagtttgattaaaattaaaagtttgaagaaaaaagttaaaaatttatgtgtgttggaaagctttgatgggatggaaaagttggaagtttgaagaaaaagttaggaactaaacaagcacttatagagttggggtactcgatcgacgtgtatctgctggcctacttttgagtcaccattccccacctgatgaaatgggtgtaagatgagatgcacttgatagtgcaatgacaaaaaagttaacccgaaagtcttatgttcaatttctaacacgctatcttcttaaaaaaaatatttggagaacgtctccctctaaatcttgttttttttatatattatgggtgcaatatgtagcagttctcgattctatttgatagagcttcggatctagtttttcaagttacataaatttttaaggctagaaatattcaacttattcttaggtaaattcattgggacatgcttctctagatgttccatatctgttttccatcttgtatatgaaaactgtcgattcttattagatcttcgagtaatgtcaaacaggttcaagattatcttttatatccaacgttttagacctggactgttcgtaagtttgtttatccggaaatgtgaaatgcaacgtgtttttaattattcagactaagggatcagatattcagatgggttgatgggttgcatggattcatgtctgtttctcacctcctccgttcccggtggcgtctgaacccaagaaaacaggaggacgacctgatcgatgatgatactgacgagcagagtccaccacgccaaactcaataaaaacatcacacatgggcatacctttcccagcaattcggtgaacacattatcatctaaggtctttcgtctagaaaacattatagtgtggatatttcagaaattaattaaaagcctcctcttttcgcttatgtttatgcttatcaaccaaaatttaaattttcaaccttaaatttgaaactaactttggcttttttttcatagaagtttattttcagcctttacttttagatcgataagaacatatatgtaaaagttttatttataaattactattagtttataaatatgttgtttggcttattccacaaataagcgaaacaatgaggctttatctgatttctctacaaaagattaagtcttagctctgggtttcaggaagtgctgctaatggtgaagagttgttactcttataaaagcataagcatatatactcttaaaaacaagagttattgcttagtatttaaattaattgaatttcacatagttaaaactagaattaaaccaccacagaaacagatcgagttactactaacagtaattaaatagcatttgaccgtgtgtcattgttctgaaccctgaacaatgcgtgtcacactctcacaggccacagacagcacgcatatgcatcaggaacattatggcggttataattaattaattactcagaattaatttaccaagtcaaattctttacacacgcagtaatgcagttaattacagtgttatgccgaatgaattttgttagaactaatgaaccgtatcgcccatgcatgtacacccattcccagatcagaactgagctgagctgctagctagcaaggtagccaggccaaggtgtcacgctgaagaaagcaaaggccaagaatatatctcacgcactgggggtcgccgcgttcacacggcgcagctcaccgcaacaacatcactagctgagcagtgaccacttttaaatacgcatgcgcccactcctcgatcgctcgcagcactgagctcgatcgtgcgcgcgcgcgcacgacgcagcagcggctagtggcactcagagcgcgccacggcgggcgccagcatgagcaccgcgtgtcacggcgttcgcggcttcttctcgatctcggcggcggcgatgacgatcgtcgtcaccaccgccgtcgtcctcctgtccggcccgcagctcgccgccggggcgcgcgtcctgatcaaccacgctgaactccggcggcgcgacattgccaccgccggcggcggcggcggcggcggcgacggcgcgtgcgcgacggccgtggcgccgttcggctacccctgcgaagagcacgaggttaatcaatctcgtcgaacacctttaaacgcgcgcacgcagaacgttcgcacgcacgaatcaaaaccgtcaaatctcttttgttttcttcttcttctcatggacaggtgacgacgcaggatggctacatcctgggcttgcaaaggatcccgaggggacgcatcggcggcgtcaccggcggcggcgcggcggcggcgcggcagccggtgctactgcagcacggtgtactcgtggtacgcatcacgcacgcatggcacctaacattctctctaatccgtggtcgttttcttgccaatctcacatactttcatgtgcttagcaccacgccatgccggtgcacacgtattcgtctcatcatgtcgcccctgtttcattgcacctttcgagcttttcttagctttacagacaactttgtctaaatttaacccaagttcgtacgctttttcgtagtttgggttagtagaatagaatctgtgtccaagaaacctgatttttggggggtcggtgaagaattctccgaactccgtttgggttcacaatatccgttcgatggagaacgtacggacaggatagtccaggatttttagcatctttgaattaaagtttgaatggaattaaacaagcttgaggaattaatatatatgcatggatgcttcttttcatgatatcccagtgttagtctcgatcaatatggaatttgcagatatgcatggcacatggttcggtgctcctgtctccttctagcttctgctgcggactagttgcagcactcatggactttagctagcccatcacttgcatggggtctcaaatccgtacaccgttgtagctagctagaaacatgagacatgctacgagcagtaatacggagtatatcccaaaatataatccctccgtcacaaaaatataacaatctagcactaaatttcctacatccgaatacttatatgtccagatttgttatactaggatacgcctcatccattaccatactgttatattttgatatggatagagtaaaatctttcagaccagttagatatggtattaaaaaataggtaaaattaaatagaaaatattgtgattggttgagaagagaaagcagatggagaaattaaattgtaaaaatttatgattagttgagaaaaaattggtggagaagttgttatattttaggatattttaattttgggatgaagagagtagtccttaaatatgtacagcacggcacgcatcacagttttatattgtcaatttgtgttatctcttgatgcatcatttaaaaaatatcaggagtattaacatttacattagatggtgcaataactctcgagaccttcctaaagattctaaaaaaaaaatctcaaattatatagagtatatatatgttatatcgaacttgcagattatatatgcacaattggtgggtaatttgttgtttgcgaatctaattcttgctacaagttttttttctgctgattgagatttttttttaaaaaaaccgaagccagactaagctggtgttatattaagaaggagagaaaatatttacaaggtcaccagataggtgagagaaacaggggagggggggggagaaaacatagaaaaaatacacacactctaaatgagagctaagcggatattcttgtgatgttttttcgctccacacatgctccatatcttgatttcatcttgtattttgacgagtagttgtgacatggttttctcttaattttgaaatattcttctgtttcgttcacaccatatttccgaaatatgccaccaacaagtggattgacttgagtgctttagctttgctttttcgtctgattgagaattaagtggagtcagagagccgttaggacaatttacaatgatgtttactagtagtaatgatgtaaatgtatggtcagatatatagtacgtatgacaaactaatgaatatacattcatgcaagaatttactcctagtatctcacaatcaaacatggataatagcaagatgcatggttcaacaagaagcaatgataacagttccgtactacactattttgcaatcaaaacatactctccatctgtggtgtggtacgattattgattagtatggctatcaacatcactactctctctattccaaaatcccaaatttcattgtactacattatatctcatcccaatagattgatttattttgaaacggaggaagtctctcttatccggtgtcttcatgcatgaacaatgggcacataaatttcaaaattgtcaaaatacgcatcacctaaaacactactatatttggtcataaatatttaatatttaagataatatttggttgaactttaaaactttgaccatctatttatgttaaaataaatttataaaatctaataagtttatgatattagtatagtacttttcaggataaatatacacatacttctttatcctaattttaaattaaacatttgagaaattaattatagaagatcaagatttcaaaatgttgaccaaaccctgtactaaacaccaaatatcagggaatataataaattgttcgtgacaaaacattaatgctaaaaccgtcccacgttaattagttgaaaggacgtacaaatctaagtaaaaacaatctttttcatagtacacaaaaagtgtcataagcagcccaacaattacatcgttcaatcgaatactccatgtaatgatgtaaggctgcgaaaactgtcactccatcttgttgagctgaaatatctttgtgagtggcaggatggcatgacatggctgctggggtcgccggaggagtcgctgccgtacatcttggccgaccagggcttcgacgtctggatcgccaacaacagggggacccgctggagcagccgccacgtctcactcgatcccaaaagccgggtaattacttcaccattaatcacactctgaatctctttactgcttgctaatcagaaaagatatgttctaacttgtactacaaagtaatcttatatcatatcctagatagcaacaattttttttttgggaataaagatagcagcattttaaaccggatgtagtgatattaactgcaaccctgcattgcaacacggtcatgtacactgaagactgaagtaactgatgaccatctcttctcatgtcagagctactggaactggtcatgggacgacatcgtggtcaacgacatgcctgcaatcgttgactacgtttgcagccacaccggccagaagccacactacgttggccattcaatggtatatactaagctggcaaattaaaggagaattcatcatcatcatcatcatcatcatcatcttactgtaatctgttgggttgaaaacgtagtactctgtttttgttgttgttgttgcaggggacgctggtggcgcttgcagctttctccgaaggcaggatggttgacaagctgaaatcagctgcgctgctcagccctgtcgcgtatctgtctcacattaccactcccattggcgttgtgttagctaaagcattcgctggagaggtaaaaatccatactgaacaaacaatgttcttcatgcagatgctgcaattgcaatgttcttacagacatattttattttctacactgaactctgctctgatcaactatatgttccaaaactgcagctcatctctgatctccttggcatcgccgagttcaacccagcatcgtatggccggcattctcgtgcctttcagacaaataaaaatcatttttacagcttggaatcgtctccggttgctatggagctgacatattggtaattcacttctgtctaatgcaggcctcaagtgtccaacttggttagaacgttctgtcgtaagcccgggatgaactgctacgatctcctcacatctttcactggtaattaatcaaggattagtattttacctacctgagttaatttgctctacattacatttcactccatgctaactcccatgcaaacatgtcaggaaaaaactattgtctgaacaattcagcagccgacatcttcctcaagtacgagccccagccaacgtccacaaaaaccttgatccatctcgctcaaagtaaaccaatcaaattctagtctcatcagtcatcttataccctctaattaaccaaaccaaaatcatgttaatttgatgataatttgatattaattatctggatgcagcggtgagagacggggttctgaccaagtacgactacgtgatgccggacgcgaacgtggccaggtacgggcaggccgacccgccggcgtacgacatggcggcgatcccggcgtggttccccatcttcctcagctacggcggccgggactcgctgtccgaccccgccgacgtcgccctcctcctcgacgacctccgccgcggcggccacgccggcgaccggctcaccgtgcagtaccttccccagctcgcccacgccgacttcgtcatcggcgtctgcgccaaggaccttgtctacaacgacgtcatctccttcttccgtcgatttcactaaaaaaagggaaagaactgaataaatcaaaacaaaatatagctggcatatattcactagtagtgattaagtagctaattaatttggaggtctgagaaaattatatatactagtatagttgatatacagttacatgaaagatgataaatggaaatgggaccaaaattttacaatagaataagatatagagagatggcatttgggccatatcgattttttttaattttttctaagatacttatatgtggcaatgcgggtcctgcctattttaattttattttttttttccaaactatgaatgccatgtaaacgttacataggcgctgcgatacataaacgaccaggtctaagtgctaagcaagcgcctcgtagcatgaaacaataattaaaactaccgaaacctaaattgatcaggttttaataatagctgagtgaatatttatagttggttttgttgttgaaggtcgtaaatttatagtatagggagctgcaatggattttttttcctatagtattgtcatgggaagtttggcccaagaatgaccacccacagtgacggatctagaaaaatgattcaccacccatccccgttgcaaccggagccgccatcaggttaggttgttgccgacgcctccatccaatccaatagaggaacgtcggcattccaactgccatagcagcaacaacaccaccgcgagacaccatccggaacgggaacaccatcagcgtatccctttccctcacgcacccacgtgtcactcctccctcttcgtccacagttgagaaacacctagggattttctgggccttccggctagcttcacaaagtggtgggctaaacgatctgggttcgaagtctcacctcttataattatttgatattaggtcattccctaatattcaatcttttttttttcttcgtccacagttccgacatgaacctcaccatgggccacaaggtcgtctacacgacgaacaagctctatgagttcatccgtaattatgttttagacttagttggcgcttacaacctcaacaagcattcaccgagaatacaatcgtcatctcatagcttactaactactccctccgtttcacaatgtaagtcattttagtatttttcacattcatattgatactaatgaatttagatatatatatatatatatatatatttatttatttatttattagtatcattatgaatatgacaaatgctagaataacttacattgtgaaacggaggaagtagtaagatttgaccgaaaagacagtattaatttagtgtttatgcgtgaattattgaagcaatttattgtgtgaattatgtaaggttaatttatgtgtaatgtatttgaatagttaataccattatctattctatcctattgtatgtctctattatagacacaactaggtgattctctgcactttgttgcgggaatttctaagcaattttcaatatattttttcgataatcgagctaggagttaaaaaaaacaaacgctagagtttatcagtaattatcatgaatcaaacaaatgatacccacgctttaatgtggaacatactaattaatataagttaaatattataaaaaagatatatttattaaaatattgtggaaatgatgtgagagatgacgattgaatatgtttgcatgttgatttatagaattaaatagattatatatatgatgttgcatacttgcatgagattaaatatgcaattattattgtgagtgggtgatgatgtggtatggttgtatgttgaactttagtcttagtgggttgtaactttataaaatgtatagatgactgaaagacaggaaaaccaaccatgcatacattggaaatgatcatcaacaataattgtcacctttgagtattgccgtgtggccgcgcggttaaaaagggtacctataaaaacctagaggtaccgatttttcacaataggcacatttatgttgttataggtgccagttgtaaaatgccacatcagtgtcgtcttacgggtactggttatgaatctaacaccgaattgaaagccggttttcaacccgcaccaaagtggttttatgtagtactgaatcatgatttagaaaccatgcatcaattaacatgacacaacaaactaaaaattaacggagatttcgttttcgtcaactatatataaacaactccctacgtaaaaatgacctcatgctttcctacctagacattattcatgataagctcccaaccataatgtaatctccaagcagcaaagattatcacaaatgcaaatgattggttatggtagtcaatgtgaaactatggtatccttgcaagaatcatgatttagaaaccagcaacatgacagaaagaaattaagctagcacatacgtctatatatcatcaagtgacagtagtggtgaggagaaataaaggggaataaggaagctaaaccttggacagacaaaacctaggttaactcctcataggtcttaattttaaaacctacaaatggcaggttgtcctagctacgtacaatgtactcctttcgtcccaaaatataaacatttttagcatagcatcaagtcaaacatttttaactttgaccattaataaaaaaaatagaaaagatcaataatataaaattgatgttactaggtttatcattaaacaaactattataatatgcaactcttttaaatttaaaacaccttacttttatagatattgttgctcaaagtagcatctcgaagactatgacaaagtataaaggtgcttatattttaggaccgatggagtggtcgacaaagtttgccgtggtaaaaaaacattggctcatagtattacactgcacgtaaactaattaagacctatgtaaagtatgctatatatgacaaatcttaattttcagctcatctaatctaactactcagcacggatgagcattagtgttagaatcatgtgtgatacgtcacgatattatacatatgagttgcgtctgtcccttgagaaataagctttcatattctcaaaaccctatttataatgcacatgaacggtgagaaataagctattcatcttctcgaaaaccctgtttataatgcataaaagtccatttgataagagaaactgcacatctatattatcttaaaaaatgctaagatgatagtagtggtgttgactgtgttcgctggtggggagtttagaactaaactctccgcacgaaaaacggagcggtccattagcacgtgattaattaagtattagctatttttttaagaaatggatcaatacgattttcttaagcaactttcgtatataaacttttttttttgcaaaaagcataccgtttagtagtttgaaaagcgtgagcgcgggaaaagagaggggtgagttgggaaaggggattccgaacacaccctttgttatcaccaccatccaactatcatatggaacccacgaacaatgagaaaagattttatctgtccctatgaccaacttaacatatacttagaaagtgacaacaaaattagcattacgataatttattagacaatatatttttatgtacttgaagatatatgttatgatcttttttttaagaaaaaaacgtttcaacgcattgatagtatgctattaacataaaaataggggacggatatatttgaaaccatgcactactacagaaaccatctttgctgggttgaccaaaaatcacaatagtcccggtttgaatagaaaccgggactaaatatgattttttttcccggtttaaaactctatcagccctagatgatttttagtctcggttcattttctgtccgaggctgttagggggtcaaggatttttagtcccagttggtgtgaccaaccaagaataaaaattagtctttagtccatatatagtatataatccctaggacttatccccccaaactcctcatcttcctattcctcctctctcttatccttttctttaaagccgaacttatcatctccttcttcctatcggtgagagcagattgaggagcgagagcgagcgagtgaggccggcgccgggagggcaggcggtcgggcgggggcgggggcgggggcgggggtgcggactgcgggcggcggcgtggccgcgtggaggccggccagcgaggagggctgcacggcaggcggcagcctatggctctaccgaagggaaggcgggaggcgggaggcggcagcaatggatatgtgattttttgagaatttgtgattctggatctgagatgtatttgatttgtgtgtgatgcgaatatgtgatgtatttgtgatgatttttttagaacttgtgatgtaatttttttagaatttgtgatgtatttggagatatccttttgttttgtgatatgtgatgatctatttaggttttcacgatttggggatgatttagggatggagtgaaatcaatattcaatgttaaaaacaatgaaaaaagaaaaaaaactagcaatcggacctagcctggctccatctttagtcccggctggtaatcccgattatttcacccgggactaaagatgatcccggattcgtggtcctggttacataaccgggactatagggggttatcaaccgggactaatacccctttctccagcagtagtgggatgtgtatgcagatatacgtacccatctatccagaaaattttttcattattttttttcttcgaagtgttactttttttttctcaaagcatgcatgctatgttccacagcaggcgcacttgggtaaaatagacatatcacaaaagtgcaaaacgtattagattgctcccatacctgtttttaatttgcaatccacaggtaaaacaagcggtatta

SEQ ID NO: 7619 - DNA, 3028 bp, Oryza sativa
  unsure (1)..(3028): unsure at all n locations
caagataattcctagcaactcttgttatgtgataatttcatattgttgcttaatttaaagtacaagtcaattagggaagtactagttttcaaaagataaatcagggaagtactattgaaacattttataatactaacaatccatattgcattttctgctctacaagaaggcagtaccatgatggcctataaaagggttaagattgatcataaatggagacaactcaaacaaaagaaacaaagcaaaccacacacttagaagatcatgtggagtggcaagaaggcagcttgtatggtggtggccatgaccacaatactgattctgcagctgacagtaacacaggtagtattggcaatccgctcaccacaggaggtggaactagatggtttcattactacggtaaaatcagactgccttactgtctcccaaacggaagtggatcaggcttggacaccttgcggggaaacttgtcttgttttaccatgttatacagctcggattggctgtctatgtgttaacagcgtatgtatgctacctgtgcctgcgaagtctgaagtcattgcatgataaccgtccgtccgcctccggagtcagaagtcattgtattccatgatgccagacttgccagtcttgtctagaatgttttaagtatgttgtttgcttataattaagttgttgttccatgccatatgtatgatttgctggggggatatggaaaaggttgttgtacactatgtttggtgattgaatataggggacgcgatggatgtgtatgagttgattggtgcaccttttgtctcagcaaaatgtaactttgtcattcaatccgtataagtttgttaccaggagcattcgattttttttttaactggagtattcgttgttggttatatatatcttatacaaaacaaaagaagcaacgctagccatgaagtggtatagaactactgtgaaaccaatttgtgtggtttttgtttttgatggaaaattggtatttatctgagcttagattggttttgaaatatcggaggagtcagcagggtttacaaattcaaagaatggatcatgagtgcatttgcttaagaatccaaaaatacaaattctgaagaatttttaaaagccaagagtttgtcagatttaataaaaattgaaaacaaagtgatcttgagctacaaacactagacaagataaatttaactagtcaggaagctactgtagtatttgctcaaattaataaccttctttgcttgttcaatttttttaaggtaaagagagttttattgattttaaacaattacatcgagttgatacaattaaaaaattaaaaataagtactccatatagtcctcttgttttctcttccgcttcttcatatgtctctctttacttcaatccaacaagtagcagacaaaggagtgaaaccatcgaccagcacatctcccctcgccaccccatgagtaagcatatactccctccctccgtccctaaatatttgacgccgttaactttntaaacatgtttgaccgttcgtcttattaaaaaaatttatgaaatatgtaaaagtatatgtatatataaaaatatatttaccaatgaatcaaatgatataaaaataattaataattccttaaaatttttaaataagacggacaatcaaatatgttttaaaaaattaacggcgtcaaatatttagtgacgtagagagtatatccatccaccttccaagcttccacaatatggaagccatggctttgcccgagctcgccatgcatgaagtggagagctccacgatctttctctctccctccctttgtttcagaacagttaataactatgtcatcctcccctcttggcctcttctcaacccttcttcaccggaaaaaacaaaaagagagaacatattctataccactgaatttatcataggttaataacttaccattgactttctctctttctatattatactggcgactttatcaattgttctacaatacactattaggctgggcttatttttcaataatagcaaaaatacccttatggacatacaagtataacaattgatttatatcattagaagttttaaggaaaaaataaaacttttatgtggcctccttaggtataaaagtttgtctataagtttcaatttttttcatttctattttttaaatataacttatttgttatatgctatataaaatatttttgtgttgttggttttaatttaaattatctttcatatgcaacataagatattttttgctattttcttttgtgtaagctatttctctctgatataccacacaaaaatatttttttctaaaaattaaaaataccaaaaacaaattgaaactgatgtacatacttctctgttatgtaaggatgccatataaaatattttatatttttttgaaactttctaatgagataaattaattgttaaccatgtatatctctaagggtattttgggtattttttgaaaagaggcttatcccaatggtgtattgtagaacaattaataaagccgtcggtatattttagaaagagacaatgtcaatggcaaatcgttgaactgtaataaactcagtagcatagaatagattcttaaaataaaatactgccttcaccaacgcagagccgtatctagcatattgcgagattgttgcctcaaggaatgatgaggattaacttgtaagcatgtttgcaggcagacgtgtacaatcatttctctctctttttttttcagcctttggctacgtaactaaacctcttctattaatactagtaatgtgcccatgctaacgctacggcgatatttagtaatgacaatatatgtgtgagcatgataatcaatttttggcagattggcacggaaggttcgccaccatgtggagctattttatcaaacgaccacaagtgatgaagataataataaatgcacatataaaaagatatgatgatgacaaagttcattttatcacggatttttctgcttaaatagtcttaataatatcttgaaatgtt

SEQ ID NO: 7620 - DNA, 6393 bp, Oryza sativa
tgcagccctgccttgctgtgaaactttgctttacaattccttctaaacactgtccttttttttttgtcatcgggaacccacaagagttctttgattggtatacacttttctgttatcactatctacatgtgtacttacaacacccaactaaatatattgattatatcaccaattatttttttatcataaaatattaggggaagcccctacgtgtattgattttataaggtttatttacaatgtctcatcatacctaactataattaaatgtagacttagatcctccttattctacaaatgaaaactgataacacggtgcttaaaatgctgaaagtttagtttattgtgtatattgtataagattaattagaagcacataagatctaataggcactactgaaagctgtagcaaaaaggaattactttgacagttccttatctttttaaatgcacaaaagcaatctgtcaaagacaaaggaaattccttttttttcttgtttttcctcttgatttatgtaattatgtcaggtcattactaatttgaatctgcaataatgtagttcccatattttggagatatacagatagggtcctacaaatagaacaaatcttcaaatagagcaatcatattgtatacacctaatagatttgtcgtcgatattatttacataaatatcattcagtttcagggaaatgtcaagtacagagaatcattaagagcttgtttttcagttgtaaattcagatttcagatacattcaaaatgatttaattttattcttttacttaaaaaaatgatccatcttataatgctatcacaactattttatacgctctacaagggtccatatgttacttcaatataaggatgcaatcatgaattcatcatatacaatacctctaagtgattcaccagtgatcccaaccctacaaggatcaacatcctcccattcactgagatgatctccaagctttatcaagtcccacacctgaagatgtccaaatttggcactgcagcttatactatacctgtgtatcaagttcaaactatgatatatcagatcataacatcagaaacaattgtttgagggaggcaaaacaaaatagcaaatccaggattcaacggaaaatcctaatacagtagagcgcaatgatgctatttcgtctgggctaacaccagcatccatgacttttaacccatgaacagaggcagaccagctcaaatttacagcatattgtagagtctgattaaatattttggatacataaactcctgcttatatcccattcctccaagctgattttagtgcctgtgtttaaaaccatgaaaataagaatcaagtcaaataataaccatgaatatgattttcaaacaatcatgaaaggattttgagtataatacatctatgtaagtgctgttcttgctagctggccctttcaccgtgatagcaagaattgatggcaacatagattttttttaaaagcaacaactaagagtttttttacctcaagcagtggaggcagctattcgttaagtttcagaagaagcacaggtacacgcccttgttgaactaagtattggggggaacaatatctaattctgtaacttaggaaatgagctgatgaatgaagccaaggaagtgtgcattgtctcccaggttatataatgtaggtacagaatagtgcatgtgagcctggatatcacaatagaacataatataagcatcaaactgtacacaggtggccttttcaggaagagtcatggctagaatagcgatgcattattcactccatgagtgaaattcatgaatttcatatatctttatccaacaaagttggtaatgaaaggtacatattaagacaataaccacattaattatttgtctaaaattttaagcaagaaaaatcacaaccaaactgttatgatccattttactttggttcttctacaatctctcagggtggctcaaatcaaactcaccacaaagaagaaaataaagtgcttgtagcatccccttcactaatagtgatcgacatagcaatgtatggctatgtacctcagtaataaggtagaaattttcttcaaccagcttctcgtggaagttcctcacctccttcctcgatcatgattgcatggcctgaaattttgcacacataactaagagccagtgccaacaaccctgctcttacgaaaaatccttttctccaatggaggatccggacctcgctctgccccatcaacggcatcccctggtataacgaattaatggatccttcaccggagccccttgttccaccgtgagaggcactggcatgaacaaatccaaagccaaacccagccattgatcaggacactcaaaatcgtaatcccagttgctaattaagcggccactctgtagattgctcacactactccacatggcagagggaaaggaggagaccttggatgttacagcggcggctgaggaggacgtcgaggaagttcgcccagagatcggcgccagcgccagcggcctccgtttttctctctccgccgccgtggcggtggcggtgaagtgggagtcacaggtgttgaatgtgccgtttggcttggagcagcggcggtggacttgccactcaaccactaactccacagaggtagcgctggccgcacgacagcgacggtgggttgcccgaggaggagatcttcgcgtctacgatgccggtgaggaggatgcgatattcctggcgccggcagggatgacccatggcgatgcgcagcatggagggctgcccacagcgatggggacgacggacagagggttggcgttccgatctggacagcgtcaccggtgagttggctgaggaggagatcttcgtgtcccgtcggcgcctcggcaatggcgatgcttctgttcgagtcggatcgaggggcgcggtgatgacggcgatggtgaccggcgtaggggcggcggactggacgacagagatcgcgatcggtgtacgggcggcgtggaggcggcgaaccagcgaggacgggaagatccaaaggggagagggaaagtgggaggtgcgtgaaagaagccccggtcgggatcgcgtgactagcacatctggcacccggcggcggtgaagtgagggggtgcggcaagaatggactgggtgggggaggacggcgatgacggcgctgggtcggcgacgtggtggggggacggcgatggcggggaggatggaaggcgacggcggtggatacgatggatccggtggatgcgggcgctgagatttaattggacgcagcgatgagagatggcgtacgacatggcggcgatcccggcttggttccctctcttcctcatctacggccggcggccccgccgaggcgccgacgtacgtcgccctcctctcgacgaggccgcagccacggccacgatggcaaccggctcaccgtgacctcgtctacaacaacgtcatctccttcttcggtcgctttcactaatggccggtttggttgaggggagtttctaataagggattggaagtttgcagggatgaggctattaactgttttgtttggttaggagatatgaaaattttggtgggatagggatggggaattaataaatgaactctctcctttttaatacctgggtaggggctagtaattgggacttgggagggaatttctcgtttactttgcctaaacaaatctcaaccactcgttttcattaatgacctaatctccaactaaactccctatcaattttcaccacctctaccaaagaagatatcgggattaaaaattaaattctcatcttaatctcaccataattctcttgtgtaaactccaaatcatcttccctcaagttaccaaataagctgtaagctcttgatcctaatatcccatcattcagccacaaaaaggaaagaggaaaataattgaagagactaaaacacaacatagttggtattcactagtgattaagtagctaattatattttttaaaattacacagtaaaacgtagacactcacaacacacgcacactcacccttatgaaggcacgcacgcataccctacccctatgagcatcttcgaagactgggccggcaaatactagagattaacgaagtcaccatagccacctcggtgtcgacggatacgccgtctaccactgaaagcacaatgttgttaaatcctggaaaattcgcacctatggagagtcgaatctataatctaaggtgttacagaggctgaggctcttgtaatcattagactacaatcaatttgagagggtgagaaaattatactattagttggtgtatacagttgcatgaaagatgataaatggaaatgttaccagttatcacttggacgatcgtcctactgtgaataattttttacgaggaaaatgtccatcatggctccatcaactattggccaattttagtttgtatattatttaaccataaaatcgggtataccatctcccttaaatattaaaactgcaaaacacaatttgcacaggtatgcccaaaatagtcgaggaaatcattttgcgctatttttatatgtttgttggagatgatatacccaattttacggttaaagtatatatatcaaattcgatcaatagattttttttattacacggtaggcgtacacgcgtaaacatcactacatacataacaccacactcacacccccactctaagaggcagaaaccagtagtatatccctgatttcactaaacctcttgaaacttgaaaacacaccagcatgttcgtattatttttaggcaccagaattcgttgaagaagttaaaatggaacttttggcttttacaatagattacactaattgtgccttgcgttaattgaattagcacgggaagctcggcccaagaatgtaactgggccacccattcccgctgctaccagcgccgccatcaggttaggtcgccgtcgcctccatccaatccaatggaggaaccccggcggcgtcccgattggatcctcttggacaccaccgccgtcgccggccgccacagcggcagcagcaccaccaccaccgcgcgtgagagacagccggaggcatggattgctgctgttgatatgaagaatggctgagtgcaagctgtggagaagttttgtgatttttttttgccggtatgaccaaaggaggtaattcaatgtaattaagataggaagaaaaagttacaagaaaagttttacatcgacaactggttgtcgagtaaggatgtgcaccataacacacgccccgaaccatgtgccaactgcccaaacacacgatacagagagggaaaccaagcaccgaacaggccatcgttatgcgagaccgatcgccaccagaccaacaacaccaccacgacaagaagactctaaaacgacgccctcataagggtcacgacgccgaaagacgccatcgtcatctgtccaaagaactggacaaggtttttacctagagctccttgcccaggggtacctcaacaatgccctcaggagggttaccacgtgtcacgccctgaagttctcctttttagctttaaaatttgttaaataaatcgcctaaataaattgttgaattaacctagagttgaatccttaattaataaatgcaaataatcatcggaatcggcatgtgaaatttttcttggattctacatgtcaaaatatgctaacaggatttttagtggaatttttagagccttggaaataattttaaccaattaaaataagcaaagtgcaatattaaattcctaggaaaatcctttttcctttttatcttttcttttccctcctttttccttttcttgggccgccggcccatttcttcccgcgccggcccgctcctccctcccactcccgaagttcacccggcctccctctccctctcgggcgctgacaggtggggcccacctgtcagtcctttcctcttcctccatccgcccacgccggcaaccgccgaaaccgcgcgcgctgctgccgtttcccgtccttcccgcgcccactcctccccactccgtgccgcgcccacgtcgtcgccccctctccgctcctcccgctctcgcgcgtgccccgcaagggcggggtacggtttgaatcccccctccctctctctctccacctcccacgtagccggcgaaatcgggagcaccccggccacgtccgccactcccgagccccaataaagcttccccgcactcccttccacctttttcctctttccaccgctccctctcgtgccctctatcgctcccgcgccgctacactcgccgctacactcgccgccgccctcctgccgcgctccggctgccgctagccgtcgctagccgccgcgccgagcctcaccgtcgacgccgccgcattcaccatcccatgagccgtcgcgtccacca

SEQ ID NO: 7621 - DNA, 6902 bp, Oryza sativa
  unsure (1)..(6902): unsure at all n locations
cctcctccctctttccctctctctcgtgtgcgccgccgtcctccgcgcgcgcaccatagtcttcggccaccgccgccgcttttcgcgccgtctgccgtcgccgtccgcgccgccagttgccgtcgccggcgaccgcgcgtgccgccgtcgctcgccatgcttggcctgccggctttgaagccgagccgagccaccagccgcgcccctcccgccttgtgccactgccagtggggcccacgtgccggcgcccctccctctctctctcttgagccgctgacccgtggggcccgcatatcggcgccgccccctgctgacgtcagccctggggcaatattgcgcaataaatacattaaggcttttctttaatagtaaaaacacagagaattttctaaaaatcataactaattcatccgagctccgtttaagtccattcaagtctcagtaaattcataaaaatgcatagaatccattaaaaatggttttgtttcctgttttagtagtcttatagcctgttttgcttgtgtgctttgtttgtcgcgtagatttcggccgtttcgtcgatccacggtttctcgaagacgttgctgtggtctcatcagtgcgagagcaaggcaagtcatgcattataattgatcatattgtacccaatttacaaatgtcccgcttttctattaaatattgcatcgttttacaatatcacgtgggatgagtcctactactcagccatatattgtttaccttatgccattgctaactcgggtattaaaatgactagatgttggtttgggaaatgcttagccatgcttagttctactagtacacaaaaagggaatcacattaaagcatagactttaattattggcaatagctttggatcagtgccaccgtaatggtgttggcttattaaaatacactacacggtgggctgtgggtgcatggttttgctagttgtgcccatggcgattaaggaccggttcgcgggaaaccctggaagaatttatcgtgcttaccacaagccagcgtgggcaacggctgggcttgtagtgtagcttttctctagccgacgtacccaggcgagggtgggcgtgatggagttgggtcggccgaggtgtccggttgatcggcttctggattcactgcggcacgaaaggggggctgcccgttgcctgctggggacgggggcgaaccctaaggtgtggtgcgatcggttagaggggggttatgcgaagggtcctgtcacggcctctttccggtatgtcgtggtggcatgtcggcgcacggaaacgtgtcgtggggttgtgtcttgtgggtacagttgtacacctctgatcagagtaaaactattcgaatagtcgtgcccgcggttatgggcgatcgaccagattcaccgtgattagtctcacccctagtttagcttaatgaactggtgtagttcaggtggttggttgggcctgttgcaacgtggtgtagcgttggacagtgacgggttaatactgcttaattactacaactgtttttactgttttcaactactggttttaaatgcctgctttatgcaaatgaaccccgtaacctcttttggttatatcctgcatcatacctcctcttccggtatgacttgctgagtacagtgggtagtactcagtcttcctctcttttcccccacaccagagttgaagtccttctcagttgaagatgtctcgaagaggttggtttcgtcgctgccgtcaaggatgcctgtggaatggagtcgtccgctgcaggagtcaagtcttcaggctcagctcgcttttatctttttccgctgcatttgtaatcttttatatttttgtaaaacgtggatctgtatgtcaatagttgtcgtttgtgtatcctggctggtcctggacaggggtttaatgcacattcagcttagaaattctggttcgtgaatttctgggcgtgacaccacgcctgaaggcgtagccactgttggcccaaagaaattgcgctaagctttcactcggaacccccaactgccgtggttcgtcgcccaatccgaatccaccatctaaacatcgcgtcaacagtggcacatggcttccgccacacccgaccgatgcccttccgccagctagcttcgagtcctgccaacaacaagactgccaccacaccgcaccgacgcccctccgtcggccgacttcatcaaaccgccaccctgagagctggcccggctagcttcgagtcctgccaacgacaagactgccaccacaccgcaccgacgcccctccgtcggccgacttcatcgaaccgccaccctgagagctggcctggctagcttcgagtcctgccaacaacaagattgccaccacaccgcaccaacgcccctccgttggccgacttcatcgaaccgccaccctgagaactggcccaggacccctccgttccaccacccgccggccgcctcgccaaatctggctgaaggagaacccgggactgggtggcactgcttcggtaccctgagcttcccccgctaatgagcagccacctcaatccagcctagaaactccccgcaaagaaggggaggagctccaggaaaggcgagggtgccgaccggcaacgaggaagacgaccaaccgccgccagctccctttgcactgccatctggccaccagcgcccccgtagcccggccgccgcacctcacgtagccatcgcggcggcattagcaaaaacggagcaagaggccgcacgccggcagtagcacccatggtgtgcacgtggcgggcgtgctctaccgtggctgagaaggacaagtagcagagggctagggtgccacccctagccgccgaggacacggccggccgccgcgcccaggctgcatcgctgagccgccgctgccctccgctgagccgccgccgccgcccccagacgcccaccgcgtccgcgccccgggctggccgcacgccgccaccaccacggccgcacaccgccaagccgcccctagccgccgccgcaccggatccaggcgagggatggccggatccgggctttggggcaccggatccgcctccctacacctccccgccgtcgccaaggacaaagccggtggaggcttcgtcgcgcgccctgtccacgtcgcgccgaggagtgagtcgccgcgaagaaaggaaggcctcaccgccggcgagagctccggcggcagtgaggtggggggaagaagtggaggcgggcagctagggtttcgtcacccccgagcagcccgcgcgagagcgaccgggggggaaaatatccgtgaagttttgtgatcaaagacagctttggttcagctatcatctatcgccaagtatatgaatacagatactacctcaggtaattagttagttagtttccccgcaaaaaaaaattagttagttagtttattgtattatttcttaaagaaaatgcttgctcctgcctcctgtgatttgcatgaaccatctatcgcgttagtatgatttccaagtatatatgagtccatattgtacctggttagtagtttattgtgttattgcttcaaaaataaatgcctacgcctgtgacttccatctgctcagcttgcttttcaataaactttttatccattacaattagtaatgcgtgagaaacacccatggttttctggctaacttgtggtaagctcattggtctggattcgaagtctcaccccttctatttatttggtattaggccattccttaatattcgtcgttgcacctatcagtgaaaatgcttttgttattatctgtttggttattctacatctctctctccaattgttcttttaatatttgcaatgtacccattggtaataatttcgtactgatctatggtggtagagagttaccatcaccacctactttttaaaaatcttttttaaaggttagtgtcactacattttttttatgcaacaaaatggcgcaagatagcatgttgcttgaattaatcgaccggatgatgaagcgaagttatatggtaacaaactaacaattgcagttttcttcttgagaaattaaaatccttactcgctgatttgcaaatacttgtggcatatatatacatgcaggggataacttttataaacatacaatgcaaatatttgactgcatagacattgacacatattttaaaaaacgcacgattacttatggagaaggaataagtctaggaaaaagtctaaatatccccccttaaactttagatgaaagtccgtttaacaccataaactttaaaaccggacatcatccaaccccttgaactttgttatgccatccatataccccctaaggtggtttgggttttggatgatggttttgcatgttttgaaagcttaaacgaccaattttgaataactaatataacttatttgcatatcatcagttataagtcattaatttatccttatacaatgatatcatgctattattaagttggtacttgtttataagtgagagccaataagaagcatgtgatcaaactcatccaacttatatacaagttagaaaaaaaaaccactatgcaaaaccaccttaggagttatataaatggtattataaagtttaggggttaaatgtccggtttcaaagttcagggtgttagatggacttccatccaaagtttagagggttatttggacttttttctaaagtctaatataaacattttacaacttttgtaggttcaggattccacacttatcatattaagtacaataggcactttgtgttcatcttaagagttaatattaaagtattaatagtattaaacgctcccagcactataccaccgaccattttgtttgtgttactaaaaataatagagccaacaggcccaattgtaagaaaatcactcgactctttgggaaaaaaactctaaattgggcccatatacttttggtatgatatatttgacctcattgctagctttgcattcctcaattaacatctttcaactttatttttagtttgcggcacattacattataccatgtgtgatgtgtctatgtgtttcaactccgccttcgatggaaaaatggttttataaaaattggtattatatttctctactacccacattcatcgtctcaggaccaatctttggagctccgtttttacatcaccaatagaaagttactttctatcacttttatcatagctagctgctttagacccatttttattcatctgattcgatgaatgtgggatgaagtagaaccccagggtttccaccacacatagccacaaggatttgccataggctttacttaatttcaagaattgaatcttgagatctatgagtggaatttggaagacacgaatgctcacttctccttttccaaggaccggagaaatgttcctagatcttgagaagccagataactgtacttatccactgtactgtgacataaaataaaattatactaattgggccttgcatttattgaattggcatgggaagctcagcccaataatgtaattggtccagcaccaggtaaccatcaaagcccacaaattttcaacttgatttcttacatttctcgattgtttttccttgatggtccccatttgtgatttataatattgagatttatggtgtggtagagttatcaccaccttcaactgaaaaagaaagtttagcaccgcctatatattttcaaacaataaaatgaaagaagagccatgttgcttgaattcaccggacactgaggcgaataagttatctggtaataattgctgatttcttctagagaaatcataatccgtaccagttgattggcagtactttggacgcacacaatatttcacaatgacatagacatgcagatgataactttttgacacatacaaaccggtacaaatgacagcatagagctgacacacacatattaaaaaacacaccacgtgattatttatggagaagaaaaaccttatattattatatatatcaagtctaatataagtattttatgactagccttttgtaggttcaggcctcaaagcttttcaaattaggcacatataaacacttcctattcatcttaagagttactccgtctgtcctaaataactttattttttatctatcccactcgtatcaatagaaaaaataaaatacccctactttattaaatctcaatgcaactaattctcactttatttcattcagtataattattttccactttcacaaattttgatgcgatgattagctaaggcatgttcggctggcagggcaaccagctacagtagcaagcaacacagccgcgcacaacatacatcgccgcagcgctgccacataaacggctaccaaacaaagagacagaggacgtaagattatagatttaaacagattatagatttaaacgctcctagcactatgccaccactcttaaggctcctttggattgaatttttttttaagaaaagtagtaaaaaccaattaatccaaaaaaataactcctatgtatgttacttatttggtatatagaattaattcgaaggaatttcaaaggacaggaaaaacttctccaaagggtgcctttatatttcttctctttgataattggcatggatctaattgaaaaacagttggaaaaaggaacccatatggatttgccactgccagccataccacgtagtgtaattaatccattgaacaaaactagctgactccctcgatggtgacaggtctgaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 7622 - DNA, 633 bp, Oryza sativa
attgttttaaacaacaaattatcactagatgcaataattcgacacttaaatttgatgattacccgggcagttgacttgtatattctgcagtaggcatctgcttgccgtggctcaggcaatgcaaaggccggaaaaaacgcatgtctttacttcgtgaaacatccctgctttggtttaatggaactattcttgtgtcccaaaccagtgtgttgtttgatgtgctagaagccgaaaaataggtaccacagttgctaaatgaaacagatgtgacctaaaagcagcagtgcatttaatatcaattctccgggaagaaatatgccagtaaaattaagatattgaaatactaaaagacacactttcaggaatgagccaatgataggtgcagatgatccatgcaacaacatccaacaaatacaacttatgtgcaaatgtaccaaatccatgggatgtgtgaagtaatccatgtactaaacaacaagaaaaattcaatgcttagagttgtggcctgtgctggttgagcgaaaaggaattcccaaacaacacaattgaagttgcgataattttctttcactacattgaatggggatcccaaagggactgaggcacaaaaattgcaaggataaatgaggactc

SEQ ID NO: 7623 - DNA, 1574 bp, Oryza sativa
aacggccttttgttgccaaccacatgaagaatttaatccgcgacggtgctcttttttgccaaataagctgtgcgcattgcgatcgcaatcgagccagcaagaagagctcgtaaacggaagcagcattgtaattaccgtcagctgtgatgcaagcccagacttgacgataaagggacactaatgagaagatagtgacgataaagggacatttatgcaatcccagacttgacggttaatatcagctggagtagaatcgttcaggtttactgaagagctgacaacaaatgttcagaaggatattctctgatggacttcgatcgaatcggcacaggttcgatgttttcccttgtgcaatgggcactctgatatttcggttggattaagtgggggaaactggaggtgattaagcaaggttcaatgaacagtgtgtaattttgggatgagacgtcactactgatacagttttgtcgatttgttagtaccaagtctgaactttctacgatttggactccgtctacagaacagctacaagaatctttatacttgaccttctaggccacttgcccaattggcacttggtgggcccggcctctcggcctgtgggcccacataggctaactgcctgtcccagaccgagtaatttgaccgtcgacttctctaaaatatgaagaaaacaataattaatgacctttctgatatgcgatggaattcattgttccaaacttcaattcgttagttatcctgcaaaatatcttctttggtcatgcctgtgatcttgtcccgctaaatgtgatccttgttatggttgaaatttgaagctttctcatttgtcaacgttggaaaatgtgatcctgaaaaaattgcaatcctgaattgggtaaaaagttatttgacaattgatattatcaaccaatcaaggattgtgggattggacatctgaaatttcatctgatctaccaaataaaaattgtagggcctattggaagacaacacttgacatgagggaagtagacaagtagtcacacactcgcactccattgtgcatctttcctaccagctgagttcgaatgttccaaatcctacgaagctaccatgaaagtacaaaaccgtattagcacttttttagagaaggacaaaaccgtattactacctcctattgaatacaaacttgtatgccgtacatatttttgcacacggttacaattcccgaacaagggaaaaaaaacatgactttcccatcaaaagcacaaccttctccatcaaaaaaacattttttttccattaaaaacgacatttttcacgaagtgagcatgatttatcagttagttagtgttaatgaccaaatttggtaatatcagcatcggaaaaggagattagatcaaggtgtagtcgaaggcggagattgatccaagaacagagcaaagaatcggctgaagtccagattggctacgattaggatcggctgggtctgagtcgaactaggtgagccgatgcagccgattctaacagtataatttggtgtatgacattgggttgaattgaggtgcttcaagatgattgccgcacatggatag

SEQ ID NO: 7624 - DNA, 1773 bp, Oryza sativa
ggtataaatagaccccgagccctatgtaatttttaacacacatgttcaatacaatttcggcgcatcaccaactttttactttagttttgtttcgacgagttcttgctttcggattgagctgcatcggtttcgatcttcaacaagaggtaaaacttgttatgatgacttgtgttctcgagattagtgctttcatctttatgacactctaatcttgtctatataattcgtcaagttatcatatatcttacataatctttggcaatatcgtcatctaacctacaatcggctaacatatgttaatagaaggcagccgattaggttaaataacgacgttgtcctagattatataagatatctaccactttatgaaacacctagcggcttgattgtctagatattgttcttcttttcatacttaatgctgcatcagttgagtttgatctattaagtcgtgcttagaatatcaatctctagcctgccctctggttgccgattagggtagtatcggagtttcagccgatcttatctgatttaaccatattcgatctatatgcttcaatgacatattaaatccgccatttatgtcaagatcttattgcatttaagtatattaagcttttgtttggaatattatatttgttttgatatctttatataaagtagtatcggagtattagctgatacatgctagatctatctgatcagctatgctataaacatatataatcctgttattaatatatatttcgatctaagtggtttatactgtctcggcatggtgaccgatctatcccaatcacttaatttaagtatatattaatataagaactatatatcgttaatatctacagccgatcgaatagatttagttccttactatctatttataagcgccgatcgattcatatatgacatcgactcaaagataaatgatatgtcatcggcacctagccgatcggctatcatttatagatttaaccacgaattttttgtttctatttcttgttgattacaggatcaaatcaactggtacgctcatatattcaaaggcgagctttgaacctgcactggaattaagcagatctctcagacctcgtgttttctatcaacaatcaacgacagttagttttctttttctcacgacatacccgtacttcgtcgattttaagatacactgacatgattagaggtgttaattggataaaacaactgcgtctgaactgtgtttttcaataaaaaaaagatagccttttccataaactcgacacgagataatcatccccgagtattagaaaggtgtggcgctgcagtgttttgatacgtggaaattgtccgaggacgccgagcaaagcaaagcagcacgagcggcgcgtttggttggtcgcgtcgcgctgcacagcacccggtctttgaaagctaccacccggcgcgcgcgcgcgcccgcgacgacgacgaacaccaccaccaagaagctctctctctctctctctcctttgcttctcctctaggcgattgctgcgtcgacgacgcccatggcggacggcgcgcgggacgccgtggtggaggtcgcgaagcacatggggaagagcctcgcggtgtccaagaacgcggccgatgacatgatgcgcgttctgtccaggtacgaaggtgaggcgcccatgttccccttgtcacatccggaggtggatcaggcggaggaggaggaggtgttcgcggcggcggaggacatcatccgccggtgcaactcggtgtcgtcgccgtccgagatggttg

SEQ ID NO: 7625 - DNA, 1295 bp, Oryza sativa
ccgcctctgcgacgaggtgttcgcctccgacgaggagctcggccacgagtgcttcgccgacgtcgccaggggtagcctcctgcagctcatcggcttcgcggacgccgtcgccatgtccaccccggcgacggagaagctctaccgcatgctcggcatgtaagaggcgctcaccgccgtcgagccggacattgaatccctcttcaccggagacgcccgcgacttcttctcctccgaggtcgccggcgtcgcggcgcagctgggcagcaccatccgccacacgatcgaccagttcgtcaacgtcatccacggcgagtcgtcgcggcgaccagtcctcggcggcgagatccaccccatgacacgctacgtgctcaactactgcggcctcctcgccgagtgccgcgtcacgctcgacatggtcctcgccgacaacaacaccagcaaccacgacaccaacgacgacgaccacgacggcggcggcggcggtggcgcctcgtcgacgccgtcggggcggtgcatgagggagatcctcacccacctcctccgcaacctcgacgagaaatcgaggctctacgacgacgccgggctgaagaacatcttcctcatgaacaacatctactacatcgtgcagaagatgatggtggagttcccggcgctgcgcgagctcctcggcgacgactgggtgcgccgccaccgcggccagatcaggcagtacgagacaggctacctccgggcgtcgtggatgtccgtgctggcctcgctccgcgacgacgcctcgccggcggcggcgcacgggcacggcggcagggcggcgctgaaggagaaggcgaggagcttcaacgcggcgttcgaggagctgtaccggagccagacggcgtggaaggtgaccgacccgcagctccgggaggagctccggatcgccgtgtcggagcggctcatcccggcgtaccgctcgttcgtcggccggtcgaggcagctgctggagtccggcagcagcagcggccgccactcctcgtcggcggcgaagcacatcaagtacagcctcgaggatctcgaggactacatgctcgatttcttcgaaggcgttcagaagttcgtcaggtgatcacaaattcagagtttcgcagaattttctgagagtttcagaatttcacagattcagagtttcagatatttcagagcagaggagctctgcttgacttgtagagattcagagtttcagagaatcaaaagaacaaagtactccattgcgtagccaatgcttatagttgtagctattgattgctgatcgaatctag

SEQ ID NO: 7626 - DNA, 2258 bp, Oryza sativa
taaatattaagaatatcaagtgaatagcgattacacatgtttatcattccaaattttgatgtgtaataaaatttactcgtcaatatgtaccatattagattaattttgcttgcatagatcgttttggcccaggttcgcacggacttgcaagttgttgtatcgaaatgagcaatttgtaaattgttgtacttatttacacccaccacgcaagtttatataccatgagcgcaatttactcatgtttaattttagggtttgttggaaccatgccaccctaattttgtaaaatttaagatatgccacacgtatttcaatgacacgtaggacccacatgagtcaatgacatgtgggtcagggtggcatatcacaaattttacaaaatttgtgtggcatggttcaaattttcccttaattttattgggtgcatgtattgtgttagttgagatgattaaaacacagaggtgataataattgtttcttagtctttgaatcaagggtggttgtgccttatattttaaaatggagggagtattaatagtcaaatttaaaaatgtttgacttgatactatattaaaaatacttagacagatgaagtagatttcgtcgtggtgtgttaatttacgggatgggggcacgatcgggtgcccgtcgttttgcactttaaatgcaacaacccctacagttcaaatactagtagtccacaaaggccctgattagattccaacttttccgtcacatcgaattttcctacacacacaaactttcaactttttcgtcacatagttctaatttcatcaaacttctaattttggcgtgaaactaaacacagcaaaaaaaaaaaagaagtttcttcttttttttaagaaaaaagttcttgtcagcatgtacggcagatcgtatgtgttggatctgtaggacagatcacggttaactgtatctctcatcatttgttgtgttggcttatactactccctacgccccggcccataacgtatgaagacgtcgtctacatcacagaaacaatcataagtactcacatcatcacgagtgggacactttaccatacacttagaagtcgtacctaataataaactcgtgaaccacgctaaatttttattaaaaacatacactcataatcagggccggctctgactttttggtggcctagtgcggaaaaaaaatgaaggccccattcaccataaaaatacaagataatatttaaaaactcattgttattaacgaatttcacactaataagtttaaaataccaaaaagaaatatctctagatcatttaaaacatttttttctaacagttctagatgcaaaatcagtaatgatactgttaataacaatctcatctagtagcctcttatcaatgcatacaatagcatatcagacttggtaacatagtatacatattttggaggcccctaatttttggaggcccagtgtggtcgtaccgcccgcactgcctcagggccggccctgctcataatcattttatatgtatgtccttcattcataaatataaatatttttaaaataatgtcaagttaaacatttttagtcttaactaccaatggcaaaaagatcataaaggttgacaatataagaatgatattattagatttattgtgaaataaattattatcatatgcaacttttctatttaaaataatttatctttataaacattattagtcaaagtagtatattagaaaccgtgtctaaatgcatgtttatatttgtggatgcagacagtaatatatatatataagtcatcaaataatctcaaaagcttacatcactagctagtatatgcaagatattatgtgttacatgtataattgtataaatgacattaattgatttgaacgactagaaacctgttaccacattaatcgtagataaaaaaagttcacaccatttgcttctggtgagtctaaattataatatttagatttgattgatatggttgtatatggaatataatcataactatgggaaaataagtaagaattgtcccaagagtttaatataaaactaatcatgtttataaatttagcttcacacaaaattgtgcgagacagttcactagtttatatacattagtgattaataacatacaatgataaaatgtatgtattaacaaggagagaatcccttatataccactgaaaattagtctgatcccttatatgccattgaaaattggctcttcccttatatgccattgatccaaatttgcacaccctct

SEQ ID NO: 7627 - DNA, 2660 bp, Oryza sativa
ctataaataatccgtgttgatatctgaactataaatgaaaaggaagaaaacatggagaagcagccttgacttctttaaaatggcccacacaagatagtgcaaagttttatactgatataataggaaaatttttataagattacaactctaaaagatagtaaccggaaaaagaaacaaaaaatcaaacacgccaccaccacgagttgatagctcctagctcacacaacctaggcctacaaggaggtcacaaacgtccgggcaaacaccgaaactacacaacaccaacccaaccgtcgctaagcgtgattgattgccgctagatctaaaaggatatcgcaaacgccccgccaaaacaccgaaaccgctcagaaatcgttggcgaactttcgattatccttttgcataggggttgagaagaggaagctggcaagagagaagattatcaagtcgttcctcgcgcataggtacaaaatagtttgattctctcgattattgtactttttatatattatccttatgtactgaactcctcaattattgcagcaagttgagttttgtatgactcctattatctatctattactcctattatactggagtggagtatagtttagtgctatagactgatttggatcactgcaggtttgggcgctcctttttgtgtagtttaattaatcgatggtgcagatcacgcctgccttagtttaggctttttgctagctcctgtcgtcgttaatcattcatctgtcaattacaaatcacctggatttggaggagtctggaagcccctctctaaaaaaaatataattccctctgagttttgaccctcctttacaaacaccatcttggttggcttgccggccctgactcgatagtatagagcgttgcgtgtgtagagaaaaatgtgaaccgcatgatgcatgagtacgtgcatatgtgatctctggataattcagatccggacgaatcgatcgtttaccgggctgatccatgtcccacttgtattatgaaaacttttacctttttgtgacgatatgaaactatttgtttattagcggaacacattatgaaaatttgactctcattacacgcgaaacactctcccctacgaatgaacaccttataagtatattacatatcttaaaattaacgaagtcattacgaacaacacgtcgacggatatatcacctaccacagaagaaatataaagttataaataccagcatcttttgagagactggactgacatattttaagatttaatgtgtttgtactgtatttatatatgtgagaatttagtgaaaaaatatggagcggtagtccctttggtttaagtatagggtgtgtgtgagtattcacaccacataggacgaaaaccaaaacaacacgtggcgtggatgctctggtttggttttaacagttgaggatgcccaataagcggttttgtagtattgggatgtgaatggaactcagccgctacatggggatgctaagtggactttgcttagtcttcaataatctgctgatagaccgtgggcttagctactccctctctcgggccgaatttacgagcccacaacaaacggcccatatttgcttgcggcccaccaactaaaacgccctcttaatcctcctcctcccccaggcgtcgccggcggctagattccggccggtgatggaggcgtcggcgtcggcggcggcggcggcggcgctgtgggggcacaagcacctcccgctcctggcgcgcgcgtcctccaaggagtcggtggagtacatcctgcaggcgctctggcgcacccgccgcaccggcctcgacgccgccgaccgcgccgtcgtccgcgacatgctccacctcgcctccgacgccgacctcgaccccgtccgtatccgccgccggctactcatcatctccaccacctctcctcccgtccccgcgctcgcttgtagctgatcccatctctctctcgcagttgctggtttgcctcagggtactgattcgcagatgcgtccatgggaacatcgggaaggacgaagtcgccaagcttttccccgaggaggtgtcgcccgagctgcagaggctgctcaccttgcttcttcagaagtttcagccggagtggcaagaggatgttgccaaggatcaggtaaaatcaggcaaagttctagctcactggtcatttcattttgcttatgtgattagctcaagagataattgtcccaagctaatgtttctgtggttggcatgttcatagtttgtgcattggtgtcaagataaaatgtggtcactggtcactattgatacatggattttggttcttgttttgaccttcggagataattcaagataaaaaccagcaagttctagctcactgatcattttgcttctgggattaattcaagagatatttgtttcatcttctgttctaagagtacctggtgtgcagtgttgaatcggagcctaagctccaattaggcaatggttgacatgttcatagtttgtgagttagtgtgatgataagaatgtgcttgttggtcaccattgacataaggatttgcttcttttttttttaacgcaattagttgtttcgtaggcatctgcatcacggccagaaacaaccgaatgcccttcaaatcaaaaccaagatacaacagcgcagccagct

SEQ ID NO: 7628 - DNA, 1353 bp, Oryza sativa
acacttgttgtccaagatatatatttgtgtcattatcttgtaatctatatatatttgtcattatcttgtaattttgcttaaaacttcatggtagagtctcactgactacgctcctaacatttctacaatcagattactcgtttatcagaagttcaatcagattacttggatggatgacctgatactgtaaataattgtcttttctgcagattcagaatggtgggaaatcatcagttgtggaaaaagaactgaagcttcagttaaccaaggatactttagacaaaatgctcgaggatatgtactcaaccaagggccaagcgtccaacactgtgagttggccaatcccttctgcaataacaaattttcactacattcttgcatctgaatgttactttcatacttttgcagggcaataccaatggacatgaagagactgcaggatgcacttaggaaaatggaaaatgctgtttttgtcattttagctttagctccagggacattttgcagcagaaaaactgtaccagataacatcccgtgtctctctgcgtcttgtgatagatatttttccccttgggcagtttgatctaggctttggtcactgcatccatttaccctaaggagcaaatgtaggtttagaagctttccttgtagaagaagttagtaggtgattcatctgtaaattgaaatccattggaagtatcagtgtcaacgcatgctgaaatccttacatttccacatatgcggggaatgttaatgtcttgtcacatctttgcaactgaatttactgagttttttcttttatcatatggagcacaagaactgcaaattttccattagaagacaacataaatactggagtacgtattaatcatcttcttaacatcactcccaaaaattgtgtttcgtctcatataagcccaggccagcaacacgattccaacatagtactatagtacaggagcacagtctgcgagaatcatcgaatgctgcaataacttattattccgggcactataaactcttgacttctgattccaagcagtttacttatttcacattttggatcttcccacgcacgaagaattctgtattttgatccgatgccaagatgtgttgaggattcctctcaggttccatacgtcttccaccttttcaggttgaacatttgctgctgagtccacctgtttcacacaagatgcattttcatcagaattatattattcatgcaaagcaccaaacgttgggtaaaatagtaacccagccagtggtggatatcacttaccgccttagctactatctcagcgtttgctggaacgtctaatgtagcctcgaatagaacccatgcccacttat

SEQ ID NO: 7629 - DNA, 3799 bp, Oryza sativa
  unsure (1)..(3799): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgttactcatgacatgacatttcaaacctaattaaattgactgatgtgtcatgtacatgtgattaattgtgtataacataattaaattcactatggaagcagcagccaggggtgaaaatggggcgggtaagatcggatcacaatcaagttttcattactgtcggtaaccgcggttaccgccattaccgcggggtacggtaatagaaataccgcagtatcctccttaatttcaaataaatttagaaaataatttgaatttttaataaattttgcacggtttcgtacggtttttcacggttaccgcggtaaccgtgcttaccgccggggcgcggtaaccctggccccgatggtttaggaaaccctcatcacagcattctcatatcctaacctacatcttactttaaattcggaatcggatatgggtagtgtcggataacacatcactcatcccgtattctatcccatattaatttcttcgaatcggattcgggaacggatatttttttatgtccaactcatgaatatttaatgtaagaaaactattaaagtgctaaaaaagatacatcaaggaacaaattatataatattgcacgtgagctcataaaaaatagtgattaactaatcttttattatgtttataggtgaatttataatagattttcacatatgtttcataatatgtgacatgcgggcgaatacaacccttcctgtattctaatccatatattttttttacagatttgggttcgaactcggataatatcgggtatcccattttctctcccatattcctcccgcaggcctcggatcggttgggcgggcgggaaatatccgccccattttcaccccctagcagcagctactataccgatcgaccacatcacgtacttatacgtatatatatacgtacggacacaaatacaactatatatgcaagggcagatccagtgattcatctgtaaagtgtggacctacgtacgtatctacagcatgcacgtattcgtgtgtgtgtaataggtgttaatcgaaggacctatatatacgtaatactacttccatttcaggttataagactttttagctttgttcacattcatataaatattaataaatctaggcgcacatatatgtctagatttattaacatatatataaatgtgaacaatgctagatttattaacatatatattataatatgaaacggaggaagtaggagttatggtgcccatcggttggcttatttagggaataaaccaaacgacatatttgcaaacgaaaaataatttgtaaataaaacttttatatatgtattcttggcgagctaaaagcaaaggctgaaaaataaatttcgataaaaaacctcaaaaccaactcaaaatttagggttaaaaatttaaattttggctgataagcataaccacaatcgaaagatgataggtgacgaataaatttttgtcacgtgagcgtcacagattatgaactgtgacgaaattttatgtttttgtgatgtaaaagaagcgtcatttatcataagatttcttgtagtgaggccacatatataggttgtaaccgtgtcattgcatgatctaccgaccacacgagagtatactgcatgcatgcagacgatgtatacgtactcgtaaaggaagtcgtttaggacaatgtttaagtcaaacattgggaatataaattatgaataactctcaagttgttaagtttgaaaatataaaaattatatgaatagatttgtcttgaaaaatacttttataaaagtatacatatatcacttttcaataaatatttttatagaaataaaaagttaaaattctgttttggagaccgtgtcgctaaccaaaacaactttttttatgagtacggagggagtacacggaggttttaattaataatgacggtggttctggtattgtacgtgcatatgcatgagatatcagagtactgtacgtactaggtgagatgggcagatcgcaattaaaggtttggtttggtttaatttggtttggccctgtatacattatactagtttctgattattggaccaccctctgcatgcatatgcagctagcagttttttgcaatgcagatcgaggcagataatatttagagatgcagccactactgtacgttactagtactactgttgcccgtgtacgtgtgcatgggcaactcgttaaaaaccctagctttatgagatgatccaagataggccggctggccatcgatcactataccaatacaggcttagagctagcagggtacaataacataatgcaggtatgataatgcatgcaggcttatagctagataactattctgagctcttgaggggatgttccctggttgtttacatatcacttaaatagttatgaaaaaattttagaagatgtattaatatgtgatatatcactccacaaatatgcaacttaaaattcaactttcacatgtcacaacaaaaaaaaagaaattaatttacagctagttaacgtatatttatagtcaaattttattttttttcgttgcgatatgtagaagttgaattttaagttgtatgtttgtggagtgatatactacatgttaatgcatcttcttatttttaaaaaaaaattataactatttgagtggcatgcaagcaacgagtgaatgttctttccagagtgtaaaatttactcccgatatactagctcactattactacgctagtggataattagattttagctatatatccatggcatgatagtcaatagatatagctagtttttttttttgagtaatagatataggcatatagctagttggctttactattagctttgctatgttcggacatgttaacttttccttgaattcgtcatattggtgtacctaccccccctgcaggtaatctgcttatgttatgctctaactagtaaaacctgctttatttagatgagggaagaatcgtactacacatttgttggaaggacggacaacgataatcaatttctctctttttcaacatggccatggaaagttttttaagagtaggtaaaatagcaaactattaaccaactataaatatattttaataagataaaaaatgagagagaagagcagcgagctacagatctgtagccagctgtagcacggactccaagacgcaatatgtgtatgatatgtgggaccatatattaatacactacaagataattgagctattgccaccaaattattacagcaaaaaataattcgtagcaatatattatactattgcaatgataatttttctgtggcaaataattattttttattgcaacgatctacaatcgttgttttatttagtacttttgttgcaatagaaaatgagatatcgccacaaaaaatcgtactattgtaaaaaacatgttctatcaccacaattttaatttttgtagcaatttatatagtacatggtacttttcactattttttgttgccacgatcaacaaattcgttgcaataaaaaaaattgttatctcataatttaacttaattttttcatatggacacggattaagacaaattgtatatagaaattatagctctcgacgagatctacaattttataggtgataactt

SEQ ID NO: 7630 - DNA, 11374 bp, Oryza sativa
ttagtttcaaatattttcttgaaacttccagctttttcatcacatcaaaacttttcaacacacgtaaacttttaacttttctatcacattattctagtttcaaccaaactttcaattttagcgtgaactaaacacaccgttggtagaagtaacagtgctagcttcccttcatggcttcatacaataccgttgattcctcggacccacttaccacaaacagaactatacagaacattaattactactctgtatttactactcggcccttaattactctgcgggcctccccagctctacaatttatgggctggcccatctgtctcccagatataagatgtgccccttgcaaaaagacattgatataagatggaccaaggtgacaaaacgaaaaattgaggctcagtgaactgaaaataatctggtgaactatgtcgattcctggttacattccctggcatatttacaacatgtagtatatatactggtctagctgagagtagcagattcaggagtcaaaagaccaggctctggtgaagtaattacaagtttacaacctcctatgataggacagccgaagagtgactcaagctgctttatacgcaaatgttggtcgcgactcttgttcctcatcttccgctaccatccaatctagcttagggccctaaagcaggaaaaggaagacataagggcctctgtgcatttatacaaaccgcataaaatgcagttgaagcatccagtattagctaattatgccaatcataagtcaacgaaataggtcacaaatatgaaatagataagcattacgagataatacataacggtgtgtttaaatccagtacatatcatttgccaaatgtcaggggatagaatgagaaatttccttttgcttgatagtatagtcatatggtaggataactttagtccattaatgaaaatgcatacctttccctgacgaatgatggtagggtagcttcccgtcatatcaaccacagtagacgggcagcaattctagtacctccatcgacaatgaaatcaaggccctgaaaatggaatcaccaattaatgaagcgtatcacgccaatttgtgtttcagcatgacccaggaatgggtacacaactgcacatcaaagtaacgcagaatggacgctatgatagttttactagacattccaagcagttcgttacaatttttacctttttacatataattacatcaatcatatttagtaaaaaatagcttcatgtgaaaatagccagcaactgcaactaacagagtcacacccacaattgttttgtaagtcaggactttttgcttcagttactaccatacaagccagagctgcagagcagatcatagagacaacttgtataaaaagcctagtagatgataactatgaaatctacaataacgggtcagcatgtactaataacaatatcacctataattctttataagaaaacaacaaatgacactctttaaaagatcaatacagtggaaagtgtaacgccattgatacacaaaagctcttttaataagatcataatgtgcatagtttctagtgtattgatggaagtgaagatatatacctgttgctcatatatatcagcaatgataaccgggtcaagtatccattcatcctctgacagagatttgacactgtaaatacaggaaaaggagtatgactatgagtatattgtttaagaaagaaaagttgataacacgacatctcgatcattatcaattcctcattcctttcaaacgctaaagaaacctaagctccagaaattactaaaaaaaagagagcacaagaaatctccgttcgtttttaactgacaagaccaaaacagagaggtacatatgcacgatatagtattgtgaatgttcaaacatgccagcagaaaaaataaagtactttctccaaactatttgatggtattataattcagcaatataacacagcatgtcactacatagagcaggaaacaaataaagtaaataaaaaaaggtagttacagcctagaccaaccttgtgcagatcaaaggctcatcaagattttgcaatattgcttcacatatggggtcatctggaagtcggacaccaacctgcctccttttcgcgtacctagtagatgatccatgccttatgcattgtttgggcaattccttggttgcaggtaaaataaaggtgtactgcacaggattaaataaacaggtcatttgtgaagtactacaaaactatggccaagggtgaaaagaagatatgcttacaggcccaggtattacacgcttgacagcacgaaatatgttagcttgcccttggttagtgcctcgaggaaatccggttgtgtaggtatcaatgtctcgtagcgagcggcacaagatgctgagaggctgcacaattcagaactggtataaatacacagaatctacaagtaggaggaactgctcccaggttgtgttttgcttgagaataatcatcaaactcgtacaaaaacattttttacgtctttgcatatcttgcctttgaatctccaatgcctttgatcctgaacaagataacaaatcacaaatccccgttagaactgaaatgcatgcttgcttctgttattcaacatactaacagatcaaaggctcagttgtacctgcgaaggcgctcgacagagtcattgttactgagatcacagacgatggagtagctggaaaaaatgatactataggtattatttatgttcccagtgcattatgcaaaacaataagagatggaaaattcaacagcacatttatgtatctaaatatggtcaaacaaaacgcacaacgaattaggaccaatgcaagctactactatcagtcttctataagttgattttgagtggaaatcaaggcttaaatcacaacatttgcagagaaactattcagagattgctgtgtctgcccattgacgagcatgtacttgaatgggcatgccatacttaatattgagtggaaatgaaaggcttaaatgacaacatttgcagataagttattcagatattgccggcgtctgcccattgccaagccaagcatacacttaaacgggtgcaccgtgggtatcaactatcaaccgcaattctgcaaagtcgcggaacgccacctcactaaactagacagtggcagactcctagacaagcaaagcaaccagacgaacacgcggtgagactgaaagcggtgggcgtacacggtgtcggtagggatgatgccgacggcgccgcggttgatgagttcgacgacgggctccagcttccacgcgtcctcgccggatggctccacctgcacccgcagcatcccggcatcccctctctacacacgcccccacccccaccaatcaccaccaccaccacaacacaagttcagcacactggagttagccgcgacggcgacgagcagcggatagagagagagagagagagagagtaccgtgaactggcgctgggaggcgtacttgagccgcttggggttgcgcttgtggagggcgacgacggcgaaggaggcgcggtggggaggaggcaccgcggggaggcggagctgcgaggaggaggaggaggaggcggcgcggcggaaggggaggcgcgaggaggacgcggcggcggcggcggcggtcgccgtggcggtggcggtggccatcggagagggtcggggttgggttgggttgtcgccgagtgggggaatccgccgcggtttatgccgttctcgtgatcgaatccacgggcggcgcgtgcgttgggccttgggccgcacaaggcttcactcagcccacgtatttttctcgtgggctctacggtgaagtccacgtattttaggaaggaatgaactatggaagaattttgtagaaagcttataggaattgtcagcatgaaaaaaattccaatggaaacctaattgtattttaggaattactgttcgagatgaacgtttcaaatctacaattttaaagaaaaaaattgcaaaaaaaaaacaccccaaatgtcatcccgagttgagtttaaggttatctccttgttgcatatactctttagaattcacattgatttgggattcctgctattgtttggtgttttttccctcttcatgcatactagtatgttgtattacctagcatattccttaatagaaatggccttaaacatatttatttcttagcaataccaatacttatattgaatctaacaaaaaaaacctaacaaatgtcgaaccctgcgaaacaaacgcaacaactcatctcttcgtcgcttcgatgtgtaagagtggagactcatgatcaccgtcgttcattgacgtgctgaacattatgacttttatgagtaggcatgcatctgcaacggcaatatcatcagccctgtctgatatgaatggcgaccacatctccttactcgtgagcgtatgtgggatttgcagctatgatgatgagctaagcatataggtaattgggtgaaaaagaagaaatagaaaaaacatagcatataaaaatgtacaacaaagaattacaaaagcacaggacaaccgttggaatgaccatttgattgggtcgcagaaaaaacattgaaatttgaggagagataaagaattaaaaaaaaatcttttcatgagattatacctcatgttaaatttcctctaaaatttgtatggaaagatacattccgaatttttatagggttcgtctctctttgattcaaaggactactagtctatcaaacaaaaaggcaaaggccctcttcgtttttgaattaaaatggcatatttttcaaactgctaaacggtatatttcgtgcgaaaactttctatatgaaagttattctaaaatataagattaatctatttttcaagtttgtaataattaaaactcaattaatcacatgttattaccatatcattttacgtgaaacacttaatcttcatcttcaggagattcaaacatcaccaaactctacctacgagttcgtagttaggattaaattttttttgggatggatagggtatgtaggaaaatttcatatagaaatgaaatcctctaaaattcatatgaatttcatttgaataaaggagcccgaattaggagagaacatttgtaacaaacggtcatataagagaaaataaactcagggttttttatgatttccccaaatttttgtaacgagattcgataaatttcgaaaaaaaatgtgtcgagccgcggctaggtgaaaattcgcatacatttcacattgccttacgaacacaaacaaaccctcccggcttgtttggcaacttgagagaagaggattgggaatttacacgagggaattgatggtgagattaagatgagaatttaattttttattacagtctcttgtttggtagaggtggtggaaattgatagggagtttagttgaagattagatcattaatgaaaacggatggctgagatttgtttagcgaagtaaatgagaaattccctcccaattacctgcccctacccagatattgaaaaagagggagttcatttctcaattccccatctctatcaaaaaaaatcctatatcctataaccaaacaaaatggttaatatagcatcatcctctgaaactcccaatccctcgtaaaaccccctccaaccgtcccaaaaccacaccaaaccacgccacgcccccctcctccgactctccggccaccgcccgccgccggccgccctagccggcgcaaatgccggagccgcaggccatcctcccgctccgcgcgctcccgccggacgcgccgctcccgcccccgctcccggcgccgttccactccccgtccacccccgccgccgccaccgccaccgccaccgccacgcccgccaccgccacagccacgccggccacgccccccaacccgcccgctccccccgccgcgccgccgcccaccttctcctcctcgcggcccccgcacccatgggagatcgccgcgcgcgcctggctcgagtccttccccgacggccgcccgcccaccgaggccgaggtcgacgcctacatcgacgtccaccgccccgagctcccctccctcccccgctcccagctccaccagcgcctcctcgccctccgcggcgaccaggtaacccccttctcctcgtgttacccacgggagattcgcacattgcttacgggattatcaggtgtatccatcgattttaagtcaaattggatcgattagcttgggcacttaaccataatggagattctggtagcgtctgggttgagcaattttttgtatcagtcaagtggagtctgtttgtgaatgttcagttgcttgattgctactagtcatggaacaggtctgtcaagtattaatgtatgttatcatgctagaaaggctgatggacttcagccctttgaaatggatctgttcagtgttgatatggctgatttgcctttctgaattgcagaatagctgaactgggacagattggaactgttagagctaattaaacatttgaactctttgcctctttggttaacgatgtttgtgagcttcctagggtttctatcatgtagaactgctgttcgccaggcctgttggatttagctgtttaccagatttttccaattgatcactgattcagactgacattttattttcacctatgcgtaggttttagatgcagaccaaagtgctttcccgtataggttccagcggactgatctttggaagcctgtgtacaagtggttggaatctcttgagctagagtcgctagttacatcaaaggagatatcggagtggcttacatcaaacccacagataatggacaggttggttgagaagcattcaaaatatcatttgatacactacacccagaggatgcacttgaagcttctgaagaagagggggaagataccgaaggtacataatttctgatccactttgatggggtagtgcaaaaaaatgttatattttcgctctatttcctaaaggtgttgctaagcaaaggataaaatatttatgattttttcataaaggcctatcaaaagttaattatattttctagtagttggtatcttcttattgctgaatgttctacccatatttagcacccgagtattcttccttttttcattttatctctgtttctattattattagcttacgatagcaattggaaagaacctatggcacaccgatatgcaatatagttatatggctgtaatgatacagtagtttccctaaagcaccaatttggcagttcagatgtatgtgtgtgtgtatttaaaagaaggaagttgataatgatgggtaagagttaagtgcagtcgataccgcacatgtaagattaaacattagtctgtaagtaggaaaaactgttccaatgttccatagagcatagcacaacttcacaaaccataacattatgcacctcaaagaaatagatatgtgcagtagtttgtgtctttggtgagggtggtggcagactggtggcttgagaatggtaattacagttagacactgggcctcaattagcgagattttatgtctattgtaccatatatttatatgctatttctacatacaaagatctggttatattgaggtgttgttatgtcactttggcggagcatttgtctatcatactaaggctgagttctttcccaaactttcccaattcacctccctcgttttccgcacgcacgcttttcaaactgctaaacggtgtgttttttgcaaaaattttctatacgaaagttgctttaaaaaatcatattattccactttttttaaaaaaaatagtaaataaattaatcataagaaaatgcgtcgctccgttttatgtgcgcccaacctcacctcccgaacacagcctaaagaatccagtctcctccaaaggagcacctattattattttacaatgaaggagcactaggtttttttttttcaattggattacttcagggctcaggcagttgcttttcaaggaattatttgaagtaattgtatctcatgtagcaatttgatgccagtttattgcatagactcatgcacactatattgcaatcatttttctattttcacaagtgtctcttttaaatatatcttgctacaccgttggttccttgcaaataattattttgtccttgctcttacaattcttgaattggcatctttgttgtcccttttctaagatgctaactttacattatttgcatttggtcaacagagtctacaactttctgcggctagagccacggtcccagcgagtgcttctccagttaccccacaagaaagcacaccaactgtgaggaaatctctacctccagtgacaggttatcctttcaatgattttgcatttgtttcttgaagtgacgttttctcatggtcttctaaataatacagcatcctatttgttttccaggtgttagtgcaagcagatttgtgggcggcgatgctcctataagggacaagaagatgtcactatccaaaaaaaaggaagctttccttaaatatgaactgtacgtcactcttagcttagctaaccctgggttatacctctgtttggtttttttaattgcttgcactaaaatattaatagtcgtgtttcagtttgacagacttgcagaatcagttgaccagtgtgttgttaaagaatcgccgcactgttgctattaaagaaacagattttcagaagccagagactaatgtaagtatgcaagaaggggctgctactgcaagcacatcaacccctacagaggtgacgaagatttattgcaacgaacagccaaaccaaggagcagcagacaatgaatttggccagaagagaaaaaggaaccctataattgtaacacctgcttggtgttatagtgaagctacaacaggtttgtcctttcgcttggtggaaagattaatcatctgttgttctatttgatacaagctgagaagtactacgtcctattggtccaacacattttctgtgaaagtttgatttgttattttgtgactatgctttcagtatgtcctactggccatactgggagtgcacctaggaattctggtgtgttgccattttcttttcacatgttcatccaaggcaacataaattgtattgaagctctgcattttcatcaggtaaatgaatgcaatctcttatatgtgttgttaaaaaagaatctgtatcttcggtggtaacaggaactttgcagcaataacaaaaatatagtcaacatagaaatggtgcaacacgttacgatatgtggaaaggacatgttaatctgaaacagagagattgtattattcagcactcagcagttctctgttactttgaatctgtagttgtagtttccttatttttaatatcataattgatttttgttgattatttttattaggatggaattcacctgcggtccagtttgaaggtcctgctgtacatgtcgtgaaacaaagttacctatcttggtgtccgacttcatgtgcttatacgtcaagcgctccttctgctcagcctcatgacagggtatggatctcaaattaatttgcatggcactatgaagtccaaagagttgtcagctggcagtttgctctggtcttctttttggttatgcaatttcatttattcttttggtgtacatttacattgcattctccattatgcttttaagttttaattcaacacactattttctaatttttcttctagtatgcttccattggaaaaggtgaaaaaaacatactgtctacatctacatagcttggcaactttgacaggttgctatattgacatcatctggctggagttgtatgtatgtatgttgtgatgttgacaatattaacagtgctaaagttttatattggaaaatgcagaggtggggaaaattatttttgggttgtagtcttggatgcttccagaattgaaaaaacatttcaaaatgttgaatatccggtctacctttttcctatatctcattgaggccataaagaactcatatgcagctcacttagcatatttttgttggctctatacatgcattttcgtttaataccaaagcagaaagccaaaatctctttgcggaactaaattaacgtgattgatcgtctagctgtgcttgattatgataatttttttttaatctaacctatttatttgttttctattgtaatggctcagcaaggtgtacgcaaagttcttgatgtaaagtttcatccagaagggttgcctcagcttgtctcttgctctaatgaggttggtaatagaactgttcttggtgcattatctagtcaatattttctagcagagagcagaaatcttcgatccgaagaagaggcctggaaatgagtgtgatattctttctgcgtattttgatggttacctttgggacatcattacagtgtctccataattattggattgatttattcataaatcatagtgctattccattaattcaggcaccgaatgaattgttgcttttcaatcttctttatggaagagctactcaacttagaggccacaataccaaggtatgctgaatgagtaatttgtatatttactaaatattttctgggatactaaatccataaatacctttcctcctttttgcatttttgcttaaaaaatatatatgctatcctacctgtacctgggatagaaaaaactttatagagtttaagtccatgttcatggaaaatacaaatgatttgtttgtcaaatgttcaaccatgtctcttcaatccttacatcatgtctgtctgccctgcatatgtacttcagtaattaagtgaataatgatgtggtactactgcagcataagaaatttacagttacaataatcatgcacgtgcaacaaacatagctttcaattcacagaggctgattgtttgagagtttttttgtacttataggtttttatttgttgcttttgctatgctgattattttattttatttcctcagatccaggctaccgcatttgcggtgaaaggagcaagcatagtatcttgtggttctaatctattaaaggtaactcaagacttttattttctttcttcagttctaattgttgctgaaataattagcaggaaaacattatgttgattttttttttcatatatggactataggtatgggattgcattacagggtcttgcctctataccttaggtggtgacgatcacaattcagtgggacatactcaaaaaattaatgctatggctgttaataaatggcaatcctgtaagctaattcttttgtcagcctttctgtactgcatctagtagattcctacatctgttctgtttccgtatgacaggtgttagttttgaattgtgaactttctatgtgattgatctgataatacgtgggaaagaggcaaaaccttgacttaatgggttgtataggcca

SEQ ID NO: 7631 - DNA, 1891 bp, Oryza sativa
  unsure (1)..(1891): unsure at all n locations
atgatatgcatagcgaccatttctcactctatttttatcgtacttaccaaaagtgttcaactatccacctgcagtgttggaatgtgggatgttactttaggtcaaccttgtgtcagacatatcttaacgcataatcgatgtgctaatgcggtaaactttccaatattcttctgggtagtcctttagcttactcttgcagatacttcaattttgtcattgtacggatttcaggttgctgttgctcctaatgacgaatacatttccacagggggaagtgaccaaaaagttgtgagttgcttatttccccctttactagtttgttacgatgctctgtgttgcatggctatttatgaagattatatttaaacattataagaaaatgggaaacacaacaccaaaattttcttgatatggtttaccagggattggcataagtcaaaaactcaagatttacaattcataacttattgcatcaactgagatgaatttttgcctttatatatgctactgaaatcacatcaaatgtttgttgattctgataaaagtgtgactgttcaccttgttctctttttttttgcggctctagttgttcatgttattggtttttgcaggttttatatcatagtaaaagtgggtgtgcccaccttaattggcgtctcacatatcctctcccaggaaatgattaatgtactgccataatttgtagaatgaaatgtaagttattcttttgtgctttctgatgttgttgaacttgcaattagctggtacaaaaacagataagggaaccattaaaaaatagctaaaagtgtaaggataaaaggattactgtatgacaaggcattaaggcaataattacatggttatggtatcaatgcacacattgtctagtgtctactgctattcatttttaagcttcgaacaatggtgctatcttcacacaccagacataacttaccgtagacatctaatggaccaaataagaacttggaaaaaaaatcaaattggtgaaacgccttgttttattgcggagagacttggtgttttatcttcataagagattgagatgcttctgttatttcctagcgcgcgctgcatacttctgttcctaacttttcttatatgcacatctttttcagctgaggaattatctgcactaggttgttgaaccatagtaggaagtctgctgctccaaatagtacttgagccagggctggtattgaagcctctgcttgatggacgactgcagcttgtgttgggtcttaatataaatgaattctcatgcctccttgcaagttgagtctgtacctttttattctcctgtaaagagaatcttgatgaattaaacaacaatttgactgataattttctgtatcaccaatcgattaataactacttacccattgcctgtatttttcctcttccttttccttcagtgttagcatgtagtctttcagcatggccaataggggaagctgcaaaactgaatgttaaaaagtcttgttcaagaaattaagggacttctatcatttgaaaccaaatagttgacatttaatccaacttgtgggatttaggnggctatatttaaatttttttgcatgcggctattcataaaatgttattttattggcaaagtaaaatgtatcaatgcccaaatacataacaaattaattcacaaagatttgctaaccagcattcttatcagaatattatagttgagtatactattataagctatacactgaatacttcaaatacaccgctataaactagtgcataactgcatattgtttaggtcttggtaagacaaggccttcttttttgtcatagagcataagttcagggttataattatttattcttcatgagctgattgatgttggttgatttgctg

SEQ ID NO: 7632 - DNA, 1133 bp, Oryza sativa
  unsure (1)..(1133): unsure at all n locations
tatgcagcttcctagaggcatgccacatgggcctttgcttgtgtgtctttgacaaggttgcttccactaatatgagggccactttactaattgtgatttgccagaagtttttttttgcttttcaggagtgaaattagaagtagagaagattctattatctaacactattttgctgtcatgcatcatatatgtgctaaggttgatttcgtactttaatgaaagcttcggaagaaatgtatactaacatagaaagttttcgtaatgattgttcttctaaactagacattgttgtaatttaatatgattgtgcatggttgacaacttgatattatcaaatatttaccttattaggaaaatcatttgcacattacttcccagtctcaaggaaggttttccttttaaggaaacaaccttgttagttgttacttttataaatcggtgccaataaaggcattggttatcccagtaaaagataattctggccatttagattggttatggtaacaagtacatggtggcatactggcatatcaaacttgtaaaactgaaacagtttatggaagatttcatattagagtaacttctaaatcgaaatgtctttatgaaggatttcatgtttagtaattacgttttgagtcaaaggttcacacctagtcgtagtagaaagaccttttccctctcttgttcccagaatttctgtctttgccattaagagttctaccaggcctgcacttttatagttaatataacatatatgcactaacttttgactctatntttaaagggggggtaagctttttatacttacctgggattttgttcacaatgattctagcacgctctgcacgcttcaaatgcttatgtgctcctctgcttatcgaataccttctctcatcctgcataaaacattgtagttagctcaacatgatgtagtcttggaattttggtatggcaggagcaagtacggcaccctgctgtattcttctagccatctctcttcatcacatgaagccatccatttttcaaccttgtccattatttctttacgacttgttgcctcctcttttactttgtatatatattcatccattgtctttagtagatcatcatggtccacatcccctgttcatatt

SEQ ID NO: 7633 - DNA, 11294 bp, Oryza sativa
aatgaaactactatatgagctttagacagtatattcttcagtatttcattttttggtttgtttaccttctgaattgtctcgagtgtgaggcttcctgggcctagcatactgcttcctgaagtcattgaatatatcttaatttcaccatatggcctgcgctcttccatgttagtatccagaatattccataattttgtcaatgctttcccaaggctatggagctgcatgttaatgcctacattagtgtaatatacatggtactgtagcagggtcaggcagctcggcttcctggcctaatgcccatgacatttgtgcaaacattttatgttcctgcgaccgttcatcgtatgcttgtaaattgtattaattgtaaccctgaaattttggtgtatatctattatatattattaaaactgggtgcaaaggagcccccatgcctgctagttcgaagcaaatatagctgcgcaaacatgtgatacattttgctaattctaaatttctaattattacatcggttcggtgcattatagaagtatttgcagaaggataagaaatcaccttgtccattctctggttcttctcttctttaagttgctggaccatggtgttgagcttgttaagaatgtcatcactgatgttttttgtttgttgatcatttgcgccatctaacaagcttgtgtggacattagagaggatctttgagggatccatccccataatctttgcgtagttgtgaatgagaaccttgtactcttcaactttgcacaggcgatcactctggagtaaataaaattccaataggtaaatcagataacagggagcctgaattgctctatatttgactctagaagaattcttctgtgcttctggtaccttttctcttttaagcctttgcagttcactttggtgctcctcgagtttctttagtgacagatcttcttgattcactgtgatggcttcattctcagggcgtcctgctatttcagaggcaattctttgtatctcagtttgaacctctctgaactgcttcagtctggcttcttttctcatctgcatttcttgcagggctggtgtgatggaattcagctgctcctttagcgtacctgtcattttctcaggctgcataaagaaatttcaggtcaggttcttgctgttttcttcaatttgattatacagtatggtctttgagatgagaatgatactcggcctgggaatgatctttctccaagagaaagaagtaggttggtaaattctgcctcggattcagccaacgcttgatgcagttgaatccgagacatatttgcactatttacttttctcctataaacttcctggcattcctgctctatctcttgaagtattctctctctttcattttcttcttgcccaacttcatcccatatcatctgaaatcgtttggagtatgataagccaaataatcttcagctgtcatgctacaaaactagatgttttgagaaagaggaatgtgtgcaccttcagttcttgaagcaggtaggcacatgaggactctggcagtgctgcacagggagcttttccagtcatcttgagtgatcccatcttctggaaatcccaaggcgaagattgctgggagcaatttagttggatgcactacttggttaggggatgcattggagcgcagagatgtgtgtaagtagtgagtgtgtggcagaaaaagctgggaaacacgttggtgctgcgagtggctttagatgctggatttgcttgcaagacaagtagcacatacgtggttggtgtcaccgagctgaaacacaaagcctgaagctttgtgaagaagagtcttgacagttgctttgctttgttgcttctttatcttttcattattagcccctatagtttcaagaagttgagcaggtatggtcttttcacgcattgtcatatagtataatgtaatggaaatgttaaacaaaaagatgagggttctaagtcattgtgatggctgctcttcatcttcagcaaattgaattctggagacgtccatctgtgctagagcttgcaactgaagcctgcagacaaatgggtgctactttattggacgtgtggattgtactgagaacgaaaccctacttcgtgaccgcttaaggtaacagatcaattgcttactggtaggcaattaactgcaggttaagaaataagaaggtaattctcgtctgcatgtgccagttattatttatagccacaggatatcagcttaagttgtttacgggaatttcagcttaggagcaattcggcgtcttgtgcattcgctaagtctaatggcgtggctttcattctcgtgttggtctgtcacatcgcattatgggactaattaatataagatgtataacaatgtcttatcatcatatcgtcaaatagcattaaggtgaaatagcataaatcatgagaataatatgtcagttgtgggctgccccggctatttcagggtttgcaagttgggcagttgagattggacaccccaagatcgcgaaaagaatttgcgccagtataatttgttttatgattacctttagcaagctcttaagatgaacttttgctacctttaaccagcacatgttttggtgctgaaatggtagtggtttttgctacataatgttgacatggtagcgaacttaacaaataaaaacaaaaaggggtaattgtgttcttgtccctatttacaactgcaattgtgattttacccttgtatttttaactttgtgattttaccctcactattttgaactgaagctcaggtatgctcctgttccgttagcagggcttaatggtgttaactgacaggtaaaaggacatctatgcccttgcagatttggcttgtgaggactttgtgttttggctgtgtttcacgattacagtagaaaacggaggtatgaacttgccctgcatgcttaattattttaacaacgaaatccaactttgtaactacacaagaaatgcgattctccagcatatgtttaaaaaaaatcaagggatttattaattaagaaacactatggaccgaggtatgaattcaatgcctcaatgcctgacgtatgaacttgccctgcatgtttaatcattttaacaatcaagggatttatgaatatgcaaacaagaaacactactctcatctctttctttcaacaacagaatagctttgttggtcctgtccagtttaggaaccaaccaatagtccaaggcagtaagaaaaataaaaactaaagggggagtgacaaagaagaaaaagtaaaagacaataaaactcaaatgttcctctcctcctctccttgctgttcttctcctccttgtcaccatcatgcctcaggcgagctcctcgcggccatgctaatggaggcaaggcagcctagctagctacgcatatgcagcagtacgtatgtactcgatcatctgctgtgcagcggttcgggcactatagccgaggccgatgccgacgagcccagtgaccaccacggcggacggcgacgggctagctcagcttgacatcgccatttcgcgccggcccagcctgcttcaccccgcgctcctccgcgacgaccgcgcgctcctcgctctcgctagcccgcgtgtgccgccaccgctcgcgagggttaggaatcggggacggaggtcggaatggggtacggggatcgggaggagtcagcagtggcttaggttgaaatttttgggatagagatgtctttttacattttgcaagtcaatttcttattttcttaaactcatttaatctgagtccacctaacagacgttaaacaggggcaaacagaccattcaacatcaaaaagtgagggcaaaatcacaaagtttaaaaagtaagggtaaaatcacaattgcaaataaaagtaggggcaagaatacaattgccctaaacaaaaaagtttgtgagaacaccatatcatcctgctacattcctcctcccttcccatctccatctcctgtgcagctaagcctgctaatgggttggatgggaatgggtctaatggattggttttcaatttggcttcacttggtatgggtgtaaacgggttgagatagctaatggattggatcggcttgggtgagggatggatgtgggttggattggattggtttttggacataagttttggattcaatttgtaggttagtctttttttttctcccttatagttgactgtttggttccacatatagatggccaaataggctgcctggcccggcatggcccatgcacgactaggcctgggttgaggctagtcgggccagtatggcctgaccaacacccaggccaggctgggactgcccatgggctgcacccctggcccaacaagactcgggctatgccgggctggcccaaaggcacgatagcccatcgtgcttctctattaaataaggatttttttctccctcatctctttgggctatgtgggccgggccgtcaagcctcgggccatatggccatctatagttccacgtatctgtcaatgcctaggtgcttactctctctgtttcattaaaaaaaaacttctaaatttaaatctggacatagggggtgtgcttgcacatatggacttcatattattgtcatttcaaccaaaatcaccttggttttaagtgattcggagggtgtccggcgtaaatagttgtttctataatttattcatttatgggcattgtgtggactcagaaattcagattgccaatcttattagacatttgtgcccgagcagctaagcaattttattgcacaacatcaccatccatgaggaagagaaacacgatcgagccaagcgatcgaccactaccacacctgatcgaaatggttgaagaagaagaaaaaaaataaaacccaactcgatcgaccgaccgatcactctttctcagctgccagcattttgacgatgaggcatcaactcatgcatcctaataatgatcctttcccttgtttcattcatcaggaggcgagcgtggtggggaggcagctgtcgtgcacgcagctgagcacgtcgcggtaatccctctccacggtgaaggagtcatacaccttcccatcgctgctcttcttgtactcgaacagcagcgacgagtggttgaacgcggtgagcttgacgaacccgaagtcccggtccctgaaaacgctccacttggggatcgccgaggtgtagtccgagaggtggctcccgccgccgccggcgacgacgaagatggtgccgttcatggtgccggagtagcggcgcctctcgccggagacgcactggctctggtacatcgggcacgtccgctcgtagttgtggacgtggccgaagaaggcgacgtcgacgcggtggcgctgccacagccgctgcaggctctccctcccttcgggctcctcgaaggagccctggtcggcgtaccaccagttggaggagtagcccagcacgcggtgcgccgcgaagatgagccacggctggtgcttccggtccaccgtcgacaggcactgctcgatgaacttgtactggtcggtaccctccctccagtcgtgctccgagtccgcgatgcagaaccggaacatcccgtagtccaccttgtacctgtgtcgtgttcgtgtatgcaccgaccagttcgacccaaaaagcttaatccgatagagcatatgatagaaaaaaaagtttaaactgataaagcatgatcgataaacaatttacaccagccagttcaaccaaaaaaagtttaagccgatggagcgatgatcaatatacaatttacatatgtcgagaattttgtggtctactcatcatacgtaaaatcgcaatcagtttacacaaaagcttaaactaatgaagcgggattggataaacaatttatcagcctcatcttttcacttatgcttatacttattagccaaaatttaaatttccaactttaaatttgaagttgattttagggtttttttcattggagtttatttttcagtttttacttttagatcgctaagaacacgtatataaaagttatattcacaaattaattttcttttgtaaatataccatttgacttattcacaggcttttgtggcctcctcaaacgtgaaatgaaatatatagaagtgggctacgaaacgtaccagaagttggctcgattctcggccgggtagtagtacatggtctctgccggaacgccgcactcgccgccggagtccttgacgtcgaagaaccctccggtgttgggccagtccctctcatggttaccgctgcatcaatcgacacgaaaatgccaaatgaatatgaacaaatgcctgaacatttgttgagtttgtctgaacattgcacaataacagatactaaccttgcaatcatgtagggcttcttggcggtgatgggggcgacctgggcggtgaactggtcccactgggagatgtagccattggcgtacggaagatcaccgatgtggaagacaatgtcgtagttgtccagatcctcgaccagcctgtccgtcgtgttcagagatcctggctggtagttggcgaactcgtttgatccgtctctctccgcctgaaattgcatatattcagatcaatcaattacggtattattacactatatatataacagctgtgcaatttgtcaaaatgcatgtcacataagaatttattccgttttatatggaggagtagtaatttctgattgatctagaggcaaatgttgatgaacggtttctgaacattcttgcaggctttgctccttcgtcagaaacgaaaattttcaccttgcccatgtcgccgaagacgatgatgcgttgcagcgagttctggccagggaagggtggcgcccggaaagtgtattgcttgccccagacaattgatccgtcagaaagttcatgcccaatcttgtagtagtacctgaaatcacatcatacgtacatacataccacagttctgaatatacaattgttcatcatgatttcacataattaattaactcttgctgctgcactaatcaccttgcaatgatcaaagattattttataatagtacatacaaaggtttcttttccctggatagaatagaatataaaagcataaaaaatatgcacgctttcctagctcctaaatagtaatgtgatttttcatatactttctacatataattttttaaaagtattattgtaaatcattttccaattttataatagtaaattcattcatttgtatacttaaatcattcatctatttcagcattccatactattcagtcctaaagatcgaacatgccacttactctttgttgggccacaggtctctcaggaaagctgtgtggatgaacccggggtctctccacccaacagtgcgtgccggctcacctgaaaagcatacaagctcactcacctttacaaatttctttttgttgatcgtttatttttgtacggcttaaccaataattcgtagaaagaaatggagcggtgtggtacataatgtgattatttttattatttattgaaatttttagttttaaattttaaaaataaactatcataatacttatttctaaaatctaaataatttttaccatgtcatctcgtctggcatgccactcgtagcagacatgacagctttataatgttattgtccatggtagcatgatgaaataatattaccacaccagccgaaccgatatggcgaaataacgatatcatgttagctagaccggcatgacagtattgtttcatcacgctaatctagttggcgtggctaaaagattttagtttggaaataagttttgagagagtttttcttagaaaaattaaaaagtttcagagagagagagagagagagagaaaatctaaatatgcgtgcgtgcgtaccgcacatgctgccgcggttgaaggtgagcgtgccggcggcggtgcgggttggagcggcggcgccggcgacgaccatgccccactcgacgaacgggtacgcctcgctgatgtcgtagccgctggtccatgtgacggtcatctcgtcgtacgacttgccctgcgccagccgagggtacaccggcgccttggggttcttgaacgatatcgcctccgacaccgccaccagcttaggctgcacatcaacaacaacgccgtcgatttcatctcatttcatcagagttcttcattacatatattgcgattaattgcatcaagattgattaattagttgcagttttaattagtttctttcttaattgggttaatcgatcataatatcacgtacgttttccaggccgccggtgaacagggcgaaggagaagtcgtagcgctggttgatgagctggaaccggatgctgcccttgccccagtacacgtagttcgccgagtagtttgcgaattgatactgcatgcgcaaatcaattgattcgttaatcatccataaacatgttcatcatcagttcatatgtgcagcaaccacttgttaagattcaggttcagagaaattgcagttaatccacctttattggtgcagtgcagagcagcggctcatccgggtatctggaaggattagggcaagaacccgagctgcacaagtgacacagatttaacagtttaaactaatttcacgatcaaaatgtgtccactgatgagtgaaggaaactaatttcacgatcaaatgtgtccactgatgagtaaaaggaactactttcacgatcaaaatgtggaaatttgaaaggattttgttgtaattagtagtacatgaaatcggccggagagaagacagcaatccagtcgtcagcggaagggtttgcccagccgtatttcaccgtgacccactctgtgtcttctccctgaagaacatgtagtgcattcagtatgccaaattgattgatgttgatgcaaatttgaaactcctatacttttatcaaaatttcacatgtttaattaccacttcttatttaaacttatttattgttcatcgtcttctttttttcaagtaagctagctgttacggagtagaatattatcaccggtggctaggggcggaggcaggcctagggtagctaaggcttaagcccttgaactgcctccaaaaacttgcttaaattttgttaattcaccatatagtatttttttttgaaaaattaatacttcattagtcgagttctatatttttagtcttctataattttttgactccgtcgccggtgacagtctgtacagcagacaaaaactccgaagggcccaactcgaagaattcatgctctatactcttttctcactaagcaacaggttacagtaggtaaaaaaaagttccatgctaaatgctcgttaattaaagaaacaaagtcaaggtgcgccacctctggttagttcttgcgtgacagcatcaaattaaaatgatcaaattaagtgtctcctacttgcacacgctgaccttgatgcttcatgctaagatgccttaatttattttttgctaagtgctaagataaatcacagagaaaataaacagaagtaccaaaaaaaatttatagtaaaatttccatatctttatatttttactggtttaaaaatcaatactgaaaaataaactacgattgagaaaaaaaaaactctattttacggaataaaaaattaatgaaaacttcttcaactcaactttaagttttaagatttaaattttggttgtggcctataaaccaacaacaaattaaatgatgagagatacggttagccgtgatctgtactacagtatacaacatacaatctgccgttagctgtacatgctgacaataactttttttcttaagaaaaaaataaacttttttttgtgccctactaggataataaatactatttgaacggtaggggtttgcatttaaaatgcaaaaaacaacgtgcacccgaccgttcccccatcgcgtgaattaacacaccacgacgaaatctatgctgttctgcatttctgctccggtggtcactcgtgtcgtctacctggcgatggcgaatccaccaacagtcgcacaactcagatattttcacttcttggtcagctacttcagttagctaaacacaccacgcatgcatatgaaatggggatataatatataggagtagatcgatttggattaatcagcttaacataatctgcgtgatctgagtgcaagaatttcgccagattctctgctccccggatctatatatttcaattcaggtctcaaattaaaacattaatgatctctctctctctctctctctctaaccgaccatggcggcggcggcggtggcgggcgtgtacctggtcgccgagcaacgccggcgtggcgctgacgaacgcggagccgtggaggtcgacggtggccttgtggacggcgatcttcgacagcggctggaacccttccagcgacgacgacggccgcgacgcgctcgccgccgccagcagcatcgccaccgccattgccacgcctcctcctcctcctctcttcctactaaccatggctagctttctacagctagctaatgcaatctaactacctctcctgcttccccagaagctggaatggatggatgattcgccatggccatgaccgtgtggtgatcatcttatacacgcacggcaggaagcagcttcagtgacaggtggggcccactcgtatggacctgcacgtcagtgacacacgttcccccttgacatgtgtgcatgtcagaggagcccgttacacacagtggactacactaaattatactaagccgttgattttttaattaacgtttgaccactcatcttatttaatttttttatgcaaatataaaattacttatatcatacttaaagaatatttgatgataaatcaagtcataataaaataaattataattacataaattttttgaataagacgaaaggtcaaacgtttatcaaaaagtcaaaggtgtcgtgcattaaaatacggatgtagtacttattaatcgtcggcgtggagcacgttacctgcttaatttggacattgatcgtcacctcttttgggattatttgtatttggggtctcttcaatcgtctcaacttgtcaatttgtttaaggctgctgaacaaacgcagatccaaatatggcataggcaggatctaaagtgggggaataggaatgatatttaactcttgcagcttacttggagtatgatatatactccctccgtttcaaaatatttgacaccgttgactttttagcacatgtttgaccgttagtctaattaaaaaaaattgtaaaatatgtaaaactatatgtgcacatgaaagtatatttaacaatgaatcaaatgatatacaaagaataaataattact

SEQ ID NO: 7634 - DNA, 10189 bp, Oryza sativa
caacggtgtcaaacattttgaaacggaaggagtagttattattttattatacatcatgtgtagttgttttttaattacatgatgcacactcacagaaacaataaaaagcactcacatcatcacgagtgggacactttaccatacacttaggagtcgtacctaataataaactcgtgaatcacgctaaattcttattattagtccaagtagtatgttggaaaccgtgtctaaatgcatgtttatatttgtggatgcagacagtaatatataagtcatcaaataatatatctcaaaagcttacatcactagtatgtgcaagatattaatgttttacatgtataattgtataaatgatattaattggtttgaacgactagaaacgtgttaccacattaatcttagaaaaaaaaaggttcgcaccatttgcttctggtgagtctaaattatttttttttgcggggagtctaaattataatatttagatttgattggtatggttgtatatggaatataatcataattatgggaaaataagtaagaattgtcccaagagtttaatataaatctaatcatgtttttaaaatttagcttcacacaaaattgtgtgagaaaattcactagtttatatacatttgtgattaataacatataatgataaaatatctgtattaacaagttaatccgggttgatatctgaactataaatgaaaaggaagaaaacaaggagaaacaactttgacttctttgttactcctatagtttagtggtactaaatattttttaaaataacccacacaagatagtgcgaagttttatactgatatagcaggaaataaattataagattataatagtaacttaaaaaaaccaaacacgccaccaccacgagttgatagctcctagctcacacaacctagacctacaaggaggtcacaaacgcccgggcaaacaccggaactacacaacaccaacccaaccatcgctaagcgtgatcgattgtcgctagatctaaaaggaggtcgcaaacgccccactaaacaccgaaaccactcaaaaaattgtaaacgatctttcgattatccttttgcagaggggttgagaagaggaagtaggtgagagagaagattatcaagtcgttcctcgtgcgtaggtataaaatagtttgattctcttaattattatactttatatatattatccttatgtgctgaactcctcaattattgcagcaaatacgactgatttgggtcacttcaggtttggggcgttttttttgacaaattggtccttgcagaaaacttatttcgaaactagtccctaccaaaaactatatccagaaataggccgtcggatcagcgccaaagcggttggcgctgaggttgttcttatctgcgccaacgggactggcgctgacatcgcgccagcgtggcgggcgaggcgcgatgtggcagggcctcagcgccaatgcacttggcgctgacaccttgcacaccctaaatagaccgatgtgcgacaatgaattaacggtgtcgctcgtggtgcaacggtaagtttctttcttgctatatctgaggactagggttcgaatcccaggtcagccatttttgtttttttttaaaatcatcaatctacgtgcgtacatattaatgatgatctccattttcgtttttgtcttcaaatcttcaatgtactttttttgtttaaattaatttttattaaaaagaaatatcacatttagtacaaatttaaaaagtagaagaatggattaaaaaaagtttagagacaacttttaaaagaaatatcacttttttataaaaaagaaattagaagaatggatttaaaaaaacttgagttttttttttaaaaaataaacaacaagttgagaactaagggtaagttttattctaaaatgtcacgtgtttttttaaaattaaaacaacacttgagcttgtaaaagaaatatcacttttttaaaaaatatttaaaaggaataacacatttagtacatatttaaaaataaaagaatggacttaaaaatacctgagctttgaaaaagttaaaaccgcaagttgagaactaagtaaaaaaaaagtttagtaaaaacataaaggagagggttcgaaccctggtcactgtaacgccaccgttcaaatacctaccactgagctaagccaaacctaattgttgcttttgcttttgcttttatttagccagtataaaggccagcgccgctgtagaacatatattctgatatttatatttatatatatttaaaaaacagagagcatcattaatcatttatatgtactaatgtacgcacgtagattgaagatttgaagaaaaaaaaagaacaaacaaggctgccgtgatagggagtcgaaccatggtgctagggtacacaagcaaatggtcataccattgtaccacaagtgcattgcttattaatggccgcgcatccttttaattagcctgtacaaggggtcagcgccaaatacattggcgctgaggccctgccacgtcgcgtctcgcccgccacgctggcgcgatgtcagcgccagtcccattggcgctgatatgaacaacctcagcgccaaagaggttggcgctgagccgacggcctatttctagatatagtttttggtatggactagtttcgaaataagttttctataaggaccaatttgtcaaaaaaacggaggtttgggcgctcttttttgtgtagtttaattaatcgaaggtacagatcacgcctgcctttgttggtagtacaggcctatttagttcgcgaaataaaatttttttaagtgtcgcatcaatgtttgatcggatgtcggaaggagttttcggatacgaataaaaaactaatttcataacttgcctgaaaactgcgagacgaatcttttgagtctaagtaatctgtcattagcacatgtgggttactgtagcacttgtggctaatcatggactaattaggctcaaaagattcgtctcgtgatttcctccctaactgtgcaattagtttttttaatctatatttaatgctccatgcatgtgtcgaaagattcgatgtgatgtatttgggaaaaaaatttgggaactaaatcaggcctgcctccgtccgaaaataagtgcagtcgtgagtatctgtgtccaacgtttcactatccgtcttatttaataaaagtatgataaaattaaaaaaatcagtcacacataaaatattgttcatgcttttttatctaataaaaatattaatcataattttttttaaataaaacgaatagttaaatgttggatatgaattgaatagtgcaaaactgtagtacttatttggagggagggcgtactgctttatgcttcttgctagctcttgtcgttgttaaatgatgagagatacggttagctgatctgtactacatatacagcatacaatctgccgtacatgctgacaataactttttttcttaagaaaaaaaaagaaactattttttgtgcactactaggataataaatactatttgaacggtaagggtttaatttgttgcatttaaaatgcgaaacgacgtgccccatcgcgtgaattaacataccacgacgaaatctatgctgttatgcattctgctccgctaaaaaatgttcggtggtcattcgtcgtctacctggcgaaggcgaatcaaccaacagtcgcacaattcagatattattttcacttcttggtagtacttcagttagttgatttggattaatcagcttaatatagtctgtgtgctgtgagtgcaagaatttcgccagattctttgctccccggatcttcaggtctccaattaaaacaagtattttttcatgatctctctctgaaaccgaccatggcggcggcggcggtggcgggcgtgtacctggtcgccgagcaacgccggcgtggcgctgacgaacgcggagccgtggaggtcgacggtggccttgtggacggcgatcttcgacagcggctggaacccttccaacgacgacggctgcgacgcgctcgccgccgccgccgccgccgccagcagcatcgccaccgccattgccacggctcctcctcctctcttcctactacccatgggctagctttctacagctagctaatgcaatctaaccacctcgcctgcgtccccaagaagcaggaatggatggatgattcgccatggccatggccggagtgatcatcttatacacgcactgtaggaagcagcacaggtggggcccactcctgtggacccgcacgtcagtgtcacacgtcccccctcaacatatgtgcatgtcaggggagcacgttacacaccgtggactacacggtgagtttgaagaggtgattgagaagatacgtaaaacgagattaaccattagcgtatgattaattgagtactaactattttaaaaatggattaatatgattttttaaagcaactttcctataaaaattattttttacaaaaaacgtaccgtttagtagtttgggaagcgtgcatgcgaaaaacgaggtgttttctgacattggatacaggtatacacatttaaagtattaaacgtagactaataacaaaataaattatagattccgtatgtaaactgttatacgaatttattaagtataattaatccatcattagtaaatgtttacttagcaccacattatcaaatcatggcacaattaggcttaaaaaattcgtctcgcaatttacatataatctgtgtaattagtttttttatctatatttaatactccatgtatgtatccaaatatttgatgtgataggatgaaaagtttttgcgtgggaactaagcatgacctaaatctttataccgatttcaggattataattctagcatgttattgggccacgtggcaacctgataatttagctgaacaactccaaatatttttcacgtgtcaattatgtcgtgtcaataagatatctaccagaatctctcttagaaagctcctgtgatttgagagctccgggccaattgtcgaatggttaaccccggcacatgggattcacaaatttggttccctcttgcaagaggcagctgggtcatgccatacacgttgagtagggaggtgacgacccaatccgatagtatctgaaacggatggttgggctataaccttcctaagaaatacaagttctaagtaaaagatctaatctctgttttataacatgtagaagtagatttgttgtatcaacacatgaaaattatatcatttaattttaaaacaaaaaaaatgtacagatggatagcaaaccaaggatccatttctaaaataaaaaaaacataagaagatttaagcaccacatcggttatattaaagggtaatttaaaaccatgccattataattttgcaacctgcccccaattgtacctcccacaacgattttggagtcgcgtgttcgatcgccgtgctatccacgtcgccccgcgcgctggaaggcggaggggtttttcgagctggcaattttcaaaaaagaccttggttttatatataatttataataggtccctcactatatgtttctatgttctgtattcttatgtaaaagccctccacaacctactatatcttatacgaagaaggaaaaaatgggaaaatagggctgcgctctgataaacgaaaagtgaggggtttttctgaaaaaaagaaaatccctacccaccccaccccacccgaagccctagctgccactgttccctacctttcccctctccttctctcgctctctcctctttccttgcgacgggcgacagccgccgcccggtctttccctccacctggcttgcttctcctcgtcggcgatgatctctcccacaccacaacacgccatcctctgcttcctgctgtctcatcgcccctctcccactccgtcgcagcgtcgctgccccgacccgaggatgcaccaccttcagatctggcggtggctagggtttggcttggagtggtggcttgcagcaggccggacgcgggtgcgcagcggcggtgcagcagctggcgcagtcgcagcatgcgcaaggcagcaggtcgccggtgcggacgcgcggaggcagcgtcgacgcgcagcgtgcgggcgcagcagcagctagcaacagcccagtgcacgggcgcatggtcgcgtcctggtctgctactgctactctactcaagtgctcacatgctatttctaatcagctaatggcactaataagtgagtattccctatttctctgtagcatttaggtagactctggactctaatctatttatcttttgaatgagaaacagagccttctatttaatagttttttatttactgataaacttgcaagagagaagaaaacaacattgtttaactactttacaaacccaattgatgagagcacaaaccaaccaacaagattcgaatagattttgatcctaatgaaattcttttcagcacgatgaatgacaatggaggatatgttggtggatgcagttacatttgtttctttggtttaagatttgtttccgttgatttgtcactaatttgctactttgcatatatagctggctgctcacttgacttttggctaaggcctaaaagaatgcactttgtgctggcaaagtactccttttttttttcttttctatcatgtgaacatttaatttgacttgtaagaggaaggggaaaagaagggagtaagaggcagtttggtctcagaagaatgcacttttttctttaccctgcctcttacggtttgtggctgcaatggctagcagtgtatctggttcaagaagtcttatcgacgttgttccattcttctgatgaccacactggatctggtcatttgttgcatgatagaggatccatcatggtgtattcatgtagtcattatctccatgctttccttcatgctcagtgaatggagactgaagactgaaaactggttggtgctcttgcaggtgagattgaagatataaaattggtcagggctctggtaagctttgtaatggagaaattttgcagctctagctgtttgtttcatagcttctcaaattgctgggaaaaggtagagatgaaaacatgatggctagagctacagtgtggaccaatgatggcacttggagctgggtaaggaccattgatgatactagaatttagagatgtgtttgcgcatgctatactctacatgttttatatttccattgccttttttttccttttcttttttcatttcttcttgaaggtattgggtcagagagagccaacttaggttttagtgtacctttatattggtaaagtcacttggttattcaatctaggtccagagttcggaatctgaactacaccttatcttggctgtataattaatgggccccggtgagtaaatcgttgagttctgtaccgtgactaaagcgatgcagagtataagaaattcagaataaaaaattcagaaattccagtcataaattcagaatcagaaattcctaacctcgagacatggtcaaaactaattaacaagttttaaggaatcagtgttgaggttgtgttctgctcttaatgtttgttttaatccatttttgcagtacctgcgtgactattccatattttctgctactggatagaggcctttgcagagtacctccgtcggtatggaagaaaatgtattgttaccgagttatacggagtatttgttattccattggatatacggagtacaacttatctgtgactgtgaccacatgtgcataagttggtttaaaactttaaatgggcttccctgaagacatcgtgaggagtgctctgaagattgtcgacggcgacgagaacatgattcttgaaaagctctgctctgtctgaggccctatggtcgatatgaactgtaaattaaatccccatttgtaataagacaacagtgcttgctaatgctcattttctgtcttttcagtgtgccctttatgacacctgtaaaacctattagcttgaggcacacattatttttgttacaagtataatggttatgcccatgaataaatggaaatggtgtgaattgaggttaacaatatgatggttccaagagctttttgtttgtgattctttagccagctgatagggcgcgcaacgcgcgcggtaatgtctagtgtagactcaagaggcctcccactgtgctagattaccagtcacaaatccatttttggcatcaaagagaacatcacgtgatttttatttccctcgaaattgtagcattacaataggatagttaattgaaccaacgaaaaatatttattggtaaaaaaagggctactcaacgaagaaaaaaaatcaaatgaccatataaaagaaattaaatcccaaatcaatatagaaaaaaatattttttatatataatttagacatatgatgttgtgctctatgagttttggcattatcaaatattggcgcggtagataactgaaccaactgaaaagatatgccgttaaaaaaatgctagtaggatatataatgaaaaaagaaaatcaaatgccaatacaaacgaaatttaatcacaaatcaatattgaaatcaaaatataatgacagtcttttgcaatttgcacagatggttgtatgctctataagctgattcatgcctttgcatgttctcaaatttctgtcatgccctaaataatattgacaaaagcaattgatttataattatctactaagggttaaaaaaatatttaattttcttcggttacacgaacaggctaactaaagacgtgtcaaatggctcgccaattttctactagtagttatacttaatcgtcggcgtagagcacgttacctgcttaatttggacattgattgtcacctctttttgggattatttgtatttggggtctcttcagtcgtctcaacttgtcaatttgttatggctcctgaacaaacgcagatccatatgtggcataggcaggatctattaatggggagtagctaggaatctatactttctataacgttataatcctctaactctaaaacttaacatgcaaccatgccacatcatcacccactagcaataattacatattcaacctcatacacacacgcaagagcatcagcaatctatttaattatacaaattaacatgcaagcatattcaatcgccgcctctcacatcatttccacatcaattttatgaatctctctatcatttttataatattgaatatatacttatcaacgtgttatacattaaagtgtgaatttcatttgtttcatgataaatattgataagccctgagatttgattattttttctttttactcctagctgaattgtaacaaaaaataatattaaaaattacttagtaattcccgcagcaaagcgcggggaatcccctagtaatatttagctcttagggcatgttcaatggtagatattaatatagtttcttgaacaatacacgattatttagagacggtgtctttacgattgttgagacgacaaaggttgtaaccattaactctaaaaatgtgtatcttgttaacattctttccatttttcttaccttcatgcaaccatattccatattatagtgattaagagtcgttgttaagctgatgttatgcatagggacgatattttatctctcctttttctctgtgttgcaagtcatcaagtattccagaatagcaatgataagaccccactattgacaaccattgttcttggattcgccatcgacaggtagccgacgagtgtccaccggaccttttttttaagcaacgcggaatgcagaacattatatactccctccatcccaaaatataagcatttttggatttgacacagtcttcgagaagctactttgaccaccaatatctatagatctaagatgtaaataaaaagagctacatactatgatagtttgcttaatgataaatctagcaacattaatttgacatgattgatctttttcattttttatcactccatatattccaaaatatagggtacaactacttttaaaaggtgtttcataatataaggcatacatgcatgcatgacaatttatagcacttcctctctcagtaattatcattttcctaaatcatagactctcaaaatgtttaaagagtggtttgcgtcgtgggacatgaacttgtgtggtgggtccaaataggtacatccacttatagactcgttcatcctaa

SEQ ID NO: 7635 - DNA, 869 bp, Oryza sativa
aattaagtgatcacacaggtgagaaaaacattgaaagtacgcatcacttcatattcgttcaaacggccagtgtattagagatggcaaagcatgattcaggtgacgagtaatttcgtaataattactagctagagcagttcctattcgatcggagtggttgggaacacatgaaagcatgcccaccttgatggatgtcatgactttgaaatgaaggccgcttctgaattcatcagttcacattcaaattttctactttgcccgaccaaaatactactcaacaggattgtaatctcttatgtattgtttaatactactctgtaatctaccctgttttggaaacaaagaaaaacgaatactcgtatcgaatttaggaattacaaaactcactgaaagttatgtgcagtcaacgtccaaggttcattaccacagtacgaatctgagcaacatctattgaaaagatccctttgggccaagtgagccaaacaaatgtgtatgctgtttctatcaaaaagattactgtatcacgaattcgagcctctgatttcatccgagttggacagtggatacaaagttttgacttttatcttgctggattgctactcaattagtctttcctgatcaatttctgatctgatggcttcagccaacttcatcaacctgatgctgtggtcttagaagaaatgaacttttgttgctcacagtacagactccagaacccattgtcttcaaggggatttttttttttttgtcttcaaggaaaaaaaaagttcagaacccattgtatttataagtgttgctgtgcttatgttcaatcttaatgcccttcggttaaatattatgttatgggcatgcagtcacaagggctgcag

SEQ ID NO: 7636 - DNA, 1726 bp, Oryza sativa
tttcacaggttacagctattttatgctgttctattactcattatggtcttgttactcatgttttccttatagatcttccttgtacataaaactattgtatcattattgtagaacatgtggcattcttgtcacactgttcataactctcactagaagttgctgttgatatgaaatcatttcctggtactttgtgtgcatggtaaactgaattcactggactagtttattgtaagactctgatgcgtatgcgatggtttgtttcttggttcttgttatcctttttcctgtttctctagctgaatgtcaaatgctctaataattgctgcagaacacaagggagacagcgttcgctcttcgcaagctgcctttggtcaaggcaaagcggtaccttgaggatgttattgctcacaagcaggcaattcccttcagaaggtactgtggaggcgtgggccgtactgcacaagtgaagtctcgccaatcaaatgggcagggcaggtggcctgccaaatcagccaggttcattttggatctgctgaagaatgctgagagtaacgctgatgtatgaacctgttgctagttttcctctcaattttaatggtgacactcttcatatttttttaatatgcttgggctaactaatggtttgttgcgtataggttaaaggcttggatgtcgacaacctcttcgtttcacacatccaggtgaaccaagcccagaagcagagacgccggacataccgtgctcatggacgcatcaatcgtaagttctcgaggatggatgttgatttatggttccatttgtagtttacttatattgcttttgtggccagcttacatgtcctcaccctgccacgtcggccttatcttgtcagagaaggaagaggccgtgaagaaagaggtatttgtttctttcatcccattatagtatcagttgttttcgtgaattaggtagtttgtgggaagtaatgctttggatttatatagactattcaagctgtttgggccacaatgttttttctcagtgccatgttctgtgcaataatacaatcatgatgttaacctaaatccatgtatccttctcagcttgaggtccttgtagttggagctaaattttgtgggcgatgccccttttatcgttccagcatttctttagctctttttttcttctaatccatactgtcaattgtttcttttgtagcctgaaaccaccatcgccccgaggaggcagtgagcttatccgcccagagtcgcaactttagttcattttctagtactttgttatggcattgtgtgctatttatgtttctggtaccattgtttagtcggaacttgttaagtttgatgctatcctttcgtttgtgtatgttcaaatggtaacaattacttgccaacttatctgccaaaattttactgccttacaaaagcgtcatcatcaaactgccttgattgcttacagtgattcaaattaaatcttattttcgtctatgtaaaacggtcggtcgttcccggcacacgatggttggattgctgatgctacaggccatctagattcacaacaattcgattacatctatattattgtgagcttggcataatcatattcagggcctgtttagttaacaaaacacaaattttcatgctgccacatcaaatgtttagacacatgcatggagtattaaatgtaggaaaaaaaatcaattatatagattgcgttagattgcgtgtaa

SEQ ID NO: 7637 - DNA, 788 bp, Oryza sativa
acagaatcactggcagagaaagataggtacgattctggagactcaatatcccacaattgtaccacagctgaacctccatattcacaatcacttccacatgctagaagattttcactacagaactccattgtatcaattgaaggatagaccatatcctgggacctacatcaacacagaagttgacaaggtttgacagctacattaagatgaattagaaatttgcaagcttaactggaaaaataatatgttgagacatgcaaaccagggacattttaagtttgcaccacgcctatcgataaatagattgcataattgagcaaaaacaaaattaacagtggatgaaaaaaataaatggatcacaaataaagataaccaagaagtttcctttgcccaaggctacctagtagagaatacgtagataatgagtatagcagtaaacatttcaaaatcctcatgcatttagctttaactggtgttaccacttaaacaaaaatgatcataaagacataaactagataatattttatagtatgaatgtatgataggcaagtttttccactgtgcgtggcaattatatgtggggaacagtataattgcaaaatatgacatacaatattttgcacaacaaaagcattctacctagttatgtagccaaggacctgattaagctgaattaaaaaaaaatcagctcaataacaataaggttctgtgcaattgtacattagtgtcattcgctcactaacccttatagacaaaactgccaagagctagtttccaagctcatgtga

SEQ ID NO: 7638 - DNA, 474 bp, Oryza sativa
  unsure (1)..(474): unsure at all n locations
nnnnnnnnnnnnnnnnnnnnnnnnnnnnnnnnnnnnnnnnnnnnnnnnnnnnnnnnnnnnnnnnnnnnnnnnttcttcttctttttgtttttttaaaagggtgctaattattcctacaatttacatcttgtgacatagacatgatgaaaattctttttcagccatccctaacatgtagctaagaaagtatcatgatacattataaacgatcagatcaaagcacagaaacacttttttatatgtaataatcacgggtgacatatcgttagacataagaaaattgatttcaggaccataagagacatagggtagattcgagtagaattacttgaaaccaggacaccactgtcttcatcatcatatactatcacagccttaaatccggcattctgtgcatttctaactttatcgtcaaattggcaaccacctcgtatgaccagtgnnnnnnnnnnnnnnnnnnnnnnnnnnnnnnnn

SEQ ID NO: 7639 - DNA, 572 bp, Oryza sativa
acaaatgggaccaactttgttgtgggctcatgaggaccctgcctaccaagttatacaacaaaattcttcgtcaccgtgtgatagcccaactattaatgacaaaatccacggcgtttgtgatgagcccgtttgtcgccgtgaacatatattatgaccaaggcctccagttattgctaggattggttgagggtgaagtttacgatgactgtttaacgaatttgtcatagatcaatgacgtacggattccctattcgtcacacggaatgcgtagaaagcctatatctattttattgaagccctgggaagcccccgccttccattccccccaacccctctctcaccccacccaaccttgggacttataattggtctgtgctgccatctttaggcattgccggagagaagagatgcttgctagaggaaataaaatagctgctcgtggagaagaagaggtgcatgaatttccatgttcatctaactattaaactatacattggaattttcgaggaatattttaggtgatagaaaattaatccccaaatactaaacccttagaatacattaattttcac

SEQ ID NO: 7640 - DNA, 537 bp, Oryza sativa
tcctagtaatgctaagttgcgtttgtatccataaatcctaatatgtaaaaggcaatatctgctagaaacagattaatctggctgtacaaaacatgaagacagtgagaacccaaatcatcaagtctgacaaagctattctaaaataactgtgatctttaaatgtgagaggaacatactgtgacgacaaggcaacactcttagcttttctccaaaactgtagtcttccaagcaaatggcacaagatgatgatgtactattgtcttcttgcacttttgtaaaaataagacttggcattgctttaaccaattgactgctcattccatgaaattcccgggttacaggaatccttcccctgtcccgccttatctggtgtctcctcacaaagaaacaagtagctagaacagcagccatagcaagcagtgatgtgaaagaaattgccatgatagaccaagctgagttttcatatactggtagtatccacacctctacatcactttgacctgaatatttcttcaaaacctctcctgaagccttaga

SEQ ID NO: 7641 - DNA, 12404 bp, Oryza sativa
  unsure (1)..(12404): unsure at all n locations
ttcctcccaaaccaccaccattcatttagtgttccggtggtgatccagtgcaacaaattgggtagtaattttgttggtttttggagattgctcaattttggggcaaaatttgagaagaggatggttaagttctcgtcagagcctcatcaggggtaaaaatatcttgctcctcctgtgagagaggaactgttttagcctctctgttttgctactataggatttttccttggctgcgatgctacaaagattgttttggacctgtgcatgatgaaatgttccgtatgtttatttcgctggctcaattttgcaggacttttagctgatcgatgaattgctgttcaagtgaagcggttttaagttccaaagtggcgcttctgaattcactcttctgtactatagtattgccaaaggagaattgctctaataagatgaactgtacaaaaggagggggatttccccttttgttttgcgcagtcatttgtctcatggcccaacagggggcttgcaatgtggtgctaatagcgaataacactaccttgtcatttgatgatgtcgaggcaacttttagtgagtgctacaacttaccaagtatccttgcatttcactactgatcaacaaccaatgcaggcactgcagagtaaacgttaattgtttttatgttacgtgctgcctctataggttatgaatatttatttggatattgcactagtttgtttcctaaacaaatgctgctaatcttgtgtgacaattgatgaatgggatgattgcttttcttgcatcatgctagttgtactgtatgggtcttctagctgttgtacctgtattagcttttactaattcttctctagctatttgcatgtttctttacatttgttagtggcttagtgcgcagtgctatactagtgcctgcatcattctatttgtgttatggacaacttattggcatatcaatcacttgcagctccagaagtgaaagattcaggtgtaaatggtgcaatttacgctgtggaacctctggatgcatgtagtccattgagaaagaaagcagccaatggtcctgtttcaccatttgcactggtcatacgaggtggttgccaatttgacgataaagttagaaatgcacagaatgccggatttaaggctgtgatagtatatgatgatgaagacagtggtgtcctggtttcaagtaattctactcgaatctaccctatgtctcttatggtcctgaaatcaattttcttatgtctaacgatatgtcacccgtgattattacatataaaaaagtgtttctgtgctttgatctgatcgtttataatgtatcatgatactttcttagctacatgttagggatggctgaaaaagaattttcatcatgtctatgtcacaagatgtaaattgtaggaataattagcacccttttaaaaaaacaaaaagaagaagaagcaataatcagcatccttgtataaactggatatattacttgctctgtgcatatatatgcaatagccatttgagttttgactagaaattgttacagtggctgggagctcgtccgggatctacatatatgcggtattcctctctaaggcttcaggagaggttttgaagaaatattcaggtcaaagtgatgtagaggtgtggatactaccagtatatgaaaactcagcttggtctatcatggcaatttctttcacatcactgcttgctatggctgctgttctagctacttgtttctttgtgaggagacaccagataaggcgggacaggggaaggattcctgtaacccgggaatttcatggaatgagcagtcaattggttaaagcaatgccaagtcttatttttacaaaagtgcaagaagacaatagtacatcatcatcttgtgccatttgcttggaagactacagttttggagaaaagctaagagtgttgccttgtcgtcacagtatgttcctctcacatttaaagatcacagttattttagaatagctttgtcagacttgatgatttgggttctcactgtcttcatgttttgtacagccagattaatctgtttctagcagatattgccttttacatattaggatttatggatacaaacgcaacttagcattactaggattaatagaagtgctgttctggcgtgattgataaaatcttccatcaagatcaatattggtttatctatttgtttcctttgctgcttgagatgccaactcaattaaatatgtgctcgctggatttcattttattcctgattccatagcggagtaaatcttggcaacagtgctttatctctgaatttttagttgcgttggtggatggttccacagcattgcttgtgacaagatgatcatttagtgattccacaatgtaattgatatgaaatgattagtgcatccatttaatgcaactgctttagatagttgagtattgcattttagttgatccgttttctatgtggtattatttttgacatgtgtcatgagactttggttgtttggcttttacagagttccatgcgacttgtgtggacatgtggttgacctcgtggaagacattctgccctgtgtgcaagcgagatgcaagtgctggaacctcaaaaccccctgcatcggagtccacccctttgctttcttctgttattcatctgtctgctgaatcaacagctttgtcttcttttcggtcaacggtggcagtatctccccctaggccaataagacgtcatccttcatcacagtccacatcccgcgcttactccatttccagtgccccccgcaattataaccttcaaagatattacactaactcaccttatattagtacgagtagaagcaatgtagatctcgcaaatatgtcatcacaatggtctcacactccggaccaagcatccatgcattctctaagaagtggccatttgtctctaccgatcaacatcaggtatacaataccacatgtttctcgttctgactatggatctgccagcctgggtttatcccatgattcctgttctcaccatggatctccgagttattatcatagctctttgggccagcaacgttcttacctgatgcaccgcaccgagtcagggccaagcctgtctactatggtgctccagtcgccacaatagagtcagtagcagtacaatggcgaatcaggagaagtctatcagctgcggtttaactcgatcattacgtcaggcctatgtacagcattgtcttgattctgatggaagcttgtctgctgtgacatcggatcagtcgctaccaagatgctgattgatcttacgaagttcactgtttcatgagcatttgtgcaagcccctgctagatttgttcctgggagatgcaaataaaacagaaaaatcctatgcgacacaaaactggcaggttcatgcaaagttaattcatggaactatttcgtgccagccaccattgtgattcaacaaggttacttacattgtctgtacggaggggaaattggtgatcttaaatcgaagaaagacttgctgagttttgctgaagaagcaaatatccatcagtctacaaggaatggtttgactttgcgtattgtttgaggcttgtattataggtgatgactttagagttggtgtaatggtgtgtttcttttacattagttattttgtcatgcgtataaatgttacagcttagcaataatctgttagtcggtgaatgttttgtagctctctaatatttattcttttttgcgaaactttctaatacttattctgatcttggatatttgtgcaagtgtgtttttgttgcttcgttcttcctttcaagatcaactgtacctgaaaattctagagcatgtttacgctatgttagctgatgggagaattctaaacttaaccctatgttcactgaaatacaagtttagacgtgggacagatgtctaaaactgtttcgtttctgacatcagaaatgggagaggtcacctcttataatgccagtttggtggaggttttccataagatttctggaggtcctgatgcttgaaacgcttcatgcaaacttttgattcgttgcttgttgtgcctttttacttatttaactgagaattttcttctggacttattaccaggtatttgattatactgtttaattaatgcctttgaatcttttttacaagagcgcaacgtgtacttttacggctacaattatgacagtaccaattaccgtccgggagttcctgcatttgaaataatgcaggccttttagagcatagagatagagggagagcggcgcttagataggggcatgtttggtttatgggatttatccgtaagtttcttcatttcagtcgctaagaatctaaacagagatgattaaaaggactaaaatgtatattaaaactaaaatctattagtcctttatatgagaaaattagtattatatatacaatcgcactaaatctaaacagggatgattaaaaggactaaaatgagaaaattagggttatacaatcgcattaaatctaaacagggatgattaaaaagactaaaatatatattaaaactaaaatccattagtcctttttatgagaaaattaggattatacaatcgcaaaagagtggttttgctgaaataccaccgcttcaaaatgagttattgaaatgccattctaaactgagaggtgtttaccaaaatactatttttattttttttatagaaatattttcgctcaatattattttaatacccctgagacggcccaactatcgtactctttcactctcccagtagatctgacacttctctttcccctcttcctctctctcggacgccgtcgagagtagtggccgagaggcggacggtggccggtggaacttcttgctaccttttagctaagtttctactctctccattccaaattaaccaataaaaccaatgctaatttaaacagcatcagagaacaagaataatttaaatcgcattaagacacgatacacatatttctcccacgatacatatatcttaaaacacattatcaattacacattagttgtatcttaaaacaccttaccaattacacatacttaccaattacacattagcatataagaccttaccaattaaacattagcatacaagcatgcacacatttttcatgttttattagttatacttctttattaattatactctgatgaaattcgttatataatgaacaataacaattttagtttccaatttcagttatatgttgatcaatttaagaaattttatataattatacgatgattaatttagaaagaggaagagaagagaaggagagagtaattatatatcgaccgaggcgatgatcatggattatatagttctatttgaaaaaaaaaggctagctactagctagcagcttgtcgcatagtagtactatgcattattcgtactagtattacatacacacatacgtatacggcctggcttaattagcaggagaggagaggagaggagacggttctagcacgcatgtgcatatgcttgaaggcggggcagggcgcgattacgcttggcggcccaccaccttgtgctgctgctgatgcgcgacgcggccggcgtcggagaagaggtccacgggctccgactctgcgatcttcctgcagccggcctcatcttcttcctcctccggacagacgcggcgagcctggtcgaagagatcgacgggctgggagtcagcgaccttgccggcctcgagcggggtgccgttgatgaagccagtccgtagcatctcgtcgtcaccgttcaccttcgcctgggccgtgccgtgcctcacctccttcttgctcgtcgccatgttaattactctctctctctctctctcttcgatcgatgtatatgatcgatctctcctgatgcggctggctggatatatatataattagttaagcgatcgatgatcgcctttaatttgctatgaaggaacagaatacacacacatatatatatagggaattgaagtgatgaaagctgatgcgaggacacgcagcagcgacgtggacgctacctgttgatttacgcgcctacgtacactctctagaactctctgcaataaactcatctccatgatccatgacgaccagcctccgcgtgtactcctgcaccgacctcaatcgccaaatacagtcagtcggtggacagaaaatgcaaataaggacagagctagcaagccaattttgtctttgagtatggttaattacctcttcatttcatttgatagcgagtaaggttacctctataatataatatatatatatatatatatagtataaaatatacatattgcataagtctaaaatatgctaaattttagtagaaaatcccaatatcaaatttaataaactttataagaccaattcatccaaaagaggttcaagcacaatatgatttgagactatactagccagttgaaaaaaaaaatactgaaacaaattaagactgtgttaaacagtaaaactccgccatatacctacaggcaactaaagaaagtaaggaagaagaaaacgggccttgccctcgtcgctgctcatccaccatcgctccctgcagttcgccaccatcatcggagcttgtccatccagatccgttggacaggagctcaaggctatttggtctgacacttatgatctcgcgtgtcagatctaactgttttggtggctcaagaaggggggcaatagcttgtcaggatgatggcatcatcagcagcgacggcaaggtccgaaatttccaaccgaaatttccgtcatttcggtcccctccgatacgatattaattcggccgaaatttttgaatttttcaattttttcatgaatttgggtaatatttgttcaaattcaactaaattttgttcaaaatttctgaaatttctgaaatttcggtgactcccgatcaaaaaccttcaaccgatagagtgaaccctggcgacggcaaggagaggaggatcccaacaccaacgacagcggtggagatgatggcgccccttgagcttctggatttgacatcctcttcgagtccttccttcttcctgggtagcaagaccttaccacccactagagatctgacaacaacaagcatgccgacgctagagctggtggccatgaagtcgtggctacctgctacagtcactaaagaagagaggatggcctccatcatcaacgagggaatccattgagtggcaatgacgaaataggaaaccctaagctttcaaatgggaagagggaggtgacaggatgtgtaaggtctcaacctggacgtggagtgaagatcgattcgggcctagttaggtgattttgcatcagcagaaccatgccttggcaaccaagcagccgctgtgtgcatccatgggtgcgaaccaccatccatatcgtgtgctgctgggaagggtgacaatgcggaggagaatggagaagtggtcatgtgtcacgccccgaactagctccgaacggaaccagcccgtgacgctccaaattaacctgttaaccgataccagtcccaggaaatagtgctggtatcacaggaagacagaatatcgcaacaacagaggtctctttattacagagtaggagtacagtcatgttgggctacggacagatcccgagctcacaactgcattacaaaagaggaaagcggaagccaagacttggaccaatcatcacaggcgcgacttggaaactaggccgaaaccctaaaactcatcgtagccgacttgctcctggaagaactcctcgtcagcgggatccacttcatcttcttcggcaactggggggaggattatttatatagagcaagggtgagtacatgagtactcagcaaaccatgggaattaagtgtttaatgctggcttcaagggaaaggctgttgtttttgcaattgattttatttaaactccttttcgaaacagctaagtgagtgcttctcaaacgacatggatgagacagtgcatctcgtccggtcggagtatgtgcattgtatcagtctttgattgattcaagattggcacccggccacaactttcaagcggccacccgggcctagctgatcccatcagccacagggtttccaaacatcgaatccaaatccacaacagcaatttcacaaagcagtagtcaaacaaaactacgctaaggaatcaccttacatccacccatgaccgtgggcacggctgttcgaacagtttaataacctctgcagagggggtacactttacccacacggcattactaacccggatcacccagcccgtggggatcagccacgtcgggagacctccaagctttcatgacaaggcatttccaaagccgacacagatttaccatatgccgacgagaggggtcccagaccaacaacaggttaggtcccagaccatactgtgccaggaagcccagggtcctccccgacaccaccccggcgaatccacttgtctctcggcatcaaggctcccctgattagctaattactcagccaggggtgtcccattccacccatgtggtcgtacttgttatatgttcggatgaaattccaaaggaatcggtccttaagtgcaagaacaggaaaccgtgctcccggcacgtcccctggtctgcgattttggaaattcatttagttcgcaagcaccgacccaggcgtcgggtttttccaagtcttttgtaaaacccaagttttacccatacttggatattttaaatttgaggagaggcgttccgatgcgcttgcccgaaggcccgtgcatcgaagcacaacagtcgacaaagggagtttaagtgttcaataattcaaggagggtaattgcagcaattaggattgggaccggcaggctatctcgcaagccgcggccgaattgcttgtgtaaatcctattcatgcaatatttgcggaaaagaaatacttagatttaaattataggtgcaagatgatcaaaggtgacttgccttgctcgagatcttgagcttgattctcgaaatcctcgcattgcgggtcttcgggctccgaaactacacgcgaaacgggacaactcaacaaacggcgaaaaataaagccctattattgacctctaagcgtgccattagatagatctcgagatttgaggaattttggaagttgaacggagtcaaacggtcatacggttgagaagatattgaatttctaagattattggatttttgatctaaaggaaaaggatttagttaaacccttttgaaaaagaaaaagaaagagggaggagaaatagacttccctcaggcggctagggcgcggcccgagagaaaaggccgcggctcggccgagcttaatgggcctgccggcccgagaaggcggcccaaggcacgcgcgagaggggaggagagagagggagacggtgggccaggtccttctcgcgtggtcccgagtgggacccgcttgtcggtggcttggctcaccgtgcggagggagcacgcggcgtgcgctagggtatggggagagagacgcggtgcacgcgcgcggttcgcggaggacgcggatgcgacgggcccacgcgcagcctcacggctcgcggtggaccgcgcgcgcgagcggggctggagggagcggctaaccagggtcggctcgacccggtcttggccgagctggcgccgatgtggcacctacgtggctgccacgcgggccggcgggaggtagacaacgacgtcggccggaacggacgggggacggcggctgcgaacggcggggggaaaccacggcgatacagggaaaagcgagcacaccgggtgggtgcataagacgaggggagacgagccaacggctcggattcgccggagggagttcgacggcggcggattgcgcggcggcatccggcggcgagagaagagggaaacggcgacggcgcgacgggagatcaattcgggcgagctagagcatcaacgcgactccgggaatccattccttgcgccggattaggagggaacgcaccgagggaggccggcgacgagaggcgctaccgagctcgggcggtgacggcggcgagcacacagtgggcagcggcaaggcttggggcggcgccagctagctacggggaggctacacaagcttctatcgaaagctaaggggaagagggggaacgaagagggagaacggggagatgcactaccatgcgggacgaggcgcagtgacgatgggccgatggcacgggagtgatctctccggcctcaggctggggaagcggaggaagacgatgcgcccgaagtccccttcacgcgtccttcgcacgcaccggctctcccggtgcttggcgatgaacggcggaggcgagacagaggggcggcaatggcgcggtggtggcgagcgaaacgggaggaggaatcgatgggagggtgccttggttaaataggaggcgatgtcggtttgggaaccgacctagggcggtcaagggagagagctagagctcggcggtcgcggccaaaacggcgtcggggaggggggtgacgccggcggaagagaagagggaaaaaggaggagagaaaggggggcttgccctttgccactttgggaaaaggcggagggagaaagggcgacgcggcagagggaggaggagctctgcctccatcccttggaagctagcgcgcggagtggcggggccgggtcgtgacaacggcgatgacggcgggggcggtttggaacggagcggtgacacgggcggcaggcccgggctcaggcgcggcagagggctgactgcggcggcgactggccggttggccaccacggcgcgcgcgcgcgggaagcaacgggcggcgcggcgatttgggcggcgtcggcgggaacggcagcgagagcggagagggagggagaggcgctcggcgcggctctcgcgcacgtgcacgcgcgtgcgcgtgcggcgcacgggcagagtgagggaggggagagagagagagagagagaaagatgggccgagagggaatcggcccaccggacctaagggaggcaaaatagacttttcgagaaggattgatattagggatttgaatttgacgatggattggggatttgagatttggaattggcacggagactgacaacaagcaaagaaacaattttcgcaattagggtttttagaatttaaattttcccgctaggcgccacgatggaacgggcgctacatcatggcttcgatcggccgctatcgatagctagttgagcttagcttgtataatcatcagcggataacagtgatcagccctcaagacacagtgatttacgtggaaaaatcccctcggtgtgaggagtaaaaaaccacgggaccaacggtccactccaagcttccactataatccagtacaaatggagtcttctctagaacatctagaggcacatcacaacaacagctacaacatcaagttacgcaattggcatcatccatcaaccatcaaaactaacaagaggcatatcagcaaacaagcaaagaaatgatagatcctgtcatcttcgtttctcagctgagatctcccaagccacatatgcaaattgcacgaaacatggctgaaatgatgatctatgagtcctttccaacctttccaaaaaacacctaatcggataccgtttgacctctcaaactgacactttactaactactgcataatctgtaactgcagtaactcgagttgacaaaccaccactcaaatccggcgctctactcaaccaatcctcatacaaactaaccagactaaagtgcttaaagtgagaaacaaactcatcaagtttagtgccaatccaaccacgtttgagcctccaatgaatgacttgatgaagatcgggtaagaatgcaggctagggtttttcttcccatcataaagagataaggcaatatccaccattgatcaacatatgaattaatggctcatatttgttggactttttcggctgcaataagctgatagtaaaggcttcatatggagagaaatttggcccaaccgtcagcggaaatgctaatgggcgatcgatctcctggagatgggggcagcgatcgatcccctccccctccctcccttcacctgttttccctttttggcaccgcattactttcctattttagtaaatttatgcacctaaaatttatacacatcaagtttacacatctaaagtttagagacccaatatctaaagtttagagacccaaagtttataagtcaaaagtttatatatccgattcaagtttgaatttgaattcaaatattttttatatatagtatttctatacacctaaagtttatagacccaaagtttataagtcaaaagtttacatagccgtttcaaatttgaatttgaattatatctaattcaaatttgaatttgaattcaaatattttctatatatagtatttttatnnnnnnnnnnnnnnnnnnnnnnnnnnnnnnnnnnnnn

SEQ ID NO: 7642 - DNA, 5864 bp, Oryza sativa
  unsure (1)..(5864): unsure at all n locations
nnnnnnnnnnnnnnnnnnnnnnnnnnnnnnnnnnnnntttcggctgcaataagctgatagtaaaggcttcatatggagagaaatttggcccaaccgtcagcggaaatgctaatgggcgatcgatctcctggagatgggggcagcgatcgatcccctccccctccctcccttcacctgttttccctttttggcaccgcattactttcctattttagtaaatttatgcacctaaaatttatacacatcaagtttacacatctaaagtttagagacccaatatctaaagtttagagacccaaagtttataagtcaaaagtttatatatccgattcaagtttgaatttgaattcaaatattttttatatatagtatttctatacacctaaagtttatagacccaaagtttataagtcaaaagtttacatagccgtttcaaatttgaatttgaattatatctaattcaaatttgaatttgaattcaaatattttctatatatagtatttttatgcatctaaagtttatacacctaaagtttatagacccaaagtttataagttaaaagtttacattcccgtttcaaatttgaatttgaattatatctgatttaaatttgaatttgaattcaaatattttccatatatagtatttatatacatctaaagtttatatatctaaagtttatagactcaaagtttataagtcaaaagtttacatacccgattcaaatttgaatttaaattcaaactttttatatatatagtatttctatacataaatttttctaacttttgttttttttaaaaaaatttttgtggtgtagtgtagtaggaaaagaagaagggggagaaaaaagggggagaagtgagaggaagtattacctatagggggagggggggccggatctaatcgcttgggtgatcgatcgcccattaggacccttcgaaccgtcagctcttcggttaggtacacgagacaacgcagcagaaagaaattaagggatggatatagaaacgtccacgtggccgcaggagattgggcgtcttatccaagctctgggctaccaggatcacacaataatacgtacatctctgagtcttctcttttttcattatacaaagtacctacaaagtatgatccgtattaatttcataccaagtaactttaatatctggcgcttctgctcccttagcttctttgtgtggatagatatatgaccgttttagcgattttaatgggattaattttgacctcgatcggcatatatacatccattcatacacgaacagttaattcagtacgaaacacatggagtagacacaagagtagaactaggatatatagcttattaattaactgttctttcaaatacatggagtacgtatttgacagtagtatatatgacacagtaatgcatgcatatatgacaccaaaatgtgatatggatatgattaagcaggtgcagcaaaacgtacattaattaaacaacaacaattaaccctcgggcacgcctgtgttttgttatctcgctcaacatatacgtacgtaatactttgcttgcatagcatagggacgacgacattatattcttaattgataaactcaagaacgcatggagatggatcgagagatttataaatatggagcttgcttgattgattagatgaggtcgtcctccttgtgggtctcgatgacgacgtcggacttggggtaggcgtggcaggtgaggacccagccggcggcaacctggtcgtcgtcgaggaagctctggtcggactggtcgatctcgccggagaccaccttgccggcgcaggaggagcaggagcccgcgcggcaggagtaaggcaggtcgatcccttcctcctccgcctggtccaggatgtacacgtcgtccggcacctgcagctccacctcgccgtccggtgtgatcagcttcacgttgtacgtcgcctgcatccgcagcctgtctcccagcttgttgctcgccggcagcaccgacacgcgcgccggcgccggcgccgtcgccacccgcagggacatcggcaaccggacctggctgctcagtgccgtcgccgccatggctgctatagctaattaagctagctagctgctgctgctaggtaaggtagacgaggaggagaggagtgagctagcaagaatgtgagcgtgaggttgaaggaggctgaggcaataagaaggaagtggaagggtgccacgtggcgagcggcgactggttggcttatctgcgggggagtggatggggcaacgaccaccacacgatgcacatcgccgatgctgtccggccgtcttgggggtggtcgccttgcttttcttttttggtttcttcttcaccccttaactttttttgagcttttttttttaaaaaaaataatttgtgagccaatcacatgtaccttcaggattcagatctggtatctctttttcccatggccgtccattgattttgtttttcacgagaaaaataattgaacaagatgtatgtgtggtcacacacattttctttaatttcttttgctatgtatatatgttgtccacacatacgttgaatcacaattgttagattgggatttgatggtcacgagtcttgcacaagatagagtgcgatgtgcagcctctaataattttgaactgctgcatgtgccttcttccttcctgttcctggctaggaactttctccaaactaacctaacctctctgtttttcttctctcttttttgagggccaggccaaaacttttgctttgtacgatcacatgcacgcttatatgatattccatgtaaatgggccggcccaatccgcatagccgtacccgattccaagatacggcccatagaacactggatgcgatgaccagcccatcttgtctcttattgggcttgtttgttgacaggaacatccatctcatctacttctaggacacgatggaacctgcagcaggcagcaggtacatacaggagtgattgagtataaaaatatgagtggatgtataacaagagagtagttcatgtgctgatcgaattcgatcgatccaactctatatgcatgcaggaatatatacgcatgatcgatgattgtacatgatattttcaactctttaagttctactctatatatatatattgctactggccggccggccacgtgttggttacgtggtccttttgatcctcacacgacactatcagtgaacaaacacgttgtacacacacatatatacgtgtatgtgtaagcggaacaataattgattgatcaattagtagatcgagataactggagtagtatcaactgctgcacatatatgcatgtcaagcatccatcacatgttcacatatatataccccgatatgaatattgatcatccgcatgcaatcgaatcgcccttcatgtggtaggactaaaagacaattttacctcattcaattttatattacattctatttaagtcaaacaacaaaccaatttaaatattttgaatcatttatactgatagtatatgtgtgtgtaactagtacattgtatcgtaacaaaagaaaaactctccacagctagctgactcacatgcatgccttggccctagcttgttgggacgtaatacatatccgtgcattattagcaaattaatagcaattgattaagaaaatgactagctacacagattccctagggaggaaaaaaacacacatatctaacaattaatagacagattgatatatggagtgagagaaaaaaaaagatttacaaccgaaaagaaagaaaacatcgggaaagcaccactggtattgacgtatagtaatgtgatgataaagtcgtggatgcatatctttagcaaatatgtccatgaatacttagcaaatatgcaagtgaagcttgtaccatgatttgagtgagatcagatcgagatgtgctattggtttctgtctttttagtacatgttaggggatgcattctcgggtgtacgagtgtggtgttgcatgtatggtggtgtatgtacgtttattgcacaattgaaaaaaaaaagaaaaatcaaacatggattatatttcattagtgaaattaaattgtagctgggtgtgtttagttcacgctaaaattataagtttaattgaaattgtaatgatgtgactgaaaagttgaaagtttatgtatgtagaaaagttttgatgtgataaaaaagttaaaattttgaagaaaaaattaggaactaaaccaggcctaggtacggtcgcgtgaagattgctcggatccgatcgacatccaaacgtaccgacacggtcaaaccagggatgcgcgaatgtttcctatctatagtttgaccagcatgcatgttctaatgttttctattcttccggtagccactactgttctattttcctatttcattaatcaatatactaataatgactaagcatatgcttcccacccggccctatccaaattccaatctcaaccaataattaagcaattaaccaatgagctatatatgagatttttttattgtactagccaaactgattaattttaattgttgcttttaatcatttcactttgcttgtaagcaattcatcgatcagttcgtgctttgcctgcggcctaccctttttgttgcccggcactactcccaggatatatacggagtatatgccaacacgtaccatgcacgtttcttcgttttgtattctctctcttcgcgtgtgtgatccagttgccttcttttatccgacaagattaatcttcatcacttttaaagaagaaaccacgtttaaaattgctgattttttttgttgaaaattctctctgtgtctctagtatttcaagtgctgatctcgtggtttttttactcccctttgtcacaaaacatgcatgtactctgaatgccgcatctatattgtttgaaaatataacattgactactactacctccgaggacaaagggagtaatttgtacctaattaaaagcaaaacattttaaaaccaacaatattataatactatcaaagtatttttcatgacatatttaccacatgcaactttctaatattggaaaaataaacatgtttagagtttttagagtttaacttgagacatcaattatgataaatttatattacacggggtatatataagactacccacctacaacatatgcgaaatatgtaacttttttttaataatggatatataaagttggtcattgtttcaactgaagctacaaccacctattacaaagttttagttcgaaggccaagcacggtacaataaaaccatgatagatgaaaagactggtacaacaacaccaaccaaagaaaataagccacttatttaaagtttaagtttattccttaatctccatttaaaggtaatgaagatatgtatgatgattgatcctaaatttcgaccgcagcaatgcgaaatagctagcttgttttgacagggatttgtatatatgctatgcatcttctggattcctagttgccatcgtttgtcatgacaatgatatattgcgctagcttgaagaaatggtagttggacaaataattatctcattttatatggtataagggtgaaactaggtattcgatcattggcatatactagctaattgctcatgtgttacaacaagatttcacaaagagtcctcatgataatttcgatcttagaccatttcctattatctatatctatatctatacctaattaaaaaatacgtaaggcttcgccctccccttcgtccatccgccccaccccttcctcccgcgccgcctcctctttccctccctcccggcgcccccatctctccccctcccctgcagcccctcttctctctagcgccccttctctcccacct

SEQ ID NO: 7643 - DNA, 3417 bp, Oryza sativa
  unsure (1)..(3417): unsure at all n locations
nnnnnnnnnnnnnnnnnnnnnnnnnnnnnnnnnnnnnnnnnnnnnnnnnnnnnnnnnnnnnnnntcttctctcatcttttgtttcttgtgttggctagggaagacgacgaatagtattagtcgttttttcctatgtgtttaaggaaaaaagaatcctctcgtccgggaacgtgttttgacacgcctgcatccagtcgtgttcaccactaaagctcgtcgttgtcgtttctctttctatcgggaccacatacacgtcctaccactttcctcaccatcgtttggtcactggagcactggcgcccatcttccctcctcttttatttctcgccttgagttagggaagacaatgaacaatgtctgttgggcattattccttcttagtctagcccaaccatgctactgaaccactcacataatattaagaccatatgagaatgaatagaacatgaaaaattctaatttatatcaattaaacaagcgaaaggaacaccatagaagatccaatattgaagacaatatcgatgcacgttatttgttaataaggttcagccgaagcctacatccccagagcagtggtcctccccaatcaagcatattacaacgtatccgaattacaattaatgattctcggccagacgccgccgacagccgatacctctcacctatgctaagtcatcattgtcgtcatcatgtttggatctcatatgacgtttctttcgcgtttggtttccgatgtattatcggggtcggttttataacaaaatcatttctcattatttattaaaaaacatcacacttgcatcagttatatttttcagtggttagcttgacatatatacagtccatcaatcctattgtttggggtccacgtggcagtggtagtgggtgtctggtggaaccgtgactagcagaaccaccacatcactaccatactagtgtttgggaaagagggacttcagtccctctcataaaagtacaagtccctactagtatgtatggtgttgtttgggaatgagggacaccaccaaagtaatatagatattagtgcgatttctgataaatatttcatgttttcaaatatgctagctcaacgtaaattatgacattatattacagaatatggaatcatgcatgtagctataataccaacgagcttaattatctagacaggataaggttgacgaaaaggatattgttattatttattttgttctctatatatgaactggatattaagtccagcatgtgtggttcagttaagtcatcgatcatgttaggacttaggagttaggaacaacaatacacactccgtaaagtcttgtcgattggttgcttgaaataagcgttcttcagacatacgttaattataacgattaatggatcgatggcaactacagatagaagtcttttttatctttatctttataagttggtattttgagtagttttattgttttttaattaaaccttgtttttagttcatagttgtttctatagtaccattttgtagcaaagaccgaaatattttttatcatcttaaaaagaaataatcgatgacgaataaatgctgtgcgtaggaatgagatcatctgacacgaaccatactaaagtgtgatccatatgtcacttttttttcgcgaacgcgtaaaaagattgcacgtcaatatgatccatatgtcagtgactgaactacgtgtctttacctattataaaagtttaaggtgtttttgccagaattttggtacgtcatctgtctttgaaacggttttagttttatgtttcggttttaatctatatgtctactacaataaattcttcttaaaaaaaagtaaaagaagtccgactaaaaaaaggtaaataaaggaagaaaaaaagtccgacttaacgagtgattaaaaaaaaagttccgtcgtcacttaaagagcgattaaaaaaaaagcttccgtcgtcgtcagtaaaaaaaaaaaaatctcttgtccgactatgtagaaaaaggaaaaaaatcttccagtaaaaaaaagtccgtttggttttttttggcaccgatatttttttcccttttttctttgcacgcaaaagagttttttatgcgcacacgctaaagcttttggttttttcttttttttaatccgatctattcaccgcgcacctctcgggtgcttttagttttttcgtcaatgttttttgtcacctgtttttttctcccgtatgctttttgtttttctcttccggttttataatcccatctgtttaccgcacgcctcccgaggtgaaccctagcgccgcgccgctgccataccgatttgtgtattttctcctccaatttaattgcaaaaatggattccccactcctcttatcattttctccatgattttcccttcgattcggctttaattgccagttttaatctctgttctatagttgccgatgatgacggcgatcttcctcggttatttttatcccgagttttatgctctgattttggggaaaacggaaagagtagatcgagtggattaaaaaccctcgaccaattttggtttaccaagaaagattcggccggatttgatggggagatttgctctagcaaacgtatgggcacgggattatcttcgggaggttgaagatgtagtcatattcgggaagttgaagatggtagggtcgaagagaagcagaccaaatggagggaggtagcggactagcctagggctgaaaaggaaggaaggctttcggtcaaaacccagaaaatattttcattaactttttttaattataatctatagcgattccaatattaagatttttattaactttttcaattataatgtatagtgatcccaatattttaatttattacttagctctcaatatattactgaaaaatgtttacccgttgtaacgtacggacatcttttctagtatataattaggtgagaggatctacttccgcacgcatacaacgaagggagattaatttttcatattcggcaatacgtacatgctcttttaaaattaattatgtgcttattaattaattttttttgccgcggggtttctttcatatacatgatgtgagcctatacatcatgcttattaattactaataacattgtttaagtagttaattgttctttagaagaagttgaaggtgcgtggctcgtgacataatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 7644 - DNA, 617 bp, Oryza sativa
  unsure (1)..(617): unsure at all n locations
nnnnnnnnnnnnnnnnnnnnnnnnnnnnnnnnnnnnnnnnnnntttccattagtgaaactatgctcgtagcgcttttgtcaactgtattaacaacacaacattttaaggcaatgaagatgacgaaccccagtgaattaccaattcacctcatgaaaaggactacagctttactaacatattgacctctgcatttctgattaccagataagatgcaacaatttgttaaaatattaaatttccaaaatactgctggattcatgattatattatttgttccatatggatagttagcagctttcaacagatctttcatttcaatcacatcaggttttctgttgaagggtctaaaataaagttgctttctcatgattgttggtgacaggacaaatcctacacaggaaccttagcataattctgaagtacaaaggcacagaaagcctacttacataaattgagaggactatggtaacagcaagaattgcataccctgcattatatgcaggaaacatgtgtatgagatgcctcgccacaaagtagcagaagacggcaaccgggattgcaattagagagaaagatagcagagtggccttggcatctggtcccaaagataaccctt

SEQ ID NO: 7645 - DNA, 1576 bp, Oryza sativa
  unsure (1)..(1576): unsure at all n locations
caacactggtactataaatgatgacgacgacgatgaattcgtatcggagagagaagaagattgcaggagtaattaatttgttgatcaggtctgtatgtgttgtcaaaaataaaagcaggtctgtatgtactgtcaacttaaatgtgagacataaacagtgcaaaattgcacctattttaggattgagggagtactaacacaaaatagaaatagtaatagacctcctcgtgtcgtgggacttggaattggactccctcttcttctttctttcctcttctacttttcttcttttacataatagtattagtattacaatataggagtaatactaatactctttgttccttttgttggcattgcatgtttgtattggtaaggttgttcaaatcaatcaagtctagtgtagtagctaattaagccgccgccgcgagtcgacctcgcaaccatccatggccccgcgcctcctcctcgccctcgccctcgtcctgctcgcctccggcgcaagcgcggcgagcgtgggggacacgtgctcgtcggagggagactgcggcgcggggctgcactgcagcgactgcggcggcggcggcggcggcgacaagacgtgcacgcgcgccaagcccatcgacccgctcacgcacgtacgtcttcttcttcttcttcttcttgttgctcctggacctggatggattcatggatctgatgatggatagtggttgaacggagcagggcacggatctccccttcaacaactactcatggctgacgacgcacaactcgtacgccctcgccggctcctcctccgccaccggctccgccctcatcacccaaaccaaccaggaggacaccatcaccgcccagctcaaggtatcgccgccgcatttcttctccgcttccggcgcccgcggcggttggtgaccgtcacatggctgtggcccacctgtccgccacttccttttcctgccgtgtgggccccaccgctcgcttctttctctcttcttcatgagatgtgctagtaataaaaattggtactattagtattagtattgcagtccgactaggtaaacacgattttccttcctttccctccgtaaaacatgaagaatcgtaattttcctttggctgtgtgccatatgccatacagttttagccaacaatattaacacttgacgataatcgctatgctattgagttactcaacaatattaagtttctacgcaaagataactttttttttcactgtaatccaagttttactttaccaaagcctgaccctttcaatctccacaatagagatttcgatcacatcctccccttttaccaccaataataataataataatggacaacgcacctccatctttctttgcattattgctctacctgcttccttatccatctaacaaattattctgatggttgttgagtaggtctcgccatcttcgatctaaaaccaaaggtcatgcttacacacacagggtttcaccaccctacctgcccactccttttgtctttctnnnnnnnnnnnnnnnnnnnnnnnnnnnnnnnnnnnnnnnnnnnnnnnnnnnnnnnnnnnnnn

SEQ ID NO: 7646 - DNA, 8783 bp, Oryza sativa
ctaaaaccaaaggtcatgcttacacacacagggtttcaccaccctacctgcccactccttttgtctttcttaggaatatattaactccatacccacaaagcaagtctgcacgcaccatttctccattaccttatacacaaaaaaagactgtccttttgcaattaacacatgttcatgttatatcgccatgcttttcttccaactctggtgcctgcagacaaaatcaaactggctcctttttcaactcttctttttttcccttttagatatctggatcccttttcacttcatgttagatgtcttccctttgcctccgggcttgtgctaccaaatcacaccttattggatattaaggtcaatatccaagacaaacacacaatacagattttaaatttaaagtttacatgtatggagcttcttgcaatgacattttccatacaaagactatgaataattcgaggttaattaaagaagggagtaaacaaagaagaattaacaactagctacagcttatgcatccattttctgtgtcttagttgcctgtggttggcccatttaccagctttggcacaattctggctttcaataaatactgctgaaagatacaacagattaatggttgtttgacttaaattttcctcacatgctgcaacttatgacacggttttctattttttctttgttttctttttttgcggtgttcaccatgggaatgacttgatgcaacttaagcatgttttcacattcttatattgtttattgcctcttcaaaataactaaatcttcaaaccgtggtgatgctcaatgtgtttaaaagcgaaagagattcttgaaggtagcgattgacaagtagactttgttgtaatcatatctggttctggtactaagctgtgaagatatcgattgctttggtcttaagaaaacaaaggggccatactcactcagtttatcataccatatcatcttacttttttctttttaattggcgttctaaagtaggaagttcttataccaaagtttataaatacagttgttgtatttaaaagtgtaaacttgatgcagctcctttttctcatcacacttcagaattaagccactcctcaacagtgacggctgaggattttctactcgtatgtctttgagggtggaaaatccacaaacatgttccagactctgtgtgcactcttatggtttctttaaaaaagctggtcgcaagccttttctcaaaaaaaaaaaaaaatccaccaaacccacctaaaaatactgtggcctattttgcagctactgaataaattcatttttttaccacaaagatacaaacctgtatcttgtggttgtccattcacactctgaattttgacttgttatttgttattaaaaaaatttaaccattggaaacttacttgataacatgcagaatggtgttaggggcttgatgcttgacacttacgacttcaataatgatgtctggctgtgccactcatttcaagggaaatgctttaacttcacagcctttgtaagatgatcaactgggcatttctctctttctcctatctctcctctctctcacaccgagagtatgttgatcttgtaactctaacattgagttggttttgtggtcagcaacctgccatcaatgtgttgaaagaaatccggacgttccttgacggtaacccttcagaagtaatcacaattttcttggaagattatactgcttctgggtctctgccaaaagtattcaatgcttctggactcatgaagtattggttcccagtggctaaaatgcccaagagcggtggcgactggcctctactcaaggacatgatcagccagaacgagcgcctgctagtcttcacatcaaagaaatcaaaagaagcaagcgaggggatcgcttacgagtggagttacgtcgtggaaaaccaatgtaggatttcaaaacaaaattggtgatgtcagaacgtgaaacatttatgttcttatttgacctgttatcttttgtctgtgcagatggaaatgaagggatggtagagggtaaatgcccgaatcgtgcagagtctccagccatggattccaaaagccagtctcttgtcctgatgaacttcttcacaacagacccaagtcaaacaggggtttgcgcaaacaactcagcgccacttgttagcatgctgaaaacctgccatgatctctcgggcaatcggtggcccaattacatcgctgttgatttctacatggtacatcaacttgggaattgtttcactctttaatccatatgaaatatgtttggacatcttttgttattataaatctccactctgaatcatgcagaggagcgatggtggaggagctcccttagctactgacatcgcaaatggtcatctagtatgtgggtgtgacaacatcgcatactgcaaggtaaggacatacaacatttctcttggccacaagttctacttgtaaaaaacaacatgttacattttgataaaaataaatgttgcataccatggaaagctgaatcagaataatggtgtagctatttattctacatatttatgtgatattttgcaatggaaaaggcaagttaggttgcatctcatcagcaagtggatattgtgtcaagtctactcttagatgttaggcagaacaataggtgatgggattatgaatgatatgtcttaatgatgaaaacggggccatctatctagtagttaatgttgcaaccacacctggctgtttacttggatcagaacttccattgcatttcttgtattgtatctgcatgatgatgatgttgttgtgacctctgagctggaggcgaatttgacattcggaacatgtgtgatacctccactttcaccgccgccgtcgcctcggaaggcacccagcggcggcaagggcacaagtgcaggcggcagctccagttccagcggcgcaatggctcgggttgtactaccaaagctgaccttcttcttcggagtggcacttctgatcctggtcatactctcttattaagagcagacccattcacttgagcttgtgctgtctttgtgctctgctggtacaagcacatactgtactgccattctgaggcaaaattttctgctctttttttagccacctgttccattggtttgtaacttctttttcttttttgttaatgagagctgtagatgccagattagctggagaaattgttcatgtgccgagctgtagatcattccttttatttgaggcaatatttttctgcatatcaagtgatcttattgctcataaaataactgcaatcgcattgtaaaaaaatgttgtggtaagaccttttacaggtgcaaaatatgcctattatgcatagacagcaaatggaacagattctgcatatgtcatcaggattattcttgatcttatgcactttatgttccaagaaattccaggttgtgctactagctggatgcctgattttttcaacttagtcggtggataacagcatcaaactaagcatatattcccaccaagattgttctttacacgttctctaatcagataacaatctgtttgaacaactttgtcggcatggtgtatgtgtgtaacccaagtagtaactagaaaaatgtcgttgatcctttccagggataaggaataactggttagtcagttagctaaagcataatctttgtacacggacacacgacaattgtctaaatgcatatgggaactactgactaatctttggacaaatatggtccaatgggggtgttttaataaattcattcatctgccttgaacatgtgagtgacaattaagggagacattgatctcttataatcaagggatctgatgctttgctatgccagattccactgcaacagtgatggtccattgtctttcctgtacaacatgtcaccagcataaatggtccctggttacctgtactcccacaatttatgaacatgcaacttttttttatagtagtatcacaacgcaatcaattgtcccttatttccagtgacattccttaaaaagaataacatgtgaaattattacatttcctaaataaccttcacatgaaaaatccgatgggctcatggtatgtaatataattagaagatacactcatatgtgtgtgtacacgtatttatatcccgtgtgatcgaacaaaaaacaaatttgcacgatcactcaagtaatactttatcatatattatattagagagtgccattaattttatttggacagtttgtgattaatttttatttgtattgaatatcacaactggatgatcaactgcagacattaagaccccacattaatgataataccatcatcaattgatagttcttgtttctctagtagtaaggagtatataggggataaataaaaagaaagaaaaaagaaagaaagagtagaggatgagaggagagagatgctttggtagtccggggcgggctaacaagaaggtaggattggatggatataggagcctgccttgccttcctcataggtttcgtttagctccccctacacccagatcacacacacagacgcagacgcaggagggagaagaagacgacccaagtgatgctgatggcatctcgtctcctgtcctgaacccttttccttctccctttcaagaggaaatcaaatcataaaggattctacaacaaggaagagtggccaaagtgttgtggagtggctttctcctcttcttcttcttccttcgtgcggcctgcggccatggccatggccaagcagcagcgggtttaccaagtctggaaaggcaacaacgtgagtgagattggattactcctcctcctcctccacgatccctctcttctttctttcttgcgcccccgtcccccttcttgtccccataatccgcgcttttcttgggttcggatcgactgttgattttgcccgcttccatttctgtctgtcccgttggcgcctaacatttcgcgatgtgatttgttctaacctgctctgacgaatacttttggggattagataaaggaaactgcttccggcccatatctttgtgtgtggttagctaggctagtttattagttaattggtttgtgcgcctggtttgtactatattttactacactgttgatgagttagatgaataaactatcgttaatcagtttggagctttggggccattctggatgataaccctcttttgtttccaataacataatccaattgggacaggagtcccaaggtcctgtctttctgcagctaattcaacctggcttcaggctgcataaaaaataatgtgctacacttgcaaacattacgttgcttaaatcttctttttactcttctctttagaattattgctttcagcaacttgtcttattcagagttcaggctagtgtaaaaacaatggccttgataggagttctgatggagttggacaactgcagattttacacaatatcatatcaaaccttttaggatttcggaattttcacctttgcttgcagtttataccaccagttaatataaacatttttaatgtgtcatcaacgtgtttctctttgttcagataatcttgtgcggtggaaggtttatctttggaccagatgccaaggccactctgctatctttctctctaattgcaatcccggttgccgtcttctgctactttgtggcgaggcatctcatacacatgtttcctgcatataatgcagggtatgcaattcttgctgttaccatagtcctctcaatttatgtaagtaggctttctgtgcctttgtacttcagaattatgctaaggttcctgtgtaggatttgtcctgtcaccaacaatcatgagaaagcaactttattttagacccttcaacagaaaacctgatgtgattgaaatgaaagatctgttgaaagctgctaactatccatatggaacaaataatataatcatgaatccagcagtattttggaaatttaatattttaacaaattgttgcatcttatctggtaatcagaaatgcagaggtcaatatgttagtaaagctgtagtccttttcatgaggtgaattggtaattcactggggttcgtcatcttcattgccttaaaatgttgtgttgttaatacagttgacaaaagcgctacgagcatagtttcactaatggaaagggatcttataggttccttttagtttatcaagtgatggatcatccgagttgtgattataatgacataccctgtttcaaccttcgatatatctcattaattgatgaaccaaactttttttgtgtgtttaccgagttatcatcttcgatgccctttttagaagatgttcactggattgattgatactttggtcttcatttttctcagtgcaattggtcctcttttcctcttacatatactcagttgtatatattatcatgatcatttatcttactggtctccaaaatttataaaaaatattctatctctagagtgtgtagattgttttatcgtattttatttcacagtactttttacagacaccgccaaaatcataggatccttctctgcaaaacctgattgttaggtactgttactgctcttcttgacctcatctcaagatccaggtattgtaccacggaactcacatccacctgtggaagagttttctcatgatgcttcagctccacacactcttcagtttccacgggtcaaggagattttggtcaatggtgtacccgtgaaagtaaaatactgtgacacttgcatgatatatcgacctccgcgctgctctcactgttccaaatgtgataactgtgtcgagcgctttgatcaccactgtccttgggttgggcagtgcattggacaggtctgttatgtttaatttcttttcaaaataaaataatccagctatgggtggctttagtttctacaccctgacagctgttcatatgaaaccatctcagttaatatgcttttatttcccctttgcagcgcaattatcgctacttcttctgttttgtatcttcagcagccatcctgtgcatctacatattttcaatgtgcgctttgcacatcaagcttctcatgaatagggatcatcattcagtgataaaggcaattaaagaatctccagcatcagtggcaattatggcatattgtttcatctgtttctggttcgttggtggtctcacagggttccattcttacctcattgcaacaaataaggttagtactccaattatacagagtgaatggtaaagtataaaatgtgtagcctttctgctgacaaaggtatataggtcacctttaaatatcatgcagaaggtttgtatgtagttatgtacataaccacaggtccgaaatgcctacctgctattttgaatttagtgcactagtgatcaagtcaaatctcactggatgaatttttattgagaatagaaatggaattaagtattgcaatgatgcatcatgtacactaattctttcttgcatttatgaaaaattgaaaactatgatctgaattgaatttccacttccttttttgaagacaacatatgagaacctcaagtacaaatacaacaaccaacccaacgtgtttgaccgtggttgcatgaacaactgttctgaattcttctgcaccaaaagagcgccttcaaggatcaacctgagagcaattgttcaagaggaccatggggtagcaccaccacgaatcagccgttccaatgtagcagaagaggagacaccccaccgtccacgagccaaagtcgaggatgatcttgagatgggcctcgacatccttaagacctcacaacgtcggtcagatgaactgggtgacgaagagttgggagttgaaagcaatggcgtgaaatatcgcagagctgactgctcacctggtttagacaatgagatcccaattacaagaactaagattgagagttctagtgaggttagagatctggagatcttgccaactggcaatgctgcactcccttcatctcctgagaagaaacaacatcctgatgtactttgttgacaaatacatgaatgtggctgtgaaaagtgaagttgttttcatggattgctgacaaccaacaacttgttattcatcaggtgtacaaatggaatccggatgtcatttgacgtatgttgagtgttgccatctcttcctgggattttgagtgggctgttgattagtcagtcatatcatagggttcttcctgtaacgatctcccgttaagcagtttatgaaggtttcttttttttttcatctaggatttgtttccaagattgcaggaatggtgcttcattactgttaagtgttaattgtacataatctgcatgcctatgaatcgatcaactgatattgcctcctttccaagtggctccttcaagcacatatgcaggctgtagcagtgtagcttctctcatatagcagctatgatcctaaaggataccaagatatatagaccgagtagataaatcacattcgcaagtaagatgcataccctctcgagaaactagaggagcctggggttgttccacttccaacctccaaatacttacatgatataaatgtagtagcagcaaacaactgcacttgagatgtgttgccattctttgttcacatctgccacacaagaagaacagacaactaaatcaacagcaacaacaaactgcacctgcatctgcacacaacgagactgactgatgtttatactatccacacacactgacacgctatacaaacacacttatagtactgatgtatgttattcacaaaccagcttggtgtccaaactgggccaacagatggcgaaagccttgaatgct

SEQ ID NO: 7647 - DNA, 1356 bp, Oryza sativa
  unsure (1)..(1356): unsure at all n locations
nnnnnnnnnnnnnnnnnnnnnnnnnnnnnnnnnnnnnnnnnnnnnnnnnnnnnnagaagagattcgccggctgccatgctgacatgacatgaggctcccagcattgtacgggggctgtgtatcgtagacaacgaatttggtgccaagaaaatttgacctgtttgtgtttgcagtgtcagatttcaatgcatatttctatgccaaactcaagttaatgaagttaggcaggaacacttagtgaaggatggtgcatcacctcatttttccaacataaccattacttgaccgtgagatgtttttagaatccacagaaattatgtattccgtagaagttgcccgacgattcctcttagctgcaagaaggaattttccattctcgctgagcacagctacatgatcgaaatcatattattagcattgcatccatctatgtttctaaaccaatgttaatggaaaaaagaataaccatgcgtgacaactttcatgtatactgagaaaatgttcggtaggtatttaaatattaataagagatgcggttacatatacttaccagggctaagacacaggtagagataataagttaattttgatttgtcccttttgataaaacactggattaaaccatctcgaggcccaggctgtacatgaaaaatcaaagttagacaggtgcagacataacttgactgagatcaataaagcttccattatctaataaaagacaggtgcagacattcataagaggacacatctatttgcagaatctagtctttaatttcaattgcctacaagaatttcagtgttacctgataaacatagcatctgctatgatttgaaacacaaccatttgttcgttttggttgttctacactacaagtgtggcaaaagaaatataagctatacaattctttacacttttaaaaggagttggggtgatgatgtgccccacacccatccccagtccagaatatccttttggctggctatccatagactacatgtgttgttcacaagaactttggtaagactttacattcttagcatatatctaggtgcttgattgatctcatgtaatcatttacagttttacacaaaggtaccatacatataattgaacatgattttacctgttttagagacacaggaaaagtgagctttccacagatttccgggctttgcactatatccttacatatctctctccatgttcggcagactgctgcacaggcaacaacatctttgcgggacggccaattgctctctccttcctccagtcttttcatcacatcacggagtaattcaggaggaagaccaacccatctnnnnnnnnnnnnnnnnnnnnnnnnnnnnnnnnnnnnn

SEQ ID NO: 7648 - DNA, 3287 bp, Oryza sativa
catgtgttgttcacaagaactttggtaagactttacattcttagcatatatctaggtgcttgattgatctcatgtaatcatttacagttttacacaaaggtaccatacatataattgaacatgattttacctgttttagagacacaggaaaagtgagctttccacagatttccgggctttgcactatatccttacatatctctctccatgttcggcagactgctgcacaggcaacaacatctttgcgggacggccaattgctctctccttcctccagtcttttcatcacatcacggagtaattcaggaggaagaccaacccatctgctttgatctactactacaggtctgtcacgcagctcgctcaaagatccaagggacttccctctgtgatggccagaaagaccagggaggcctgaaattctcacctcgaaactccgtcttgataagctcccgaagctgtccctaacatcacggactatgctgcggaaagacatcccttgtgaaaaatgcacagcgaccaaactttcacctgatgccgcgtgaccaagatcttccacttccaattgagcttagcagcactgcatatgcacaagataaaacatcagcaactgctgagctcctgcaatcagaaagtacgtggagaacaaaatcacagtagtacaccatggtaataccttaagtaatcttgttctgatttgcaaatcgaaacatcacccccaaaaaagtaacctgagaaggacaaaagtgattactcggtgatgtcagagcaatgaagaccacaaagcagttagtgccatggaataaaactaaagcatccaccatggaagatgattagtagcattcaacaaggaatccaggacaaataatccaatcatgtagattaagtcaagcctactctagagcataccattcccatttgaatagtctaaagtggtgggctaccgcggttagtgagtacaagttattgtcacaaacttaatacaagatctcaacgtaggcgaccaactccgtgatggtgaaaggccaacaaaaggccgcgttaattacaaataatctaattacatcatacaccagcgttgtaaaattttgaccccttatctgctgagactagagaggataaaaggttggctcttgttatcccaactttgtgatgtgcaatagattgcatatgtcctatgttggtgaggagaaattctaagatctgcaagaactttgcacaaggggtagggtagagaagcgaagcgctgtttgagtagctagagaaatgaattggataaatataaatgtttctgtatttttctatgcgaagtgcaaaaccaaattggacacaagaagagaagaggaaccaaaacagaatttctcctgaaagacggaggaggagatggtagggatggaatcaattaatcaggcggaagaaggaaaaggaacatccgtatcttaccctctccaaatcaagctccccaacttattcagaaacctcaaatgaaatcagccagtcccccttgcaaagatccaacttttgcagcagaaaacgtggcaaaggaaatgaatctgcagaaagcggccaactttgcagacagacagaaacctgggaagagcacaggttcaattcctgtgtgtgtcggctgaaattaaccttggatctgaaaagaagaagaagaaaaggaaagcaagcttccgaccggaagagaaggcaacctcctcgatggtactggtatatggttgtggtggtggttgcaggtgcagagagggaagagagcaacagtgtgaagcagttgagagagaaacagcaaggggatggatcatggatgaactctttatattatcattatgacttatgaggtcgattgagatttggcaagatacgtactagtagcactagtgtatatatatatatatatatatgaaaacattattccagtaaacacgaatatgaaacgatttggaagataccgagcaagtctatccaactaacctcaaccaataaataaaatgtcacccaaccaaccaaagttaattagtagtattgtttactttttgttgataaagagagcgagtcgattagctcaagctaactatccggtgatgattaactggtgggccgaattcctgaaaaaggaagatagaggaaggcctaattttaacgggctgcatgggcctcacctccttcaggctggccatgcccggttgcttgttgcgtctctccgtcgtcgtctttttttttttctaaaggcatgctcgatgtacatgacctaccttaatattatcgtagggcctataaaaatatatcgtcatacacataatgtatatgataagagaagggtattaagatggatcccaccaacctaagagcagacattgagagagtgagagagagtagcactaccgtaaaagatagaagagttttttcccttgtgggtagtctttatgtacatatagctagctcaacgaaatacatcccataaagactactctcacaaatatataaggtctattttagaggcttaagacaccggctattcttcctacaatatcattcctctccttctcaaactccttcatgttccaacgctctcaggtccttggactcggtgccctaaccttggggctatagcggtggttgggtgatggcctagaagcagtggcggatctagaaaatcgattcgttggtgttataatgtgtctatcggtgtcatagtatgctgataatacttagatcatagtgttataatatatagataagtagttttgctatagattttgccgaaagtcgtcggtgttggctctagtactgtagatccgtccctgcctggaaggtatcgatgggtggctagaaccgaacaggcagatggatttgagtgtttggggataaaagttttatgtctttttgtataaaaagtggggttggattggaaggttttgggaatttgggtataatccctttggtaattatgagatgaaagtttcatggaagagttttgtgatttgagataaagttttatatttgaaactaaaaatttatgattttcgaaatgaaagttttaacgcacggttaaaagtttttgaagcagagtccgacttgtgtgaagcggcaagcgtagtcatgtgtgcgtgatttctgttcgtggcgcatatgcatgcgcgtgccagcatctcctagaagatagccatatgcactagacgccatgcatgtaattaagataaatactcctagattggaaagatcgatatatatgtatcaccttaattagtacattgtaattgatattttttttctgaacgaat

SEQ ID NO: 7649 - DNA, 2765 bp, Oryza sativa
  unsure (1)..(2765): unsure at all n locations
catcatgattcaacaagttctacaagttttactcatattttataaaatttcacttggatattaattattagacataacatagtgcaaagtaaaacttatgtcaacatatatgcttatataaactaaaagtattcgctaaaccttacacaaagtgaaatatgcaagttgcattgcccgttgcaaattgtaaccaattcctaataagtaggagtaatattgattctagtgttggatcggagcttgatgtgatataaagctttcttgatatacgtactgagatgatatgtatgatcccattaaaacaggagcatgaatgtagatatgtactaggatcacctatatatttatcgtctaaaaatttaccagatgtatttatagtacaatcataatataattacactataactttacatgtaaccttgtatataacttttaagaatctctccgtaacatgctatttcggtgaaatggagatcatgggaaaaaatcctctcatatttgtgcgcgcagtgacttttttccttcttcacttgcacaaatcttgaaacaaatatacagttcaaaattatgtgaaagttacatgcaagttacagtataattacactacagttgtactataattgtgctgtaattacatctgtcaaaattttagaagaaaatttgtcgataaatatatagcatggtctaattagatatatagtttgtacagcagggttcgtgtccatgagattgttttcgtatgccttgacaaacccaagctccttagtcaggtaacacacgtacggttcatttactaattaatctggctagctagtatgttatgcatcattttctctttttttttcttttgcggagaattatcatgcatgcatggttttagttaattagttgcatttatattgtgcaaacattatgcagttaactattattgagtacaatataatatgcagctatctgcgttggtgtctgaggttggactgaatatccgtgaagcccatgtgtactccacactcgatgccttttctctcagcgtatttctcgttgatggttggaacaaagaggtaccccatgtcctaaattacaggacgctatcttttaaggaaaattagattcgataacttttaactaataattttactgattatatatgttaagtattatgtatgttatatcattatatttatattttaaagtatttttattgatgttaattttatatcggttgagaacataacacgtacttaaaataacgatcaaagtatgttatttaagatcgtatgaaataaatatatattatacttttgactgatcaaccaaccatgaaagactactactctactaattagtactctaattattaagctagtacgtgttgtccgcaatatttggccattaattaattagctaattcatcgtctaataactgcaattatataaaacttaatttcaggaagcgggtggattgcttaaggcaatcaaggagaaggtcatagtatggcttgcagatcagatgctgagagccacggactgagaaaagttactaatattaacgatcaacctacgaattgataggttggtcgagctgcacattgtatcatcttcgtggagctagggctcgacagacagatcgagatcctcgtcaattaatttgcactgcgcctgtatatgtaataatcttccagagagacttgcaataacacggttgctggtaccgtagtatgtcagctagtatgcctgatgacaaaacaaattagtttgctatctgttaattgtaatactaatacttatttaattagtttgcaatcttgcagaatatatggtggcctatctgtagatagtccatgtttgatagagatccaacttctaaatttagcttcaggagttaggtctgaagtggagttgtggagctgcctaaacccagctccacctcaccagaatgtgacaatttaagagaaccactttaccaataaggagattggtaaagtaatgccatgaacccagaggacattaattgtcacatgggcacctcaccaataaggagaacctccaatgtgacaatttaagaaagttgcaaaatctagaatataatatcgccgtagctatttcggacatccgaaacaagttttcgcctggagaatccaccagagacatgggttagagagagagagagaatgtaactaatattcgtaatgcccaaaataccaaaaaaagagagaagagaatgtaactaatattcgtaatgcccaaaataccctcagaaaccctatccatccaccgtgcaactctctctctctctctcgtgcaacacacattctctctcgtgcgactcgtgtagcggcggtgatctgagggtgtggcggcggcggcgctccgagtgcgcgcggtggagctctgagggggtgttggggaggcgtcagcgagggggcggcggcggcgtgatgcggagccccgccggcgtccgctcgtggaggtagaaggcggcggcggcagtggggtccctctctcttgcctctccgccgctgccccaagcccgatccaccgcctgtaccacgtgtcgttgccggatccaccgcctgtgccccgagccgccttcggatccgctgcccacgcctcgagctccgccgccagacccgctgcccgcgcctcgagccgtcgctggatctgtcgcctgcatcccaaatacaaaatgattnnnnnnnnnnnnnnnnnnnnnnnnnnnnnnnnnnnnnnnnnnnnnnnnnnnnnnnnnnnnnnnnnnnnnnnnn

SEQ ID NO: 7650 - DNA, 9164 bp, Oryza sativa
aatctatcaaacttgagccaaaattattacaaatatgttaaaatatttgaatatatacacggtatgacatataatagggtcaaacaagtaagatataacagggtcaaataagcaagggcaaaattgactatttacccctaaattaacaccgttaactcacccaaacggaataggtgcttcgtttttgaaaaggagggtcaaataagtaaacttcaaaaagtaatgttaaattggtagttacatgtcaaaacagggtcaaataagcaattgaccttatgaatataccaacttgtcactcctcttttctttttacatggcaccgttgatcaggatgttttttccctcaaactttgatcagcatttatttaattacttagttataagtaaagtaaaagaatatcacgagatctatcatcaaaagtactttttaagtgagccttatatgcctatctattcatatacatatttccagaaaacacgaatagtacgtcctacgaattataaaagtcaatgcatcatatatattaaaaaaacagagatagtaactgtaaattatggtggatttagtgtgcatacagattgtaaagttctagggagatcgacatgggagttcatacataggagtataagataaacatggcttttattaattcctgcagccttagctttaaatcttgagtttcaacggtatctttgtgttgcgtgagatgaattaattaagcggccggcagcacctcaattggtctaataattaatctgaatatcacaatatgcacgacaaattgactttgcttagtgggcatccatatataatagcacgaggtagaactgcaattgggtacctatgcttggtaattgaacttattgcattggtttttccgacaggagtgcttgatccagtgctcctccacctccactagttgttaccagataatttttaactataagtctatggtaatagtagtatttgtttaggtttatacataaaagttgatgtattttggattggaggttgtatgtcacagaataaaaattaagatatgtcatgacattatatatacggagaatgataattagaccccaaatccaaccactgcgatacttcacaaaaaaatacgttaagtatacatgtgtgtgtatatatataaacattggacatgtttgggagcttctgatggctgtattttctcctaaaatccgaacctcccacaacaatacaaacaactctaaagctatagaccggcatgtatttatttactattctttgtctagatttattatcttagaagaggtcatatattcccttaattaaattaagttctgtaacgcattgtaaatgcagtcatcaaattaataatggttcctagttttctccgtacgttgaaatctctgtcccaaccatactagtagctgctaggtcgctaattaattaactaaactgtctcaagtttatcgagttgttaaattgttaagtgaacttggggttttcaccactgcgtgctcttcggtctaggaatctactgtaagcaagttactaataattaatactccatcgttctttacatcgtacgtgtttgataaagctcctaacttagcttcgtaaattcatacatctatgggcctgttcactttaatgtcaaaaaaaactttatatagttaccaaaattttgacaggatttcttatatagttatcaaaatttgacagcaaactaaatatagccacttttttttacaactttaacaagattgaaaatgacatcaaaatgaacaggccctataatccagagctccaagatctaaatatgtaattatgttgataatatttaaatacatcatttttttattttcaataaaacataaaatattaattactatttcctccgtaaaaaaatcaatctaggagagggtaacaaactacgagagccagtatatatgagagaaactacgagaggcagtatatatatatatgagagaaaataaactcttaggttacatttttatcatatatttttaatacaaagtatagtgataagaagcgtacgtcacgagtgagtcaccttgtttgtggagttttttttttgtctttataattatttttaatatagaagaggaagaaactgcggtcagagtcacgcctttctgtgggccccacccccaaccaaaccctcaaagtcgcagcttgcgtcatccaggtcccaacccggtgggccccaccgcatccgcatccacccgcggtgtgggggaaaatcccagccgtccgcagttaccatccgcaccgtccatccctctacgcagatccgatccctttccgctccggataagagatgccacgcgtcgtgtccccattggctggaccgctacgtgtccccattgttcacacggccacggcagatcggaatattctgaaaaggaaatactactagtagaaacaaaacccacagaaaattgaattcaaaaaggaaatttaaatccgttagtatttcaagcccagtggtcgtcgtcgtcttctccaaactccaatcggtggtcgccggccggagcctgcaccaccgccacgcacggcggctataaatacgaggcccccgcgggcgcgagcacgcaggggcgcagagggggagatggaaatggaggcggaggattggggggagagctcgtcgccgccacggccacacccagaggcagacatggtgaataaagagaaggaccccgaggagatgaagaggaagctgaaggagcgaatcctggagctggagaaggaggaggtccccctccccgacgacgcctccgccttcgtccaccacctgtcgcgcctccccaaaaggtatctcttcgacctcggcgttgacagggtggacgacgtcctcctccactggaggatcctcacccactgcgcccacccacagaatcgccccgtcttccacgcccgcttccaaaagtccattcctctcccggattccgatttcgatccatgccagaggctcatggaagacctcagcttggagagaagaagaagaaacgacacaggagacaacaccggctccatgtccatctcctctaggttggtacttcctttatttcctcatctttccatttgccttttcactttattattatgtctttatttgtttcaatacactagatgaaccctcgcgttgctgcggaaaactaaggaaacatcatgcatgccataagcacaaaacaaaacccacaatcacatacctttaaataacatagtatttgatagcttgcagaatcatagaataggccaaatatatgttgagcgacctgcaaacaactcaagaataatatgaaataaggtagatatttagctgaacaaacactgaatcagtacattagaggataataaagcatacaaatttctctctaaaacatcacaggatcgtgcaatgtttaaggatatatttgtgttgagaatgagaaaaaatgtatacctgctagctatgcatccattttttcagagctaaaatctatgaataccttttaatatcattttaattaaagacaaatctagttagtggtaaagaaatattgctcgctgagtacctgcagccaagcaagcaaatcatcagatcagattataaagtatatatgagatatatacatcaattagccaatcaaaggtaaaaggattaaagaacaactgttagtaaaaaaaaatgatttccataaagtgaacacaatattattgaataaaggggtgcatagtgataaggatcagtacaccacattctttggtcaagctcacacaaagcaagcactgcaagatctggttaatggtgtccaaacaaaatgatgaaaccaagcagtgcagagaaaagccgtgcaaactgctgataatactgtaaaacacatcaaaaggtctgggcaaagagtttgggttcctgaatgttacagaagaaacaatttgtcaaatcgcagtcaaaagggtgcaaagtgtacatatgcagtacccagtctaacctgattataagcacaatctaataaattggttgtgaaatacttacattaaaaaaggttgtgagatacttgtgcacagatggcactgatcctgttcaaatgttgtcttgcataaatctgaagcaaatcaaacaaaaataccagtacgatatcaatctcgttcatagaaattggtgtggcaaaaattctgcagtagaaacagaggcaacccaaatacataaggcttagtgtagctgcaattttgcatatacatatataagaattaagaaatcttgtcttatatattttgtcgactcctagccttaatagattccatacgatattgtatggataattaagaactgattcgatttttacaaattgtcatgtaactggaagtgaagaaacagcaatcctgtactgtcgaaagtaaagcatccccatttttccattatcttaatcatggtgatgatgcatatggttgggttggccggtcgcacggggatgatggattaagagtcttagaagctgacgatggtatattttgaggacttaaaaaaggcttaagaagatactcccgactgcttgttgctggcgatggtttcagaaagaggaatcatcccgtgggtagctagtggtaggctggtagtccatcagacaatctggagaagaggaacagacgacgccagcgaggtcaccgaaggggattggtgtgcgcgacgggggtggctgatgtgaaggagcggaacgtacaggcgtgaggagcagcagtgcgagaggaggggaagcggcggcagtgttggccgatgcgccgcacttgtgaagggatgagagcgggcggtggttgcgagtttggggatgagagcgagcagatagggaggccgtcgggatgggctcaattcagttgggctttctcgtgtgcattgtgcaagcaataaccatcaaaccgttgagttttggtccaacggctggcattcattttgatgacgtggatcaaccacaatgcaggaaattgtgtaataactacactaagtggggatcacttatatagatttataggataggataccatatatatcatactcataccttatacaccccaactagtatatagtacttactgcctactgaattcccttcctacaggtaccccaaaactaagcttattcatgagattatcttctcttccctggacaagcccaagcttcttagcagggtaataattcattttccatctcctacttctgctttcctttccatattataattgccaacttacttaccaccaatagttacttaatcttttcaacagctcactctactcttgtctgaggttggactgaatattcgtgaagcccatgtttactccacaactgatggcttctgtttggacgtttttgttgttgatggctgggacacagaggtcactctataaccatgcctgtttctacatccatctataaactctctgtgattaccagctcacatttcacgcacacagataatatcgtttactctttcattatgtgctcttgtatatgcaagtgttgcttgctcattttgcaacttcacatgcaggagacagatgatttgatcatcaagattaaggaggcattgtcgcacaaaaatgtatgatgccctttacactcaacctactttaattcctttccgtttcggtcatcataagtcatccgcatggtttttcgtctcgcttgtttcatgtaaatgcagtaccacgtgcaaagctctagtttcactcacaaggaaattaccgacatttcctaacagacttagattaattattccatgtaatatgtaggcatcaccatctaattcaacaaattcttcagcctcgacaaatcagcagaaaatagctgagctacaacagcaggttggagattctgaaattgactggaacttgctaacaacaggggaaaagattgctactggatcttctgctgacttgtaagaattatttggcacttacagtttgctaacagtctagtatgatcaccatttactatgggaataataatttacaagtttcaattatttgcacttcactgctgatacggtggtgtgccgctctatcctctacagaccataatagtttgctggcttccactgacaaggaaatgttgatgtattaccatgatgccaattgacaaattaccatggatattattaacctagttttggctctgatacacaaaaaccatataacagtattttccagtcgagtctcatctttactctgtttcacaggtatcgaggaacttacaatggtcttgatgttgctgtaaagattctcagagattctcatttcaacaatccgtcagaagttgagttcttacaggaaatacttattctaaggcaagttcttttataaactgctgaaattagcgtgtttcattttattctgacttactcaagatattttcctccaggagtgttaatcatgaaaatgttcttcaattttatggggcatgcacaaggcctcaaaagtattgcattgtaacaggtagcatttatatcttttttttccttaatatttgattggaatcacctccataaccactggtgctgaattgcataaacaatgctgttgttgccacgtgtgcatgtgcgcacataggcttaaagcagaagctagtatttaggtattgacacaaacatacatccattttatagccatctatctgatgttgttcttcaggtagactatttaattttgaagttcccatactatcaagaaaattgtgtaatatatagcaaagaatttttaattatgcatcaaataggtcttagacttgcatagttggagtcagtattcgaatgaatcatgcttcatgtcctgtctggcttactgttactgaactcacatttttgtcttgtggttggttctctttctttcagaatacatgcctggagggaatttatatgactttcttcacaagcaaaataatgttttggacctccttacgattttaaggattgctatcagtatttcaaaggggatgaattatctgcatcagaataacatcattcatagagatctgaagactgcaaacctgctcatgggctatcatcaagtatgcgtactgaatattcttctcagttcccattttcttcttctttctgatatgtggtagtgatatccaaaaattagaaaaatatatcaaggtgaccggtactattacagcaaatcatttgttatccacttttcaatcatatgacactgctttgggatgggatatttttttcttcgaattatgtaaagattttcagtccacatcttgcagatgggcaacggcatttcaaagaggattttttacaacattttatagctcaaaggggagatttcatttataaaaaatcgagttgcttaagaactttggcttcaaatagtccttgtaatttgtcagtattaattttgtttttcagttttgaactgtgaaatttcatgcctcatgtgaaaaaccacattatggtcctgaagatgtaattctgttcctttaattgaaatggactaatctcccagatttgtattgactatatctgctactggtaataggttgtgaagatcgcagactttggtgtggctcgacaaggaaatcaagagggacaaatgactgctgaaactggaacctatagatggatggcacccgaggtacagttgaccatttaatttgtgcccattgagattcatacttcttttttgttgaaagaaataacttttaggaagcttctgtgtccactataccatcctcagttttcctagtttccattgttatctgatgtgtgaaactatcggtaaaccttttgcttttgcgtggtcctttgtttgctcttgtgagttgtgaagcgtaggctccttgcatcacatttttttctggaatgggtcatgcctcctcttcactaaactctgcctttcttttaagaattgcttggtgttgaaatttttctttcagatttttgtataaccaatttgtgagttctgagtaacctaagttttgaaaatctgctgctttgtatgagatacctttttagataaatccaattcaaagtcaagatttgaaactagaaacaccaatcatatactactagataatgtggagtggataatgctgcacaaactgaaatagggcatcacttctccaacttactgttgagcgatgaaccacccatcattaagccatccatgtgagaggtgtaagttggacttcttaagttcccccatgcaggcatcactgcaacagtgttgcattatcaactttgaaagattttgggtcaatcagtgtccttggaatctaagatgcctttggaactttacctgttatgtgaaattgattgtattgatgatttgatagtgacaaataagatccagttgtaggaaaaggttggatacattgtttaccactctggaattatctttgcgtgagatgagaagttctgaccagagttttcattgcaacagtttttccattcttttggatgagaatctcataggtgctgcttgtctcaacagatcattaaccataagccttatgataacaaagcagatgtgttcagctttgctattgttctgtgggagctggtaactttgaaggtttggccctggtgtacattctgcttgagcttaattctgagttgtttgaacataccatattgtgattattaacggtaacactgtaatttttaattctgctataggtcccatacgataacatgacgcccttgcaggctgcactaggagtaaggcaggtatgtatctgattctggtcatctcgagaaaatattgctttcgttgtggtgctacctccatgtcatccactgtaaaagattccagaaaatcccaaattttttggagttgtaagggatgctccttatccatgtaaatcacaagatcaaacagaaccaaagtaccacacttcaaggatattagaagatgacagaaatgaacatgaataatgacaaactagcaaattattttgtctctgtgtttctttaaacagaaatccacattgactcattttcccacacaccctgcttagggatttcgcttggagattccctcaagtgtgaacccgagattgtcaaaactgattcagcggtgttgggacgaagatcctgatgtccggcctgtttttgcagagattgtcatcgaacttgaagacatcttacagcatgcccaggtaagaatgatt

SEQ ID NO: 7651 - DNA, 886 bp, Oryza sativa
  unsure (1)..(886): unsure at all n locations
nnnnnnnnnnnnnnnnnnnnnnnnnnnnnnnnnnnnnnnnnnnnnnnnccttcgctgctcctgtacatgtattttactgcattctttagttattcacttcagaatctttcagtttgcctgatagagtataataatcaactttgttttggtctctggtaaaacaaaaaaaaaggccagaagtaaagaaaattataacagcctctagctacattgacctttgacatgtctacaaatcaaaagatcagtcagtggtgtaagctgtctccttaatgctttgtagcagtgacttaacctcatcctttgttaaatcaaagccgccatggatcttctccagtccatcatcagccaagtgtgacattttgtatttttgtttgtcttccaattgtcttatggttgcagcagatgagtcggcaatttcatatagactcttcatcacctcttctgaacgtccatactaaaattgctttctgaacatcctcttcttcattttcctcttctccttagaattaccctccgccgcctgattactgttcaacttccactttgagctattcatatccttattactagagccttccattgaatcagtgaccctacagatcatacaaagaagagaataatcaaattaatgtcgctaatataatccgatgggcaacaatcttgaatcaagtgaaacgaaattaagatatactactattcagacaatatataccgtacctctctgatgtgttgtttgaagcagcagcaacatcagcagctttgcaagcaaattccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 7652 - DNA, 701 bp, Oryza sativa
  unsure (1)..(701): unsure at all n locations
nnnnnnnnnnnnnnnnnnnnnnnnnnnnnnnnnnnnnttccattgttatctgatgtgtgaaactatcggtaaaccttttgcttttgcgtggtcctttgtttgctcttgtgagttgtgaagcgtaggctccttgcatcacatttttttctggaatgggtcatgcctcctcttcactaaactctgcctttcttttaagaattgcttggtgttgaaatttttctttcagatttttgtataaccaatttgtgagttctgagtaacctaagttttgaaaatctgctgctttgtatgagatacctttttagataaatccaattcaaagtcaagatttgaaactagaaacaccaatcatatactactagataatgtggagtggataatgctgcacaaactgaaatagggcatcacttctccaacttactgttgagcgatgaaccacccatcattaagccatccatgtgagaggtgtaagttggacttcttaagttcccccatgcaggcatcactgcaacagtgttgcattatcaactttgaaagattttgggtcaatcagtgtccttggaatctaagatgcctttggaactttacctgttatgtgaaaatgattgtattgatgatttgatagtgacaaataaaaaccagttgtaggaaaaagttggataccattgttaccacctttgaattatctttgcgtgagatga

SEQ ID NO: 7653 - DNA, 711 bp, Oryza sativa
gacttgggttgttgttttgaacattctgtcttaatcgagtatgttttttgagcaggcaaacagcaggggagccagtcggcgttctagagctaagatacagaagaaatcacctcgatagagtatcataccaaaggttatcttgctctttggttttcattctttttggtaaaacaggctaacttgtagctgctttcttagcaactccacagaatgtgtaatttctttaggtctccttcaaatgaaggtatatatgcgtatatatatgtacttgccgatttgacggcagtaacagaatgactgcgaattcactgttggtgtcatctgtggactgattagaagatgaccattgtttgcttcccatcctcgatggcaaagccgaccttagaacacttgtacagctgtagttgttgcacctaagtactagtacttcgtattatagtggccttcgctgctcctgtacatgtattttactgcattctttagttattcacttcagaatctttcagtttgcctgatagagtataataatcaactttgttttggtctctggtaaaacaaaaaaaaaggccagaagtaaagaaaattataacagcctctagctacattgacctttgacatgtctacaaatcaaaagatcagtcagtggtgtaagctgtctccttaatgctttgtagcagtgacttaacctcatcctttgttaaatcaaagccg

SEQ ID NO: 7654 - DNA, 678 bp, Oryza sativa
  unsure (1)..(678): unsure at all n locations
nnnnnnnnnnnnnnnnnnnnnnnnnnnnnnnnnnnnntaccatggatattattaacctagttttggctctgatacacaaaaaccatataacagtattttccagtcgagtctcatctttactctgtttcacaggtatcgaggaacttacaatggtcttgatgttgctgtaaagattctcagagattctcatttcaacaatccgtcagaagttgagttcttacaggaaatacttattctaaggcaagttcttttataaactgctgaaattagcgtgtttcattttattctgacttactcaagatattttcctccaggagtgttaatcatgaaaatgttcttcaattttatggggcatgcacaaggcctcaaaagtattgcattgtaacaggtagcatttatatcttttttttccttaatatttgattggaatcacctccataaccactggtgctgaattgcataaacaatgctgttgttgccacgtgtgcatgtgcgcacataggcttaaagcagaagctagtatttaggtattgacacaaacatacattcattttatagccatctatctgatgttgttcttcaggtagactatttaattttgaaggtcccatactatcaaaaaaattgtgttatatatagcagagaaattttaattatgcatcaaataggccttagact

SEQ ID NO: 7655 - DNA, 791 bp, Oryza sativa
ccaatctaatagctcattcatacaatagtcacatactacacaattaatatctggtcccatctgtcatacacacattacgtcttagagtccgtgctacagctggctacaaatctagagccccgctacccttacctctcctcatttatcttcttaaaatatatttacagctggcttatagcgtgctattgtacatgctctaaggactccttaatcaatcgtcgtcgtattgaagaaagagcaattaatggccccgtaaaaccaagccagcaatttgatcagcaattctacacaaagcaattcagcaaagaagctactactactacagatgagcttacacctgtaccagtaaattacagtgcataataatgttggatttcaggcggtagctgtgctctgtggagtagagtacctcgcagcatgatctggatgatgttattagggcaggagagagagttgtgccgactttagttcatcggatttgttttcttttatatggctcaacatctccaatgcagtcgcagagtccagaggaaaacggcggtatagaagaaaactggagtattctatttagcacacagattactgctctcttcccttgaaaggccacatgctgatttgtttctcatactccttccgttttgaaatgtttgacacaattaactttttagcacatgtttgaccgttcgtcttattcaaaaatttttgtgaaatatgtttgattgagaaaatcccttatatacccctgaaatttttcctaatcccttctatacccctgaattttgcttacttcc

SEQ ID NO: 7656 - DNA, 683 bp, Oryza sativa
  unsure (1)..(683): unsure at all n locations
cccaccggacctaagggaggcaaaatagacttttcgagaaggattgatattagggatttgaatttgacgatggattggggatttgagatttggaattggcacggagactgacaacaagcaaagaaacaattttcgcaattagggtttttagaatttaaattttcccgctaggcgccacgatggaacgggcgctacatcatggcttcgatcggccgctatcgatagctagttgagcttagcttgtataatcatcagcggataacagtgatcagccctcaagacacagtgatttacgtggaaaaatcccctcggtgtgaggagtaaaaaaccacgggaccaacggtccactccaagcttccactataatccagtacaaatggagtcttctctagaacatctagaggcacatcacaacaacagctacaacatcaagttacgcaattggcatcatccatcaaccatcaaaactaacaagaggcatatcagcaaacaagcaaagaaatgatagatcctgtcatcttcgtttctcagctgagatctcccaagccacatatgcaaattgcacgaaacatggctgaaatgatgatctatgagtcctttccaacctttccaaaaaacannnnnnnnnnnnnnnnnnnnnnnnnnnnnnnnnnnnnnnnnnnnnnnnnnnnnnnnnnnnnnnn

SEQ ID NO: 7657 - DNA, 626 bp, Oryza sativa
  unsure (1)..(626): unsure at all n locations
tagggttagggaattgcacgaatcttaaaacgatatattgggctatccaaagttttactaattttttcttgttttcaggcaactaaacaacacacagccccttaagatttgtatttttaaggctacaattttaagatgtaaatgacacacgatcatacatcactcttagataacacgccaaggccaccacctctttactacatctacctcctcctcgatctacttaactgagaacctctaggaatagtgggacgcatgaggacaagttacctacctgcctagcacaagtaacctgatgctagtcttaggttcgatgaggattgcacctttagagcagggttttaattgggatgaaaattttagtgatttgaggggggggtcatggatggaaagttaggaggacacctactgctggcaggtgggagatcatggttgctcatttcaccagagaagagaagaatagaggtagctctagattgaggttagaaaagagtccacacacacaacacgcgtgcgcatgctaaaatatagccaatattagccactagctactatctctcttnnnnnnnnnnnnnnnnnnnnnnnnnnnnnnnnnnnnnnnnnnnnnnnnnnnnnnnnnnnnnnnn

SEQ ID NO: 7658 - DNA, 1209 bp, Oryza sativa
  unsure (1)..(1209): unsure at all n locations
nnnnnnnnnnnnnnnnnnnnnnnnnnnnnnnnnnnnnnnnnnnnnnnnnnnnnnnnnnnnnnnnnnnnnnnnnntcctaaattacaggacgctatcttttaaggaaaattagattcgataacttttaactaataattttactgattatatatgttaagtattatgtatgttatatcattatatttatattttaaagtatttttattgatgttaattttatatcggttgagaacataacacgtacttaaaataacgatcaaagtatgttatttaagatcgtatgaaataaatatatattatacttttgactgatcaaccaaccatgaaagactactactctactaattagtactctaattattaagctagtacgtgttgtccgcaatatttggccattaattaattagctaattcatcgtctaataactgcaattatataaaacttaatttcaggaagcgggtggattgcttaaggcaatcaaggagaaggtcatagtatggcttgcagatcagatgctgagagccacggactgagaaaagttactaatattaacgatcaacctacgaattgataggttggtcgagctgcacattgtatcatcttcgtggagctagggctcgacagacagatcgagatcctcgtcaattaatttgcactgcgcctgtatatgtaataatcttccagagagacttgcaataacacggttgctggtaccgtagtatgtcagctagtatgcctgatgacaaaacaaattagtttgctatctgttaattgtaatactaatacttatttaattagtttgcaatcttgcagaatatatggtggcctatctgtagatagtccatgtttgatagagatccaacttctaaatttagcttcaggagttaggtctgaagtggagttgtggagctgcctaaacccagctccacctcaccagaatgtgacaatttaagagaaccactttaccaataaggagattggtaaagtaatgccatgaacccagaggacattaattgtcacatgggcacctcaccaataaggagaacctccaatgtgacaatttaagaaagttgcaaaatctagaatataatatcggcgtagctatttcggacatccgaaacaagttttcgcctggagaatccaccagagacatgggttagagagagagagagaatgttactaatattcgtaatgcccaaaataccaaa

SEQ ID NO: 7659 - DNA, 486 bp, Oryza sativa
  unsure (1)..(486): unsure at all n locations
agaaagagggaggagaaatagacttccctcaggcggctagggcgcggcccgagagaaaaggccgcggctcggccgagcttaatgggcctgccggcccgagaaggcggcccaaggcacgcgcgagaggggaggagagagagggagacggtgggccaggtccttctcgcgtggtcccgagtgggacccgcttgtcggtggcttggctcaccgtgcggagggagcacgcggcgtgcgctagggtatggggagagagacgcggtgcacgcgcgcggttcgcggaggacgcggatgcgacgggcccacgcgcagcctcacggctcgcggtggaccgcgcgcgcgagcggggctggagggagcggctaaccagggtcggctcgacccggtcttggccgagctggcgccgatgtggcacctacgtggctgccacgcgggccggcgggaggtagacaannnnnnnnnnnnnnnnnnnnnnnnnnnnnnnnnnnn

SEQ ID NO: 7660 - DNA, 767 bp, Oryza sativa
  unsure (1)..(767): unsure at all n locations
nnnnnnnnnnnnnnnnnnnnnnnnnnnnnnnnnnnnnnnnnnnnnnnnnnnnnnnnnnnnncgctctcatccccaaactcgcaaccaccgcccgctctcatcccttcacaagtgcggcgcatcggccaacactgccgccgcttcccctcctctcgcactgctgctcctcacgcctgtacgttccgctccttcacatcagccacccccgtcgcgcacaccaatccccttcggtgacctcgctggcgtcgtctgttcctcttctccagattgtctgatggactaccagcctaccactagctacccacgggatgattcctctttctgaaaccatcgccagcaacaagcagtcgggagtatcttcttaagccttttttaagtcctcaaaatataccatcgtcagcttctaagactcttaatccatcatccccgtgcgaccggccaacccaaccatatgcatcatcaccatgattaagataatggaaaaatgccaggtatgctttacttttgacagtacaatattgctgtttcttcacttccagttacatgacaatttgtaaaaatcgaatcagttcttaattatccatacaatatcgtatggaatctattaaggctaggagtcgacaaaatatataagacaagatttcttaattcttatatatgtatatgcaaaattgcagctacactaagccttatgtatttgggttgcctctgtttctactgcagaatttttgcccaccatttctatgaacgagattgatatcgactgg

SEQ ID NO: 7661 - DNA, 805 bp, Oryza sativa
  unsure (1)..(805): unsure at all n locations
nnnnnnnnnnnnnnnnnnnnnnnnnnnnnnnnnnnnnnnnnnnnnnnnnnnnnnnnnnnnnnctgattaccagataagatgcaacaatttgttaaaatattaaatttccaaaatactgctggattcatgattatattatttgttccatatggatagttagcagctttcaacagatctttcatttcaatcacatcaggttttctgttgaagggtctaaaataaagttgctttctcatgattgttggtgacaggacaaatcctacacaggaaccttagcataattctgaagtacaaaggcacagaaagcctacttacataaattgagaggactatggtaacagcaagaattgcataccctgcattatatgcaggaaacatgtgtatgagatgcctcgccacaaagtagcagaagacggcaaccgggattgcaattagagagaaagatagcagagtggccttggcatctggtccaaagataaaccttccaccgcacaagattatctgaacaaagagaaacacgttgatgacacattaaaaatgtttatattaactgctggtataaactgcaagcaaaggtgaaaattccgaaatcctaaaaggtttgatatgatattgtgtaaaatctgcagttgtccaactccatcagaactcctatcaaggccattgtttttacactagcctgaactctgaataagacaagttgctgaaagcaataattctaaagagaagagtaaaaagaagatttaagcaacgtaatgtttgcaagtgtagcacattattttttatgcagcctgaagccaggttg

SEQ ID NO: 7662 - DNA, 939 bp, Oryza sativa
tatagggcgaattcgagctcggtaccccatatatatatatatatatatcgcacctggctctgcaatgcaagcccattatatccaccataagctacctagctacctgcatctctctttttgctaattccatgcatgctgcttctcaacaagcattccaccacagatgatgcatataaacatgaattcatgccttcaagcatctgatatttacacaccacatcacatttgccgcccggagttctgcagtttccacacgactatttacacaaccactttcctctactataaacacttgtgaatcttaaactgaatactgatccacattggggtacaactagcaaggacgcagtgtacatcttcacaagtgcaaccgaatatttacagacccccccatatatagggtcagtttggagctagcgctcatatgggcttccacgcagttatgacctcttggaacatttccagcatcagctcacgatctgcgtgctggaagaagctattgatctcctccctcacatcgtatatcttcccaaaaacaaacaggtaggtcaggcaccctttcttcagcttttgcagctggtacagccacgcgacgtgaagcctctcgaggacattgctagagtttatatcctccaggaggctctcctcgcagcagtccttgatatcagaaatgctgtacttgttcgctgcggcgagcagcgagaggcggtgcttccagaactggtctagctttatggtcccgtagatgaagccaatcagagcagagcaagactcaaggcacatgtcatttatgttgattgtggaggactccttttccttgagatcatggaggaacatgctttcaaacacaggagaacatgatgcaaggatggccttatgggccttgaggacaccatcagtcgtatttatggtgacgtctgcatgtatcgactccgtgag

SEQ ID NO: 7663 - DNA, 656 bp, Oryza sativa
cccagtggcgcatcgacaccttgggcccctcctcctaccgccgctccgattccttcaagatcggcatctggaactggttcccttcccaatcccaatcccccactactcagagatcaccgatttgccctatcaaatcaaatcatccgccaattcgatccgaatccgtgcaggtacctatcggtggagaaggctcgatatgtatacgtgaggctgttcccggagcccgggcgggtggccaaggaacggcccccgctcgcccgcttccttctccgagcttgctggtccggcccgccacgccgctcctgcgtctcccctggtacatatactcctctactttcttctttcttcttgccaccaccaccatatttagctttaggctatggaccatccccgttttagtgcatgtcttgtcttcactctccatgccatcttcagactttgaacacctgacctgacctgaccacttaacatgctatctgcaaattgtctaatagagcacttcttcacttcccttaccagctatctactctagtagtaccattcaccattcaggtatggtggctagttgaagatgctcccaaagagtcagaccctccctatgcatatggtcatcatatttctctatgaaatactcgtagggcatattggggggaaaa

SEQ ID NO: 7664 - DNA, 827 bp, Oryza sativa
  unsure (1)..(827): unsure at all n locations
nnnnnnnnnnnnnnnnnnnnnnnnnnnnnnnnnnnnnnnnnnnnnnnnnnnnnnnnnnnnnnnnnnnttctcccatcagctaacatagcgtaaacatgctctagaattttcaggtacagttgatcttgaaaggaagaacgaagcaacaaaaacacacttgcacaaatatccaagatcagaataagtattagaaagtttcgcaaaaaagaataaatattagagagctacaaaacattcaccgactaacagattattgctaagctgtaacatttatacgcatgacaaaataactaatgtaaaagaaacacaccattacaccaactctaaagtcatcacctataatacaagcctcaaacaatacgcaaagtcaaaccattccttgtagactgatggatatttgcttcttcagcaaaactcagcaagtctttcttcgatttaagatcaccaatttcccctccgtacagacaatgtaagtaaccttgttgaatcacaatggtggctggcacgaaatagttccatgaattaactttgcatgaacctgccagttttgtgtcgcataggatttttctgttttatttgcatctcccaggaacaaatctagcaggggcttgcacaaatgctcatgaaacagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 7665 - DNA, 1154 bp, Oryza sativa
ccacattggggtacaactagcaaggacgcagtgtacatcttcacaagtgcaaccgaatatttacagacccccccatatatagggtcagtttggagctagcgctcatatgggcttccacgcagttatgacctcttggaacatttccagcatcagctcacgatctgcgtgctggaagaagctattgatctcctccctcacatcgtatatcttcccaaaaacaaacaggtaggtcaggcaccctttcttcagcttttgcagctggtacagccacgcgacgtgaagcctctcgaggacattgctagagtttatatcctccaggaggctctcctcgcagcagtccttgatatcagaaatgctgtacttgttcgctgcggcgagcagcgagaggcggtgcttccagaactggtctagctttatggtcccgtagatgaagccaatcagagcagagcaagactcaaggcacatgtcatttatgttgattgtggaggactccttttccttgagatcatggaggaacatgctttcaaacacaggagaacatgatgcaaggatggccttatgggccttgaggacaccatcagtcgtatttatggtgacgtctgcatgtatcgactccgtgagcatgcgcgaaaggcatccgagactgctcttactagcaatgttctgcaccgctatgctttcatttggccaaatcgaggtagatgattctgcagcctgtaaccatatcacattacattagcatattattattatcagtaggcatctgtttgaacagtaggacttgtcataacctccaagccacatacatacatacatacatatatatatatatgtatacacacacacacacacacacacacacatatatatatataaactaccgtgtaaagaaagagaagtgtgagatgttctgaaaaagaagcggaattattttggaaccaattttgaggacaagaggtggatacttgcattgtagaggctatcttcaggtccaaaaactcaacatcaatagtgaaacgcccagcgtacatcgtatcaagttgccagaaaaagtcttcgctgcttcggaggagatgctcatgcactgtcaggaaaaattggacaatacttatgaagatcaatgaggctggccgtaacatcagtaaaacatcact

SEQ ID NO: 7666 - DNA, 5779 bp, Oryza sativa
  unsure (1)..(5779): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttggaaccaattttgaggacaagaggtggatacttgcattgttagaggctatcttcaggtccaaaaactcaacatcaatagtgaaacgcccagcgtacatcgtatcaagttgccagaaaaagtcttcgctgcttcggaggagatgctcatgcactgtcaggaaaaattggacaatacttatgaagatcaatgaggctgcccgtaacatcagtaaaacatcactgcagtagctatagaagcaagatgactatggaatgacttggaaataaaagccattgggctgttaatgcttgaaagtgaacattaccctattttcgttctattcatattataacaatgacaaagccacccaaattccagtaaacctagtgtcctgtgaaaattagaaaacagacaccttatgtttcatgaaggagatggtggagctgttctgagcttaaaaaggttcacccaaaactaaagcagtagaatggaaggtagaaacagtcttctgcgtatagcccttccctttgagttattgctcacatgatagttggaattaaaatgaaagtgttatgcaagaaaacaccttttccccccaatatgccctacgagtatttcatagagaaatatgatgaccatatgcatagggagggtctgactctttgggagcatcttcaactagccaccatacctgaatggtgaatggtactactagagtagatagctggtaagggaagtgaagaagtgctctattagacaatttgcagatagcatgttaagtggtcaggtcaggtcaggtgttcaaagtctgaagatggcatggagagtgaagacaagacatgcactaaaacggggatggtccatagcctaaagctaaatatggtggtggtggcaagaagaaagaagaaagtagaggagtatatgtaccaggggagacgcaggagcggcgtggcgggccggaccagcaagctcggagaaggaagcgggcgagcgggggccgttccttggccacccgcccgggctccgggaacagcctcacgtatacatatcgagccttctccaccgataggtacctgcacggattcggatcgaattggcggatgatttgatttgatagggcaaatcggtgatctctgagtagtgggggattgggattgggaagggaaccagttccagatgccgatcttgaaggaatcggagcggcggtaggaggaggggccgaaggtgtcgatgcgccactgggccagccgggagatggtctccacccggttctccctctccatcccgccgccgccgccgccgccgcgccgtctcctctcactctacttgtaataactcccggtaacataactcattaacttttcctttttcctggtcaacaacatttttcttatcttagaaaaaaacaaagagataaactttaagcctgttcagattgtagctaaaataaaccttactaatttttagcaagatggcaatattactaaaattttagtacgatttcttatatatttatcaaatttagtaacaaactaaacataaattttatttggcagctttataaaaaataatatggttgaaaatggcatcaaaatgaacatgccctttccgagacatcacatttttatgggtgatgcaatgtatcaaaaaaaatacacacaattttgaaaagtaattttgaaatagaagatttctattgtagtataaatacacacaattttggaaccggacaacacaagatgctcaagggaagaatgccaagagaaaaaaaaattaaagaaaaaaaaaaggtcccaccgggattcgaacccaggtcgccagattcaaagtctggagtgctaaccactacaccatggaaccattattgttgctaattatctctgtaaacttatttatacaaataatattcgttagagcccacttgagacggcccattagtttatagaatgataatagctaggcctctttcgtcagatggttcgaccttccaagtccaactgtacgcaccgcttcaaatctgtttgctccctcttcaattattctcctacattgtttacgaggtttagggcttgttccttctaaagaaattgtaatggaaaagtactgaaatatgtcatcctttaacactaaactgcccatttgttttaaagaaactcacgaaaggcaaatttcatatccctctactttaggaggaaaaaaaatccacctcaacataatgttttcaatcctttgtactgtttaccgaacaaccatagaaaagtttactatgttttcaacccttaggtttgcacatgtattatcatatattcctacttttttttctatttttatgttgtgaaaatcctacaaagcaaatgagcccttgagggaaacaaaactttttttttaccaaaaatgtggtgacacttttgttcatttcagccctatatatgtaatctctctctctctctcattttagtatataactatctctcatatcatatcttctaggcagttgattaattacttttaattttgtttctcttaaacacatgtattatcatatattcctacttttttttctatttctatgttgtgaaaatcctacaaagcaaatgagcccttgagggaaacaaaacatttttttaccaaaaatatggtgacacttttgtctagttcatttcaaccctccctctctctctcattttagtatataactatctctcatatcatatcttctaggcagttgattaattacttttaattttgtttctcttaaacattgtgtattaaaaaaaaatacaatgtaactgcagaaatttataatataactttaaaaatttacaatgtaaatgtagttaatatatagcacaaaaatgatttgactattttctatttaaattgtggcgcaataaatatagctagtcaagaaaatagaatatctctaccatatctatacttctttaaaaagactctaaagttgtgttcttttgggcgggttgggaacctctcacctccacatgcaaaacggagcgatagattaacacatgataacgtggcaatgatgcatctgtctttccctacctatttccgttgtagcttttacatattacccacttaaacttcttaatattacataagaactaaatctaaatagatagccacatgtaaaattaaattaagataactattccatataggaaaaggtagataacatatctcacaaaaaagtacttttctttattttgagaaatattgtgatattttttgtacttttatcactagcaaagtgcgacatttagctagttagaaaagctagcatacgtcataccatcccggtacgtatataagacaatatagtcatgtagtccacacgttacagccgaaacatggccataccttatgctcaatgtccccatgcccaagcctagccatgtgaccacaccttgattctccacattcctcctctactaaattgctcatgtcgaagagcatatgcaggcctagcgcaacaaatacatgcagctgcgtgagccgatttgatcatacataactttctccctagttttttttgttcttaacttaatttttccccttcatttcatttgatttcatttgtcagtattaactaatgcaccatacccttttatttgtatatcttaaatttcttactccaagcactattggagctatgcatatcgactggtgataccatgataatcttatgtattcaagggcaaacattaataatatttagcgatgctacattgatgatactctactaatgcaccaattacacttatagcatgctaaagataatcgtaaacatattatacggtcaatacaccaacaataatgataaacaatgatgaaaccctcaatacaatgatgatattcatgacacattgatacaccaacggtatgaagtggacaatatatttgacatgccaatggtactatcacccaaaggatatctcaaatacaacaataccatgcctataatacctctcatgcatcaacaataacacgttgatgatacctccaacacacatatagtactcaaattggaatatcgatgatatttgaaatacattgaccataaaaaaactaagaactcaacattatgatatatccacaatactatagtatcatgctacttgttgagtcataatacctttgtggtaccatgaagaatcattgatgttttgtgatacgtcttgatttcatcaattcatgatacccgtaggtatcacggatatttcatgatacctataggattaatggtaccttgtagatatcaccgatgtttccatcatgacaccttgtggtatcatgatacccgtaggtatcaccaatatttcatgacacccaaatgtattaggtacctttgttgtatcatgataccagttggtatcaccgatatttcataatatccatatgtagcatggtaccttgtggtgttatgatactcgtaggtatcactgatatttcataattcctagatgtatcaggtaccttgtggtatcatgataccaatagagataccatcgacaattcatgatacctttaggtatcaccatgtttcatggtgcccatatgtagcatttacattgttgtatcatgacgtaccaccaatgtttcacgaaggaatcctctatataggtgtgtgtcagggtttaggggtaactaaatttctatagtaacattatgaagctatatcaaggttgtaagattatatcatagagatatcacctatatttatagtggctttcatatagtgttgtctgataagccaacaagtagataataaaggcctatgtaggtattactaaggttttatatatggtgctatcagtgatatgtatatcacaaaattttcatgaacgtgttgagctcatcttttcccttcgtcggtccagcccaactgctatctatcctaattagagagggaggcatgctatcctagaccaaaacacacaaattatgctgacaagaacggccactaaagccagcccaatccggccaatgcacaaagcttaatctagcatgggctatgtaacgcgtgcgggccgatagggttccatggctagcacttaagcaaaataagtgctcagctcgcgaaatagtggcacgttgaacataagtagaagcactagcaagtcaggtataccattaagatgatatatcgtacgctagttgctccctatgtaaaaacatagcggaaaaaatatggttccctatagtttttttatctgtagagaacaaagggtagagggcccaccacactcttaccatcgtctaccagcatgcagaaaacaacataggcagtgccataaaagttgtatgggacaaactctcatttgcttcctaaatttttttgctttgacccaattttgtttttttttcgccatctctcatctctaatatccccttttcttatgctccttccatcccaaaatatatatacaacttctagagttcaaattttgtcccaaataaaacaacctaatacttgtaaaagatgatttttacaactaaactacctatactaccccttaacttcattatcacctgaaagtctaggtccacaactcacccaccttgaggannnnnnnnnnnnnnnnnnnnnnnnnnnnnnnnnnnnnnnnnnnnnnnnnn

SEQ ID NO: 7667 - DNA, 14917 bp, Oryza sativa
aaaattttcatcccaattaaaaccctgctctaaaggtgcaatcctcatcgaacctaagactagcatcaggttacttgtgctaggcaggtaggtaacttgtcctcatgcgtcccactattcctagaggttctcagttaagtagatcgaggaggaggtagatgtagtaaagaggtggtggccttggcgtgttatctaagagtgatgtatgatcgtgtgtcatttacatcttaaaattgtagccttaaaaatacaaatcttaaggggctgtgtgttgtttagttgcctgaaaacaagaaaaaattagtaaaactttgaatagccacaatatatcgttttaagattcgtgcaattccctaaccctaccatttcttatcttcttccttacattctcgacacaattcctctttatccctcccgatcccccaacccaacacacacctcctcttccaccatgccatatgtacagaaattgttctactcctaaccagatagagcatggctattgatttcactagagaggcgtagatgagctttagtgtgccccacccttctttgtgccatcgcccccaccatgctctttcttcattttcccaaagagatacccggctcgccccaccttgcctgtcggattatccaccaactcctagttgatcacctcacccctgccaacaactgaccctctccttgcctgtggctccaacgccatcactgtcaccttgtaccatataccttcaccatcgagctgccacctccacagccatccctctaagcactacaatggtgctagctttccttgacgaggcattttcatcaagaagtagcgcaatccacacgcacatatgctggagagagacgttgatggatctattaaaggggatgggtggatttgggggtttgcgggtgaaagggcatacatacacacgctgatttagaaaacgaatgccggacaaatgcatacggtccatgtaaacactggaaaaatgcacatgttttctcttacttacacgtggggctttcttgaaactatatattattgattagttatatgatgaaaatacttgtacacctatgctagtacagttgttacgactaattaggcctagattatatatgacgaatttttccatacaatcccatacttacaaatgggaccaactttgttgtgggctcatgaggaccctgcctaccaagttatacaacaaaattcttcgtcaccgtgtgatagcccaactattaatgacaaaatccacggcgtttgtgatgagcccgtttgtcgccgtgaacatatattatgaccaaggcctccagttattgctaggattggttgagggtgaagtttacgatgactgtttaacgaatttgtcatagatcaatgacgtacggattccctattcgtcacacggaatgcgtagaaagcctatatctattttattgaagccctgggaagcccccgccttccattccccccaacccctctctcaccccacccaaccttgggacttataattggtctgtgctgccatctttaggcattgccggagagaagagatgcttgctagaggaaataaaatagctgctcgtggagaagaagaggtgcatgaatttccatgttcatctaactattaaactatacattggaattttcgaggaatattttaggtgatagaaaattaatccccaaatactaaacccttagaatacattaattttcacataatacattacttttctgtaagataagatcggaagtgagatatcatggggtactcaatttgggcacatgaataacaaaaggatggaaacaactgatgattgcgttagggtggaccgccccagccggtgtgttatgattgcagtggtagtggaagttgctatccacgtatataatcccgcggcttcaatttcaattatattcgttctgttgattaacagtgaaggtatctgctgagtttaagcaatgtagcaatctactatctacctagctaggtgtactaacaaactgtgttttgtatctatcaactaaaaacaacacatgcagaaacaagtgatacgtacgccatgatcaatataatgttacattatatttaaacaatgataaaatatatatatatacaaattaattgatcaatactatatatactgcagagaggtggtgtacacattaagcagacaacgatatatgtatacatatatatgatgtatatagtgatagtgcatatatatgtgtatatatagcacctaattaaatgctagctaacttaatcatcatcagttacaaacctctctcagcaatgaggtcaaaagacgaacaaccgatagatacacacactgacactagtagctaattaattaagaatgaactaacaaccgtgtactgacataagctagatagtaagcatgcagatggcctgatgatggccagtggtcaaattaatgtatacatcatggagacggagtaatcaactaattaatagtacactcgatcgtttaattgtgcgtatttgtaagaattcatgcatatatatgatgaatgaattgtcaattgataataatcgatctggatcgatcgatcagtctcggtcatcgatgaagcctgacgaagaaatgttgttgctgttcttggagctagaagcggaaggcaggtggtggaagagctgatgcgccggcggcggcagcaagctggtgagcaggttccagtcgacgatgccggcttgctgatcgacgtcgacgcagctgctagcctgcgagacgtagccctcgccgtcgacgatggtggggctctccagaggcggcatcatgtcggagaagtgaagcttggactctgaactcagaatgttgctgtggtcgacgacgctgttattgttgttgttggcgaagagagctgaggcagcggcgctcatcaatggccgcccggcgaagctagggttgtcgtggtgcagcagcaagctgtagttgtcggggacggcggcgtaggctccggcgccgtagctgccggggatgcagccgtaggacagcctgtgctgctgctggttgggcatcggcttctgaaacgcgcggcaaaccacccaaccttcctcctgcatccatattccatattaatatccatgaattaacatatatagtaggacagataattaagtaaagaagtaaaaaattaagatggaatggaataggtggttgcaatgcatgcctgagtaggggcgtgttcgtttgattggaggcggtactcgtggatgatccagtcggtcttccggccgttgggggcgcgacccttgtagaacaccagcgtcttcctcatcccgatcaccctcgtcgacggcgacgagagcaccggcttgtcgcggccggtggccttccagaagcccgccgccgtggcgcggttggtcctcgtcccgctggggtacttgcggtccttgtagctgaagaagtaccactccgtctgctcatcgccgccatgcccaccgtacttgcaacgctctgccacatatatataattcatcagaatcatcgatcgttcagttcccaaattaattgctgaattgatattaattatgcatgaatagaatgcatggtttatttaatgtaatggatcagtacgtaccttgcagatcccatggctcgatcctgtagagatcgagctcctggatgatgtcgagatcgatcttctgggaggccaccttcctggcgaggtagtagcccaccagctcctcctccgtcgggtgaaacctgaaccccggcggcacacatggagactctcctgcctcctcctcatgccgatccattgctatttcctccgatcgaccgatcaattcttctagctagctagctaggagtatcgtgatctttgctgtatatatatctagctgatggatggttggaatttgattgcctggtgactctctatgcctcgatcgattggctgcagatcaaaacaagcatatgcagaaaaagctatatcatcatcagctatatatatgtcttcttcagatcgatgctcatcaattttcagcccaatctcagattctcatgagtgtatagtagctatagcctatagctagagcaatgaactgcatgcaagtgcaagtgcaagcgcatctggatgggtccaaggctggaaaagctcctagaaataggacagacacggccactcatgcaatggaacatgacctaatcagccagccagtagttgcaccatacctatacaacctagtcgtacatacatactagtaagtatacctttaaaccaatcaatattctgaagctagctaggtcgaccggggagactagcttcatgcatcagatgaatattagaactaattaagaacacggacagtcagcagctagcaagctgtacacacacgcctgtacctactaattaattagtactagcagtttgattagggacaggcaggcatgcatggactatagcatatatatgcagctgaaactaagggtaccttccttaagctagctgctcagcttgtaacacaccaaagttgggcttctgctgcatgcatgctagctaggagagatgagaactggaaagtagtagtactggcttgtggacagtatgagaggctttttggagggtagagagagatctacaataataataatgtgtgcaatatttgtcttcctagcttggagtgcacttcagggctcatatccaccatccatacaaccctctctcttaccatacagccatatagtactagtactagctcctcctttcccaatcttacctaaagcctgctgcttgttgagctcctggtcacatcttcaatatttctccacacaaaaattatatgcgaatctaacataatactgcatgcgcaggtatgtaacaacgactcgtgcatatataggtacgacataccaacaaatttaattaagatcatgcatgcaagaaatatgtactcgatccttagtttaattggcatatatatatgacgaagtgcgcgtgcactcacctaattagataaccatatgcatgaagtacagcgctacagcagcagccagaaggagatcttctcccaagtcgatcccaactataatgaacactgtatatattatatatggtggctgtgtagctagctatagatgagatgagatcaaaagatggatcgatgatggcaaggaatttagttggtatctaagctaagggagctttgtgagctatttatacatgagaaaaagcgagcttatgagtgcctgggctgtgcaaagatgaggatatgcatggtacatcatcgctcgatcgagtagcgctatagtcatgcttaattgaattaagtgcgcgtggagtggagatcttcagcgcgtgtagaatctagaccgagaaagagacaccactatactgtgtactacagcatgcattcagagagagagagagagagagaattaagcatgcagcattgcagcagctagctagctatagctaacttgtttggtcggttaacaagtcaccaagcgaccaccaccactcagtacatgaaagcgactctcaatttgttcccagcagcgcctgctcagacttgagtacaaacaaactctcatcagctaattaaactagcttaattagctagctagctagctaactacacatccatcgatatgatatgatagctagatcgatcccgatcatattcttccgcgtttataatttgtcctattgaattgaaggaaaaaaccactagagatattattaagcagacaataacatgcgcaaaaccgttgctttctatatatctcccccgacccggccatttaattaattcctacatatctcacttagtgtatcctaatagacttatatcttagttctcttagtgtgtatacatattttttcccaaagaaagattaatatatagttagttagtttaatcaacaactgtgctatatataaaactagtgcatgctctatcagattgcatcaggagaccctagctagtaagatatatatagtaaaaaacaaataagattgcctgataagaaaggaaggaagggatgatacatgcattgtatggccaaagttgtctaccatatccatttttccgccgttatattgagcttcaagggtagcttttgctacttagaacagacgctagctcgatctagctaggttgttcttcctgtacagtatacatatataattaatcattgatttgttttgacagggaagggcatgatcatatgtgtgcgtgtggagcccacaaatcatacgctagctagctaggtatggtacgatgtatcgatcgagcaataatactggcctgcagctactacatataatatgaatgatcgatatatatcatcctatatcttggccgggatcgagggaagcacactacataaaatacatatatacgcatcattgcttgtgttgcatgcttgcattgctattctcgtctctggccggccatgacaataatatttgtatttacactaacactagtgctttgttctagcttatttaagtttggtggttgtcactgtctggcttggtgaatgcacgtaatgtctggctccacactcaaatgatcagataaagacggctctagattcacgagatctctacatgatgtatcaaattcatggtaattaataatcaagtcatataacccatatttggaagctaggagttctctagaccgacctgctgcaccgtaattaaatggtaattaattaatcaataactaaaagagatcaagctaagtgtgttcatatatatataaatcaaacttatcgtgtcctctatagatcatagtagccaacctgcccccactaacaataaccaaccaatcaacagtagctatatagcttcatcagtattatattttcctatagtttcttttttgcttctgttccaaggtttagtgtggatagagttgatgtacaatagctagtaccgattgacccttcttaccatcagttcgatctgatcacattatgctagagtactatatatatattccatatccattaattgctggaggtaagttaataatttcatatatattccatacccctcgctcttggtagcatttgtttgcagacagattaaacatgtaaagtacaaggaatgcatcatccatgatatatatgcagaattgtcactactatatacaaacatttatttgatagtgtaattaaaagaagagaaagagtaatatgtactggtgattaaatgttactacatattcacatttcatgtgcctttggcagctaatgataaacacatactaggatgagatatgaagtttcccagtatgtccagcagattcattttacaaggaaatgttacatcctgtcctatgttgattttttatgggacggtaggagttgtataatatagtttgtttttcttgtaagattgttatgtatgataagcgtgtgcacattttatcaagatcaatatcgctcattcagtcacaagtccaaaaaagaacaccatagaagtagagtcaatctattatattattaaaatagccttgaaagaaggcatgacgttcgctgtggaggttacaaattcccacattaatcggagaaaaagaaaaaaagaagagttcaagtagaatataatttagaaatatctgaaattcggaattaaatataagaaaaattggaagaagagtccttatataactgaatacgagattaattaaaatttggaattaaaaataaaataaattctgaaattagaaaagaaaaaaagatttcaagtaggaataaaagttagaaatatcttaaattcagaattaaaaataattaatatctgaagaagagtcttatagaactgaataagagaataattaaaattcagaataaaaatagaaaaataattataagagttcaagtaggaatacactttataaataaaaaaaatcagaataaaaaaatatggaatttttagaaaaaaataatcaacctagaactcaacgacgacaaataacaatagcaaggggacaagtaataggcctgtaaaacaataaggtagtgaatggttgatgggacatctaaaaattataaacaaaaccataaatagaaccccaaggacgattaagaagtggaatgatagacaagacgttaagcagcatagtcatgacggttggcgggacttctataaagtaaaaaaaataaatcgaaataacaatcatgttttacttttaaaatctcaatgataataaacaggggagacaacgagcaggccatacaggagtatagtggtgtggagccggcaacggttggcggtacttctagaaatttaaaaatgaatccttaaaatttgaaataaaaaataaaataaattttgaaaatagaaaaataattctaagatttcaagtaggaatacactttacagataagaaaatatcggaatgaaaaatatggaattttcagaaaaaaaaatagtccatctcgaactcaacgatgacagataacaataaaaaggggagaaacattaggcccgtaaaggagtaagttggtggcagttgatgcgacgtctaaaaactataaataaaaccacaaatataatcccaatgatgattaagaggagggacgatagacaagccgttaagtagcacgatcacgatggttgatgggacttctagaaagtaaaatccaatgacaatcatgttcaatttttaaaatctcaatgataataaaaatacatgagtatagtatggcggagctggcggcggttgggcggatttctagaaagtaaaaaatgaaccccaacgatagttatattcaatttttaaaatcccaataacaataaatatgggagacaacaggcggatcatagagaaatacaatattgacggttgacaacactcctaaaaattataataacagaacatgacgagacaatggactctaaaaactagaagatgtttttttaaggtttaaaggaaggtaaataaaagccgtgatagatcgggtaaacaaataaaggagttataaaagagtaagagttaaatactataaaaatttaaggatgataaggttcgatcttttaaggttataagtcaacataatggccactcactccgtttcacaatataagtcattctagtatttcccacattcatattgatgttattgaatctggacatatatactccctccgtactcataaaggaaagtcgttttgtacagcgacacggtctccaaaacacaactttgacttattgtctctataaaaatatttattgtaaagtgatatatgtatacttttatgaaagtacttttcaagacaaatctattcatataatttttacattttcaaactcaacaactcgagagttattcatgatttatatttctaaggtttgacttaaatattgtcctaaacgacttcctttacaaatacggagggagtatctatctagattcattaacattaatatgaatgtgggaaatactagaatgacctacattgtgaaagggaggaagtatttaaaaaaagtaagtaatttcaaatatagaaaaatggataattttatatgtgtgctagccgcgttgcacgggtcacccagctagttctacatataaaagaggggggtggggagggggatcgtcaattccctaggagctcgggcttcaactatacatacatgtactgtatttttgtgatatttagctttaaatctgtagttttgtgataaatttattgttaaatttatagttttatgataatttgctcaaagtacatgtaagttttgtaaaatttactcattaattaattatgtgcagtttaataattagtaaaggtttcttgtaggactgtactgtgtatggtaagcgtgtgcatgctttgtcaagatcaatatcgcaaagagagatcatgttgaacacgccacagatctatcgatcgatgatctagacgaacgtacacatatcgatccatcgaatatatgagacgtctagcttggatcgagatggtgatttaatttgatcgttcgatcgcgatggatttacgcgtcatccatggactagtagctagcgatccaacatcgatttgtctcatttttacactggatctgatcaatcaatctctcctatacagtgtcatcagaagctctagctcagacacagggcgctagctagtagtagaccaattattgattaatcgatcaatacccgcgctccattccaattctcagatatcatttataataaaaacgtacgggccgcagattatatttgttgaataattaaatttttgcagatctagtggaatttaaaatagttatgttttatatgcatctcttatttggttcttgtaaaattttaattgtatccaatgtgtaattatatcaaccaatctaattattataaatattagttgaacaatcgcattacgatgtttatatttctatattttcctacttttgtaaaaaaatattttttgagataaatatttcgagcgtatgtacgtacgtacgtcgtcgctgtctcatcacatcacttggagtcttggatcgatcatgtgtatctggagaaaaagaagatcgagagagagagaagaaattcctagcctagctagatagctactacaggcagatcgaagcagactcttctccctaattggacctcacaaacgccggctgtcccctccactcggaatcaggcaactagcagtagtcaaactaaggtggtgtttggatccaatcatccctatcatatctgatgtttgaatattaatttgaagtattaaacataggctacttataaaactaattatataaatgagagctaattcgcgtgacaagttttttatgtctaattaatccataattagcacatgtttactgtagcatcacataggctaattatggaattaatgggtttattaatagtctacgtttaatacttctattagtatccaaatatccaatatgacatggactaaaaatttttagtcccatccaaacagcccctaatactacatgctgcaaaggaaggctacataaagctatcgctaacaaatactctatccgtcgcaaaatataagtatttttggatcttgacgtacacggtctccgagatgctactttgaccaacaatatttataaaagaatgatgttttaaataaaaatggttgtatattatgatagtttgtttaatgataaatatagtaaaatcaattttacatgattgatatttttttatttttttctattaatggtcaaagttaaaatgtttgacttgtcactatgttaaaattgtttatattttagaacggagggagtactagtttgtttaaaagaaaacaaatggcattagtactttgatacggcagctatacttctatcatatccattgcaagtaaagtacaataataaacgggctctaaaaattgccactcaataaatatttatatttgtatggttactacattgattgaagatgatgtgtaattcttttgtgtgttcacgaaaaatagataacgtgttaattcttgagaaatgaatttgaaatatattcggagaaatggataatatatagtggagctaactatagctaaaaattaagataaacactttacaagtagaagggagtagtaattaaatattgacctgaccgatttttattttaagttgagggtgttagttttgtctgcgttagatcgaccgactccgagaggatttgtattgtgtccttttgttgtgcatcaaattaagggaaactaatacagtatgtcattcaaagaaagcaaagaaagtactatagtgctagtccttagcaagagtagtcaagagtcaagatggattctttgcgatcctcgttgcacgatgattaagcaaagttgcttttttttttgctggaaaagttgatgttgtgattgtgtaggtagaccttggctaatgaactggctatatatgttatgttatgtatgtgtcggattttggctgggacggtcggtaatttgcgtgacggatagaagcttctggagtaatttgactgaccgtcacattcacatcactactcacttaaaattaatttgtctttcggtcggcccagtggtagtggagtttgatcgtttccagcacctttctgtttccaatcctacagtatcgatcgtcaatctgccttcctttttctttactgaaaaggccaccaccttagctagctcgtacgagagaggagaaatatgagtttgatttggctcaaccggccggcacaagagccgatcatagtgtcctcttcttttcggcttacatattatgaattatatatcataggcacacgcttctaattaagcttctaatctgtagtaagagttaatccaaaatactttcttcatcagtatttcttacgagatatcttctgattttcaaaacatagtacatacagacatgaatgctcatataaacaagcgcacaatcaccatattactgagttgtgatccaaattcatttgcacataataaaggccagcttttgccagagcgaagcggaggcccgtcgccggaggcttaggtcggagcgttatccttttaaggtttcaccttcatatatacctcttgtaagccatcgttcgccgttgtaaccttaccccgatatagtgaagatattttgctgactggcgcccatggtttttctctcttgttttgggagttttctacattaaatctcgtgtcttatgtgattgatctattgttctttgtcgtttatttgcctatcgtttcctaacactgatgagcatacatgtcttattcttgataggtacgtcgcctaccactataagaaaatagccataaatacgagcgcatatattaaatctagaacttgaatctgagtggacagattcttctaaagaaaaataaccggttgaactatgcttactctatcttcttagaggactttttatgtcaatatttctactttttagttttaattcatcagtttatgtccttgaataattatcataaacttatttccatccttcatccacattaccatatcaaacacattaccataactctcacgcaagtaaggtgaaacaaggacatttttgcaattttttagtggcagtcttgtaataacgattcagagtagtagtaaatttgtaattgcccaaaaaaaactacatacctaagctaagaatgcgaatgctctccatctttgtttggtattcacctccggtcgctccaccttaggaggggaagaaggaggggagggttggcgccggtggagaagggggagggccggtgccggagtggggcacaagtggtcgtagctggcaccgatatgcatcaagcgttgggaggagatcagaactcaggagaataggaagaggaatagttcagtgctaggtagggtggaatttttatggagaaccctcgtaatttttatggaatttttacaatgatatccttataagaggaatttctcttattctcattgtatttcgtgaaaatacgagggctttttaggaaaaataaaacgagttgtcagctagtgcgagggcttgtttgagattatgtatacagatgaggagtttttgcaaaatagactgaacacgtgtcaaattctctgagaaaccaaaaatgagaaaattgggaaggaagaagtgttatgaccggaggattctcttccatttcaaatgtgaaccctcttttgtccttaattctctgttttcttcttcttcttcttctcaaatactccttaggactaggctgttgaatttatttctcctacatgggaatacaagtttatagcccaaattaaactccatgagcaaaagggcataggagcagcaaattattgtgtgattgtttcagcatgttaggtttagaatatgcagagttgcagaccgtatgatgtggcaaatcctctcttagccaatgttattgttttttaggatcttgttatgctttacggtccacacaaataactttgcatttattttcagtttccacctttcattgaaaagggcataaacacggccgtcgtatcaaatcacttttactaccgccccaaccactatcacggcctcctaatgataataaaaccaggaatcgtaacttattccaaccatctacatatttgaaaaacgaaagccttttggatgctaatgaggaaataaagtgagaggaaatgtgctggaaaattgcttcaggaactcaaaagtgacccgtattcataatcacactcagagaagacacaggtgttaaatcaaaatgagttattgaataagtattacaattgcaaaataccctgtcattcatggagccagattctcaatggaaaaaggatttgccctattacacatatttcagcaaatacagtaactcgactcctgccttcgcatgaaaaacaagaatgcgtgggaatacacaagctacaggcaaaagagtcaagctctgggcctctggccatgatttcttcaaatgtgaaatgatccctaaataaacactgtttttgtgaacgactgctacatgtctacacatggtaagttcacacaaaaaaattccttcggttagatcaacagtccaagggaagcaacttgtctgctggccaccaaacagcgtagtttcagcttttcaggtagcttaagatcaatcctgcttgttacgaacctcacgagcacggtgcctaagctccgcccttttccatcttaccatcagcaggcagagtgtgacaagagtgttcacctacagaaacaagacaagaaacagttgcccacaatgcacgggatggaagacagaaatgatcaactggatgagacatgcacttaccaaaataaggatcgttatcaaaaggaggggcccagaccagacaactgaaatgaacagaccttggggatcaaaataattctggcttgagaagctcttccagtgttgccctaaaaatgtatttattctctcagcgagaaatacaccagaaactgcaccaaaccaacaagagcaggt

SEQ ID NO: 7668 - DNA, 4336 bp, Oryza sativa
cttagtggcagtcttgtaataacgattcagagtagtagtaaatttgtaattgcccaaaaaaaactacatacctaagctaagaatgcgaatgctctccatctttgtttggtattcacctccggtcgctccaccttaggaggggaagaaggaggggagggttggcgccggtggagaagggggagggccggtgccggagtggggcacaagtggtcgtagctggcaccgatatgcatcaagcgttgggaggagatcagaactcaagagaataggaagaggaatagttcagtgctaggtagggtggaatttttatggagaaccctcgtaatttttatggaatttttacaatgatatccttataagaggaatttctcttattctcattgtatttcgtgaaaatacgagggctttttaggaaaaataaaacgagttgtcagctagtgcgagggcttgtttgagattatgtatacagatgaggagtttttgcaaaatagactgaacacgtgtcaaattctctgagaaaccaaaaatgagaaaattgggaaggaagaagtgttatgaccggaggattctcttccatttcaaatgtgaaccctcttttgtccttaattctctgtttcttcttcttcttcttctcaaatactccttaggactaggctgttgaatttatttctcctacatgggaatacaagtttatagcccaaattaaactccatgagcaaaagggcataggagcagcaaattattgtgtgattgtttcagcatgttaggtttagaatatgcagagttgcagaccgtatgatgtggcaaatcctctcttagccaatgttattgttttttaggatcttgttatgctttacggtccacacaaataactttgcatttattttcagtttccacctttcattgaaaagggcataaacacggccgtcgtatcaaatcacttttactaccgccccaaccactatcacggcctcctaatgataataaaaccaggaatcgtaacttattccaaccatctacatatttgaaaaacgaaagccttttggatgctaatgaggaaataaagtgagaggaaatgtgctggaaaattgcttcaggaactcaaaagtgacccgtattcataatcacactcagagaagacacaggtgttaaatcaaaatgagttattgaataagtattacaattgcaaaataccctgtcattcatggagccagattctcaatggaaaaaggatttgccctattacacatatttcagcaaatacagtaactcgactcctgccttcgcatgaaaaacaagaatgcgtgggaatacacaagctacaggcaaaagagtcaagctctgggcctctggccatgatttcttcaaatgtgaaatgatccctaaataaacactgtttttgtgaacgactgctacatgtctacacatggtaagttcacacaaaaaaattccttcggttagatcaacagtccaagggaagcaacttgtctgctggccaccaaacagcgtagtttcagcttttcaggtagcttaagatcaatcctgcttgttacgaacctcacgagcacggtgcctaagctccgcccttttccatcttaccatcagcaggcagagtgtgacaagagtgttcacctacagaaacaagacaagaaacagttgcccacaatgcacgggatggaagacagaaatgatcaactggatgagacatgcacttaccaaaataaggatcgttatcaaaaggaggggcccagaccagacaactgaaatgaacagaccttggggatcaaaataattctggcttgagaagctcttccagtgttgccctaagaatgtatttattctctcagcgagaaatacaccagaaactgcaccaaaccaacaagagcaggtaaataaaatagtaagctagcataccagaaataaattcattctttaaaattgatgaaacgtacaaaataacatgtgtcagaatatgaaagagaattttcactaatgctccgctatcgtcttgcaaactagggttgagatattcatcctaacatatagttaattcatgctgaagatagctgaaacaagagcaatgcatgcccttcacatctactgcatggaacaagaatctggaaaggtttacagtgcattaattgacataattcgccagtaacttgttcaatattcctaccaatgtataactcagaaggttctaccactaaagaaacttacattaaatttaagcaagtaggtagaactccacacaaatatgttgttttttttatggttttagggaacctctatccacatttgagggaaaacgttaagttagaaagcacataaaaacaagacaattatggttggtagagtataacatttaatatgataccagcagaatataggaaaaaaggataatagtatttatgtgaatataagcattcaataaacattataaaattgcaggagaaccatgcaggacaatatcagcaaccaagacaaatcaaaacttacatgttaaagctgacaagataagttggaagttgacatttctccttgagatgattgttaccagcagcagaatggcatgaaaaattaacatgctgatcaaccaaggttcctgatgaagggaataataaagattatagcacagacataaaaattgatacgatgagatattgcatttactaaatgtttgctaggttgacgaaacagacaattaaacgtgaaggcaaattagatgtagcaaaatatggatatccactacccaaagtattcgggtcaccactgaattttgtttgtctttaataccacggatagtgtgcagttggttattcattttacaattccaactacctatattagctttcatttagtattccttgttttgagaaaaggaaggaactagaaattcaaggtgtatggttgactgggtcaaggaggctttccccagcaacatggtacacggatggcctgtcggcatagatggagcaacatagcatgacagtgcaaagcatgcgaaaactcaggtatggtatcacgtcccgatagaagattagacatgttcctttattttataatttccctgagatgttagagctgttgcgttgtgtttatgataatggaaagggagagggctacctctttgcttgtgaagaaaacaaaatagattagatatgtcattccgtaagcatggtatgactacacagtacagtacacttgtaaaaaacccaaagctcattagttttctccatctatcgatggtttcatgtacataggaaagacaggcactcaatattgttgattggggcaaagaattatcgccatagaaattatatagttagatccgtcacaagaagcatgcatcatctttttttgtgggattttggatgaatagcaagcatcacaaggtgggtgtcgtcattcatttgctaaactagcactactccctttgataagccctcaactatatactgtatcaggtagccctattgcttttcacttgtcttgtctaatctatcatactgatattgatgcgcgcgaggcaggggaacgaattttcttacattatttaattacttgatgattgaggagcaaaaggttgaagtgggaagttagatcccaggtagatccagggcagatggggggcaagaaggctataagaaagaaaccgaccttccagtcgacggcgtggaagaagccgaggaaggagtcgagggcggggcggaatccggagcggaggtcggaggagacgcgcccaaagagctccgccaccacgtcggcgtgctcgttcagcgcctcccgcacctcacccaccgggcgccccaccatctccgccgccgacgccgacgacgccgcgtcgcccatctctccggcgagtccaaggaagactcgagagagaggcgagtgagatcgatccaaggttgcggagaagacgagatgagagaaaataattaattaaataaataaaagccccctcttctgctgatcggggcccacacgtcagccacctatatacagtatatgttctcgaaaattctctctctacaactctcgagtagtgattatatcacagtttctcaccatcttccgcgtgtcttccacttccagatgttgctatgttaacgtgagcaaacaatctattcttagcttaataagagcgactagactagcaggctacaaatcggctataagcacacgtaaaaagaagaagagagaaggaaaacgggctacaaatttatagccagttacagcacagactctaatatattatatgtgtatgagaggtgggaccatatattaatggtatagtatatgcttgtagctaactattgtatgaatgaatgagcta

SEQ ID NO: 7669 - DNA, 1158 bp, Oryza sativa
aaaaaaaagacaccctggtttccgtgcccaatatttaaccgttcgttttatttaaaaaaattataaaaaaaattaaaaagacaagtcacgtataaaatattaattatgttttatcatctaacaacaatgaaaatacgaattataaaaaaatttcatataagacggactattaaagttggatacggaaacccagggtttgtctttttttgagacggagggagtatatcacatgataaatatgctgcaaataaaatactagtagtacgtttttaagggaaaatatactgcgtatttcctgaacaccacatactgcaactactactactttcttttatttatagctacttatattattccaattccgaacagtgatacccattaggagcatagcgaaatcacctgatattccaaatttcccagagtcagtactacgtggcaaatttttaaaacacaaatgaataattgattttttgtatttcagagaataacacaggaggttccaaaaattgtagagggattgagatagatgatgacagagagggtcggacaataaatctgatgcagatggatggaatcaactcaagactgagggaggccaatttgagcttccatttcgcatctctctcagcctcaccgtcgtcgcctcccttaatctctcatgcttatgctcatggcagccgacgtctccatccccacgccgcctctctgctctctgctctccctccacacctactgattcttcttccccttcccttctccgctttccctgccttgcaaatccgccaaaggttcgccctttttcctcttccaccggttgcgttttttttttcttttttttttgggggtggaacgtcccgcgagtgttgggattgggccttcctcgttgcctcatcttgatctgatatggtgatattctcttattggaacgggttagggctcatcttagtgttcctcttgcgtgattccgagctaaaggtgccgtctttcctcccaaaccaccaccattcatttagtgttccggtggtgatccagtgcaacaaattgggtagtaattttgttggtttttggagattgctcaattttggggcaaaatttgagaagaggatggttaagttctcgtcagagcctcatcaggggtaaaaatatcttgctcctcct

SEQ ID NO: 7670 - DNA, 886 bp, Oryza sativa
  unsure (1)..(886): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcatgagaagcttgatgtgcaaagcgcacattgaaaatatgtagatgcacaggatggctgctgaagatacaaaacagaagaagtagcgataattgcgctgcaaaggggaaataaaagcatattaactgagatggtttcatatgaacagctgtcagggtgtagaaactaaagccacccatagctggattattttattttgaaaagaaattaaacataacagacctgtccaatgcactgcccaacccaaggacagtggtgatcaaagcgctcgacacagttatcacatttggaacagtgagagcagcgcggaggtcgatatatcatgcaagtgtcacagtattttactttcacgggtacaccattgaccaaaatctccttgacccgtggaaactgaagagtgtgtggagctgaagcatcatgagaaaactcttccacaggtggatgtgagttccgtggtacaatacctggatcttgagatgaggtcaagaagagcagtaacagtacctaacaatcaggttttgcagagaaggatcctatgattttggcggtgtctgtaaaaagtactgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 7671 - DNA, 599 bp, Oryza sativa
ggctaaaatcatgtggtaatttcgtggaactcaaaccataaaacctggggttttctttttttttaaaaaaaaaagaggtagtagtgaggcatatacacaggcgcacgtacgtacctgacgatggaggaggaggaagaagaagggatagtgaggagaaagcgggcatggacgacggggcgattggcggggtcggcgcagtcggcgaggagctggaggtggatcagcacctcctccgccttgccgccgcacatgtccaccaaatacctcgccggcatccgcctaaagtggagacggagctggcgttggagctgatgatcatgctgctgcaggaggcctccactctccgccagccgttcgaatatcctctctgccgccgccgccgcctcctcctccgtcaccggcgccattaattgctatatatgctacctggtacgtgtgcttctcttctctcgcgtgggctctcctcccggccggaggccatcaattgtggctcattcttcatatttatttactctctttctactcctaagtactaagtaattaagaggagtcttaatggttaagtatatattaaccgcctccattgatcgatccatcga

SEQ ID NO: 7672 - DNA, 404 bp, Oryza sativa
aaccaacagggcgaggatgatatacctgaggctaaggagaggcctttggttctacgaaacaaagtgccaagatggcatgagcagctgcaatgttggtgcctcaacttccgtggccgggtaactgtggcttctgtcaagaatttccagctgatagctgctgcgtcctctgaatcttcacagttggagcagcagcagcagcagcagcagcaaaaccatgcttcgagttcttcttcggcatccgatcatggcaaggtgatcctgcagtttggtaaggttggcaaggacatgttcaccatggactaccggtaccctctctcagcattccaggctttcgccatctgtttgaccagctttcacaccaaactggcttgggaataacatacatcagtactataagtgggttt

SEQ ID NO: 7673 - DNA, 543 bp, Oryza sativa
  unsure (1)..(543): unsure at all n locations
nnnnnnnnnnnnnnnnnnnnnnnnnnnnnnnnnnnnnnnnnnnnnnnnnnnnnnnntcaggtataatgtatcaggaacaagacgatattcttcagcgacctgcacaaaggaaaagcacaaatacagtggtaagtaacgagtgtggtctttaggctccaatcaactaaaaaaatgtttggtataaaagcttacttccacaagccagtctatcaggatcgctctcatgcttgggtttacatccttttggattgtttccataaaatcagttgatggacgtttcctggtctgcttcaagtcaaatagaaaatcacaatgtaaatatgaaattcaacctagatttgaaaccactgtgctcaggccagattaattatcatttggtcaaactgactgcagtagtgcagtccatgtcacagaaaaaataatgagtaactgaaaaatacttcaagagcattgattacaacaattgaagtcatgtatcaattcatcggttcagtcaatgctttaagtggattactccattacaatttctccatattatactgt

SEQ ID NO: 7674 - DNA, 377 bp, Oryza sativa
gtaaaggcattatctagaaaattgccacacatatagattgttgttctgccggccaataaattaatttgaccatggtatatgtataaaatctagtaacaaaagtgtatttctcaaatatcaatattacacatatatatcccatatttatgtatcaaacgtttatacataaataaagtccaccaatattcttttaggaaaacatcaacgcgtcatatagaaaaaaaaatcaaagcttgaacattggacttcaaagctactggacctaagtaatgacatcaccttgatatatatatatatatatatatatatatatatatatatatatatatatatatatatatatatatatatatatatatatatatatatacatatat

SEQ ID NO: 7675 - DNA, 900 bp, Oryza sativa
cccccccccccccaacacgaaaacccccaattcctgaccccgcccaaacccccctaaacgcgatgcacctcgatcgcagattttgacaccgcacaccgcactcgccaccaagcaacgccaagatcaaactcggggaaagcgaaatttattattacggggacgagacggaacaggccgccggggtggtcacgactcacgacctggcaccgctgccgcttctgctgctgctgggtggaggatccccacgccgccacgtccgccgctcggcacgacgccgacgacgacgacgacgagctcccctgccccacgccgacgtacctacaccacattacaaaataaataaataaaaataaaaataagtcccaaaacaacgccgggaagaggagaaccgccgtccggtcggtcggccggcggcgacgagggggccgactcacccgaagtccatggccgtcgccgccgccgccgacgccgacggaggaggaggacgccgctcgcgctggttggagtgcgggtgcggccgaggcggaaaaaccgcgtgcgcgtagtgattttatgcgatccggggttcgcaccccgcggcggcggcggctgaccagtgggcccagagacgcggtggggcccactcgtcagcggaggggattcggcgagggcgactccggttcgacggggtcaggtgtaactcggggagggagggaagggaagcgaggtggcgagttggagccggagtccacggtgtgggccagggctgtcagggaaacctggtcgcaggtgggccccccggatcctatgatcttctgtggcgtggtccccgctggggaaagaagtactggtgccgtttattcgacacgttggtttgagggtgagtaggaggagccgtacggtaggccaaacagcctggaa

SEQ ID NO: 7676 - DNA, 552 bp, Oryza sativa
accgttaagttggggccatggtacagtacactgtacactgatcagaacactatgtatacatgtcttcagtaagaccctgtttagatgagactaaaacttttaagttcctatcacatcggatgtttggacactaattataaatattaaacgtagactattaataaaacatatccataatcttggactaattcgcgagacgaatctattgagcctaattaatctatgattagcctatgtgatactacagtaaacattctctaattatggattaattaggcttaaaaattgtctcacaaattagcttttatttatgtaattattttttaagtagtctatatttaatactctaaattagtgtctaaatatagagactaaagtaaagtccccggatccaaacaccacctaagcgagtcttaataggaagaagaagaagaaaggaagtaacagattaaacatgcgcactgtgcaggtagccgacacaattatattatgcattggcgtcatggcggagcagagaagcaaccctaaagttttggattatgtcctcgttcc

SEQ ID NO: 7677 - DNA, 873 bp, Oryza sativa
  unsure (1)..(873): unsure at all n locations
ctaggcctacaacatgtcgagttagaagtcctcttcatcgtccagatctggatcatttgatggccgtattctcttgccgtctctccctccagggcgacctcctttctttggttttcctctgtccaaacacacgaggggtcagaactaggcaattcaactaaaagggttgttcctagaaacactggtatttttaatataaagaagtgttagacaaacactgcccctggcaagaatgtatgtaaagttgagaacgatagcacattttttgccgcaaaagtaatctgagcacttactgcccgtttgcaggagtggttgcgcctttcgaacgacctgatccatattctcttccatctgccaggatgcagctggtattgagcccagagtctcaattgttcctggtttcagcttaatgaaaacaagaaagagaacttaccatctcgtccagccatatgttcatcgacctggaatgaataaaaaataatggtatgtattagcaacctcacaaatatcggtatagcacagggggaataacaatcatcgatcaaagcaaaccaacagattaaaaaaacgggcactggcttttcagtggcattaggatttaggatcattagtcataccgctggagatgtaaccgatgacagggagaacagcctctcatcagcctggaacttcctggagcgcttgagactgaaattaataagacagaaactgtcataactaattctatgtgacctattagcagaacaggcatgataaaacatttgcttgtgcagaataatgaacacggaagattatgccaatggttatcataannnnnnnnnnnnnnnnnnnnnnnnnnnnnnnnnnnnnnnnnnnnnnnnnnnnnnnnnnnnn

SEQ ID NO: 7678 - DNA, 2371 bp, Oryza sativa
  unsure (1)..(2371): unsure at all n locations
nnnnnnnnnnnnnnnnnnnnnnnnnnnnnnnnnnnnnnnnnnnnnnnnnnnnnnncgaagtgctgcgagggggcaaagagaggagtgttaaagcggcttggaaacttgatttctgttctactttgtgatgttaaaaattggaagtagggttggtaacataatccagcaccaagctatagtcaaatcaaatcatgtgtgtttattcagcaaacttctccgtttcatcctccacctataatcattattttcaagaaaaaataacctttaaccctccatcaatctctatgttctgcgtgctaaccataatcagtactccctccgtctaaaaaaaatgcaacctaggataggaatataggatgtgacatattctaggacaatgaacctagatcctttcctaggttgccttttcttttgaacagagggagatcctttcctaggttgccttttcttttgaacagagggaatacttctatatggcaattgtggcaaagtactgccatgtcacaagcattgtttactggacagggtttccaggttgcattaaagtgacaaatatcctttcttttcagctttagagtctatgcaaaaattaacaaaaatattacctctggaggccgccgaagtgagtagagcatcgtcctgcatgagtgcagaaatgtgttgtcgttatactccatagcaatccgctctccagatacactattggcgtaggatgcatatcctggctcattgaagtagggcttctcattcaaaatgagagcttgaatggagacgagcacttgtagcatggtcgactgagatggattccacgtctcacaaccactacctgcccaggtaccaagaagactaaggcatacttttccattattgtataagtttgggttaatccgtagtccgccagagtggtagtatactgactgcaacatcatcaacaacaaatatttcaacaaaataaaaaggtgaaaatgtcataaaagcagtgctgagacttaggcacatactggaggattagcagggtaagagttactaaattgaatatcaaagaagaagagcccatcgtggtacggtgttcccttaggtccgataatagcagccctaagaaggtccattctatcttcagcaacacggacataaatagatgctacataaaacaaaaataatcaggattcagatttctacaatgagaaaatacactgcaacaaagaaagctatagtttgtccaatttcctctaaagtttttttcctgatatgttcaacatctatgagctatgaatggtgagtgacaggatgctaaatcctaacataagcatcattcactatttccaaactcactgcaggattcccaagaatttttacagacaaaaggcaggtgatcagcataatgtaaacaacatttggaaacaaacccaccacaggattcccaaagatattttacagacgaaaagcaggtgtaacataaacaacatttggaaacaaacttgagaactgatagtgttataagaaaaatcaaatctggtccttcttataaggtgcactttaacaaggctcaaagatgtaagttctaagattgagaaggaaaatagctttagtaccctcactagatagtagtaaaagataatggtctgtgcaggcagacataagttccacagtgagaataaaacaattagaggaaatgaaaggaaatagcatcacatctacatgaagccttatcaaaaggacaggatgaaatactagtttctcaaagggaaattcaggttacatatttaaaccatgaacagttgtgttcaacttacatggcacttacatgacgagcatatatagtcaataaaccaaatagtgtaagcagcataatcaatgcttgtgctggattattgaccagcaaactattagcactaattgcatcaaaatgcatggttagtgtgaaaggggtacttaacgatcaactcacaggtgcagccatgcagagaagaaactaactcactatgccagtaggcaaatagctaacctggtagatctttctccaaaagtttccagtcatgctgaatcctcttcacccagtctctctttgtctaatataatgtaaacatggaggaaaaatgaaataacagatctaaaacaagcataaaacaaaagcaaacaacaaattcaacatattaccacatcccctgatgttgctgcataatgatgatcagagaaatttttaacagtgtcaaactgtttgaacaactgagatttatttgcacttttatttgcgctttcatcttcaactgtcaatttggaactgctttgctcttcggtagttataattttctgaagccaaggtacagtaagcctcacgcctggaggccaatcccaatcatcaaatttatca

SEQ ID NO: 7679 - DNA, 1225 bp, Oryza sativa
  unsure (1)..(1225): unsure at all n locations
nnnnnnnnnnnnnnnnnnnnnnnnnnnnnnnnnnnnnnnnnnnnnnnnnnnnnnnaacagttgtgttcaacttacatggcacttacatgacgagcatatatagtcaataaaccaaatagtgtaagcagcataatcaatgcttgtgctggattattgaccagcaaactattagcactaattgcatcaaaatgcatggttagtgtgaaaggggtacttaacgatcaactcacaggtgcagccatgcagagaagaaactaactcactatgccagtaggcaaatagctaacctggtagatctttctccaaaagtttccagtcatgctgaatcctcttcacccagtctctctttgtctaatataatgtaaacatggaggaaaaatgaaataacagatctaaaacaagcataaaacaaaagcaaacaacaaattcaacatattaccacatcccctgatgttgctgcataatgatgatcagagaaatttttaacagtgtcaaactgtttgaacaactgagatttatttgcacttttatttgcgctttcatcttcaactgtcaatttggaactgctttgctcttcgttagttataattttctgaagccaaggtacagtagcctccacgcctggaggcaaatccaaatcatcaaatttatcagcaagacgttggttgaagtagtcaccgccatcaaattcataatcatatccatcgccatcatcataaatgcaatcgtcctcgtccagatagtaatcttcttcctcattttctccattatcaaaatctcgaggctctggttctgacatttgcaaagaattacttgtgctcaatccaacttggtcatcagaagaaccctgttgaataagtatgttattataggttaggctaaccagtacttgatgatgtaaaatgtattgactctccactactttcctagttatgacaagaaaagtcacaaaaaagtaagaccggctgattagaaatccggctgactctgcagcagacagatatctatgagactatgaagtgtgcaaataatttgtattttgggtgttttctccagccacttgttctgaagatgtgtcatccagtaggggtaaaagcttcaattgaggcaaaagatatagttttcacttaaacatggggcaaataatagatggcctactaattaactttggggaaaaagataaatttcttcaataaaatggttgtcagtcctcaaagagggaaga

SEQ ID NO: 7680 - DNA, 10180 bp, Oryza sativa
  unsure (1)..(10180): unsure at all n locations
aaataaaaattagtcccaaaccaacgccggaaagagaagacccaccgtccggtcggtcggccggcggtgtctagggggccgactcacccgaagtccatgtccgtcgccgccgcccccgacgccgacggagaaggagcacgccgctcgctctggttggagtgcgggtacgaccaaggcgaaaaaaccgcgtgcgcgtagtgattttatgcgatccggggttcgcaccccgcggcggcggcggctgaccagtgggcccagagacgcggtggggcccactcgtcagcggaggggattcggcgagggcgactccggttcgacggggtcaggtgtaactcgggaaggaaggtaagggaagcgaggtggcgagttggagccggagtccacggtgtgggccagggctgtcagggaaacctggtcgcaggtgggccccccggatcctatgatcttctgtggcgtggtccccgctggggaaagaagtactggtgccgtttattcgacacgttggtttgagggtgagtaggaggagccgtacggtaggccaaacagcctggaaaagttttgggagtagctatacaacaaagttttttttggatgaaaaacttttaggtgctgccgcaaccagcacaaacaatcaaagcttttgaaatgtaactattattatataattatagtacgtgttcgatcagtaactctcataaaaatgcaacggagcaactaattaatggaacaagtgtgtatactgcagggttcggttcgatccccatggcacgcttgcaaattttttccatcttcctccgccagcatgaatcttggtgaatcttagagccaaatcgaacgggttttgggttcgatccccatggtgtgcttgtaaactttttccatcttcctccaccggcacgaatcttggcaaatcttagagccggatcttcctccaccaatacgaatcttggcgaatctagagccagatcgaacagccaacaaattgaaagctgaaaattgtcgacaattaactagcaaaacccaaagtttttgttctcaattctcaaaacaagagaaaaaaggtttctcaattctcaaaacgagagaaaaaaatgttacacggtacaaacgcagacgtccatagtacatgtacacttatttttatgaacacacgcacaatttatccttatgaacatctacgaaaaactggaccaacatatcttgagattgatgaagttacctaacacattcttccgagaaatattaatcacaatgcaagaataaattccaattccttctaaatcgcaattaccttacaaccataagcatcattactacaaggttttaacaatgtggaactcagctacaagtctatttgtcagtaattttcttccaaagtttatctcactagatactagtgctgctaatacatactccctccgttttaaaatgtttgacaccgttgactttttagcacatgtttgaccgttcgtcttattcaaaaacttttgtaaaatatgtaaaattatatgcctacataaaaatatatttaacaatgaatcaaatgataagaaaagaattaataattacttaaatttttttaataaaacgaatggtcaaacatgtgcttaaaaaatcaacggcgtcaaacatttcgaaacagagggagtaattcataatctgcacaatgcagatagttcgtagatataatgtactcaacatgtgagcagtatggttcaagaggcatcattattcccgtatggcacctgttattaacgtagcaagctttacaattcccgtcaaaagaaccaaatatgctgttgtacagcagcaaaaacaaaatcccgcccgagaacaatctacaatgtccgactctttaaaagaaaaaaaaaaaggcaaggcatcaaaagaaactgagaagataagtacagcttatttcaacataaaaatcgacatttgtctagatacatgatacaacacaatcccccgtcgtgaattcttttctttctttcttgggtcatctgttgcagcacaacatgcaaaacctgtcctgagattgatccagctaatcgatggagtacgagtgaagtttgcgtgaagccaaacaaatgcattgttgctacattctgaacatacccatcgctctcgggttacttttttgaaccacgagctgctgcaagatgatcctgaaagaaaactaggactgttaacaccagaggatggtgcttcagatgtcaaaaactgaagtaacatcttatgcaactagcatagagccatagattcatactgcccacgcattatgacagttggtaatattggcacgtctatatatgaaatgaaataagaataaattagggacatgatgaaagcgcataccgaaacaaaatcaaaagctttagtttcatccttctttgagttgctcatcacagcaacatgttgaggttggttacttgaattgaagatatcaggaagcacagatgcatttccgctgttcattgcattcaaagacgaatgtcccaacccagcattgaaatttcctagattttgcagcagctgctgctgctgagcaagaagaacactcatagcaccatagtttaattgctgcccagcaaatgctggatttaacagcatctgtgatggcaagttgtactgcaagggaacctgctgttgctgataaaagctttggccaagaataccagtcattgctgcagaattagccacatttgttgtctgactgttcatgtcaaagagctgtgaaacattgacagtattgttagattctgttttaatcccaggctgagcttgggcagttccattaaggttcaaaccagccatcaaatcattcacggttcctttatcctctactctttcttggaagaatggctcanggctgctgccaaatatatctgacaattcatttttgtttattgatgagctatcatgcaaggctgctgttgccttttcttctaccgtcatccccgagaataggtcgttagtatccttagtatctgctgtctcatggaatgaaacgtctgcaaacggatcacctccattaccattactggtggtggtacttatatcagcaataggttcaccacccagcaaatcatcaaccgaagaagtaaacatgctattccccattatcctctcgctaccttcctgagctgaattttgagctcctgggtcatcttgatcccctgtatcaatcaaatcaggcatctgtgcagcaggtactgttgtctttgtttctgaaaaattattgcttccagtaggttgttccccaaccagcagatttaagacctaagaaaatggcacggtttattatatagtaataattggaggtggaaatagctatagcctagagagagatagaatcaaagagatgcaaagcatgtattctacatagcaatttgcagaaaataaatggtgcattatacaaatttatttattaatggcttgcaactttactgaccttcgaagccttttctctgagagaaacgtgcggaagctcacagcatctaacaacagatgcactgttctcacagaaatatgaagtaatgattgaataaggatcagtatcctgtttccttacaattgcttccaatacacaaattgccttcatgcgaacctgaagtagaacaaatgcattgaatatttatgaatatataaagtgaaaacaatggtggaagtgcttggtcaagataaaatggtattataaatatgatctaatcatgtatataaataatgtgagataatattgtatcaaaaatataagaaaaggtcagagaacatcatagataatgaatgcactaattctgaacatactccgtattgctaacccctagtagaaataaaccttattccaatgaaagttcatggggttataggtgaaaccaccatgcaaaaccacttcagggggttttatggaagtattgagaagttagatgcctggttttaaaattcagatgctaggtggacttccattgataattggaatgtataacaaggcaaaacattttgattcctttgaccatgttaaaaggatatgctgcccactgcctaatatttttttcagaaccagtatgctgcctactgggtaaatctttaaatacgctaagacatgtcctaaaccgcaaagtagggaggcgggtgtaaaagcccttaactaagcacttttaacatgcaaagagttcatgccggaactgtatttttcacatgttattaatttattattcaaataaactatgctgtcctgaaaattggaagctaagttaagcatcaatatgtttacataccactcactattatatatacagctctgaacttttaccataaaaaagtatatgtgaatggtcacaagtcaactcataaatagtgtttttacttttgaagtttgaaatctcaataagcacttgtcaaaatttgaacaaacatatgtttaaagtatctatatattagatatccaaagtacttccatttgactgcggaataagaaaaaatatcgatttgtgcatcaatatacactagtcacttgccagaagcagtgtaaaccataatatagactaaaggtaccccatcccatagccgtaaaactattgtaacttgtaaggttgaagtagatgaacaaagaacatcgtaaagtcacctgccataaaggagaattcaatttgttctcaagggcacggctcaaagcaactgcgtccaatttggcagcttctgttagaaatatttgcagagcatctcgagttggttgcaaccgcacaccacttgaagttgcaattgtatctaaaagtctctcttcacgagtcttaacccctgtttgacttgaaccagtatcatcagttggtgcagaactggatggactaggaccccatgaaccagaactaacattctttgaagcaccagatgaagaacggctctcgccttgaatttcacttggatcatacctgccatatttatccatttctgtggtcagagacctacgaaggtttgggctcttgtacggaccaccattatcatttgttatcattgatgaatgagaagcagcaaagttgctcaaaccctgtttaatggaagcactgccaatgcccactacttcacttagctcactaaggaaagattttttgtcatctcttgatggctcaaaattagtatttccaaaaccctgtatgcgcttgccaagaccttctgttgcaacagcaggtttaggttcctctgtggagaaaatagcagcaatggcatcatttgcagtttcacggacagccttattaagagaatcccctttcaaggggtcagggtgtcccttgtagtgaacaagctggcgcatagctgctgagtgccgttgcatttcccgcttgaaatcagtaccagacttcccaacagcatatttaatcaaccgcaaagcctggaaaagagcaattgaaaaggttagtacagaattgaagaacagaagctagtctcctcaataattaaacaccactgtacttaaatgttagacataagttaggacagcctaaaaattccatcaaaaacattagggtacattctatgatatatgtgggggtcaccatgtttgcaaaaggtgcaatgtgccactgctcaggactgacgtgtaacattcagtacaaatgcttagcaaagcaaatattatgcccataagcagcatttcctttgcgcagagagtctactcagaaggctggtatgagctttaccattacgagatcaggagtcagaacgcaacatgccatgaatgtaaagcaattcatttataaaattaaaattagttgtcacaagttgaaatctgaattcacattcaagttcactaaacaacctcaaatgtatgtgtttggttcagcattaaacccccccccccccaaaaaaaaaaaacatcccttaaatccaaatcaaaagtagacaccatagtttacaaaaaaacaccttccattggtccatagctataacaattgttgtagttcattagccacataaggcttctgctctataaaacagcattcaccaaaaacaaccatacaagccactaaggtctcagtcgatatggaacagttacatgccagatagttggatgtggagaatattctcagctcttcaagaagcagtaggctagttttaaatttcaattgatagggactatgacacatgaatccattctagctaatttgaatccacggtaacaggccatcaactccaggtgagctgtgagcaagatattgttgccacctagtagtgaagaacaaaaatatatagccagtttctcccttacaccttcaccaaggcactgctcttttatgctaggggctgtggcgcacaaccaataactatttcattcaacaactgcaattccctactttcgccgtttcccttattaaacccacatccagaaggccaaaacagaactatatcttcgacagcctcttctcccctcaactgatcggcaatccaggaggcaggcatgaactcaaaacaatcacacaaatcatcagtcacccactcaaatcactccccggatacgtgcgccatccttcgaccatccagagttcgacaagaaccgtggccacagaactaatcatcatcatcatcaatgagaacacaagaacaccaatccataagtactcaatcgatcgatcgatcgatccacctcgccgccacccacctaataccctcgcacccgagatcacacaaggggagagagagaggaggagaaggggaaccttctgcttgacgacggggctcttgttgtcgagtcgcttgaggacgaagtcagcgacctccttgacgacgctggcgtcggaggcgcggaggagctcgcagatctcctcgagcttgtagacgggggccaccttgtcgtcgtccgccgtgacgccgtccaccatccgcgacctccagtacgactccaccgcccgcctgctctgatccatcgctgcgcccctccgatcggagacggcgaaaccctagcggggggagaccgagctgccgaggccgccgcggcaacggcggatctgagaggggcggcggtggaccgggtctaggagaggaggggaggggaggggaggtgggcggcgcgggtgagcggcacgtgcggcggggtggatggaagcttctagtggcgggtcggggtcaggtcggggaagggaagggcggggtggttaacgcgataaccgtttcgctttccttcgtgacgacgggaggggaggggagaggccaagagtgaggctgaggctcagaggggtaatgcggcaaaacccgagattctgctactagtcgcactggaaagtttcgtgtcactttgctgccaccgtgttcaaaatcaaacttttcaaagattatgtttagttcacgtcaaaaataaaagtctggttgaaattggaacgatgtgacggaaaagccgaaagtttgtgcatgtaagttttgatgtgatggaaaagttagaagtttgaagaaaaactttggatctaaacacggccaaaattgtaaatcatttcggtagaacctgctatcatgggttcaagtctccgacgtaacttttttgatcccaaagatgtggatagaacaaagtttcatgtcggttgtaatggttgggttttgggcgatcttgattgtagttcctttattggcctagcggcggctggtcacgattagcgatggccggttcggtgctagcttttctcttatgtctatgtgttgatgttatcggtacgtggatggtggtattcttttttcgttttccttgttacgacattacatgattataatcttgtaatttttttctactctatcattatgaacttcacactatctagtgcgagtcattaaaaaaaagtctcgacataacgttagtgcttatatttatggttaattagagtatttgacttaataccaatgtttgtatttacgggtaatgctttgtacttactgctaattgttctttttagtttagatgtcatgtgcatcaacaacgagatatcgacaataatttcaccaatctgtatgggcatcaacagcccctcaatttatattgtctcaatctatataggcgtgcttatagagacaagtgtcgcgagtacttttgcaatactctcctctactagttttaaatctcttacataccacttgatatggatcctctctgcggttcattatagttgtgagtaacatagtagattgatgccacaaacagtgacattttgttgttatactatttttgcagtagcgatcgagatggtcaccgcagagcaaatggtgcacaaatgggtaaactaatgtggaggatcccatttcctaagattgtcggtttcctgcaaatggaaattcatcgcacacccagttaaagcctgggacaaagccactgggattttaaagttgaaatttaaggaccttttaaaatcaaagacttcttcagtccagtatttttaactaaacaaacaaattcaagaatttaaaactgaaagtgtatcttcaatttaaaattggggtttggatggtgccttgatgagtgagaaacgtggaacatatgtgaggctgaaatgggactcactctgtgaaacactgaaaccccaagtactaacattaacatgacacgtaattgaacgcatcatctgtaacggcaaagccttaactgtccatcaaaatactaaattagaagggcaggtcgcacgcttgcttttcaacgcacacgagacttgcaaattgccgacaatgcttattgcacaagacaacgccaaaaattgacagtacagctattctagtatctgaatgcagggtggttggcctcactagtaacatatcgcatggatggcgctgtctacaattggattctcaggtcaaaaatcattctatttaaattgttgtacactattctatcttatatcagtactacataacagcctcctggatctcatcagattcgtcaaccaccatctcatctttgaacaagagcttcaggtgaggaagaacctttggcagtactggcaagtccgccagattcacactcatcaggtcgaacgcaatgcaagtcttttgcatatcaacctcatcaaaaactgggattttagggtatctttggctaaagtgggtcaagattatacggtatgctccggctgatgtgcctactgctatggcctcctttgttgtactatggttcctagcgatcgcctcatccttcatactgtcctcaaatgttgcctggagaaacgagtattgcacagtttagacacgcaataccattattgccattaactagtgattaatatcatcaataattagaagagaacattctgcagctaacagtatacaaaaacatgcaaggttagttggtgatgcacttggccagttgtcgtccacatcaattggagagtgaaatattttactacaggacactaggacagacagaaaaaacagaactgataactcaaataatatattgaacttttggaaaccaccttggagcataagcagtgatggcaagcactcaaaagggaggaatatagaatcatagccaccatggaaatggcagtggatatcaagttggtaataatggaattagttgtccaaaagatttatgttcatcttacctcatgtattagtacagtggcatctctggacgcatctacaagagctgggcagggcctcgtgtcacctgaataaacaaccttccatcctggaatagcttttccagcactgctcaccttctccttggctctcagaacaactccaaacgcctgtggacagtgcagaactgggacactgtaaagaacttccaaacctgattcatgtaggacatctttcaaattagttagagctgtagtatctcttggacttgcaggcttccggctgtagttctccattttacttccaggagcaaatatagtgcttccaagttgagatgtggcagattcagtagcattgtcactgagaaaagcctctatactaggctttaaagtctgcctgcagtctaggaactgcatatcaagatcttcgagtgttgaatatgcatttagaaatctttcaagtggtcttggtccaataacaagtaagggcttgtgaggtaccccttttaacaatttagacctcaaagcaagaactctagctacacctgtgtggtgatcagcatgaatatgggaaatccaaannnnnnnnnnnnnnnnnnnnnnnnnnnnnnnnnnnnnnnnnnnnnnnnnnnnnnnnn

SEQ ID NO: 7681 - DNA, 5134 bp, Oryza sativa
gggtgctttgtcagccacttgctgtcaatgaagtgccatcttgtaccttacctgaattactattttcgtctacaaaattacaaacagaggaattctcagtaatccatggctcttcaaccatgagcatatgcttgccaactgaattactttgccagaacttgctaatctgttcaggaacttctttaatctctgggatctccgacaagagctcatctacaatatctccataagtagtaaggcttggtatagacgatctgtccagccccagttgagcatatggacgcagatgaaactgaaaaggagaacccactaatgtaataaacggcattgcactgaactaaagaaagtttaaccagcaactggtcacatagatgatgcaaaattcttatgatttatttatctctccttcctcctgtcagcttcatttttatgtagtatctttcatgagaagaatttctccttctcagcttctagattgtaattgtgtgccatagcatggcgtggaaaataattgcaaggtgcatatattcaagcccatgctcagagaatataagcaagaccagaactaacgtagggcaaaaagtaactgtctgtgcaaagatcatcaataaataatgaccaagacattcgtcacagcaggttattttacaattgcattgcatagaagggaaaatcctagtcatgctgctttaaaaagattggtatagtgtggtaggttgacacgttaagtttcgagacataaactattagttgaattttcacatccatatttgaaaccattttcatcacaaagtccagacatacaaataccagatagattaacagaaacgctcgtgtgataagtgctaacagggaaatacagtatggttatagagttagccatacctttagaagattagccgctgacacactttcacaggcttgcaatgaagaaacctaaaagtggtaagaaaatttcatgtatataagcagaatgcatttttatattatctggtattatgtatcttactggaagctaccttattcttctctgaatcaacatcatttataggttccacaggccaaaatccagaggatgggaagagatgagggcatacaaaatgaagacgtgatgatatccttgcactacccttcaggataggaatttccatgtttttactgcacataggaggaaaaagtcccatcacatgaccaaatattagaactggatcattacaaacaagatggcagtatttgtagtggtttctgccgcgcagatcctactatatgcagatgcaccacacttgtgttcactcatccatgtgtcagcaatccatgtgcccagttggtagcaacaactgtacatgagaacgctaaaacagcataaaagtgagcacacgtggcaaaaacaccacaaatatcatcacatggattggatttaagccagatttaaaaagttagacaatgttaagtgaatgatttaagcatttaggttgaaaaattaacctatggtgataactgagggttccaaaatcctaaaacagatattatacaataataaaattaataaaatggtgttttaccgaggtggaatattatcaagaagtaccttacaagttacaatgttccgtagcaaaatcaagcaaaacttcactaattatcaattaggaactgacgaagataatacagtgacaaagtaaaacttcacaatatgcaatcacgacgtataaattcattcctggaagttacagataaattccaccaagttaaacatttctacaatatggaacttctcacttcttttgtaaaaaaaagctaacttcagatttactaacaacaatagttttaacctaagttcaaactagaaaagccaataattggggctgcatgaaaagcatacataaaacagtgaacagaactgaatcttacatttcatgccctgccatgatatgctgtgtggcaccaaattttctcatccagttctgataatcgagagcttcagtcacagaagatgggcccaagtggattacacaatttactttcttgggactccctgcttgctcagaagaatcttcataaaagcgtataagagattgcagggaaaatagttcgtgcatatgatattttgtagggcaatccaccaaaagtacagtaggtccaggaatcgacgggccaagaacatcacttggatgaacctagaaattggcaaactaaatgagctgtacacaagaaattttcatccagttatcttgtgcgtgcaatttatatctgaagtaatatcaaaagcttaaattacagaaaaaaaaattaaattatgttatcaaggaaaggacagaagatagtcaagcggcactgcttaatttagtatttaacaactttaaagactaataaaatttaatttagtatttaacatctttaaagactaataaaatattacatcagcaatctattcatgaaaatatatagtgccaccccatccacagatgaatcactgaacagcggactcaacagcctccaaaagaaaaagttaggttcccaacgggcagcactgatctacctggtggcataggctcaagcttgaatcaatgaaaaaaaacattgtaaacaaatacatgaaagaatattatttataatcctacaaatagattacagtttaaatatctcagtattcagtactaaccattttatcgaatgcatcagactgcacagagttcccgagctgaagttcacgatattttggtccaggcttgagaccaagggcagcagccttagcagggtcaaactttcctttaagttctggcagttcacatgcataaatgatagcagtattgccaggcttcaagttggagtcattcaagcaactggcttctttattgtatcttggtttgacaaacattgcggatattcgaactacttcgtcatcaacaatgacagtagcatctttagattgggaagaagatacattttgttccacaccaaagctatgtgtgtgaagcattgctctatttgggataaaggatctcattgcactagctaaaaaatctaggtcagaagggccccatatattcacctatgttgcagataaaagggaacaatacaatcagtatgcagaaaaggtataacaggatgagttggcaattaggtactgaaaagaagggaatgatgaaatcatgtgatctcaccgacatgccctcttctcctatgcctgccagagtcagaaccagtcctgcaaaaatgaaaagaaggaacagaaacaattatgtcatagatataatcacagttcagcaaataatgacagtagttcagtacatagagtgatcaaatttacctggaaggccccctgcagtttctgagcatacacgagtcaaaaatatgtggtcaatctgggaggtggagaatcaacatttaagcaagttgctggtttacaaacacaatcaaacaaggataaaagaaatatgatcaatgcattggcgagaaggacctcatacctttgataactttatcttgtgttcagtacagaaacgttgaagaccctatcagacagcaaggttgttatttagcacattaagttcaccaaaataagacatgacaaactggttaaggatgataaaattagataaataaaatacagagcaatacacacaaaaaagcaggacaaacggaactcaatagacctgagctacaaatttgcccctaaggcaactagagtttaggaacaacttgtgcacttaagaagcacattaattaaaaacataagtatgttttagagagagagagagtgatcaaataaatacaagtgctgcagatacctcgccagcattaaatataaacctctgtttgtcaaagaagagtaaaatggaaggtgaagtatcttgtgtgtccattcctgtaccaagtatctgcacagcaagaagccaagaacgaaggggtaagatcactggcaaaggcatttgtccctgttcccatgagttgatctaagtgagggggttgattaactgaacaactatctctgaggggggtgacacaaaaagtcaaaaacagctggaatgattgcattctaggcctctaggggtgcttatacctagttttctcactcttactaaactagctcgatttgatcgcttgctttgccagccagcaactgcagcatccacaagaccctgacaacatagtatttttggtcttcaacaggtaaaggaaacccagaatatacaccctacaagtgattatcaacatcgttatcatcagagcattgatgttctgaatcatttctaccaatttggtagcgggtggcattaatatgtatatcctccgatgaactttggcatcgtgacaaaatttattattttataattttcttagcacgcaggtaataagcgaacgatggtttaaagtttggttcagatgctataccccctttaaacctaagtaagacatctatcgcaatcaatttgggataacattttagcctatgcccacagttaggtcagcagaaaggcgacacatgcacattcttacaaagcaaagaaaattataaccggcatgctgaaacccaaggcaaaagatatcgcgccatactccaatggggcatgttttgtatcccaagtaagcccaggaattaaatgtgcttgctaagtcatgaagtaaaccaacatgcacaatcgccatcaaaggattgtagcaggtactaaccttgtgctaaaaggcatatatatataatcatattatcattttgttgctcgacatcgttcgcgtcttaggaaacaaaatgtatgtagcataaaaaaagcaggcaatccccgctttaatcgagctgaactgaaagctaggcgcaaagcagagcggcttaataacgagaccatcgggaatgtggcgtggtgtggggggagaaatcggcaaaatccctcacctgtacgtagcagatggtgttgatggggttgagcttgcggctcttgagctccatgctcctgcccttcctcccgtccttcccctccgcgcgcgtcttgttgaacgccacctccgcctcccctccccctccccctccccctcctccgccgcccatcttctccttgctcctcttcccgagcgtgctgttcccgcgtcggaggaggttgttgtggtggccgcggcgacctcctcctcctgcctggccgcc

SEQ ID NO: 7682 - DNA, 2691 bp, Oryza sativa
agctcccggatggattacgggggggagcagcagggcaacgggcgtcaggggcattttcgtcatttgctccagatctaactcatctccatgtacatgtaggcccggtttggcacggctatgccgctacagattctcccagaatcagaagttccctaaacaaatttagtttttgtccagattctttgaagatgtagttatagaatccagaaaatgaactagaagccagaagctgagaaacccagttttactagattcttagaagtttattatctactagctgcttttcagaattttaagcttcttaaacaggccataaatatcatatccattcataatcgatttgaaatttatatgttaaattataatggttcaaaattttaagttttatccaaaatgagaacaaaatgatatattcaaaatctatcaacgtaattatggatataaatccgtggatttgtggagttaggaatattttagctcaaaaaaatcttgaatccggaactatgcctaatcatccttctggttgcccttgcaaattttccataagtatttttttcatagtaacaagttacaaaaatgcaggcgctcacaacacacacgtatatcatactcttataggcacattcgaaaagctgaaccggcatatcatgatattgatgaaattaccatgggcgccttgctgttgacggatacttcgcctatcactaaaagactaattaggtgtaaatacgaacactcgtgtcaagtttttttttcttaattacacataagacgcacgtaaactctattatataagtatttttacatttatctattataattatgttcatgtttagagagcttctagcaactccactttctcctaaatctctaggtcctccaaacaatttaaaattgtatctagattctaaccgtaagttgctaccgaatttaaaaaatagacttcaagtcaacagctaggaaatttatgtttgtcatattcttgtaggttgtttcttaaaatctcgagctatcataaacagggcctatattaccatctctttggcagccaatgagtcataacaaaataatttgatcaatctacgggaactatttcttcgatgtcttttttcacgataataaagtaaatttcagatattcacacaggtcattccacattactagctttttctttatgttacttcatccttcacaccgtcgttttgttatttttaaatctttgaaatctagattggaacatttgaggttagattatttgaaccttttggttggttagtagggtcttgggcctaacgggcctgttagtgggcttactatgcagtaatatctatgctttgttgctagtgctgcattgctggcctctgctgccgatctatccatgcatgttctgcaataattgatggaaatcggaaattagccctgacaagtgtaacgatagataacgtacgagtatttgagaattttatggttatcccttattgtttgtttaccagtgagtttaggcatgtgcttaaaattattgacaatgtatccctaatgatcgatcgcgggcatatttggttagaaaatgcttgtggatgggcgttcaaaacgagcccagatattggacgccttctactcctttgtctcctccctccttcatgttcccatctctttctctctcacactctcaccgtgcccgcccacagacctaccattacaccggctttcatcctgacatggcccaaccaagagaagttgggctgcccatgctgtcacagtcgcccagtggtgtatctagaattttagaatttttatgtggctagtccaacctatatatttttctaaagtaccctaaatataacaaagtttggagtatataataaattgattagatgtgcattataatatattaacaaggaagtttttttacttttccaaaaaaaatcatatatgtatatatatacattgggttagagcaaaaaaaattttcccaaaagttatattttttactttttttccctagatctgcctgtgttgtcgccaccatatcaaacatatcttcctccgcgcatgccggccctatccacaaggcccttaaggagaagagcaaagccaacatcgatgcatgcagaaccgtcaccgagaagaacaatcccaagtacaagctcaaacaggtgtggcgacgcgtagcaggtcggcgacggcgtcgtagaactagacgtctaagatccacgctcaaggaggttgtagagaaataaggtggatctggtcacattggagtagagaaaaaagtcactataggctcttgttagagtttaacgatttattgcatttttctcataagtattaatttgagtggtgttctctgttccgctatatgtatactagcagatgatgcgcacagttgcattaaaggcgtgtaccacaccctcagttgtcctggagttgctcattgacaatttttttttattcttgatgttgcagctagttttttttttatgctttacctattggtttattgatgttgcaggtcagtatttttaaatattgtattagctggttgcaacatttttttagcgagtgataaaacatctaattgatataattaattcttggccaagtgatgaaaatttgtataacattttgaaacaccatctaaaatagttgtccagttaggttgtgggactacctatatatttgtcgacaact

SEQ ID NO: 7683 - DNA, 1970 bp, Oryza sativa
tggatctggtcacattggagtaaaaaaaaaaatcacttttaggctttggttaaagttaaccaattaattgcatttttctcataagtattaatttgagtggtgttctctgttccgctatatgtatactagcagatgatgcgcacagttgcattaaaggcgtgtaccacaccctcagttgtcctggagttgctcattgacaatttttttttattcttgatgttgcagctagttttttttttatgctttacctattggtttattgatgttgcaggtcagtatttttaaatattgtattagctggttgcaacatttttttagcgagtgataaaacatctaattgatataattaattcttggccaagtgatgaaaatttgtataacattttgaaacaccatctaaaatagttgtccagttaggttgtgggactacctatatatttgtcgacaactcttcttaaaaaaaattgacagatataagtatagtataatcatgatataattatattgtaatttacatgtaacttaaaaaatccctcattaacatgctattcctttaaaatggtggtcatggaaccaaatcccctcacatatgcgccgccgtagtgattttttccttcctcgcttgtatgaaagttaaagcaaatcgaacgattcaaaattatatgaaagttacacacaagttacagtgtaattacacaacaattgtactacatttgcatatgtcaatttttgagagaaaatttatcaacaaatatatagcaaaattattaggttgttgccttggaaagaagcctagtctaaccgcttggttgctggttgaaaactatatatacatgtcacagctgagatgagccttatgataattattgtagatcttttcatgctgtagtattttaaatatgtcattttataactcgttagagatgaagttatttgagacatgtcgtgctcgatacgtcacaacaaaatgagaggagttatcgatgactccctccgtcctaaaataaacgcagccatgaatttctatgtctgatttttatcgcgcgtcttatttaaaaaatttttatgattagtatttttattattattagattataaaacatgaatagtactttatgtgtgatttatgttttttctttagaaaagaaataaataaaacgaacgattaaagttgtaaacgaaaactcatggctgcgtttattttggaacggagagataattaaagatccacctgcctgtgagcctgtcccaacaacgtagtacgcgtcttgagcaatatgacgaggccgtacgttacgttggtgcaagccgagcgagcgagcggccccccgatcgacgacggggccggccggccggccaccaacacgagaacgttaacgacggctaaccgccgccgctcccaacgtcgcgggccggcgtacatatatgcgtcacctacctagatgtctcagcacgcgtaattaatcgagccatattactcctatgtaattataagagattttaacttttttttctctcacactgtttgatcactcgtcttatttaaaagcctgtgtaaatataaaaaagaaaaattatgcttaaagtaacttggataataaagtaagtaacaaataaaataaataataattctaatttttttaataagatgagtggttaaacagtaagaaaaaagtcaaaatcccttatattatattatgggacggagggagtattaagcatgaatgcagctggttggcacaattaactagctagtcacatatcaatgattgatatatcctgtagctaattgattatatacaatagtgtttgaatcttccaagacgaagataaagataaaaactaagtgtttatacaaaataagatggtaataatatgtgattaattgagttttaattattataaacttgaaaaatggattaatcttatattttagaataactttcatatagaaagttttcgcacgaaac

SEQ ID NO: 7684 - DNA, 10629 bp, Oryza sativa
cctaaagctggctaagctattatagggacgattagagcatgcgataatggtaaataagcaattatttcatatttatattttttaacggaaggagtaaacaaaaatatagatatacaccaaagaattctaagaaccttaataacatgaaatcctatgcccatctctttttatggactacttccttcattttttaatacatgatagatattgacttgtgtacgtatgtttgaccactcatctcattttcaaaattattgtgtaaatacatggaaaagtatgtcatgctttaagtacctttaatgataaacaaataaataataaataattattgtatatttttaataatattaatatttaaacgtatgcttaaaagttaatggcgccatcggttaaaaactgaaggggtatcttaaccttatttgttatctaccttgtcctcttatccacttctgcatctctctccctccctctcctctcatggtcaaagctctatttttgacttaaggatggagggaaggggaaactttcctttgtttttcatttgctccaattccttcaatattccaattggctctttagtttttattttccttttgggattgaatgcttctaaattcctatgaaaatgcttcaatataaacatgcccttaattaagttgtgatttctaataaagaaacataattttaggatagaactttatactatatagacatactccagatttagagtgaaaatccaattaattagtgttaaaaatcaaaattagctacgccaaacaagctgccctccctatatttggccactacacacatacatctatctatttgcatctaggcttgtcttgtagccctccaaatataaaattaatggatctggagttatggagaaaggaaaagatagcttctttattattcacatgtgtactagtacttgactcttgaaaaattggaaatctagcctccgtttgatataactccagatcatatatatccacgactctacgctggtattttagttgtttagtacaacttcagatcatatatctacgcttggtatggggtttataagttaaattgtagtatttaagattttatattttatttaaaataaaaacaaaataattcttccaaatattatcagctccaccgaacaagctaggatcggctcaatagcccctagctatatctcaccgtacgtactgcatgcattatctggatcatcatatgcgcaggctcgcgagaaaagctaggacaggcaggcccctcgaaaaaaattgggaataattgtcacctaattaaaaaaatgtagctcaacctgttaggttctttgtggtgggatcaaccacccgagtttaagactttaagttctagatttgacacggatacttatattcatggctaattatttttttagtgataggttttcaaaggtacgtattcatagaaataaggtgtgtgcatgtgtattcacagaggtaactgtgcacgtgttttgagcacttcggattataccgtgtttaaaaaatttgtaactattccatgtatataactatatatatagacagagatacagggattataaacggccggggcctaggtgtttaattcctgacacaatcaatattaatgccgttttatttactgccatgaggatggtctgatacgatgagactgatcaagtgatcgatttgatcggagagccggttcacactcctgttcatcagttttacgagttgcattcatgatttgttatgttttttttttcgaaatatacagctagctgtgctactcatgtatactccgtacgtctcaaaatataagcatgtttagttgtaaatttagacgaccgctagtccgatccagatcactactacaaaacccctcataggcaccgactcatcggcaccctattgatcttttcccacctttgcggaatgaaaaaaaaaatatagaaccgacacctttgaacaattaccggtgccagttctaattaaggaaaaaccgatatcaatatccggtttataaaaaagaaccggcacctatagatgatctaggtgtcggtttttattaaattagcacctattgtataatataggtgccggttcttttaaaaaagtgacaccaacaaaactgagccgaaccacccaacgaaagtgagccgagctgatctggtacttttattttagtccaccgacacacccaacaccttatccactcggtttctctatattagtctccgcctttctcgcgtgcttctctccgccaccccctatccttccatcctcccatgcttgcgcctctctctcgtatgccgccgcctccgcccccaccgcttacgcttgcgccttctctacccctctccccttctcatcctcttgaccccttccacggtcatggtgtgcttggcggccaagttgaggggggcatggttaattttaatttaacctgcacctatgaatcaatatctatgatatattttgtaatagtgtatgcgcgaagttaattgcacatggttctcgatctctcttatatgggctggggtacgtcaatatatagaaaaaaatattagcaaagacgtagcgtgattgtgctgggtagctgggctgacagtgtcccacacggctaagcctcatcaaattatttagcagagatcaaccaacataataatacactttggaaatataggaatttgctcatgttattttttgacatgaacagtggctcatgcgatactattttctagatccgacattaattactcactaaaaccatcacccatgtgtgttttcaattagtacattactgatgatacattttgatatccttgcgaaggggtagtacatatgtacaaggccaacacatttaacacaaggagacacagcaaggacacaaattaacagcgcacatttgctagctagctaccatgcacagaaacggaacgaggacataatccaaaactttagggttgcttctctgctccgccatgacgccaatgcataatataattgtgtcggctacctgcacagtgcgcatgtttaatctgtttcttcctttcttcttcttcttcctattaagactcgcttaggtggtgtttggatccggggactttactttagtctctatatttagacactaatttagagtattaaatatagactacttaaaaaataattacataaataaaagctaatttgtgagacaatttttaagcctaattaatccataattagagaatgtttactgtagtatcacataggctaatcatagattaattaggctcaatagattcgtctcgcgaattagtccaagattatggatatgttttattaatagtctacgtttaatatttataattagtgtccaaacatccgatgtgataggaacttaaaagttttagtctcatctaaacagggtcttactgaagacatgtatacatagtgttctgatcagtgtacagtgtactgtaccatggccccaacttaacggtactgtgcacataatttcgcaagggaacatgcatgacaatggcatgcccagctcaattcgattgtaggccctccacgccacaaaattggtcctaacaggatcgttcaattgccacttttgatattctacctcatagcatattttgtagtaaaaaccggtgatcacccaatacatgtgagtatagctcgttatttgaatgatttcttccgatcgacgtgaattcgcagtggaccatataccaatcaagctgggttcgtgcgtctagcactagcgtgactatgaagtgataagtccgactcgagctagttctcaggctaattcagagcagaaagacgacggtgaacactgagaaggcctgagcatagttaatttttacaacaaaataaatcatagggtaaaacttaaaactaaagtgataattaataattgagatagttaatttacgcaatttttaccttggccgaaagctatgctgacaagtgaacaacacgcttgccgttgccgacatctcttgtacgtacataagctagcgacgatcacggtggttcaataaattaatcaagagacgagacgacagcgtatatagatcgaaaaattaatcacgaaacgacagggtatagatgaaatataaattaaacccacgcttataattaagtcggccaccgaagcagaagctagatagagctaaagaccaatgcaacaacagatcatagatcgcttttacacttgtgtgtgtaccaccattaactgtacgcgcttcgatctgtactacgaatagtagagtctctggtcctcgattcatcgtcctatatatatatatatgaacacacttaattaaacgcatatgatatgcatctgcagctagctagctgctactccctccgtttcaatttctgagacaataattccaatatataatgtgagcacttttataattgtttgatcagtgcttaaaaagggaatccaagaaactcaaaattgaaccaattagacgactttgcatctagctttatcttattcttaaactttactgaataaacctattaatacttatctataaattaatcctatataagtattcctattaattgtggttaggtgtatccacgtacgtcaccctactatatcagcaattagatgagagagtatgtgcgatatatgaatatcatatcgttctattaaatctaagcatcactggatacttatattgtcgaaacaagatttcggcaatactaaaaggaggtggctatcaagctagaaaagtggatggatttagagacaatgaattttatacaggttcaggccttcttaataagaaataatatcctactcctgtccggggattgatccgccgagtgtattattgatcgtatgatctgggagaaaatcgtgccccaagaggcacccggacccctccttatataggggaaggggtccgtagtacagcccatatccctaacggaataggaataggtagttacagataagatacaattgtaaccgactaggatcccgggtatttccttgacatacgtttagaatttaacccgagtccctgtaaagatattattttatctatacatggcaccccatacccagtcggatatacatgccgtatgggtatggggtatccataatctccacatatatcattgcagcatagctttacttttttatataggatactcttgtttgaagtgggatgccataaatcactgaccttcttcttattctctctatttaatccaggaaccaatagacacccatgccgtaaattctaagccacccttaccatttcattcaggaaaaatatgtggtggaaaccacaaatgtagtgtaaacttggaaactattgttggatcaaaaaatggacgtccgaaattcgtccacgtaatcacgagttaaaactcatgagtacatccatgagtaaaatttttactcgagatgacgtagaggaatctcagacattcatttttcgattcaacggtagtttccaagtttccactaaatatgtggtttccactaaatattatcccattcatttatcttcattttcagtttcacatgcatgagcttgatgaagaatcaagaacatatatattcctctctagaagcccatatgttttgccactgatataatcagccaagaataggtgccagtcaagaaatagattgtacgtgctctgttcatgtttcatgcatcattttgtatttttagtgtgattttcttacacatgcatcttcctcataattgcagtataatttttcctattttctacatgtatcgcatctctaatcccttctctatgcagcatgcgagatccaagaaatgctctattcatgcatatatgaagctctactataaaaacgattttttaccaacgttggctttttatttttacaggcgtacaaaaaaaacccttttataaccgtttgcaaaaatagtcaaagaacctctagatttagacccgcctataaaaataatgtattttcgcacaccttcaagttcaggagtggatggccatctgaaaaaatcgttttggtccgtttgtaaaaatgatttttctcatagtgaagcttaatacggctgggatccgccggccagggccccgccgtcgatcgatatcaatcggcgccggaaaaaaaggcgccgacgtacagggccggacctagggggtgtgccgggttggcaccggcatacccaatttttttggaaaaaaatactaggatgtagtatgaaatcaaatgacataaaaatggaatcctctcagaaaatagaatataacaatgatcacggtttagaaatcaaatcaggggaagaggaaaggaatagatgaagagaaacagtgggggggggggcagctagatatatagattaggacatgggattgattgttctgaattttattgatttttcatgaattatgggccatatttgaatagaattttgaaaaagccgaccaaaatctgtcgaaatttttccatcaaaattaggtgttttctttttaaaaaaatatatggtggagtgatcgctagaatgaacacacccggtacaatttttctgggtccgccactatcgacgtatgacacgcgacagcaggagcacgaattttaagttatatatataagcctattaagtggcacgtacggacgtaggtaacagctgccaattatatttatgcgcattgttacatgcgattatgttagtcaaaacgataattttcaggcgatctacaacgggcttaattaattactcttttcattctagtacatccatttcaaaatatattgcatattttattttattttttttagatgaggttttgactaatagttgctttcttaatatgttatttatgtgacacaatagtataatcatacggaagtaattttgaatatgaaactaataacatcagttttgcttcacaaaaaaattattacaaaagtaaatgttggttagagtcttattctcacaaaacaaaatgcactctatattttgaaattgggggagtacaacaagtcattttagacttgtcttaactcaaacttctacgaagtctaatcaaatttatagaagatgtaaatacaccaccaaatcaattagttcattaaattcactaaatctaccattatttttattcggtatatttgttttgcgttgaaactattacttctcctgcggtttttaattaatagatatcgccattaatttgtgtgtgtatttgaccatttgtttcatttaatatactttaagcaatacttagatactacaactatcctataatataagttattttcaactatttaggagtacaagactaaacagttcttgcattgttttttcaattcccgtctaaactgatcatcaaccgagtaccgacatgttgtaatgcagccgtatgaacaaatcgcttcgactgatcagtcgtgcgtacggcctccgatagttatatatattgtgtactgaatggatatacctcgtctgcagcagcaggactacttgaattacctcattgcctgtactctcctgctgtaccccttaggtagatcgagcaaacagtggccagccggctgatataattgcatgcacgtatacgttaaatgatcagtaattgtgcaataaaatatgggagttaatttgctactcaactctgtcccaaattataagggctatattttttttacacggttttcaataacatactttgacaagtattttatttcattctatgattccaacaaatatgaaattagcatcacatgaaagtacttcaaaataattagtatagatataattagtatgattattagtcaaaagctaccgagattgattttccttaaaaatgaggcgccctataatttggaatggagggagtacttctcttcgtcttaaaaaatatttttataagggattagcaatacaaattaacgcagagctaaaatttcttattttaagatatggagataaaatataatacttgtcgttgttttgcaaggcggtgtgacaatcatggttaattaggggtccttcagaacgtgctgatttcaaacaattttattgaatttctatgtgggaattatattcaattcaatcaccgtatgattttgatatgatgaaccgtgtttccaaaggaggcattagttttgtggggtgggaggaggttgggatcaagggttggagggaagaggaggtacggatgcataatgccaccaaagccataggggaaatggtatagtggtgtgtgtttttatttggcaaatgggtttggtgtgggtagtgttgagaggctacgagttaaggatgtcagagatgtaggacacaaatagttgaaaataactcttaacggagcaaatggagaaacaacaatagtaacactaggctagcttgttagtggaaaaagatagggagagtgatagagttatatgtgggtcaaggaaaaaaggcttaatagctagatagcttttgcataagataaaagataaaattacatacatcacctcttattgctacaacttcgctttgactacatggccggtccaccattactcagccaatcaatatatcgattataattaaaaagtgattttgaattctagaactcgatttttggattaatctttgggctctttttaaaaaaaatttcccaactcttttataatctaaactcgatcgctttgtaaactgagtttcgatttacaattttgtgaaatattgcacatcaatattctctacattaccattttttatagaattgtttgtaactatccatatatattgtactcatatttgataagtaaaatggtactctactagagaacatcctcaaaatctatttattatgcaagggtatgaataatgcaagcccctctgatgtgcgattttaaagtgagatagcatgccacataagcatggggctaatttcaacatagtttctccacaatgcaagctattgttgatgggatccatagtaatatactattttaccaccttcttatttgagctttagtccttcaattagttctttttatttttttggtccaaaattatgcatatagtacccccaatagaaaagagaaattgtataaacacacataagccctttccctaccatcgcgggcatcaagtcccactataggcctatcccctcttcccgcctcgacaatgagcaccactgccgccagcgtcttacctcttccaaacctcggcaatgagcgttgtcactgctgacctctgtgtgtgtgtgtatgtgtgttcaccgtgacgagctccctctctagcagactctcccctcacctagagtcgcatctcccctcctactagataggcgttgccgccattatcccctcctcctcaccaagccgcgggtggtgtagatcaagccagcgggggcgacgaagatcagggcaaccggcaccaacgacaaccttgacaatggtaagacatgcggatggtgtaactgtgtaaaggatctcagcgcgacagatagtgcgaggtgtcgagggtgaagcatgccgggacgatcgaggagggccatcgccaatcccccatggtgtcatgcgcctgggcatcttccaaagcagggcactcgtgtctcatagaaggcatgagcaccccgcgcgaagacacggccctctctcctccacgggctacgtggatcctacgaaggtactcgccagcgtggcgcattgtccatggccgaaacaaagcaacaatcccaccagagatgacaccaccaaaattcaccactagccgcttcttacggcagtacacactgcagtaactaaaccatgcagttccttgccgggacgacgtcgacgtttgtagctatagctaagcctaggcctagcttgccgttgcctgcacgcgcgccgtacgtacgtacatccacacactgacagccatcaatctcgcgatcgagatcttgcaagatcctctcatcaaccgtccgatcgacgtcgtcctcgctcgccgccggccagccatggccgccgtggccgtggccatatttacctccggcgagtacacgcatgtgcacgcgatatacatcgagatctttaccctctctttgcccatatcttcccacctcgtaccgtacgcgccatttactccgccccccttaactccggcgagtaatggcgctcccgccgtggtaccccaccaccaccaccgcgcgccgctgcatatcctcgccgtccacgtagacgactagctcgcccatccaccactccttcgtttcatcgacctcgatttatacctcgatttaacgtggcgttggtgggcagtatagctagctactagcatggatgcgatcaattcgtcgtcgtcgtcgtcgtcgtcgccattgttgtcgtcatcgtggtggtaggtggtagagtactgagctggaggtttagtggtgcagggagaggatcagggaggtagagctagtcatggagtttgggaggaggaagagctttagcttctttgaggaggactggaaggcgcggccaacggcggcggcgcggacgccggtgcaccaccactacgcgcggtcgccggcgagggaggcggcgccgcacacgccgccgaggctgagcctctcgtcggtgcatggggtggagctgccggggttggtcggagttgggggaggtggtggtggtggt

SEQ ID NO: 7685 - DNA, 2398 bp, Oryza sativa
  unsure (1)..(2398): unsure at all n locations
ttacctccggcgagtacacgcatgtgcacgcgatatacatcgagtctttaccctctttttgcccatatctttccaccctggtaccgtacgcgccatttactccgccccccttaactccggcgagtaatggcgcttccgccgtggtaccccaccaccaccaccgcgcgcccgtggatatcctcgccgtccacgtagacgattagctcgcccatccaccactcctttgtttcatcgacctcgatttatacctcgatttaacgtggcgttggtgggcagtatagctagctactagcatggatgcgatcaattcgtcgtcgtcgtcgtcgtcgtcgccattgttgtcgtcatcgtggtggtaggtggtagagtactgagctgaaggtttagtggtgcagggagaggatcagggaggtagagctagtcatggagtttgggaggaggaagagctttagcttctttgaggaggactggaaggcgcggccaacggcggcggcgcggacgccggtgcaccaccactacgcgcggtcgccggcgagggaggcggcgccgcacacgccgccgaggctgagcctctcgtcggtgcatggggtggagctgccggggttggtcggagttggggaaggtggtggtggtggtggtggtgtcggggggatgtgctcgccgtgggtgcagtcgccgctgcacgggagggttcggttcccgccgtcgccggcggcgatctaccactgcctctccgcgctgcaccggctcgacggcgacgtgcacgcgctcgccgtggcgaggggggtgctgttcacggcgtccgacagcggccgcgtccgggcgtgggcggcgcccgggtgcttcaaccgcgggtacctcgacgtcgggcgcggccgcgtcccggcgatcgccgcgtgcggcggcacgctggtcacctcccacagccgcgaccaccacgtccgcgtgtggacggtgtgcgcctccgccgtgtgcgaccacatccgcgccaagaaggccgccacgctcccggcgaagggcggcatcctctccttcaccaagcggcggccgccgcaccaccgagacaccgtgtcgtgcctggtgctccacgccgtcgcgggcctcctctacacggcgtcgcacgaccacaccgtgaaggcgtggaagctctccgacggcagctgcgccgactcgttcgtcgcccacgacggcgccatcaacgccatgctcatcaacgaggccgacggctgcatcttcaccggctccgccgacggcaccgtcaagatgtggcggcgcgtgtacggcggcaccacgcacgccctcatcatcgccctccgctccgagctgtcgccggtgaacgcgctgacgctctgcacgccgccgccgncacgggcgccacccgccggtgcttcctctacgccggctcctccgacgggtacgtcaacgtgtgggagaaagaggcgagcgcggggcggccggcgcacgccggcttcctcaagggccaccgcctcgccgtcttctgcctcgcctccggctgcggcggccgggtggtggtgagcgggtcggaggacgccaccatgcgggtgtggcggcgcgacggcaagggcgggagcacgtcgcacacctgcctcgccgtgatcgagggccaccgcgggccggtccggtgcctggcggtgggcggcggcgaggccggcgatgtggaggggagcatggtggtgtacagcgccggtctggacaagagcgtcaaggtgtggaggatacgcgtcgtcgggaaggaggaggaggaagacgacgacgaggatgacctggacgacgacgacgtcgacgtcgtcgtcggcgaggaggacgcggcggagacgatgtcgacagctgcagggaaggtcgacacggaggcgagggacgaggcggcggcggcggcggcggtggtcgccgaggaagaggcggaggtggtggtcgggctcggcgcgacgccggtgctgtcgccggtgtgggtggagaagcggcggacgagccgagggtgacaccgtacatctcgacgacgacgacgaggaggcggccatgacggccatgcatggtaaattaattaaccagctcggtcttgatcgtggttaattagcaagtcctgttcctccagctgatgattaattttttttgttcaatttctacagtgttgaattgcttggtaaatagtagtggtagtaacataagtacgtttcaccactatatggcctgtttggatagcttctgcctgccgaagattcttttagaagccactactgttagacagtccagattttcactcgaattctaagaatccgtagttgtagaatccaaaaaataaactagaaatcacaagctttgttttgcagcttctccaggttctcaccagctagcttctcaccggttggttctcagaatt

SEQ ID NO: 7686 - DNA, 727 bp, Oryza sativa
  unsure (1)..(727): unsure at all n locations
nnnnnnnnnnnnnnnnnnnnnnnnnnnnnnnnnnnnnnnnnnnnnnnnnnnnnnnnnnnttatagactattatagactgcagactgcgtatgccgcttcacttatgtgtatagataagcactggggatgttagaacatggacattgtataatcttgcaatttttgatgtcttgtgctgatgtaaaatcacatatgttatacctagattggcattatcaagtgcaaatcatcacggtatctaccgagaaacataatgcaagtgaaaccctgctgtcaatatttttatactgaaattgtataccatttgcacataggtttacccctcttgaatacttgagtagtagtagtaacatagtcaacaaactttgcattcaatagacggaccaaagattcaaaatggatgggccttatttcgagtaatagctggatcatatcccttttccttacagtcttcacagatttcgtcctcttgaatacttgaaagtgtaacacaatcaaacaaactttatattcaaagatgtatcaaaatggatgagccttatttcgagaaacagctggaccatcccttctcattagggtgttcacagattcttgttctctgcatccaagttggcccctagaacaatcatggtaacaaatctacacgggtacagtggcttcgatgtcctgaagtctgagggtaacagctcttctgtgagcctctaatccttcgacttcagccatcttt

SEQ ID NO: 7687 - DNA, 1566 bp, Oryza sativa
  unsure (1)..(1566): unsure at all n locations
nnnnnnnnnnnnnnnnnnnnnnnnnnnnnnnnnnnnnnnnnnnnnnnnnnnnnnnnntggcagatggaagagaatatggatcaggtcgttcgaaaggcgcaaccactcctgcaaacgggcagtaagtgctcagattacttttgcggcaaaaaatgtgctatcgttctcaactttacatacattcttgccaggggcagtgtttgtctaacacttctttatattaaaaataccagtgtttctaggaacaacccttttagttgaattgcctagttctgacccctcgtgtgtttggacagaggaaaaccaaagaaaggaggtcgccctggagggagagacggcaagagaatacggccatcaaatgatccagatctggacgatgaagaggacttctaactcgacatgttgtaggcctagctcagtgatgatttaaccttgctagactcatgcttcgagtcattctttctgtattagaattttttttaatcttgtgttgcaatccatggcaagcaaagccttttccccagggagtagccttgctcatctagtatcttatcatcggcatttgcctgtgcttgcattttctttcttttcaacccacctcggcgttgtctgattgtctcccgttttgtaaagcagtagcaggttaattagacggtgataatttctgttaactctactgtaaacaacgttgctatagattccagactccagtgagacgaggatgagactccagcgagacgagaatctggattggccaattcttagtactagaaaaaaatgtctcatctgattataggtttttatattttgggacgtgtagttgctatcacaccggcacaccgccacgtttgcaagggccaaagtggagttgaatctgtgagttcacctgttgcattgcaagacaagctggaacttgtaatctcaaccattagattgcagggtgcctgaggttaatttgtgtacactttttttagtgtagctagcaaagactacaagtaatgctttttatattagtataggtgattagtctaagtacaatatgatggtgcaacacgcaggcatgcatgtctaaacagctgtgcttagcttcaagtatggaaatagcttgagcatcacttcttcaacaggttgcattgacaaatactccctccgtcccaaaataagtgcagttttgcactatttatctttaatttttgattgttcgtcttatttgaaaaaaaatttatgattactatttttattgttattagatgataaaacataaatagtactttatgtgtgactatttttaaaaaataattcataaatttttcaaataagacggacggtcaagcattggacactggtttccacgactgcacttattttgggatggaggtagtatttttcattttcaaaatcttaaatgcatttgtccatgaaaacatctttcttggaaaagatgtcagaagcttttatctaagaatctcgctgaatcatcatgtttaagtcgatcacatcagctgcatatatnnnnnnnnnnnnnnnnnnnnnnnnnnnnnnnnnnnnnnnnnnnnnnnnnnnnnn

SEQ ID NO: 7688 - DNA, 1182 bp, Oryza sativa
gcacaacaaagcgagttcatagattatgcttaactgttattttataaaatcgaaaagtccaatttagatattaataaactatatgtgatatggttatgcaatttaatgagttatttattgttccttgttttcctagaagatcacatagttgtctaatatattttttcctttttagcactagaataactattctgggatagtgttagctttaattttgacattcgttgataacgagttcacatcaaactggtaactttcctggaagaagttagaatgatataaaaaggacaatatccctctcctagataactttcaccttttttaaagaatagtgtttactcaatgacagttggtggtcaaacttcattgtaacactaccaccttgtctatatagcaaattaattcaactaaatatcaattgattttttttgctaaatagcattaactaatatatcactatccgaattgttctagatttctttatatagatcgagaaaaaatacgtgcgatcacatcacgagtacaatatgttaacacgccatttaaaatttcacctttgtcatcggctataactacctacacattaacacacacccttgcccccacagaagatcagggacagccagatagataatcctaacactgtccatgacactggcattcctgcgtgtggccccacacctgctcgacggtggggcccacaccttccgagagagaagtagcgtgagcacctcgaagaagcaaccacacccaagccaatcacagcgcctcatcctggccaagaagccaagagagtactcgcaatcacaaaaagaaattggattaatcagaagtttaatggaacaatgccccagctaacctgccatagtgccacctaatggtctcaggttggacaaaatccagcagccatgctggtattattgtttagttaacttgcatcattatattattatttgctatagtagaatactcttgtgatcttctccaagatttttattgctagagttttaaggagaggagaggagaggagggagaatacacaaatagggtgttgtactccaatgtgctggcatgaatggtacatctaccagcatgacagctcctctccttcccaagtgaccgtatgcattgccacatcgaatgtacgccatgtatgtctacattaagggagaagtcttgttg

SEQ ID NO: 7689 - DNA, 1288 bp, Oryza sativa
gaactgcatatcaagatcttggagtgttgaatatgcatttagaaatctctcaagtggtcttggtccaataacaagtaagggcttgtgaggtaccccttttaacaatttagacctcaaagcaagaactctagctacacctgtgtggtgatcagcatgaatatgggaaatccaaatacacttcaaacttttcacagcatcatcagcaccacttacaccaaacctataaagagaaagtgtcatgacgacaaatatgaaataacatgcatttctcaattacctaaagaagtatgtaagaactaaccttcttttcaattgccctaaggttccttcaccgcaatcaagaagtatacctccttgtgtaaacaggttaatatatatggaacttacgttccgatattttgaaggttgggatgaacccgtacccaaaaaggtaatttccatatcttctcttgttgcattctccacacagcaagggatatcaggagtgtcctttgggtgctttctccagccacttgctctcaatggagtgccatcttgtaacttacctgaattactattttcgtctacaaaattacaaacagaggaattctcagtaatccatggctcttcaaccatgagcatatgcttgccaactgaattactttgccagaacttgctaatctgttcaggaacttctttaatctctgggatctccgacaagagctcatctacaatatctccataagtagtaaggcttggtatagacgatctgtccagccccagttgagcatatggacgcagatgaaactgaaaaggagaacccactaatgtaataaacggcattgcactgaactaaagaaagtttaaccagcaactggtcacatagatgatgcaaaattcttatgatttatttatctctccttcctcctgtcagcttcatttttatgtagtatctttcatgagaagaatttctccttctcagcttctagattgtaattgtgtgccatagcatggcgtggaaaataattgcaaggtgcatatattcaagcccatgctcagagaatataagcaagaccagaactaacgtagggcaaaaagtaactgtctgtgcaaagatcatcaataaataatgaccaagacattcgtcacagcaggttattttacaattgcattgcatagaagggaaaaatctagtcatgctgctttaaaaaagatggtatagtgtggtaggttgacaccgtaaagttcgagacataaactattagtttgaatttcacatccatatttgaaaccatttcatcacaaagtc

SEQ ID NO: 7690 - DNA, 847 bp, Oryza sativa
agagtatgagaatggggcctctccatctccaatctcccttcctcctctggtcccctgcgcctcctaccccaccactcccaccttctcctccaagcaagacgcgccgcccaccaccgtcggcgtcttcctttttgcccccacctttccgtcccttgcgtcgggctgccattgccgccgccatgccctccaccgcccggcgccatccggttcccgctctgcatggcgcggcgacgatcccggcctcctccgtgtgccgttcggtgaggggacatttcgtcgagcacctgccgcacgtggaggggcgcgtgcccggtgacggtgagggcgcgttcgccggcgtcccgccggagatgctccctcccaagaagaggctgctgcggtaccacccgtacgcggcggcgtggacgatccaggagatggcgaaccatgccagggaacagggagggttcgggggcaagcggccggctgttcctactcctcccggcgtggaggaagacgacgggctgcgcgccgagctgcgccgcctccgcatctcgcggccggcgctggtgctgacgaagcggctgaccccgtcggaccgcagccgcgagaaggcccgcctcgtcctccccgaggggctggtcaggacgtcgccgctgctgggcatgctgacggcgggggagcgccacctggtactcacgggggacggcggcggcctccccgtcccggcgttcgaccgcctgggccgcgcctacgccatggcgctcaagcgcgaccgctccccgacctgccgctcctaccgcctcacggggcagtggtcgctgttcgcgtcgcgccacgccatgcacgacggcgacgccgtcgaggt

SEQ ID NO: 7691 - DNA, 716 bp, Oryza sativa
cagtaagagctaacatgcaagaaatgtacataagttggatataacttgtatgtgtgagacttctcttcctaaaacaaaatttaatgaaaaagattagaagtttagaacatgttaatagggtagtaggaagttttaaataagatccataacacgctttaaacttttactttctaattttagtgagagcatttgtttgacaaataaaatcttctaatagtaaatgcaatttgtatgtttctgcagaaggtgcttctccacagcctgttcataagaaacaattatctaaggcttcataaattgacaagcataagaaaagttagtaatctacaacccttaccagccaaaatccgctgacaacatgtgaatgtaacatatgtttaacaaagctaggatgctctgctggtaacttcgtttgaatctcttgagctctcttcatagcagatccacagaacgcctgaacactagatttttttggaagataactgcgtgtgattgaacaagcttgtgagctacataagtagtttttttcataagaagaacaaggagagctggaataccttgcacatttattttggcccttaactggcacctgttaagtcacaactcattcagttatgagtaatggagctcaaaagtgcaacggtttcgtatacattatacaggaattggaaaggaaatggtaaagtccactgaataaagaccggacctgtgttcca

SEQ ID NO: 7692 - DNA, 791 bp, Oryza sativa
  unsure (1)..(791): unsure at all n locations
cgaggaagctcgacggtggcaacggttgaagatcaggaggggaccggctcattgggaccacctgacaatttctgacgaggttcgcgcatccaaatgaggcttcgcgttcttctttcaggcacgacccacgccaagctagctcagaatctccgagctggtgaggcgagtccaaacgccaagtcaccgcactgtgaatggccttactagcgccggtgttgctagcacactagtgccaattgcaatacaggggtgcgacgtacagggacaaaccacacaggacctgaaggaggaggaataaactaatttctgttagtagttttgtatgggatccacccttttgttctagggagttgattttacccaatctaatggaaagagaaccattttcacaccttaaattttgtttaggattcccataaacagatattgggggtaagatttagccattctcttaggctgcgttcgggaggaggggttagaaaccccttctccctggcacacaaaacaaagcacgcgttgttgcataattaattaaagtaccgtattagctatttttttaaaaaaagattaatttgatttttttaagcaactttcatatggacattttgtaaaaaaatacaccgtttagcagtttgaaaagcgtgcgcgcgaaaaacgagagagaggggttgggaacttggagataagaacacaaccttatagcaagttcaatactatagccaactactaannnnnnnnnnnnnnnnnnnnnnnnnnnnnnnnnnnnnnnnnnnnnnnnnnnnnnnnnnnnn

SEQ ID NO: 7693 - DNA, 1823 bp, Oryza sativa
tgcacttgtgacctaatgaacttctcgtcacatttataacagaggccttgtttacagcgctctggtaactctgctggcgagagacaacgaaattggtgtcctggtgtgtcagccgccgtggttggtgatgaggttgcgccagtcatcggagttgacgccggggcaggagcgcgcgacgcgttttgtggcccttccgttcgtaggcacgagccaaggccatggcctcctggaaatcctcgggctgttggagctcgacatcgatgcagatgtcgtcggtgagccccgctgtgaagagctgaacttgttggcggtcggtgaggaggtcggacgtgcggctacccaacgccaaaaggcgctgctggtacgtcgtcaccgtgccaacctgagtgagatgcttgagttcacccagggaattgttgcggatcggcggtccatactgaccgtaacagagctgcttgaacgtatcccaatccggaggacccatgtgctgctcataatggaagtaccattcctgtgcagctcaagtgagatggtatgtggccatccagacacgatccgtgtccggcgtatgttgccttcaaaagaactgctcacaatgattaatccaattgagcggatcatcggtgcgatcaaacttgggaaactccaatttgtgaaaaggaggaacggcgccaccggaattggtgtcgtgcaccgagccggttccagtcgacggcggaggtggtggtggtggcggcaggcaagatgccgctgccgcccaggcgaggcgcggacaaggtggtggaggactgctcgagggccgtgatgtgcgaagtggccacgcgacggaacgactgaggtcggcgaggtcgcttttggaagccaatagcgaaatgctgctcaacacatccgccatggactcctagagcttggccagtgcatcagcactaggggatggctgcttggaggaagaagtttcctcaagaaccatggtctatgataccaagttgttacgagcaccagcaagcgaacgaagtgggtatgaatgggacacaggaggtcgaggcttcggtagcctcttcgacgccctgccagtggtggcaatttaggagaaacaggggatgagatagagaagtggagatgagaagtatagattcaatcttgcttgcctttaactatagattcgtggctctaaatagccttacatccaaactgactttttaacaaactcgaactaattgctagcaatttgcgtggtactgttcctcatccggcacgacatcagctggtcgcttcctcgcttgctttgcctcgtcctttgccgcgtcgcttcctcaaataggtgatcctgaccttgacagtataatatggagaaattgtaatggagtaatccacttaaagcattgactgaaccgacgaattgatacatgacttcaattgtcacaattaatgctcttgaagtattttcagttactcattattttttctgtgacatggactgcactactgcagtcagtttgaccaaatgataattaatctggcctgagcacagtggtttcaaatctaggttgaatttcatatttacattgtgattttctatttgacttgaagcagaccaggaaacgtccatcaactgattttatggaaacaatccaaaaggatgtaaacccaagcatgagagcgatcctgatagactggcttgtggaagtaagcttttataccaaacatttttttagttgattggagcctaaagaccacactcgttacttaccactgtatttgtgcttttcctttgtgcaggtcgctgaagaatatcgtcttgttcctgatacattatacctgac

SEQ ID NO: 7694 - DNA, 3469 bp, Oryza sativa
agcattgcatcttgagttcctagccaattatgttgctgagctatcactgctggagtacaatctactttcttaccctccttcactagtagcggcatcggctattttcttggccaaattcatactgcagccaacaaagcacccttgggtaagtggtggcatcatcgtattgaactttccatacatcttttatatcagcattcaaataaaaaaattacaagagctaacatatgcttctcattgtaaatttgaagcagaattccacccttgctcactacacacaatacaagtcgtcagagttaagcgactgtgtaaaggcattgcaccgcctttttagcgttggtcccgggagtaaccttcctgcaatcagggagaagtatacccaacataaggtataaacggcatatcctccccatttcttcagttatctgtactgttgctaatgctgatctcctatacctttgttacctttgtttctgcagtacaaatttgtggcgaagaagcactgcccgccctcagtaccatccgaattctttcgcgatgcgacgtgctgaattagaaaaaaaaacaggattagttacagttgctgactgaattcttcctccagaggcatgctgattgcccccctgttctttcaggtggtttggccgagtgtagattctaagatcgatgctgcagctgtgtgtggtaacttttatggtactgatgttctttcttctttctcctcctgttcttttacctgtacctagtagatctatggttttcagtacattgtacatcttgtttgtaatggcatgattcttggaaatattagctgccaatctgacctgggcgtctcccaggttgatgtatgagggagtctctgttcgtgttgctcttgtgaaattcccaataagagcaccacattttttaatagtgctcattctgaataagttattgatcatgtccttgctatcaagtgctagcgttcttgatgtttttagtcaaaaggaatatttggacgaattgcttctcatcttctacacatatcggctttactttttcttttttcaacttgttctgttcttctgttgacagatactgcatgcagctgatgtgatcgacttgaacatggtgattcagcgagaagcttagtagatcattgtatctggacatatctttgccaagaaaaaaatatgtttttataggcaaatgcatttaagaatgtgaaaatattatgtcaatgtccctgtcaatgcaaccttcttgaagaagtcatgctcaagctatttccatactggaagctaagcacagctgtttagacgtgcatacctacgtgtagcacaatcatattgtacttagaactaattaatcatagggaaaaaaaatgtaatctacagagatcgtgccaactgtgcctttagcaaagcacggttagcaacgacaggtatatatcgcctctcttccagttgttattatggcagctaactaattggcctggagggttcgagaagattgcgttgcatgttcaccacagcaatattttgaacttgcatgattgatttgaattaatttgagccttgatgggttcataagcatgattggttcatgtatttattagttcctgtatttttcatgatctgtggttaagggtcattgtgtatatatgcgtgtacttcactgcttacctaagagaatatttgcatgtattttgtatattcgttggaaaacaatagctagcctactaaacttttgtgttttagcagaagtagttggacatagatgctcagggggtgtcactgtttataagaattttattagtgtaaaagcaactaacactattctttatgttgtgaaatatttgtaagaaattgtgattgcatgattcctagatcactgtgatcacttcatacgtacaaaggaaatatgattacaaatgtatcttcaatcattgtaagatggtgctcctaaatcgggtggcttgaataattaatatcaagtgttccagaataaatagttgtacaattaggaatacatgtacaatgcattttttttgtgggggcagatgattacatatgattgatattctattgccaagaattttagggtgtgaataagtgttttcttggcaaatgccatttgcatgtcccattgccatggcaaatgcgctggcacaaagaggaaggaccttaatatttctcctcacgaaaaatccctgcaatttctcttttaattatgaggaaattgcaatttctgtcctcaagaaagcaacaaaaaaacttactatttggatggatggttggttatcctgaataataacctgatttgattgtagtgacacaaacagcatttgcaaggaaagttttattcagttggtattaaacaaactaaatcttagctcatcagttgagtgttcagttatcacaagtaacttgacctggaaaatttgattcctggggctccctggttatctttttcaggaagccatttctgacctaattaatttgtgtgcaggaaacagagtagaagtacaccaccattgttgcttgtgtgctgcacacactcaagcatagcttgctgactagaactaaaaaatgcttaaaaaaataattttcgagctaagaattggtgtgttgattgaggtatatgcatcagttagctggtctcgttacctggctcataaacaggtgacagcaaatgagggctgtcatgtgacaagtggatacgaattttaaaattatttaggacaatagagaatggcctacgtttttgttttgttttctttcatttcttttcatggtagttatcagtattattagactaactcggcagtttgtcattcaaaatacaacaaacattggttttaaaaattttgagtcttgtgaattctgtataaaacattttattcgtgcttataaaattcataaaagaaattcttacatccccaaaagatcactctagacacgcatgcttcttctacttcttcttcttcttcttattgacgagtgtggaagttctcaccatttaccataatttgcgagaatcacttaagaaatactttgctataatttgcaacacattgctatagtttgcaagaatcacttaggagtacaagagaacacaacaagacttctcccttaatgtagacatacatggcgtacattcgatgtggcaatgcatacggtcacttgggaaggagaggagctgtcatgctggtagatgtaccattcatgccagcacattggagtacaacaccctatttgtgtattctccctcctctcctctcctctccttaaaactctagcaataaaaatcttggagaagatcacaagagtattctactatagcaaataataatataatgatgcaagttaactaaacaataataccagcatggctgctggattttgtccaacctgagaccattaggtggcactatggcaggttagctggggcattgttccattaaacttctgattaatccaatttcttt

SEQ ID NO: 7695 - DNA, 11353 bp, Oryza sativa
  unsure (1)..(11353): unsure at all n locations
nnnnnnnnnnnnnnnnnnnnnnnnnnnnnnnnnnnnnnnnnnnnnnnnnnnnnnnnntaatttgctatatagacaaggtggtagtgttacaatgaagtttgaccaccaactgtcattgagtaaacactattctttaaaaaaggtgaaagttatctaggagagggatattgtcctttttatatcattctaacttcttccaggaaagttaccagtttgatgtgaactcgttatcaacgaatgtcaaaattaaagctaacactatcccagaatagttattctagtgctaaaaaggaaaaaatatattagacaactatgtgatcttctaggaaaacaaggaacaataaataactcattaaattgcataaccatatcacatatagtttattaatatctaaattggacttttcgattttataaaataacagttaagcataatctatgaactcgcttggttgtgctagctatgggcaataccaatagctaagccaagccaaatttcttctagcaataatagggcggctgcactagccggctagccctatatttttgctaatttttccttatgtctttttttttgcaaataaattacttaaattaaaggggtgttcgataatgttagatgtgattaatttacaacctacagctacagtaaaaacaagaggatctatggtggcagctgcagctacggctgtacaattgcaatgtagcatagccgaacatcctctttgtaattttattggcatccattcagttgataaagaccacagagtcatagtaacacagaggatcctagcaaaaatactcttcctctttctctcccctccagcgcagcttgcaagcctccacgacccaccatcatgtcatccgtggcttaatgacaccccttccataatcttctccattttgacacttatgcccctgccacctcactgcaaccatggtgtcatctgcaggggtagacatgtaaatctctcccaagttcagggtggctttctggccagcccattatatatcactctcatggcaaggtggctcctgtactactctgcccattgataggctgctggtgatcacaagctacacaacacatcacacaagcaataggcatctctctcttctttctctttctcctccttgcttcatgtaagcttcttcttctctagcttactttgatcatttccatggtttcatgcatgcatgtttagtttcatgatatatatgaaatatcctatggatttttgttctgtactttttttaagaaggggtttttgttatggattttttattgctgttggacagttggagtactagagattaatttcttgaaggagagaaatgacaagtgtctggaagaccaaggttctcactggactcaacaagctctttgacaaggatggaaagaaggctgctgctgctgagttcttgaaatcattcaacaaggtagctacgaattcatacacagagacacttgaaagttgtaagtatagtttgtgtttattttcacaattttttttattgattgggtgtcatatgtatttgtgtaggaggagattggcaaggagattgatgacaagaagacagagctagagcccaaggttgtggaggttgttgagtcatctcctcctgagattaaggtaataatttttcaggtgtttcataggttgcttgaggacatccttgctcaagaaataataatttgcatgcttatctgtaaaaatattgcaggctttgttgaaggacaaaaaaacagccagcaaaatcaagaagaacggtcctgcagtcactaagttccttgaggaattggctaagattggtaagaattggctaagttctaattggcttgtatttgattgcatggggtattgactagaataatcacaatatgtaacttgtcccctttttttatattttcgttcaaaaatgcatttttaatgaaaataaagaacctttatcacttatttccaaaatgaatcgtaacataaaaaatgagttatttttttaaaaaataatttaggtgtcatttatgaatcacctttttttcccttaaaaaatagtagaatccgtagtttcttttagcaatcatgtttattcattttcttatgtttttattcgatagagacctatactatttgccctctgagcaacaatctagactttattccctcttgctagaaaattgaacttcagaggaatcttctcgtctaccatgtttccttgaacagaatctcacatgcaaactccgtttctttagctgacgcagacaagaggccaaaccagtcgaacaaaaaacaaacgaaactaacacagtttttttttattaaacttcagccacttatttttccaatcatatataaaaaccaatccttttatagtggattaattttatagtcttaagaggtattgggaggcatcaatatttttaatacaagttttggtacctcctaatactggaggtatagaaaggtattaaattttacattaagaaatatcggtaaaatcaattttttatatatctgaaaatatttgaacatgtctgttcctgaatagacatatttgctcgttaggtagtcctaaaaattatataatttttatgcaaacaataaaagatattttaaatttccattaatatttttacaatgaaactaatgcaatcctctttttttttttcagatttccccggagccaagccggtgagcgacgcggtggccaagtccggcacgacgccgctctccccggcgatcgccttcatcctggagaaggtcgcgcctttcgttcccaaggaggagcccaagcccgagccggaggcggaggcggcggcggagaccacctcccgggaagtcgccgtggaggaggagaagaaggaggaggaggcggcccccgccgagcccgccgccgccgccgcggaggcggcggcgccgtcgacggaggtggtggaggagaagaaggaggaggagaagccagcggaggcggcggcgccggcggctgagccggagaagcagtagtgatcactccagaagcaagcaaagctaagctagcttagctaagcttagctgatggtaattaaaatcaagattaaggttaatgtgatcacactactctctctcagtctctgcacaaaaagtaagtaaaaatcaagatacacacacttggcatgcaagaacatttgttattgaattctttcaccctttgatcctttcatctctctcctatatatatatatggtcgcctcatcggttgtaaattaatttatgtggggtttcttgttttttgggggtgattaaacatgtgtaattatattcatatgtttgttggtcatgatcataaggagcttgtgtatattatccatatctttttttttcttttgtttacaaattttcggcttgaggtgtgatgaagatagacatatatatgcaccctctccaattgtaatacaaattaatggctgtggatatatgttcatatggtacagtttgttgttgttgatccattggttaccttggggggagaaaatctttgcttacatgtcgtgatcaacttaatttgattgcgtatacatactacgtaaacaaaaatatggataggtgggaaggacatgtctggcctttgcaattaattgttccatgagtgataccatgtatgatatgcatcttctcgtacatactagtacgtacttcatctgacgtttggagcaatattcaatcaaatttgtagaattttgaccatcaaatctaatgatattatgatgccaaggcaaatctaactcaaacatttggaaaattattgatagtcaaagctttaaaagtgtaactaaatcttatcctaaatgtttaattcggatctatagaatcttatcctaaattcggggtaaaggcattatctagaaaattgccacacatatagattgttgttctgccggccaataaattaatttgaccatggtatatgtataaaatctagtaacaaaagtgtatttctcaaatatcaatattacacatatatatcccatatttatgtatcaaacgtttatacataaataaagtccaccaatattcttttaggaaaacatcaacgcgtcatatagaaaaaaaaatcaaagcttgaacattggacttcaaagctactggacctaagtaatgacatcaccttgatatatatatatatatatatatatatatatatccaaacttttcctcacaagataagcacgaggaataatataaattcagtgacaaataagctgggcactactactactgctgcatgtgtaccaaatcatggcacggaagcttaattatttagagataattacttaggaacctgaagcaagcaagcaagcaagcaaactgagccagatatcaatcagtgccacggcgaaaacgacgtgagcttgatcctaatcacgctctgcttcttcaatcgatcgtcactgcacgcatatctttaaaggggaaaaagagagagagagagagagagagagagagagagagagagagagagagagagagagagagagagagagagagagattgagaggggagttctaaaaagaaaagagttcttaaaaaaagattgaaagggagaattaattaattaattcaacaaaaagagaggacagagagtgagggctcaaaaagaaattaagaaaaggaggagtaaagatgttgattgatatttaagttttgccttgatattttcttttgttgtttaggacaggggcaaagtagtcatttcagctctttaattttttttcccttctaataccttgggcgctttgtcgctgttttagttcatcactcaagcttgcatcacaaggtccacacacatggagtacttcaatgacaatataccctgtcgccaggaatgtcaccgtgaaaaataggctcatagtatgattaaatctagctagattattcatctattggcttaattaattgggatttattcactttttacctatgaaataacttcttgttgattcgcttcgtctggttctatttactgagagttaggctgtgtttggaagtattgtttaggtgggctaattctcttttttcaccgttaacatgctttccaaactacttaaaaagtgtatttcgtaaaaagctttctatatagtttttttaatcaaataaattaatttttttcaagtctgtagtagttgataattgatcacgtgtttttcctagtagttacatataccaagttcgtttagctagaacggattagctgcaaccgagcttgaacataaacagataaatacaattgcttacagctgaatgaattgcacaagaatgatgtggctatttttaagtttatgcactcggtagaaaaaatgggaaagattcataggaatctaaaccatagggaaagctggttgtcaaaggcacaatacataataaaccatgggagctagattccttccattggtcgttttcggaaaggataggtttttgataaagacaaacaggggatggaatattctttttagtggtatttaccttttctttgactcgctttagtttgtctttatataatttgtatgatcatattatctattatctagggagtaaataccataaaaatatatttcctaaagaaagtgtattatagaaaaaaaaactaactcgacacatatactctttacaagttatagagcatgctgcttagaaaatatctaccatacaacactatcgagttagtgagaggaactatttctacatacagttggaaaaggaattgaagaagatatttccatgttttttccctaatattagctagtgcaaacaattcttttaagataaaactgatctcatgttatcatttctttttggagtttagttggacaagttacatagagttgtcttgaatgattgtgatgtgttggtggttggtctggtggtttagccaagccaggaagtccagggggggcacagggctaggagaccaggaccaccataagtatggctcaagaatagagattgatggttcccaggcctaattacctcatgatgataaattgaatatttgaatttactagttatcattacaattatgaatttcaaatctcactgattgtccatatctcctttttattaaaaaaaaacttagaaannnnnnnnnnnnnnnnnnnnnnnnnnnnnnnnnnnnnnnnnnnctaaaagaaatgacaaatttgttgtatgtaaattagaacaatctgaaaattactgaaggtggcatccggtattcagatcacgcctcctttaccgaccaaccaaacaggcaccaagaacagggtgcactgaatgacggagtctgaaataattaagtagtgttctgcatttcttcctcgcatttcctgcactgcttacagcgcattcgccccccaaaatttacaacttctgttatacgatttaccgtgtaaaaacagcatcctgattcctagacaggtttgctgctgaacagttctagataggcactgagctgcgtggtagtaactgaagaaatgtacacaaaaatgtggtcagtccttgagtttagcaggattcaccactcagtcactcaccacgaaggtttcccagtgcatcatcatcatcatcatcatctgaaaccctgaatgacgaacccaaaatgtttcagacaagtaccccagatgtcaagcaggatcaccatggcgcagtggcgatcttccgcagcgcaatgtcatggttcctcacgctcgactccatctcctccatctcggcatcgatcttcttcagcacatccttcactgtcaacatcatggactccagagccttcaccttctccccagcacgagaccgctcaagcttcagctcattgtacttgctacactccgatggatccctcggttgctcggggaggccgagaatatcgtcaacgcgcttgagcaagaacgcaacattcattcccagcaggtcgaatgactgcagcgtcttcttccagatcaggaagtcctcttgcgaggaggtacccgccccgcaggccctgatgccctcagcgatgttgatcgtctccatgatcacccccacgacgagcgtgaggctcagctgcctcagcagatgcctgtggaggaacgacttctgggcgcagcacagctcatagtacgtcctgcgctggtgatcggggaacttgcagtcaatgaccaagccgtccacgacgatgttgaagttactgtagctcatcacgtcgtcaaagctcatctctgagtctgaaaacctgatgccgtctattgcttcatgaactagattctgggtatcatcatgagccactttgctactgactctagtagtctctggatcctccttaggcttggtggcattatcagtagcttcttctgtcatgtagaacacagcacatgattcgggagattcaatagttagtgtatattcccatgtctaacacatttcaaggtgcaaaactaacaacataaactttgactcactagatatcttccgtttcttgcaggcgtaaaaactcttgagaccgggtgctctgtcagttgggctgatgtttttatctctaattatatgcacctgaatgtaaggcatgaagaaacaagaggtaattgtattgttggattagggaagactgaacccacaagggaactcaagaaatgggtatgaatgaagattataaaggaacaatcaagtagtagtagtagatttggaagaaagttatcaagcatttcagaaacacttgccttgaattttgttgtgctcacaagctcaaagaccacaacatcgccaaccttgatatcatggttaatcgcaaaacctctccatccagcactgagtccctgcttaccacccaggtaatttgtgttatggttgttcccattctcatcttcgagcacaatgtcagtgtcatgctttgggagatacttgttgcagaagccagctggtagaccctgcagaggagaacaataatcagatgcagagaaaaccaaaaagaagtttctaggtggcttgtgcagaactagtgtcagccattttcataaacacaataactcaagcagtaagagctaacatgcaagaaatgtacataagttggatataacttgtatgtgtgagacttctcttcctaaaacaaaatttaatgaaaaagattagaagtttagaacatgttaatagggtagtaggaagttttaaataagatccataacacgctttaaacttttactttctaattttagtgagagcatttgtttgacaaataaaatcttctaatagtaaatgcaatttgtatgtttctgcagaaggtgcttctccacagcctgttcataagaaacaattatctaaggcttcataaattgacaagcataagaaaagttagtaatctacaacccttaccagccaaaatccgctgacaacatgggaatgtaacatatgttcgacaaagctaggatgctctgctggtaacttcgtttgaatctcttgagctctcttcatagcagatccacagaacgcctgaacactagatttttttggaagataactgcgtgtgattgaacaagcttgtgagctacataagtagtttttttcataagaagaacaaggagagctggaataccttgcacatttattttggcccttaactggcacctgttaagtcacaactcattcagttatgagtaatggagctcaaaagtgcaacggtttcgtatacattatacaggaattggaaaggaaatggtaaagtccactgaataaagattggagatgtgttccaggattacattatgtgatctttttttttcgaattggaaaaccggagatttcagccagccaatcgaaatcctaaatgctatggcttatgatataaaaatctttaggggtattatgagctttatagatgaaaactgaaagtcctcttacaattacattcatactgcattcatacaatacagatagagttggtgaacatatcttacttcagtggtgttagtgcgtccattgctagtgttctgggtattgcatgtttgaggaatgccaggaaccgttctttgctcattttccacctcctttggcatcagcatcttgcacagtaagaaatccaagaaaaatcagaacacttaatcaataagttgtttttgagatgagaattaataaatgaagttatgagataacaaggaggacagatattgtgagtttgtgcaattgaaaatattgttgctacatagagtgctatcaatgatgtagcatcattgacagggatgctctaaatagagcacatgtagtttatatcatataaacttacaccattgtaaacagataatcatataaagggaaaagtctatttgtcccttgaggagacatccccttgttttgtgcatgtcgcccaaaacatcataaaaaagtttaagaagatttgacattatagatcaatatgtgacacgatagaacaaaacacactatttgtaatcaaatttattgtttttgtttttctacttgtataggtcgaatttgaacttgcatgtttgtgaagagatattttacatattgatctatcttatgttttcaattttttatgactttttgaacaacatgcacaaaacaaggggatgtcttctcgagtgacaaaattccacccgctaactaaagcagcactgcccttactttcaaaggaacaacctccatcacgtcatccgtatcatcttcatcacaatcaattattatagcctgtggagcaacaacaaaagcaagattataattctgcaagtacaaaaagaacatatattcttgatatcatggtaaatacatgattcttataatggcatagatccaattaacccttgattattataggggctaccagatgttaatgagcattaacagaaaaaagaaacataagctagaaataccccctcctttccataattcaaggtcttttagttttgtcctaagtcaaaacttctctcattcgatcaagtttatagagaaatatattaacatctatagtactttatagacctggataaaattcacagttaacacataaagtgaccatttaagcaaatacagcatctgataatttgtcatgacttacctgttcagagttacaaaatttgtgaacctacgggaaactctttttaatccctctttcttgtatgtcatccaaatagttatgaaaaaaatttgataagatactacctccgtcccaaaatgtaacagcttttggctatgaatctagacacacagttgtccatattcatagctaaaaatgcttatattttgggacaaagggagtagattaatatgtgatatgtcacttcataaacatgcaagaacgagcggatagaatccagattgtgaagtgacatatcaacatacagatgtgctgcgatacatgaattattcagggtagcatttaagtagaagtagataatattatcaaattaagaatccagattgggcatacacccaagtattgtagtatatgcctctcccattttttccagttagaacctgtcctgatttgaatgccttgcaacaacaacaatgtatgtatcgcatcaatgggaaatgataatgcaagaatctcaccctcggcccaatatcgtcatccctgtcgctgccactgctgctgtcaagtaaggcgagcctttgatggactagttccatcttctgctccatcttgttcttcgtgttcttggaacctggtggtctccctctcttctgctcaagaacaaccaaccaaaggacaagcgaattagattcagattacccatggaagtaaacaccaatatttcagtcattaaacagaaaacaaaaatcgtatccaagaacgagcagtacaaccaaattgatcaaagaggaagcaaaatctccaagaagatcacagataaccatataacatagctgaaatatcagatcactccgtcatccgaaaaaaaaagcatggggaaattttcaagaacacgtctctctctcacacacacagaacactctcttcagtctcccactcggatcgaagaatcaaaacaagaaaagcagctaagaagatgaaatctaacacaaaagacaaaaacttttagcccccaaatccgccgccattaatcgatgattcaagagagagtggaacaaatcaaagaaccctcggtctctaatcaaccggatgaacagtgaataagcgaagcaaatgacccccaaaaaaactgggtttaatcgagaaacgagagatacagatagagagggagaggaaagaacttgctttgatgggctgatctatcgccatcggccggcggccctcgggttgatctctccgaactcccgctcacctcgattccgaagtttgtgggggctttgaggttttgaaatgtgaacgggaaggagaggaacgagccggctcttcagct

SEQ ID NO: 7696 - DNA, 16076 bp, Oryza sativa
ttagggcctgtttagttcgcgaaaaggaaatttttgggtatcacatcagacgaccggaagtcggaaggagtttttggatacgaatgaaaaaactaatttcataacttgcctggaaaccgcgagacgaatcttttgagactaattaatccgtcattagcatatgtagattactgtgacacttacggctaatcatggactaattaggctaaaaaaatttgtctcatgatttcttccctaactgcacaattagtttttaaattgatctatatttaatactccgtgtatgagtctaaaaattcaatgtgatgtttttgggaaaaaaattagaactaaacagggtcttagacactaattagaagtattaaatatagactaattataaagcttattctataaccctacactaatttgcgagacgaatttattgagcctgattaatctataattagcctatgtgatgatacagtaaacgtgtgctaattagcatatgagatgaatttattaagcataattaatccgtcattagcaaatgtctactgtagcaccatattatcaaatcatggagcaattaagcttaaaagatttatctcgcaatttacacgtaatctatataattagttatatttttaagcctaggtcttgtttagatccaaaaaattttggccaaaaacgtcacatcaaatgtttggacacatatgtcgacgtttgagaccgcgacaacggtattttgcatagtatatggatcgttggtaccagggtatatgcgagattgaagtaaaagagacggagacaagggtttttatacaggttcgggccccttatctgacaggtaatagccttacatcctgttggccgaagccggtattgctcttattcatcataatcacaccaatacaataattaggataacctatctagctgtcgtcgacttggcggcatggataaccaactcgtagtcgacgacagggtagccttcctcctcaaatccgcactcggcgagatcagagatagcgctagatccctcttgttggctttcgcagacacaatattgggtttgtctagacttatctttgatgtcgatattcggcggtttgtcttggcatgtgttggcttgtattcatctatgttgatcttggtcttgtggcttaacccctctcctcctagggggtcttgtatttatactcatagatgccctcttgtccaaatagaactagggagataagcatggatacgatccgagtagtccttttcgtttccatatacaactctatttgcttccttatccagaactccttctatatacgaggtatgattccgtatgagacttggtatatggtgggtcctatcgtgcttagtcaactattattaggtatgtggtacccataaccctgataacatgcataaggcattaaatgtgggaaacaaaaccaattgcacagtttgcatgtaaattgcaagacgaatcttttaaacctaattacgccatgatttaacaatgtgatgctacagtaaacatttgctaatgacagattgattaggcttagtaaattcgtctcgcagtttacaggcggaatctgtaatttgttttgttatcctatatacctatacaagtgatccccactaactgcagttattaccaattctctgcactgtggttgatccacgtcatccaaaaagatagcagccgttggatgaaatctcaatggtatgatatcaatgcatatgttatcctggtgagaacacccaagtattacacacgaaaagcccatttgacagcccaacaacccaaccttttgccttccccaagctgttcgctccccttccccacgtagatgcggcgccgcatggttccccttcccctgcgctgcttcccctccacccgctcaactccctccctccctccctcactccctccccgtgcgtcggttcccttacctggccagcagtacaccagggagctcctcactcccataggctgtggctccctggtgagtattttactgctaatccgttttttaattcctgtaattgacggttatggaatggcgttggttggaaatattttcagatgtccctgtcatatgttaaacggaatggctgaatgatgatcatattataaggatggatctttctatatccttcaaccctgttgttgtcatcaaatggtggctttttcatgttaagagcgaattcaaggtggactggtgttttttcataattcgtaagagctggtaattatcacctcaaatttgttcatttttatgttggtttcttaatcgtattgaaatagttaaattttacttataccttcacactatcatctttgagtcactttgtctcatgtggccatgacctttgattatagaaggtcaccaacggtcaatggtggcctgattgagtttgcagttttatgtatatgtatatatcaccaacaaaaatgtcgttacaatgaaacagatggatggttggttcagtatatttcttttttttaacaaagaattaatagttcagttttacccgagtgtcagatttattactcaatacaattcttataaaaaaatcctttagttaattgtcttgcgcactgcacatactaccaacatttggcaatttatattggtatttcctttgtattcacaccacaataattcgtgtagttgctactgtctaatttgttatactccgatgcagagttatattttatctaatgttatattttattttcctattactatttactagaatatgcaagggaaagaggaatcaataattaaaatattgatatggcaacttgcttcttgctggtgaataaacacttgaacaattctagcagctaacttaggtgcggtcaatcacagaatatttgttattgatcatatagtttcttgcaaatattcctaattgattgtgttgtaagcctaaagattgtatttactttttatttaattcagtatgcctttcatgctatactgcgcaaattgtgttgtaagcctaaaattctattcactttttttttaattcagtatgcctttcatgctatactgtgcaccactaaaaagcacgtcatagtttagattttaatagtaccgtgacgagcagaactgttgcacgttgcattcgttttgcatagcaacaaaacaagcatgtggtttctgttagtctattgatttattttttttgtcttttgtctctgctaatgttttatttgttgctcccatgtctcaaaatagatgtcctcttatagaaggttcaatcaagtgatgctcacgcaactaatatttttatttcctaattctctatatctgtacaatttcactctttttcgatatgatttaaattatgttctccagttaaattggatggtttatgggtcgcatttaactttgtccatattttcagtattatgcatcacacgaatgcaatatatactgatgtatgctatatatgatatctaactgatatagttcttaaaggtacaaatatgatttatctttatatttttctcaatgaatcctttgcaatcccgtagcaatgcgcggggtatcatctagttagtctacgtttaatactttaaatgtgcgttcgtacacttcaaaaacattacacccaaaaaactaaacacaccctatatttaataattcatgcaggtgttcaagtattcgatgtgacagggtgtaaaattttgaggtgggatctaaacggggcctacttttattttcgctaaatctgtttttatatcccctgtacttcctccgtccaaaaaaaaactcaaccaattatttagatgggacataatctagtacaacgaatatgggtagacgtacttcctccgtccaaaaaaactcaacctggacataatctagtacaacgaatctgggcaggctctatccagattcgttgtattccctccgtcctattttaagcgtagccatgattttccgtgttcaactttgatcgtccgtcttatttaaaaaattttagaaatataagtcacacataaagtactatttacgttttatcatctcataacaataaaaatactaattataaaaagttttcaaataagacggacgatcaaaattagacacgaaaattcatggttacacttaaaagggatggagggagtactaaattatgtcacatctaagtggtaggttgggtgtttttaggacggagggagtacacgcagaaagaagacaaggtattcacgtgcgtcacacatatttgacaagtctgggggtgtcacgtaggctagggttatggatgatccaaaatctgaattcttgatagtgcaagtggctatatgtaatattttagccactaaaattttttgtttcagttcttaattttttttgtttcgattcagctttgctgctgctgcacagccgcagcactgcaacagctccaattcaaaaatatgttattgatactgtagatgcagcacagttgcagccgtagccaactataccaatcaagcctagggtgatgcggagctcgctggtatggatctggtggtagacgacctcgagctcctctccgatggcgcggatctggccggtggccggatgctacaaggggaaatcgaccctgaggtcgatggccggcgacatggtggagtggcctcggcggcgagtggacatcgaacagcgaggctttttcctcctttcttcggccctcacctcctcccccgtctggcggccctcctccctggttgctggctggaagcacggggctatgcctctcgcaatgcgctgtgtgggctgttcttcgccccatctcacgaatctccgacggtttctgacaaagaacccgtggtgtacttaggctccgagttctttagtttgtaatacattacgttatttgaataaactttttataaaaaatttatttaaaaatcattatattaatccattttcaagtttaaaaaattaatacttaattagttacgcactaatagcttatctcgttttgtgtatcttctcaattttctcaattcctctcttcttaaacagagtcttagggctcctttgaatcgtatgaatgaaaagaatagaggaataggaaaaacactgcaattaccatttgattggactgcaggaaaaagcacatgaataggatgagagatatacaccgtgtttagatcccaattttttctttaaactttcaactttttccatcacatcaaactttcctactcacataaacttccaacttttccgtcacatcattccaatttcaactaaacttccaattttggcgtgaactaaacacagccatagactcaaagaaagttttccaataggttgaaactcttactaaattttctccgaaatctttataggatggttaattccataggaatatcaaaggataggatatgatttaatcatttatttcaaatgtctccatatgaatctttttctataagataaaatcctccaaaattcctatggttctcctacaaatcaaaagacccttaaaatatctaataccactgtatttattcaagtgatcaggaaaaaaatgtctttgggttagtatatcttaatattagcacgcatgaaaatattcggggataaaatagagtcgacctgcaggcatgcgaacttttcaaaaagtattactgatctaaaaggacccgttagctgtactgcaaacttgggaagcaccgttttgaaatggatgtgatggagacagggagtacagggagttatgaaaaaaaaaatcatgttttctcgatctttttattttgtaggatttgaactagattcccactattactattagtgagatagagatacgactccaccattgaacttattaagacttttgtttataaattatataatccaaaaggctaacaacttaagcctaatgccttgtttgcctaatgtgttagggaaatgatttttcacccaccaaaagacatctttaaatcctaaccatttattctccctcttccatttaattataaccattcattcatttttcactcccaatcccactcctcatttcccattatccaaacataccctaaaagattagataccattagagacgaaaatttacttatggattttccaattaaaatcacagaggctttggaacacagtactccaagtccgaatgaaacatattcctccacgtgactcaaacaccagcacatcagggcaagtactataatgctttatatgttgctcctacaagtgccacattggattaagtgatgaggtggaggagaaaagtgaagagagagatgatgagccacccctaaattaagaggcaacctccacacaaatttcaaaaaggatgtgagagtattagatatattggtatttgtaaactagaggtgatacattgtatgggttgcctcttgctttatgagtgaataaaatagataaatttggagacaatagtcatatctatcatagcacttaccctcatgcttatgggcctggattgaggctcattcaaacaggcctaaattcaactgcgccagaaggacaggtagcccagccagaaccgtttgtgttcaccggatcatatctgggccttttgccagaatcccagctgaaatttctgtcggtttccatcagtagaaaaacaaacccaaaaaaagagaaggtaaatctttgtcgcatctcgccatgtaaaaaaaagtactccgtactctataatctttttttatagggatggattacattagcagcaaaaggcttgttttggttactactactacgcatcacgcccagaacgtcgcgagatcgcccatagaattatccctatacgtggacacgtagggcctatctttttcccgtaatataccgtatggctactaatatactccctccgttttaaaatatttgacaccgttaatttcttagcacatgtttgactgttcgtcttattaaaaaaatttgtgaaatatgttaaactatatgtgtacatgaaagtatatttaacaatgaatcaaattatatgaaaagaataaataattacttaaatattttgaataaatattttgaataagacgaatggtcaaacatgtattaaaaaatcaatggtgtcaaatattttgaaacggagggagtactccgtactaagatttccatagagatagggtctacttcctctattgtatattataaattctttaatttttttctagtcaaattttattaaatctgatcaagtttatattaaaatttagcaacatctaaaatatcaaattagttttattttaataatttataaataaatttttatgtatatatttttagcaatttagaaactaatgataagaaataaacttggatgaaaaattaaaaacggaaataaattttgatttcatgcaagggaaacaccggtgaggccgtggcgtggccgtagcggtcgtctgattgggggaaagcgccagacttccttttctgccgaacgagacgtcgcgtgccgatacggctggggccacactccggtacacgtacacgacgagacgacgtccgtgcgacgcagcggcggagagatactagtaggagtagtactacacttttgcttggttcttttcctcgcggggcacgcaagggtgcggtccaccccctcctcgcggccattgcgcctctctctctcgccgaagtggtagaggcaacgcagcagcagcagcagcagcaagtgtccctgtgtccgtctccgcttctcctcctgcctcctgcagtctcgtctccaccgactgcaactaaaaccctcctcctccggcccctctcaactgcagagcgcgaccaccacctcagacaaacccgaggttttcttcttcttcttcttcttgatcgatgcagccagcagccatcgttcttgcggggaaagggttcttttttcgttttcttttttttttgtggctgctgatcggggattatcaccaccttcgcgcgatctctcgtttttttctctgtggaattgggggtggtggatggatggttgatactcctgttcatagatggcgatggtccaagtttattccttttttatttttattttttttcggatttgttctgttgctgtagttgccgtttcttggcttcttgctttcaatgccttctctcttctccttttctctttctttcttttttttttattttttgttgttgttgttgttgttgttgttgttgttgttgttgttgtctgttcttgggggtaatggtgtcccgatcgtattggacaagccttcgtgtatgtcactgattggaattggagtgtggagttagacgccgacaggtgaggcagatgaacaagagttccaacccaaaagttcactcatgaagtgttgtgtaaatagaagtaaatataagggagaaaatactagttgcttgggggagttgggattctccaaaagattgtgttttttttcccttttcggttacgcttggtgagaagatgatttattttggagatggtggacgacgcctatatttctgttttctggctatctaattctgacgatggcgtctcatgtttttcaggtgcgtttcgcgtgaagcgggttttaaggatggttctaaacaaggtgctcgagctgttttgtgtgaagaagaaggattccaagaagaaaggtgctgtacagctgcactactgcccctatttaacatcatgtttacatcagctgcttctgtttgtttgattgatccaaggatgctttcctcttttgatggcatattattagttgtcttgtgtactctttcttccatgaattctgcattttttttaaaaaaaagtgaaaatattaatgtgttttccggtgaaaggatactgcagatcaaatgaggtggtcataatggattaaaattgttggataattgtgggtgctgtacattggtctggattgctataccagatgcttcaaagtataccaaaatgtgatgtgtaaagtataaacttaatcttgacaaattcagagtgctattagtgtggttggatacatccactggagagtgaactagtggatagtctggtgttatgaatccatgagtcttggttgtcaacactgttttgaagtttgttaaactgtataaagaaaaaacaaacttaatatttcattagcctgtatacccatctccctctgaagcacggagttctactcattttgtttcagaaagataaaatcaagtgttttgctcttctgcctggcgttttctaataaaagaatatttttcatgcaggcaaagccattaatcctctttgtaaaggtatcttttcatgcaacttgttcctccttatttgttttagtaattctcatgcttcatgttgctgaacctgttttttaaagaataaaatcaatgaaaatttagggtcctcccctcccgttccccaaaagggggatatttgttactttaacagaactacacattatctaaatgttcatcactctgtttttctgccagtagttagtactgatgccaagtacacctctttatttttgcagttaagcgagcttccatatcccattctgtatctctgtctttaagattgatgtgctttttttttataacatcgtggtttgaaattagttactctactgactttcagttgccgctccacaccccactgcaaatgtcagtacaaacaacagccttttggatcccttttcaagtgggaatggtactgtgctattagtgcaaaaacatgagcctgaatgttcaagtgttgtatcatcaatgacaaggacagaatatggatctgaaagtgatggctacaatttgtttaaccaatttgatgttgtgcaagatttttctgatcattactatgcaaagaattcaccagggaaggtaagctgtgccgctttatgaactctatttctatcactagatccaactgtgaattaatttcctgtctttacttgtgaccactgaccagacctccaaagattgggtgaagacaatccaaaatgaatggaagcttctacagaaagatctacctggtcagtacatgcttttatatggcaaatcaatgtatgcatttttatcaaaccgccagtgcctagatggtgaatacatataatggtcctttcttataatagacctgctgttttatgccaattgtatctgatcacatgccaacagaatacgtttgagatatttctagacttaaagatagttggatgccctgtatgggctataccaatttgcttgtgtggtttgtagtcttggcatgactggtgctgagtcccaaactagctaatgacattgtctaggtttgatgtataaaatactttattggtgccatatctattagtttctgttgtgtgccacatatcttttagttatggtctgcatttgtcacccttttccatgtaatcttgtgatagcagcatataacatgtattcagaaattaatcttttttaagtttggggaatgggacaaatagaaattaatctctacatatatcaaatcatgtcaccgaagggtatcacaagtatcattacatacaatttacttttgtgccttaaatctttcgtttagaggagctgtgcctgaaattatatgatgtcttcagtactagcaacttgcatctcagcatggtttcaatcatgcagaatctatctatgttagagcttatgaggataggattgatctgctgagggctgctattgttgggccagctggaactccatatcatgatggtctgttcttctttgatgttcgctttccttctgaatacccacaatctccaccggtatgtaaccacttcacagttcacacacgctttgcaccattattttcatgttactaccatcattaatataatctctttaaaatcatatccaacatgtacagaaagttcattaccattcgggtgggcttcggctaaatccaaacttgtatgagagtgggaaagtttgccttagcctgctgaacacctggtggggtactggatgcgagaagtggggcaagtcaaaatcaaccatactgcaggtgctggtttccatccagggtcttgtgttgaatgataaaccatactttaatgagccaggcaacaaaaattcggctaatacagctcctggagaaaagtactcgttggcttataatcagactgccttcctactatcctgcaggacaatgatgtattcacttcggaagcctccaaaggtaactacagaacccccatctctcgtcaagttaaaagtggtaatttcacaagtctctgtgctggaaaagatagtaatagaagaatttcagctgtcagggttatatcagtgcttctacagtcatccagataaagtgaactgctctctgtgcctatatgcttttaaatactgatatacagttaggaactactataacattagtcatgctgtaccaaccgtacttgtcactccgtgaaactctttagcaggcattcagttgccaggagagcgattttccggcttgagaattgtgttgtgttgcgtcatgaaattgccaacttaaaaatttatctgtgggcacatttaactaacaaagacacgcattgtgataatgtgttttggagttttgacagtatgttattgcaaataaacagctgaataagtgagcgcatcagcgcaagaacatttgattttgaaacatcatcagttcatcaccatatgtacctatgaagtcctataaacacaattcagttccatatacctcttgcagatcgattcgctctcacacacacctttcattcactgcagcattttgagtcccttgttgcacgccacttccatgagcgtgagcgcgtcatcctggatgcgtgcgacgcatacatatctggcgcagtcgttggatcatcctctgcgaagggcaccaagcatccccgcgacaacaacagatcgtttgcagatttcaagaagtcactggagaagtactctgaactgctcaggaaggacttggccgcgaaccgcacacacttcctgaaactgacaagagactcgccggctgccgcagatgagatcgttgagtgtaccagcagctagaatcgtcagagcatttgaccattgcagttcacctgcctaactcaaaagtgaaaatggtgtatagatcatagcactcgttacacatactgtgtaggttttttgtttggaggcaagatcgttcggattaattatgcaagaattcgggttgagttcagtgctagccattttgtttagtagctgtttctggtgatacaccaattggatgatcgaaacgtggtccaattctgccagcctaggctttgaacctgctgcattttaaatttttaatagaacctgttgcactagtttatatatgcctatatttacgtggtaacagacagagcagagcgtgttctatctttggttttgaagacgtccattttgatgacgtctttcaactccagacattatttatgctcgaaattgtaaagtaccgcaaatttggtttatgcggaggtttagccagggttccaaatatgaaatgaaatattcacagtagacatatcgatgctggtctggtttgtgagacctcctgaacaacaaatcaagctaaaatcaaactaaaatttaaatttttgctatttttttctgggttttactattttttttcggtaactacaattaccgatcaggggtgcggttttttagcctccattgcatttgtaaaccctttaggagcaagtttgaactgctgaaactcgaaggttcgcgtagatcattttttttttcaaagactgcaattctgcaaagaatagtgtgtccctcgcgaagcaagtttcatcagctaaactatagcctataacaacagaggaacatctgcattaggcaattttgttcaggtaagctagtaagaaatgaatatctgcatgacgcaggtttgatcagccaagaaatgagctgcatataaggcaaagcttgatcagctaaagaaatgaacatctgcatctgtcagtagtgtaacagaatattttacagttcattaatcattgttagcaacaagctatcacattgtttgtacatgtgtataccaggatcccaagaatcatgtatgggtgtactgtaattaaggagcaatacaacagtaacaaagaatcaatagactgtatattttttttctgtatctaaatgtatttttcagttcctagaaatactcacagatgggagctagaaatactcgaagtcgccggaggaggaatcgctcgccgccggcttggccaccttcgtcggcgccgccgccggcttctccctcacgccgaactggctgaagtcgacggggtcaggcaccgatggcgggtgggcgctgcgcacgagcgcccagttgacgccctcgaagaagggatgctgcttgatctcggtggcgcccctcctcgacgcgatcctcttgccggggtccttcaccaggaggccccggatgaggtcccgcgcgacgccgctcgccgccgccggcgccgggaacgcgccgccgtcggggaaccggagcggctgctcgacgacgttgcagagcgtggcgcggttgctgctccccttgaatggcgtcatgccgtggaggagctcgtagaggaacaccccgaacgtccaccagtcgacggcgctgccgtgcccctcgccgcggatgatctccggcgccaggtactcgtgcgtgcccacgaacgacatggaccgcgcgtccgtcggctccgcgttgaactccagcggcgagccgtggaggagcccgaggtccgacttggacgtcttgcggctcctctttgggaggatccgcggcaagaacgccgacggctgcatgcagccgacgccgacgccctcgccgtcgccgccgccaccggcggcgaggcccttcacgacgccgttggcgcccgcgtgcaccgacgacgacttcaccagcatcgggcacacggagcaccgcagcgacaggtcgaagtcggagagcatgatgtggccgtcgtcccggacaaggacgttctcgggcttgaggtccctgtacacaatgcctagcatgtgcaggtactccagcgcaagcaacacctcggatgcgtagaacctgatgaaaaaaaacattcagagattttcagaatcatggtgagcaaatgatttaaaggcaatttacaccgagtttagcatgcattttcactttataccagggtgttttgaaatactctgcagtttgtactaggttgcatcgtacatcgttgtgaaaccttgtgaaatatgagtggaacttttgaggcttcttcaatttagaccatgcttcagaaaattccattcagacttttataaaatttcttcaaatttatataggtttaaggatgtgtcctagtgtttttagataatatgtgtcctagtgttaagtgaaacttacttcctccgtttcataatataagtcattctagcattgcccacatatatatagatgttaataaatttagatatagatgtgtgtctagattcattaacatctatatgaatgttggtaatgctagaatgacttacattatgaaacggagggaatacttcaataatccctggtgtaaagctaaaacatgtgctaaacctcttgtaaagggaaaacaaagtagtacgttttacctggtgtaaagtgcaaatttactcaatgacatatatccatgtcaatgtgcaagcattgtatgtagtatgttgaggcaaagaggatatatgctggagtgatcttgaaaatgtgaccaaaaccaaccttgcagcttgctcgttgaaatgcttgttgagctgcctctgccggagcgaatggaggttgccgccggagcaatactccatgacgaggcagtagaacttgtcggtctcgaagtgcgtgtacaacgtagggaggaacggatgatcaaggaggccgaggatctccctctcggtctgtgccctgaccagcttgttcctgctgatgagcgactccttgtccatcaccttcatcgcgaagaaggcgtcggtgtccctgagctccacgaggtagacgctgccgatgtcgccgtagccgagccgcttgaggagcctgaagtggacgaggccgagggggcagtccacggagctggccgaccggacggcgtcccaccggctgtcgccgccggtgtgccgcttcgcctggccgtagctgaagctgtccaggctgttgcttctcgcgatgctgcttctgtccacgctgatcgccggcgatttcgtggtcgtcgtgacggtcgctgcttcggatcttgttgctgatgatgctgaattctgcgctggatttggggttgttttgtcagcttgatccggtttcttcttggagcgtgctgttggtttggaggctgaggatcgatcggctgaaacacctgactgattccgatctaatttgccattggggactgcatttccacgggtattgaaatccattctgtcattcgttatggacagcttgttgtatgacatggagttcatctgaaacttgcacaaaatgcacagattaggatagtaacaaatcagtgatgataatggtttattgatcatttactgcctgacctcataagtatcagccagaagcagaattcaatggatttcaaaatcaagcagaatgtgagacaacagaatttgttccagatacatttatatggaactcaaacagacaaggccaatgaacaagagcatctccaagaacggtaaatgcaggtccgacaaatgcatatatacggatcatcagatcatatgcgttcaccttttttttaattcttttttttctttttacatttccccatgtctcctatagcatactgtccatcatgatagtttttcaatatcgagccaaacagggcatactatgtgtttagaatataatacaacatgcaggtatatataatataggtcgtgcaaatgtcttgaacgcatcacaaaatatacttttgaagctttataattgaaaaaaaaagaatcagctagaacaacaaaaggcacatctatacttgatccgttttgagtttctttgaacaaaacaacatgtgtgccatttcctaccaaaggtcaaaccagcacgtcgacatgatcacgatgcccaaaattgtaaattctaactaaacagatacaaacgaacatattaaatactccttccgttttttaatagatgac

SEQ ID NO: 7697 - DNA, 1741 bp, Oryza sativa
aaaaagtcaacggcgtaatctattaaaaaactgaggtaatataaaccaatcaaactgaagaactgaacctaaccgatcgatacccaattccctacctccccaatgcatgggagagaagaaaaaaaaagagaattcatcatccgcagaagaatctcccaccaatcacaacaaattcgagcaaagaatggtcacacaagcaaagaacgaaatttacggacctagcagtgaccgaaccaacggcggccttcaagctccacggcgagacatcgcggtgacagaagagaggccaaggcgcgcaagctccatggacgcaccgcggtcgcggcggccggcaagggatcgatgagccctcatccagccgcggcgggacggcctggatgtgggtgcggaggaggaggaggaggaggagagggtggggcgagaataggtggatggagaggaggagaggagaggaggcatcggctaaatttaagaggacgcgcgcgcgcgtggggcggcggcggcggggggaggagaagagtggagaagagaagaggagaggcggtggtggaagcggtcgtgtcgtcggcaggggagatggccaagcggcggcggtgttcccgagaggctccggtctccggcgtacggccggcggcggcgctgggagtgtggttaggtgggcttgcttcgacggcccaaggcccaggttacgttgctatacgtcatggttccatacgattttttgatccagattgtatttcttcgtgatgaggaggagaaaaatatcatcattactccaggtaaagtgatttatttatttattgtgaaaaaaattgatttatatagcaatgacgtagcattatatgaagagaaattctacattttgctattggtaggcgatcgatcatatgaattgtcatcgacaaacatggaatatgttggtcgggaataagttcacttttactcccttagaagtgacacaaatctaatccatcaccaatttgactccctaggcggttttggaggacggttttgctgaagtgacgcctacgtggcggtattgaccgggtcttctttacacgtggtgttgacgttgcgcttaagtggcattagaattaaaaaatatgtgtgggacccattagtcattcacacaaaaagaaacgtgggcccactgacatgtggagcccacatgctagtcctccctgactcctacctttttcctcctccgtctctccccttcgtcttccccttcggcctgtggtgcgtggtggcagaggaagcgacaaaggacagcaacaggcgggagcaggccgacaacggcaagggagttgggtggcaagcgggggaggagatggggggcgcagctcaccgcgaggagcaggacgatgtggtcgcagcgccggcagagtgatgtggtcgcggcggcggggttcccggcgagccgcgcagacgagggggagcagcgagccacgcagacgagggggagaaggcggtggcgcaacggcgtgagggcggaggcggagcacacgaccggcctgcacgccatggtggcggtggaggacgttgtcgaggagatcccccacctcaccctatccatggcagccaccgccaaatgccgccgctgtcttcactccccgccacgcccgagtctcctccgctcgccgccggctccacttgcccaccgtcgtgcgccacagccgcctttccaccgtctcccaaccgccggatgccaccgccgtcactgccgctccagtggtgaaga

SEQ ID NO: 7698 - DNA, 23143 bp, Oryza sativa
gagagaggatgacatgtgggatccacatgtcatcctttgtgtgaatgataaatgaattattatttttaattctaatgccacttaagcgccacgtcaacgccaagtgtaaagaagagccggtcaataccgccacgtaggcgccacatcagcaaaaaaactgccctccaaaaccgccaagggagtcaaattgcaccggtttcaatagttcgggggtcgagatatttagttttatgggttagagtcatggattagatttgggtcactttttaagggagtcaaagtgaacttattccatgttggttgcctacactaacccaagtgagcctagtgggtgcaagcactccaatagcccaacaatccgcctcctcctctctctacattacctttttctcgatcattcgatccccatggctccacgccttcacccaccatgcacgtgaagacatgagagcgagcgagtgagcacgtccttcctccgatgagctcactgcacctctcttcggtgagcccccttctaccctagtgagcttccactaacgaagaagaggagatgcaaacgagctacctctctcaggtgacgaaggggctcactttttttctccaccagcaccccccaccgtgttgccgccgacctcgcccgacgccaaagggcatcaccatgccaatgaggcccgcctagccgggctccttcccttcccattcgcctcactttgctccacaccaacaccagcccaccacccgctgccggcctctcagatgccttgccacccgtccttgtccaccacccaccgcctgtctattgcctcctaggccatccctctaaacccgatcctccactttcccctcccaagtgccaacctccccctcccaccctacccatgaaatcctaaccctaacccggcatttgtcgttatgctattggaaagcattcgcgagatgcccatgttgagagcgttcgcgcattaggctttccgcactaaccttgtgcaaagagtccatttttccttacaagtgaaatatcagccaatacttcacatatagacatgacctcatgccaataaggacaagtatctcactgccacgctagcagggcctagctttctcaaactttgttaggtcattcacagtgcggtatcatgtcgcgtggattcgttgcgccatgtaggacaagtgttgtggtggaagagagggaagatgggggaccatggttttgtgaggttgctcggatcctagtaaagaaccaagtccatcaactgaaaagcctgcaaaggaggaggaggaggaggaggaggagagagagagagaggaggtctagaccacccataccaagccccgggaggcggcggcgaaggaagctcgatgatggtggcgacggtagctcgatgatggcggcgatcaccacgcgccaccgagctcaccagatccagcatggggctcgccggatctggcctcgggaggtggcgacggcagtggctcgacgacggcaacgacaacgacagtgggacctccgtttacccacttccactacctcgttggatttggctaaagctcgataactgtggcgaggaagctcgacggtggcaacggttgaagatcaggaggggaccggctcattgggaccacctgacaatttctgacgaggttcgcgcatccaaatgaggcttcgcgttcttctttcaggcacgacccacgccaagctagctcagaatctccgagctggtgaggcgagtccaaacgccaagtcaccgcactgtgaatggccttactagcgccggtgttgctagcacactagtgccaattgcaatacaggggtgcgacgtacagggacaaaccacacaggacctgaaggaggaggaataaactaatttctgttagtagttttgtatgggatccacccttttgttctagggagttgattttacccaatctaatggaaagagaaccattttcacaccttaaattttgtttaggattcccataaacagatattgggggtaagatttagccattctcttaggctgcgttcgggaggaggggttagaaaccccttctccctggcacacaaaacaaagcacgcgttgttgcataattaattaaagtaccgtattagctatttttttaaaaaaagattaatttgatttttttaagcaactttcatatagaaacattttgtaaaaaaatacaccgtttagcagtttgaaaagcgtgcgcgcgaaaaacgagagagaggggttgggaacttggagataagaacacaaccttatagcaagtttaatagtatagccaactactaactccaattcatctatagccaatctaatagctcacttatacaatagttacatactacactattagagcacccgcaatggtaaagtaaggtgttatctataaaacatgtacacctcaacaatagactagattaatagtaaaccacttcaatggtatgtctacatgagtatctatagctctctaatccattgcctcgtttttctctatagactatctccatgttagtagatagctttgctctctctctgcatttaatctcttccaagtaggaaaatatgctgacatggatctcttgtagagagcttatagataaccattgtgggtgcccttaacacctggttacacctgtcatacacacagcgtcttggagtccgtgttacagctggctacaaatctgtagcccactactcttctctctccttatttatctccttaaaatatgtttataactgacttatagtctgctattgtacctgctcttagtgatgctctaaggctgtgtttgagggagaggggattgggaagatacgcaaaacgaggtgagccattagcgcatgattaattgagtattaactattttaaacttcaaaaatggattaatataattttttaaagcaacttttctatagaaaatttttgcaaaaaacacaccgtttagtagtttgggaagcgtgcgcgcggaaaacgagatgcttttctctctcaatcccccaaatcgcccaggaacgaacgaagcctaagaacaatagtgtttcgttctcaccaaattccaaggttgtactccaaggatcttcaatacacaaagcacttgcatttcttttcatggaaaaaaaatagtactaccgttctattcctacgaacaattcaattctccccgaaaaggtattaccctaaatcaagagaatagaatcacacacgtatcctttttagcatttagtctcatttacaacataggatttgccttctatttttagagaagctatcaaatcatttcctacaaaatccaaagataaaaaaaagatgtgcaagtgcaaacacaaacatactatgcgatttttccacaccccgttcaccagttcactacgcacgcatgaacaaacggtcactgaacaaacggcatcgcggccacggcggcaggcaggtgggccccccacgttgtctgtctgcctcgccctcaacgttctttttgaactttttgaaatttgaacgaatgcacaccccgagatcccaaatcacactctcctagtcctcccccaatcagttcaaaaaaaaaaagaagattcaaatccagacgaagccccttccgctcacctccccggtaatcctctcacccttctgccctctcacccagacgaggtggggcccagcacgctcctccacgcgagggcgtttccccgccgtcgctgagcggatggacggctgggatggatcgacgattcaaacgtgcccgtttccctccactagatgtggcgataaacaaatggggatttgtttttttcttcttctttttttttgaataaagaaagggagcgcaccgttgaaggttgaacagaacactccatccacgcagccttttgctgttgctttgctctctttccatgcagtaagtacattgatgagtgatgacctctttcttggtcctccctaaattgcactgtgacaaaggagtcctccaccaccatctcaccctggggattcagatttcaaaattcaaaaacagaagcaggagtatcaactggccacaagggacaaaagtcaaatcttaatcttagtgctttgacagctgatgatttgagagtcaatgaacaggaatttggaataaccaaagcaaaaaaatgaaacattgtccatgtgaaactgtggccgcaaagttttctataggtgcaggattaggtaaatggtgtttatatggggtattttcattggcaatattgtgccattatggtgtaattaaatttttccatagtagcctttcacacagttaagaaaggtttaatcttacgttttgacccgtctattaattattaattataaatatatataaaacatgtctattaggacatattttaaactttccgaccgttggacgttattttaaacttctcaaccgttagttataaatatatggtattatatcatggtactccctcaaatattaaaaacatgtcgtttttgacacattttgaactttcagactgttgtacacattttaaactcctcgaccgttagttataaatatccggcatgtatggagtaacagagtaacgccttcaatctttaaaacacgtcgttttgcacaaagttccagaccttcctgtccgtttgtaataaatctccggtatgatactcatagcgctccatccactatcgaaaaacaaagttattttggacacactccaagctaaaaacatgaatatctaagcatcaatatcatgttaaatatccgttaccgtccacgaacaaaagaagtaacacattgcaatcaattcagctctacatccacaatatccataaaaaaacggtcggaaacataataacccacccacgaggtgaccgaataactaaaaaccgtttacggataaaataaccgcaacccaacccgatgattattagggcctgtttggtttccagggactttttccaagtccatgtcacatcggatgtttggatactaatttggagtattaaacatacactaattacaaaacacattccatatccttggactaattcacgagacgaatcttttgagtctaattatgtcatgattttgacaatgtgatgctacagtaaactttttataattatagattaattaggcttaaaaaattcgtctcgcggattagctctcatttatgaaattagtttttttattagtctatgtttaatactccaaattagcgtccaaacatccgatatgacatgggctaaaaagttttaaccccatctaaacacccccttagtagcaaggttgaagcacatgccactgcttgaaatttgaacaactgaactgcttaccagtacaaccctagaagaaaatgtgagtagaatggtaggcccaaaactgcaaagaatcgaaagtacaggggtgtattcttaaagtagcactcctcccccttttctttcatcccctaccctcccctctcctcccaatccccctggcctctgtcgggaagagcacccaaaccctcgcttccgccctcgcaaaccctagcgcccggaggaggaggaggtgggttgcggtggtagtttgccgtccgccgatgtcgagcaacctagcagcctcccgccgctcgtcgtcgtcgtcctcggtggcggcggcggcggcggcgaatcgacccgcggtgggggagggaggaggaggaggaggagggaaggcggcagcgggcgccgccgcggcaaagaagcgcgtggcgcttagcaacatcagcaacgtcgccgctggtggtggcgccccagggaaggccggcaatgcggtgcgtgatggatcgcttgtgggggggttggggagtttcttttttcttttctcgaaggctttgttctttgcgcggtttgggttcgagatctttcggtccgtgatgtggttggaatggtttttggcttggccttcttagtttcttttgcttttggtggttcctcctgggttcttgggacggatcgagttcgcttttctgcagttcttggattgggggatttcttgattcggaaattgccgaagcgatctgtatatgattttgcttctttttttttccatctttgtggtgggcatatgccttgatctgttggtttcaagcgaaaaatagtgtttcttgaatccgtcttcttgagttcttccagagtacaagattttcgtttcttcaatttctcgttgtttaacctacaaacggttcttctcttccaatccccaagattttattgccttttggttttctaattgctgttcccattcaaatttggacctctgccaaatttttccttgctgattttgaggattctcctctttcaatccacaagatttttccttgctgattttgaggcttcttttcatggttatttgattgattgatttcttggggagcatccatggtcaacaggcataaagtttattggcaccttcaaaagttcaaaaatcaagctttcttggtatttgtgaagtgttttgtacgtttgcttgctttggaatcttctattggtaatatgatacttgcgtgctgctaatgtttctaaatttttattccttttcatgcttgtggtctgtggaatcccaaatgaacagattgaaataaattataaattgatttctcttgtcccatcctcctgcagaagttgaatttagctgcctcagctgcaccagtgaagaagggatctttggccagtggccgcaatgtgggcacgaatcgggcctcggcggtgaaatcggcttccgccaagccggctccggccatatcccgccatgagagcgccacacagaaggagtctgttcttcctcctaaagtgcctagcattgtgccgactgctgcactggcacctgtcactgtaccctgcagcagcttcgtctcccctatgcattcaggagattcagtttcggttgacgagacgatgtcgacgtgtgactcaatgaaaagcccagaatttgagtacattgataatggggattcctcctcagttctaggttccttgcagcgaagagcaaacgaaaacctgcgtatctcagaggatagagatgtcgaaggtgtgttttggttgctgaaatgcacagttatagctagaaaaatttgtgctatatggtgcattctattggaatggttgattgatcttatcccttgtttgtttcgcagaaactaagtggaagaaggatgctccttccccaatggaaatcgaccaaatttgtgatgttgacaataactacgaggatccgcagttgtgtgctactcttgcttctgatatctacatgcacttgcgcgaggctgaggtaatacattcttgtctacaccttatttctctgaaaacatttcccttgagcaccttattgtagtatgttttcataggaaggctttgttttgcttcctcatgatttgagacttgattgcatccatatgaaacacaagtaaaaaaagtttactttgatgagaccataaattaagaagagaataagtgcacatcactgatataaggcagtattccaatgtaatttatcaggatatttttcacatttcaccacaatccgttcttttctgcttttcgctttgttggtgcaccttatcatctaataccagacatgctttgtgaccatcaattttcagtagttttgttctgcatattgtgtaaacaccttacataaaacattctagaatactttttttttctgaatagtgggttccatttaatggccatcatattgaaattccttatagaaccagtagaagcacagtataatatggagaaattttaatggagttatctgcttaaagcattgactgaaccgatgaattgatacatttcaattgttgtaatcaatgctcttgaagtatttttcaattgctcattgtttttgctgtgacatggactgcactactgcagtcagtttgaccaaatgacaattaatctgacctgagcacagtggtttcaaatctaggttgaatttcatatttacattgtgattttctatttgacttgaagcagaccaggaaacgtccatcaactgattttatggaaacaatccaaaaggatgtaaacccaagcatgagagcgatcctgatagactggcttgtggaagtaagcttttataccaaacatttttttagttgattggagcctaaagaccacactcgttacttaccactgtatttgtgcttttcctttgtgcaggtcgctgaagaatatcgtcttgttcctgatacattatacctgacagttaactacattgatcgttatctttctggcaatgagatcaatcgtcaaagactgcaattacttggagttgcttgtatgcttattgctgcgtaagatctgactagcaatttttttaaatgtgtttctcagtttgcatctgagttttgtgtactgattttggcttgttcctatatcagaaaatacgaggagatatgtgcacctcaagtagaagaattctgctatataactgacaacacatacttcagagatgaggtttgttttgcatatctgttaacattgctgtgtttatgtccatgactaacacatagattatcaggttttggaaatggaagcttctgtcctgaattacctgaagtttgaagtgactgcacctacagcaaaatgctttttgaggttctattccctttcatctcatcgatgtctatagtgctggaatgaatcgaactctaataactctcttattgcctacaacaggagatttgtccgtgttgcacaagtatcggatgaggtgctgctctcttaatcatctcctgcttgctgcaattccataatagttatatggtgcattgcattaacagcttttcatcgtgcaggatccagcattgcatcttgagttcctagccaattatgttgctgagctatcactgctggagtacaatctactttcttaccctccttcactagtagcggcatcggctattttcttggccaaattcatactgcagccaacaaagcacccttgggtaagtggtggcatcatcgtattgaactttccatacatcttttatatcagcattcaaataaaaaaattacaagagctaacatatgcttctcattgtaaatttgaagcagaattccacccttgctcactacacacaatacaagtcgtcagagttaagcgactgtgtaaaggcattgcaccgcctttttagcgttggtcccgggagtaaccttcctgcaatcagggagaagtatacccaacataaggtataaacggcatatcctccccatttcttcagttatctgtactgtttctaatgctgaccttctgtacctttgtttctgcagtacaaatttgtggcgaagaagccctgcccaccctcaataccgaccgaattctttcgcgacgcaacatgctgaactagaaaaataaaccaaggattagttacagttgctgactgaattcttcctccagaggcacctatgccaggttgtgccgtagaccgttcagataaccttgatgcaaggcatgctgcttgcccccccccccccccccctggttctttcaggcggtttggctgagtgtagatagatcgatgcttctgctgtgtgtggtaacttttatggtactgatgtgctttcttctatcttcttttccctgtacctagatgatccatggttttcagtactttgtacatcggagtcctgcagcaaagctttaaacatcttgtttgatattagctgccaacctgggcgtctcctaggttgatgtatgatagagtctctgttcgtgttgcttttgtgaaattctcaataagagcaccacattttcaacagtgctcattctgaataagtgctactagtgttcttgatgtttctagtaaaaaaatatcagcttcagctttttttttttcaacctgttctgttcttctgttgacagatatatgcagctgatgtgatcgacttaaacatgatgattcagcgagattcttagataaaagcttctgacatcttttccaagaaagatgttttcatggacaaatgcatttaagattttgaaaatgaaaaatactacctccatcccaaaataagtgcagtcgtggaaaccagtgtccaatgcttgaccgtccgtcttatttgaaaaatttatgaattattttttaaaaatagtcacacataaagtactatttatgttttatcatctaataacaataaaaatagtaatcataaattttttttcaaataagacgaacaatcaaaaattaaagataaatagtgcaaaactgcacttattttgggacggagggagtatttgtcaatgcaacctgttgaagaagtgatgctcaagctatttccatacttgaagctaagcacagctgtttagacatgcatgcctgcgtgttgcaccatcatattgtacttagactaatcacctatactaatataaaaagcattacttgtagtctttgctagctacactaaaaaaagtgtacacaaattaacctcaggcaccctgcaatctaatggttgagattacaagttccagcttgtcttgcaatgcaacaggtgaactcacagattcaactccaccttggcccttgcaaacgtggcggtgtgccggtgtgctagcaactacacgtcccaaaatataaaaacctataatcagatgagacatttttttctagtactaagaattggccaatccagattctcgtctcgctggagtctcatcctcgtctcactggagtctggaatctatagcaacgttgtttacagtagagttaacagaaattatcaccgtctaattaacctgctactgctttacaaaacgggagacaatcagacaacgccgaggtgggttgaaaaggaagaaaatgcaagcacaggcaaatgccgatgataagatactagatgagcaaggctactccctggggaaaaggctttgcttgccatggattgcaacacaagattaaaaaaaattacaatacagaaagaatgactcgaagcatgagtctagcaaggttaaatcatcactgagctaggcctacaacatgtcgagttagaagtcctcttcatcgtccagatctggatcatttgatggccgtattctcttgccgtctctccctccagggcgacctcctttctttggttttcctctgtccaaacacacgaggggtcagaactaggcaattcaactaaaagggttgttcctagaaacactggtatttttaatataaagaagtgttagacaaacactgcccctggcaagaatgtatgtaaagttgagaacgatagcacattttttgccgcaaaagtaatctgagcacttactgcccgtttgcaggagtggttgcgcctttcgaacgacctgatccatattctcttccatctgccaggatgcagctggtattgagcccagagtctcaattgttcctggtttcagcttaatgaaaacaagaaagagaacttaccatctcgtccagccatatgttcatcgacctggaatgaataaaaaataatggtatgtattagcaacctcacaaatatcggtatagcacagggggaataacaatcatcgatcaaagcaaaccaacagattaaaaaaacgggcactggcttttcagtggcattaggatttaggatcattagtcataccgctggagatgtaaccgatgacagggagaacagcctctcatcagcctggaacttcctggagcgcttgagactgaaattaataagacagaaactgtcataactaattctatgtgacctattagcagaacaggcatgataaaacatttgcttgtgcagaataatgaacacggaagattatgccaatggttatcataaatccaaccctcccttggtgatgctagatagtgcatatagagcacccctgcaattggccacaactgatataacactatcatagcatattttgggttatgaatctgttgtataatacctgccactgccactagagtgatcagaggatcttttgttcatctgatcattagtaaataaattataagtgatcagaggattttttgttcaatatctataactataaattattcatctgaatattagctaaattatatgtgatcagaggctggtagaaagttcaagggcaggacagtaggtcattcaatcaacagtcagaagtaagcaaagaatgtggcatgaattctgaaggtttcgaactggtaagtatacagtgggatgtcaaaagaaaatgaatgaagacctccaaatagtaaagggcatagcagtctaagaaaaggtttcttacttggaagtgttctttgacgatgataagaatgattcaaaaccctttagcacacttccgaattgattagactcttgtaggtaggttgtctccatttcataaacctgcaacatatggacataaacatcatttgcaggttgtataagaacaattctgttaaaagcatgaatagatattttgttaaattatgagtgtttaatatcatatacaaaacttccccttaaagtcaagcaaagatggttgacattatagatcatgtgttgttcctggtattaaagagcgactgttttgttctttctaaaaaaaaacacatatctgtgccattaaaatacttgatatgagagcaatacccatttcctccctttttaggattatggtttctactaaaccaaatgctcctcttatttaatgattttggatgacacaccaagattcaccatcacaaacatagattggaagttggagcacatagtgtaactttgaaatactttgaatagaagtagctcatttgatacttgttgcaaataatttctgactaagacacagtagaaactccacatcttatcttgataataagaacagatggaatttacaggttgtagctaactgattttcatttttaccctagagcaacaaagtgttctcaggcacaaagaacaacatacaagaaatagaatggtcatattcgacaagaatatcaaattgatactttcttcccttcctcctaattctatccaaattgttcgtcacaattgatcctctctgtgaaatgacaatcagtggtcactggtccagcatattggttccaaataggttcatatttctatcattcccaaggcattaagaaagattgcacaataaattggggactgtgtgtaagacctaacctggcgctctatggagcggagctcctcctggagcttggcgcgcttgctcatcagggcggagagcatcgctgtggggttcgcggccgccgcccccgagggcgcagagcctgacgctgccttgtgcgatgcccctcctccgcctcccgagtccatggttagggtttctagggttcgagttcgtggtttgcctgtttgggcgttcgttctgttttggctcggacacagttcactgttgtggagacgactagcccctcctctccaataatccgatcggtcctcttagccaaggtaatcaatatcgagatactaggtaggatcctttctcttcttgatttgatccttctcgatcggtttgatcccttctaatggagaaagattcttgtttgctgcaagtcacacctaagctgtcaaatgcacatgtgaaaatgtttagcaatcaatgcatacatacgcatgagtataacacagaaaagggtaatagagtatttagcagaaatttgtgtttcaatttttttttctgttgatggataaatttcactccaaataacattattggaatacatttctgcctataatctaagatgcacatgttttatgagcgatttgatcatgaccacaaacatgagataatgtccataccctagttaggtgcccatgtgttgcaatgggaaaagaacatttggctatgtacaatatgaataccctaatactccttcccgtcaggattatttgatccaaagtactgaggtatcccgcgccaaataatgactcgaggggcaacaaatgaaacatgcataacagttcaggaccttgagctgttgagcatatagaagaaacaaatgatacaacctatgtcacttattatctacaacacgttgacctctgtaataacagaatgacattatcaccatagatggtgaaacttccttgaaaaacacacaaaaacgaaatccagaacaaatgtggatcccctggcagtgatatcacacaaaacacataaaaaggaatgaaacctctctccctggcacagcaatcagcacaatcctttctttttcttgatttgcaaaccctttgcaggcaattttaaacattacgaattctgagtgcataacaaaaataaaaactacattattccactgtatgtaaacaaattagtgaaatgaatgaaataacaggggcggatccaacttgggacatgggggttcagttgaaccccccaaacttttgggggaacaacaaacaaactcaaactgttacttgtattaaggttaaggctctggaattaaaagaagagcttcttccagatctacaagagaagctagggtttacgcaagcaaattccagacagaagcactcccggtgggagggagagattaatcatcagaaagaggatgtggatgctcaccaggatcccttgctcgccggatggagatcggcgcccctcccctcccctgttcagccgcgaagggcgcaagaagcggaggagacgacgagacgggagattttttttttctcttttacgcgaagggaagggggaagagatactcgagtactccacctttagctcagatttactatgttacccattatgtgtagcaggccaaatgggcggcccggcccatcacggcaaggggcccgctgatggcacggcaactgtaatgggccgtacggtgccagatcttgggcagaacggcccaaggaggtgttgggccgtgtcgggccggcacggctactgttgcatggaccggtggcccacccactagcacgataacgttattcgtgagaaactacagtcgcaagttttctatagtaggtaacacaattaggcaaaattgtgttttttttagatattggaatagaatccagcctttggtcaatgagctacaaccaattattacaccaattcatacaaataaaatcgcatggcaaaaaagttataaaaacacggtcctaaaaggtcaggaacacacaccaagtactaaaaaccaacgcaagaaaagatcacaaaattattgaattctatttgtgaatcttcatccaaagttggcaaaaagccgcataaccgttgactcaagattacgacatgtagcttttattaacttgatatcttcttcacacttttgcagttgtgctcaggaccgaagctagtgtgttgccctgaaaagaacctgcatataagatatagatggtgatttgtcaaaaaccatatcatttctattcaaccatagagcccaacatatagcggaagctcctaccaggataagtttactggttttttttttatcaatcccaacaagccaagcaaaattgtgtttataagggtatttttcattggcaatattgtgccattatagccgtgttaaaaattcgcataatttcctttggcacaactaagaaaggtttaaccttacgtcccgacccaagcattcgttgtagatatcctgaaacactaggttcggacctgttttacacttttcgaccgttggacacattttaaatttatcggccattagttataaatatatggtcttatatcatgttactccctcaaatattgaaaatatgttgatttggatacattttaaacttctcgacctttggacacattttgaacttctcgacctttagttataaatatctggtatgtacgagagcaatggttttaatttttaaaacacaccgttttgcacaagttccaaactcccaaacctcctatcaaagtgctccatccggtcttaaaaacaaaggtccggtttcccacacaaaaatgttacaccctttcacatcaaacgtttgaagtattaaatataagctaaaaataactaattgtacagattacgaataatttgtgagacgaatcttttaaacctaattgctccatgatttgacaatgtggtgctacagtaaacatttgctaatgatggattaattaagtttaataaattagtctcgcggtttactgacggatactgcaattagttttattattagtgcccgaacaccccatgcgacaccctatataatacccgatataacacgcaataattttacactcttggatctaaacacccccaaagttattttggatactacattccaagttcaaatataaaactctaatggcaggtacaataatagactataagtcagctacaagcttatgtggtgaagataagagaggagatagaatagaagcgggctacagatttgtaaccagctgcagcacggactcctaaacgctacggtggtgtttgaatctcctgaagataaagataaagatgaagattaagtgtttcacgtaaaacgaggtggtaataacgtgtgactaattgagttttaattattacaaacttgaaaagtggattaatatgttattttagaacaactttcatatagaaagttttcgcacgaaacgcaccgtttagcagtttaaaaagcgtgccactttaatccaaaatttaattcacccctttcatgagtttctaacgggctctacgtgtgtatgacaagtgggaccagtaattaatgatgtagtgtatatctgtagttaactattgtataatttactattagattagctataaatgatttggagctagtagttagctatatactattaaaattcctctaagtagcaaaggccgtgttcgattattagtgttagaaactaaccctccagcacgtaaaacaaaacggttcattaatacataattaattaagtattagttatttcataaaaagtgagttaacatgatttttcaaataactttcatacatatattttttttaaaaaaaaaacacaccgtttaaccatttgacaaaagcacacatgtgaaaaacgagagagataagtaggaaaatacgatgaggaatatttcctccgtatcaaaatataagtatttttagacttcgacacggttctaaagatgcttatttgacaaacgatatttataaaagtaaaatattttaaataaaaagagttacatactgtgatagtttatttaatgataaatctagtaacatcaatttcttttatgattgatcttttttattttttttcttattaataattaaagttacaaatatttgacttgacactatgcttaaaaaatacttagggcccctttgaatcttagggtagaaaaaaacagaggaataggaaaaacacaggattctgacaggaattgaagggtaaaacagaggattgcaaaacacaggaaaaacacaggaatggtcgtttgattggagcgcaggagaaacgcaggaatcagacgagagagatagactcaaaggaatttttccaagagattggagctcttgctaaatttcctcaaaaatccatatgcaatgtgtgccatttcatagaaatttcataggatttggaaaacttcaatcctttgaatcaaagggccaaatataaaaatttcctataggatttgaatcctatgaaattcccacataaatcctttgatccaaaggtgctcttacattttaggaatataaggacggagggaatacaaagttaaaatccgtcatcttctacggcagaagtagtaacgcacgaaattaatttagctctacatccgttctgtttatgaataacggtcgaaaacgtaataacccaaccacgacgacatgaaaaaaagaaagacagacaaaacggtcgaataactaaaacaacttgctactactatttgaaatttgaacaactgtaacggcccaaaaactggaaataatcgaaagagtcgtcgccattttctttctcttctcctcctccgctcctctgagtcctctcctctccggctctcccctcctctgtcgggaagggaaggatccaagccctcgccctcctccgcctctgatccccgccggccgccgccgccctcgcaaccctcgcagcagcagcaggaggaggagggttcgggtggtggttgccgtccgtcgtccgatttcgagcagcctagcctcccgccgctcgtcgtcgtcgtcggcggcgatggcggcgaagcggcccgcggcgggggagggaggagggaaggcggcagcgggcgccgcggcggccaaaaagcgcgtcgcgcttgtcaacatcaccaacgttgccgccgcggccaacaatgcggtacgtgaaggatcgcttgctgcttcttcttctttttttgtgctttttttttctctctccaagatttgttctttgctttgcgctgtttgggtggagatcttttggtatgtgaggtggttggaatggtttgggggtggctttttttttttttttttgcttcttggttgctcttggggcataagtgagttgctgttgcttgattcttggttcctcttggggcacaagtgagttgctgttgcttgatgcggaaatggctgaagcgatctgtgtatgatttttttttggtttttttccatcttgtttgtggaggacatacgcctcgatctgttggtttcaagcaaaaataaatagtgtttcttgaattcgtcttcttgagttctttctttcagccaacaacaagattttcatttcttcaatttctccttgtttagcctgcaagcgattctcctcttccaatccccaagatattcttgccttttggtttttcagtgctcttcacattcaaatttggacctctgccacattcttccttgctgattttgaggatactcctattccaatccacaagatttatcttgctgattttctggtttcttttcatggttaattgattgattgatttcttggggagcattcaggtcaacaggctaaattcacttgagggtttattggcaccttcaaaagttcaaaataaaagctttcttggtattcgtgaagtgtcttgtatgtttgcttgctttggaatcttctattggtaatatgatacttgcgtgctgctaatgtttctaaatttttattccttttcatgcttgtggtctggaatcccaaatgaacagattgaaatttaagttctaaattgatttattttcttcaatcctcctgcagaaatttaattcagctacctgggctgcacctgtgaagaagggatctttggccagtggccgcaatgtgtgcacgaatcgggtctcagcggtgaaatcggcttccgccaagccagctccggccatatcccgccatgagagcgccccacagaaggagtcagttattcctcctaaagtgcttagcattgttccgactgctgcacccgcacctgtcactgtaccctgcagcagcttcgtctcccctatgcattcaggagattcagtttcggttgacgagacgatgtcgatgtgtgactcaatgaaaagcccagactttgagtacattgataatggggattcctcctcagttctaggttccttgcagcgaagagcaaacgagaacctgcgtatctcagaggatagagatgttgaaggtgtgttttggttgctgaaatgcgcagttatggtgcattctgttagaatggttgattgatcttatcccttgtttctttcgcagaaactaagtggaataaggatgctccttccccaatggaaatcgaccaaatttgtgatgttgacaataactacgaggatccgcagttgtgtgctactcttgcttctgatatctacatgcacttgcgcgaggccgaggtaatacattcttgtctacaccttatttctctgaaaacatttcccttgagcactgtaaagaattgtttttcattgtagtatgttttcagacttgagacttgattgcatccatatgaaacacaagtaaaaaaagtttactttgatgagaccataaattaagaagagaataagtgcacattcctgttccagtggttataacggatataaggcattatttcaatgtaatttatgaggatatttttcacatttcaccacaatccgttcttttctgcatttcactatgttggtgcaccttatcatcaaataccagacatgctttgcgaccttcaattttccgtagtgttgatctgcatattatgtaaacaccttacataaaacattcttgaatacttttttttccctgaatagtgggttccatttaatgaccttcatattgaaattccttatagaaccagtagaagcacatcatatgttatgagcaccggtgagcgaacaaattaggtatgagtgggacacaggaggtcgaggattcggtagcctcttcgacgccctacccgtggtggccattcaggagaaacgggggatgagatagaaaagtggagatgagaagtatagattgaatcttgcttgcctttaaccataaattcgtggttctaaatagccttacatccaaactaactctgttaataaaaagggataacactcgaactaatcgctagcaatttgcgtggtactgttcctcatccggcacgacatcagtcggtcgcttcctcactttctttgtcgtgtcgcttcctcgaatacgtgatgccgaccatgacatgtctcccctccttcgcaaacagctcgtcctcaagctggaacgtaggataggtgcgacaaaactcatcttcgtcttcccacgttgcatcgacagccggtttgccggcccattggatgagcacatggcatactccggcgcgtcaattgaccatgaacagccgtagctggaagcgggagcactctttcgttcgagagcgccgacaacgcaggcagctggtctagcggtgtgtccttgaacaccttgaggagttcaacgtggaatacatcatgtatcttggcaccggccggcaacttgaggcgacatgccacatcgcccacgcgagtgacgacttggtagggaccgtagtagcatggtgccaacttgttgcgacaaaagcatagtaggaaaaaccggaccggtgggtgacccggtcgacctttgggttcgccggtccaaccgtgaaccggacggtcaaaccgcgatttaatacatatatgtgtaacgtatgtaattgctaaatcacaactgcttggatggctcggtggtctacgccgcttgcttctatcctaaagaccagaggtcgaacccccacaggtgcatatttcctctgatttttgccaaccaaaacgctctttgcaggctaaatgggcctttgatttttgccaaccaaaacgctctttgcaggctaaatgggccttgagagtctgcccggtgatggtttaatggccggttcatagaaaaaccgtccgattcagccggttcaaagcgggtcacatgcatgtcctgacttttttttaaccgaaccagaaagacctctggtaacggtttttcctggttgaaccaccggcccggtctggttttttccactatggacagaagccgggaagggatgctgcttggtgatggagtagacgcacctagacccagtcacagacctagaaggtgacatcacaatgcttctcttcgtagtagagcttccaataatcctgtgcttggaggaggtgttcccggatttcctcaaggaattcgtcccgctcgacgagggcttgattgacagcgcgcacacgtgctgtgccgtgatcatacacacagacctggaatggcgtcgtgcgcagcgagctctggaacaccgtgttgaagcagtattctgcccacggaagccatcacagccagtgacgaggatggtctccggtcaggcacctgaggtacatgctaatgactcggttggctgccttggactggccgtcgcactgtggatgaaaagctgaactcaggttgagcttgatgtcggccaggtgtaatagttcggttcagaacgtgctggtgaacagggtcccgatcggcaatcgctgacaatggagcttgggatgcatggagcatagttattaggaccggactggaccgacggtccgaccgggaaaaaccggaactagggcctcggccggtctggtccccttaaaagatcggatgtgtaattgaaccggagaaaaccgtttgaaccggtcaatttttatgtaaaccgggctttaaaccggagtggtcagaccgggctgtcttttggtgatgggctgacgtgaggcccgctgagcaaactcagccaaaaatcggtggaaaaggacgttggtgtggggagatttgaccttgggtcatgtggttgagcgctgcacgcgctagccaccacaccatctgttcacttttgttggtctaagacatttgcatcctataatacatcgaatcgtggttggatcggcctaaccagtggttgaaccgctagaccagtgaaccgagagcttgaccggttcattctccggtccggttttaataactatggcgtggaggcggaccaccttgttgaagaacacacgcgccactatcgtcaccgtgtaggggtggccgagcagaatgaagtgggcgtacttggagaggcggtcaaccacagtgaagatggttgtcttgccgtgcacgcggggaagtcctttgatgaagtccatggcgatgtcctcccagacttgcgtgggcaccgacagcgactgaagcaggcccgccggatgaaggtgttcggtcttgttgcgttggtaggttgaacatgtgctcatgaattcttggacgacttgcttggcatggggcgtgaagaagtccgtgcacagcctgtgaagtgtgcgctcgacgccttcgtggccggtgtgggcgtggtcgagcagcgcgggcagtgtcggggaagacgtcggcacggacacggtcattgcgaaggataaggccgccacggaaagcccatggctagcccaaccaacccagcgtgccactggaaatgtcagcggcgatcttggctaggtcctcgttcgtggtcacctcacgcctagggatggcaacggggcggggccgagttgggctgaaacggcctcgcccccgacccctgactacatcccccgcccctggccccgactggagatgtgggccaaatcaggccccgtccccgacccctctagggccccgcaacccgactagggccccgcattaggtagtcgagaggccgcaggggagagggagagggcgaccgggacgacgagaccaaaggagtgcgtggtgccgattcgtgggacttgggaggct

SEQ ID NO: 7699 - DNA, 2987 bp, Oryza sativa
tagggccccgcaacccgactagggccccgcattaggtagtcgagaggccgcaggggagagggagagggcgaccgggacgactagaccaaaggagtgcgtggtgccgattcgtggacttgggaggctggaagagagaggaggggaggggagagggagcggacgacgaggggtgcatggtgccggtgcgcagtgcgccgcccctgctgccctgtgctccgctgcctccgcctatgtgatgtgggtgcgcgtacgggagaggagaggtcacccgcgggtgaaatatgtcccccgttccctcccctcccaaattgccatccctactcgctcgggaggttgtcaaatgccatgaacgtcagctcggagattgccaaggcgatgagctcggcgtccttcgtgcggtgggtcagggcgtccgccacgacgttcgtgcgacccggtcgatattctatagtaaagtcaaaaccaatgagcttgcttaccaccaccgatgttgcgagattgtgcaaagcgttgatccaacagaaacttcagactgtagtggtcggggcggacgacgaacgcccgttcccagatgtatgcgcgccaatggcggatggattggacaagagtgatcaactcctgctcgtagtggacgagtcaggcatggcgtggtgctactgcccggctgaagaaggctagtgggcccgtcccttggtgtagtacgactctaatgttggacccggacgcatcgtctttgaccacaaaccacatgatgaagtcgggtagttgcagcacgggacccatccacagggcatgcttgagctcggtgaaggcttgtgctgcgtctggcgtccaatggaattaggggtgaaaacggtaacggtaattaccggccgaccgacgttcattttcgactttctaccggccgagccatatggaaatggtaatcgaccgaaacaaaaatggaaatggcaaaaaatatggaaatgaaaacggaaatggttttgctgttataccgatcgtttccgtatttatcgtattctcgtggaaattaccgtttcttataatgtggtaattaccgtattctaaatatatcgatatttatagggcatgtctatacttatgtatacatataacatacttatgtaaagttaaatatatatttttatagtttaatatttccgtatttgttaccgacttccgatctgtaccgatatgtttccgtccgtattgttccgtttccggtttttcgatatttccgatatcgtttccgagaaaaatatggttacagaaatggttgaggctattttccgatcgtttccgactgttttcatccctaagtggaatgcttcgcgcttaaggatagccgtcaatggtgctgcgatcgcaccgtagttgcgaatgaacttacggtagtatccagccaggctgaggaagctgcggacggctcccacggagagggttgcgaccagtatgccattgcgcacaccttctgcacatccatggccaccctgtttgcgaacaccacatggccgaggtagttgatctgctgttcgccgaagtggcacttggagcgcttcaggatgagatgattggcgcgaacgacgctgagcactgcccgaatgtgctgaaggtgttggcccatgtcccgctgtagatcagtatgtcgttgaagaacaccaggacgaaccggcgtaagaatggggcgagtaccatgttcatcagcgcctggaatgtcgccggcgcgttcgtcaagccgaatggcatgaacaagaacttgaaatggccttggtgtgtgcggaatgccgtcttgttgacatcgtccgggtgcatgcgaacctgatggtacccgaaatggagatccagcttggagaagaagtgggcgtcgcaaagttcatcaagcaattcgtcgagaaccaaaatgggaaacatgtccttggcagtcaccgtgttgagggctcggtagtccacgtagaagcgccatggcttgtggaccaacagaaccgacgacgagaatggcgacgtgttggggcagatggagagcttgtcagcgcattatttctccaattcgtcgttttgaagctgtgggtagcgatacggtcgaaccactaccgggggcttgccgggcttgaggtggatgtgatgattgatggatcgggtcggtgggaggccggttggagcgcgaagaggtcgtcaaattccgccagcaaggacggaaggagatcgtcggcgtgcagtgcagcgcaggtggatgtgaatcggttgtcgaggataccatagagtgtgacccggcaaccgcaccagatcgccatgcgcatgttgacgaagtcccacaggattggtcccaatattcgtagccactgagtgcccaagatgatgtcgacgcagctgaggtcgagggcgaagcagtcgacgtcgaacacctcggtggccacctacaggcgaagcccgtgcacgacacccgcgccgcggatgcgatcgttgtcagccaccaccacgcggagaccttggcgtaccggttggagaggtaggccgatgcgctgggccagcttggtggtgatgaaattgtgtgttgaagccggagtcaacaagggccatcacctgctcggccgcgatacgcgccacgaggcacatcgtgctagtgccattgacaccgaaaatcgcgttgagcgagatgtgtggttcatcggtgtcgtctgtgtcgtcccattcgctgaaattagccgtggtgtcgtcgtactcaaggtagatcaggcgagtgcacttgtgacctaatgaacttctcgtcacatttataacagaggccttgtttacagcgctctggtaactctgctggcgagagacaacgaaattggtgtcctggtgtgtcagccgccgtggttggtgatgaggttgcgccagtcatcggagttgacgccggggcaggagcgcgcgacgcgttttgctggcccttccgttcgtaggcacgagccaaggccatggcctcctggaaatcctcgggctgttgg

SEQ ID NO: 7700 - DNA, 4673 bp, Oryza sativa
ctagttatcattacaattatgaatttcaaatctcactgattgtccatatctcctttttattaaaaaaaaacttagaaaacccatgctcccctgtcatggaaatatgttatcgatatattcatttttttcgaacgcacaaaataattgcacgtcaattatattagaagaaagcagagtgtttgatacacaacgcaatcagcccaacatgcttatcgatatattcgtaaagccgagaaaatcaagacatttgaaaattaacacaacggctcaaattaattagtcaaatgttactatatctgatatttataaacaatccaggtagtagcatgtaattagtgggtgagttgaactttattaaggtttagcccaagtgacacccacaccgtatggattggattgatatagctggcaagaaaacttgttatccctgaatgtccttgcttgtagtgtgtacaagaaattgtgtcatgatatagtagcaagtgtcactgttgatgtagcaagtgatgcatgtatgccatctacccaatttacatgacagtgctatgattatgataatatgaaaattgaaccacaagctctgatcactaaggaaacatcagcagtgcctcttctagctgtaggttgctaaatactcccgttggttaggtcgttattatgccatggtggtgatagctagagtttgacatttcggaccgaaattttggatatttcagtcatttcggactcccccccccccccccggatacgatattattttggccaaaaattttattttaaaatttttttcgtgaattttggtaatatttgttcaaatttgactaattttggttccaaatttcggaaatttcaccatatcggcgctgcccgatacaaacaccgaaaacaaaaagttgaatcctagtgataattactagaagtattatgctgttattgattaactataactaactagtattatgttgttattgattacatgaattgttttgtgaatgaaataaaacttttacaatgtttatctattgatattagaagtaatctagacctttaaaaaaaaattcatccaaaagtgacatgtaaaacatgtactcctatttctgcatgaagaagtagctcaaatgtctgaatatatttgccacaattgcatgacagtgccctaatatactaacatttatgcggcacaataatcagcagaaccaattatcacacgtagttaattaagttgaaaacaattgctattttggacggacaggatcattgccagatgcaaagacaacgtgcatcccgggcctccgaacatcgcggcgccaatcacagccactcatcagggcgaggcgacacaacatgtgcaaatgcagctaataattctgaaaactaaccaacatatagttatatggtctcatatcatatgatctgtatatttatatatttaccactgtacgtgtgtgtgtatgtgccatctgaaaatgtacatatctgaattggtccatggctgcatcttgttacttttgattagtaggactgcaggagcaggagcaggaacaaactttctatcttgattattttctgacgaagggctggtttaggttccaacttttctatcccatcaaaattttcttacacatacaaactttcaacttttccgtcgcatcgttcccatttcaatcaaacttccaattttagcgtgaactgaacacatccgaagtgaacgttttggtcttggtgttcttcagatacctgatctatcccttcacagaaatgatagaaagacataggaattcatagttctctgtggcatctaggaaaccgaatatttctcgggaaaaaaaaccatgttgataaggtagagatacgcagtgcttgtaaaatctgcatggggcagtgcagtaattttttttctttttagaattccctgggaccctggctgttgtgcgttgctgatttcggatttgccgtaaatcaatacaggtgagcagagtagtgcatgtggggtgagtagcagagtaggctgttggtaggtcatggtgttggagacatgtaacatggcactgcactatcgccatgatcgtgtattggattcacaagttttccctttttcatttttttgcctggtgatgatagcaaagtggttgtagacaaatgtactgtgcttgcagatttgcttatcccatatttctatttagagcatctccggcagctcatctaaatttcaacttccatatttctaattagatggctatccaaaaagattctcactctatattacttttcacttcaacagatcatccatattacattctccatatattaacatcctatattttattaatatttttcaaccaccacatatttttactcaattcctctcacttttcaccacttaaaaaaaatcttcctcaccactctctcttctacagccgagaggacgtgggccgatcggggggagcggcgcgggcgaagacctgagcggtgagggcggcggggtggcatgagtcgaaggagcggccggtcagagggagcggcacagtcggaggagcggcggggtgacgcggtcagaggagtggcggcgcgggcgttgactcggagcggcggggatggccgggtggcgtcgatccgaggaacggccggtcggaggggaggcgcggtcgcaagagcagtgggaagacacctcttcgctgccagattcgccgcctctccgcctctactccggttctctccacctccagatccaccacctctccgcctctactccggtatgcacttcctctttactgctactctctcgcgttatgtagtctagatggtggcgcgagttcgattgtgaggtaagcagttgaggatggtgtgaggagagagaaccgccatatttggcttgggaagggctcggtttggaggacctctaaaaatggcgtgtgcaatggagactctgctggagcactgtttttctcctccatgcgccaaacaccggatggatgactagatagaggagctgttgaggatactctaacacgtagatcccatgttctagtggcagagccagaatttttccaaacctagggctcaattggttgaatgtatataattttgactttatcttctagtttttgaagttttaaaatggaatttcaatgaatatttatttaggatcaggagtatggccaacctgccctactcctgtctctgtccctgtcatgttgactccaaccgggttaaccacaatcaactcgtaacgtcagccaaaaaccagacataatattgccccgggaggctgggaccttagctactttcggtattacaagttgagaaatgcattatatctgagtatcgcggttcaaagaactcggcaccacgatgagtgacccaaagtaaacttatcccatctgcttacccccatccggcccattaatctcggcccaacatctcgttctcacctctcactcctctccgtcgcttcgcgtgtgcgacgctgggagagagtacaccgaactaaaagcggcgaaggcgtctctgtccagtccaccaaccaaccaccgccatggcgggataccgcggcgggggttccgcctcgggcggcggcggcgggggggcgtcgtcggcgtcggcgttcgcgacgcgggtgctgctgctcctcacgctgctgccgatggcgctggccgcgttcgccttcgcgctgcagtggcgcggcgggatgcgcgacccggcgggcgcggcgtggcccgcggagacgcagaggttccccggcatggagaacagcccgctcggatcctcctcctcctcctcgggcgggggcgggggaggcgggtcctacttcgccgtcacctcgtcgcagtcctcctccgcggccgcagactgcgccgagatcctcggccggagcgcggcgtcctcctcgcacggcggcatctcgctctaccgcgggtggggcttcgactccgacgcgggactaacccccaaggtgaggtttccgctccccgatctgatctgcgcgtggagatctcgtctccagagcggcctcgatgtgaacctcgtgccgctgaattgcgctttgctttagacgtgaatccaatttgaaagccgcgatattaagagatccaaaagtagcctgaaatgttttggtgagatcgcatttctgtcctgcgaggatgagatagtcatcttcgtggaatgtagcaatattttgcagtttgggcaatacggcgatggcatcaaatggttattctagggtttaagtactcttgctttctgtgtaggcctgttctgcgggcaaggtcctatcttctagagtattttgatgcttcaatgctgatttatttgtcgtagattgtagattgttgtgttcctgacttgctccttcgctactgcatcaaattgagtcctatttgatgtgatttagattttagaggttagtggtcacttagagattgtctttttcaaccgaattctgtagcccagagataggaaacgtgtttgacacagagcaatgtcggggtggtgcattcttccaagaactttggttgacagggtttgtgggtgttggttgattcgcagtcttgcatgttccttgtgtgagccattaaaatttcggtatttgaacatcttgtattttgcattgaaatggatggtgcaactatgattcatgcaccctactatggttgtacaattgttcgcttttttgt

SEQ ID NO: 7701 - DNA, 7373 bp, Oryza sativa
agagtatttgatgcttcaatgctgatttatttgtcgtagattgtagattgttgtgttcctgacttgctccttcgctactgcatcaaattgagtcctatttgatgtgatttagattttagaggttagtggtcacttagagattgtctttttcaaccgaattctgtagcccagagataggaaacgtgtttgacacagagcaatgtcggggtggtgcattcttccaagaactttggttgacagggtttgtgggtgttggttgattcgcagtcttgcatgttccttgtgtgagccattaaaatttcggtatttgaacatcttgtattttgcattgaaatggatggtgcaactatgattcatgcaccctactatggttgtacaattgttcgcttttttgtaatctgaacatcaaaattaatcctgtcttatttgtgagaatgtggtatgcgagtctcgtttatcatgggatgagcttatgttaactgattatgcccctgaatatatcttcatgattctgcagatctgtatcacgggaagcacatctgcagggttacaccaaattcttccatggttgtactaccacaaggtcatcggtgtttcacactttttcctttttgttgaaggagaggctgcgaaaccagctgttacctcagttcttgaatccattcgggtaaacaactctgcaccatttcgttctgtacttgtatgacttttgcaggatctagttctgacttctttttgtttctaatttagggtgtaaaaatcatttacagaactaaagaattgaaagagaaacaggacagaaggtattgtgatgtactgagaagctgtttagagtttttttttgtaaaagatgaggttttgttggagattggtccactgacaatctaaaatttaattcttctaggacactgctttaacaagatatagattagaaaagcagtgattaagtcttatactgtttgcttcaaatgatgtggttgagttctagtagtaaagatggaaccaaaccttcttgcttctataacatttttgttgatcgaacccattttacaagatttgcaatttcttatttctgaagtattcatgttgtttgggtcctgtatgtttgtttcccttttgctagtgaaatatgtgtatgttgctaacaagtttacctgtatttttcttgatatttttcgtggtctgaatttctactgttaaaacattttcagtcgcatttggaatgagacttggctggcaggtttcttttacaaaccgtgcaattatgaactatttgtcaaacagtcgctgaacatggaaatggctatcattatggcaagggtatgaactgttcgttttgcatgttcatgcgcttttgattcaatattcacaatcatgctcttgtgaaatgataattatcacaattttgattcaaaagcaccatagcctttttgttttacccatttttcagctacctccatgctatttcccctcaatttctaaggggaaccataattatcaccatatcatgttcagcctcgctgttgaactgtgtagcataatacagcacaaacatgtaagatatgaggtgatttgtgtaacaatactacagtaacaaaaggggaatatctctggtataattaactaatcaacctttttgtcattatattgttttcttctcactcacgtgtagggtgagtaatgggatggtacaactaatgcatgtaaagttgacaaaaaaaaacaaatacacacaccagttaatcatcataatcaataattcacatatcctttttcacggtccgctataaatgttagcccaattgctactgctagcagcaaaaagttaagaaatcccaataattgtaacatgttatactaccgtgccaatgccatatgaatgatgtggtttacatcaaccgttgttggcagttggcacacaagattataataatatgcttactcacgaaggcattttgcatgatgttgtttgtttagttctccagaaaccctgtttttggtgattagctttatttgagcttctccctgtttgattatcgtaggatgctggcatggactggatcattcatcttgataccgatgagctaattcatccagctggtgcccgggagtactctctgaggcgattgcttttagatgttcctgataatgttgacatggttatcttccccaactatgtgagttgcagaataaattttctgttgaggatgtagcctgtttcacatctaatttttatttattttccccaggagagcagcattgagcgagatgacatcaaagatcctttcacagaggtgtgtaagctattactaattcaaataaaagtaagaaaagtaaaggaaaatattgcccatataccacaatagaaggcatgatttaatgaaaaccactgcaaaaaatatttctccacagaaaaaaattgatcactagaattttgaaaacactttgtgaggctgtagcatttcgggatttgtagtagacaagatttcgcctgtaatttgttgtgttgttagaacttcataatttgaagcaaatcggagagaagctcaccaattttggcagctattagcaagagcccttgttactgggccaggtgcatgcttaaaatttagaagaattaaagtatgtattcagaattgcctgctttagtcacagtgttacctttcactttgcattgcgctaagaaatcgaaaccttaaactggtgaaactttggaaggtaaaactaattcccctttgtttatcctgtcaaaagaagaaaagcttcatgaggataaagttttgttgcttgatggagactagttaatatgcaatagtccatattgctgtttccacaccaaccctatctatgttgcgacttctatagcttcattacatattttgttgattgtttattgtaagttgtgcatgatcaataatgtgcgtccatgtgcttcaagctgttgtttaattttctggccaaaatctgttgtctacagatttcatagctcaactatcatccatcatattctctgtaaattcttatcagtttttcttatccgcaggtttccatgtttaagaaaaattatgatcatcttccaaaggatacatattttggcctatacaaagaagcaacgcgtggtaatccaaactattttctcacttacggtaatgggaaatcagcagcaagggttcaggagcatctgcgtccaaatggtgctcatagatggcataattacatgaaaaccccaaagtaagatgacagacatctgaaaacattgacatatattttttataaaactaaagttgttcagaggacaaattttagtgtttcttctggtcattttagtcatcagttatatattcatgtagtgaaatcaagttggaggaagctgctattctgcattacacttacacaaagttctcagacttaacttcaaggagggataggtgtggctgcaagcccacaaaggaagatgtgaagcgatgttttatcttggaatttgacagattggtgagtttatttgtgttctttcccttcgtttcatttgtaacgttggtcgacttcttgttgtatgataccaataacagtctcttaagaatgagaagttgatgctctttgcattctctctatcatagctttgccaagagcaactgttgtagcctgcaatgggataacttgtttgtgacattgcatagcatagctaattgtgtaacagtgtaagcagctagtttgataacactaataaatttggatccactcttacatgccaggcctttataattgcatcaacagctaccgaggaggaaatgaggaactggtaaacaccccttctctcctgtagcctgcaccctccctacttctctcccttaactaaagattgtatttgtcggacttcctcttcaggttccgggaacatgttttatggaacgacaaagataccaatttgaagcttttgaggaagggtgtgttgacacgcatatatgccccaatggcaagtcacaatctcgaacttctattaggagtacctttatctcaacaatgaaggcagcaactcatctcttgaatgattcatctttgcaggctatcattcgtggtctcaaggaatccggcgtattcaccaccgcggtaacttcagcaaaagcgcatgcaaaatttaagtcatcaaatacggatctcaaaaacaaggagtctattcatccaaatataacccaaggtgatcatttgcaagccacagtaagaaagatcctagaaatggttgatgcccagaaaaaagcgatgccaccaatgtcgcctcccggtttccttcatcaaaccgtcgaaactgctctatcgtgaagctgagtgggattccggagttaaaaactagaccgctatgcctgccaatggcagctgtttcggtgatttaagatcgctaaccttacaaagatgatgagattattatagactgcagactgcgtatgccgcttcacttatgtgtatagataagcactggggatgttagaacatggacattgtataatcttgcaatttttgatgtcttgtgctgatgtaaaatcacatatgttatacctagattggcattatcaagtgcaaatcatcacggtatctaccgagaaacataatgcaagtgaaaccctgctgtcaatatttttatactgaaattgtataccatttgcacataggtttacccctcttgaatacttgagtagtagtagtaacatagtcaacaaactttgcattcaatagacggaccaaagattcaaaatggatgggccttatttcgagtaatagctggatcatatcccttttccttacagtcttcacagatttcgtcctcttgaatacttgaaagtgtaacacaatcaaacaaactttatattcaaagatgtatcaaaatggatgagccttatttcgagaaacagctggaccatcccttctcattagggtgttcacagattcttgttctctgcatccaagttggcccctagaacaatcatggtaacaaatctacacggttacagtggcttcgatgtcctgaagtctgagggtaacagctcttctgtgagcctctagtccttcgacttcagccatctttgccacatgcggacccagacttctcaacccttcctctgacaaggactggacagtgatgtacttgaggaatgagttcagtgacacgccgctatacatccttgcgtaaccataggttggaaggacatggtttgtgccgcttgcatagtcgcccacgctctccggggtccattgtcccaagaagaccgaccctgtgatgaaaaaacgatcgcctgagattaccattgaagtatgaaaatgttcaggtcaagattaagacgctgacaggtatgcctatacctgcattctcgacaagatcctcccactgttcagcatcctttacattgatgatcaaatgctcaggggcatacatattggagaatgaaattgcctacataaggaagaaagagggggcttgtcaacaatccctgggaacggcaatagatcagataattttcatttaccttcatgcatgctgcaaaattctacgacctcaaactccagtgatgtatagtacgtgccttacaaattataaataattcgagagtgggcaggaatgaagaattacctcaaccatgtctttcgcaaaaacagtgaaactgtggccaagagctttcgaagcaaattctcccctaggaagagcagagcactgcttgctaacttctgcctcaatagcacccaaatcaacaccgtctcccgcaacaactagaacaacctgactgtctgggccatgttccgcctaaaattttgaacgaacaactgttatataatataatatgatacttaacaaagcttcacgacatcatgtaattcctatgcctcagattctcaaatatggcatttcaaagagtaaaggaagttcaataacaagtacacatttcaccagtatgaagcagggtattaagaatagaagatacctgagataacaaatcagcagcaacatgaactgggtttgcatatttatccgctatcactaatacttctgaagggccagcaggcatgtctatagaaaccatggcttcactgttctgccatcaaacaagaaaaatattgtcaccagggcagatattgttcaggattttacagaatgatcagaatagaacctgaagaatcatttttgcagccgtgacatactgatttccaggtccaaatattttttcaacctacaaagacagtatataagttgatcaccacaaataatggaaatgacacaattgttatgaataaatgagtacagaaaaatactagtgcaactaaagcatttctgaagtctgctaagttaacactagtgacaataagccagccaaacagaatcaatagtgcatatgtatttccctagtttgtattagaagaatacgaatccactcagaatacaatcacaaaaactgctcaagctggttaagtcatatactcatatttgcagttctataacaatcatatatagagtaaagagaagaccacagcccctatcccctgcatggtgcacctaaaaatagcccctacaagttacagaacaaaagattccaagtacctttgggcatgagactgttccccatgccatggctgaaatggcctgaaagaaaacaacaataatttaactcaacgccatattggggaacacaagatagtactatgaactatcaaatgtcctacctgagctcctccagctttcaatacatgtgtcacaccagcttttttagcacagtaaagaacctcctgcggaggacaagagcaacaaccgattccaaataattcaacattagaaacacaaacatatcaacttctcagaaatagcagcaatcctgcatccaataaaattgtaccttacatatgctaccatcacgactagggggtgtggcaagaacaacagttttgcaaccagcaatctgtgcaggctggcagaaagagatttactatattaaattgtaaaaaacaatgagaagagaatgatgagttaacacaatttaagaaaacatgaccataccacagcaagcatcaatgcagtggaaggcaatactgcagtgccacctgggacataaaggccaacagaaccaatgcatcttgttattcttttacatcttacacccttcaacacatccagggaagagttcacaagtcaaaaggtatgagaggaaggtaaaggcagggatggaattagagctaaatgggatcaacaaatgggtcttactttcatattctcaacagtcttttcaggcaacttttgcgaaacgtggaaggcataaatgttgtcatatgccacatcaaaggcttccttcacagctggatcaagctacaagattcaagattcccatgtaaggcaa

SEQ ID NO: 7702 - DNA, 2337 bp, Oryza sativa
cagtgtacaaattaacgcctttaggcgcaactatcacttagcatttgaaggctctgaatgcaagtacacagagttcacaacataattctatactagtagaacacaagtttggcaccaagcactcacatgcagtcatcatataactaatacaaggtgaatacctccacatccggaagatcgctaacacgcacaaccacatcatcgagtgcaaccttgtcgaacttcactgtataactgagcaaaccaaacccaggaagtcaatacaaaaatcatgctatacatggtccaaaaggatcgaacactacaccatcatcatcatcacttactccttgaccgcagcatcgcctcgcatgcgcacgtcttcaacaatcggattgacctactcgcacccaaaaaaaagaaaaaaaagactaagcccaatggttgagagacaatcaatcacaaattcacgcagtgaccacggctagtgtagctcgctctctctctctctctctctctctctccatctcgtctctatctcaccgtgccgaaaatggaggagaagtcgatgcgggggcgcgccttgaggccgccgacctcggcgtcgctgagctccgacagcctgtacgacttcatggcggcgcagctggtggaggtgctcagcctcagctggggcctaggcctagcagggagcggggtgtggaggggagacgcggcgagggggtgcgccctgcccggccgcaagctcatctcgagctctcctcttcccggtggtcgccggccggagcgggagcgggagcacggcgagcggcgagggaggaggattgggtggggacgaggcggctagggctttttttggcttggcttggcttggctagctcgagattcgagagtagcttttgggcttgggccgttgggccttagggcctctacctttttgggcttggctcgtgcccaggttttgttgggccttgactttctcttcttcctctatttttcatgtaggaaaaagtacattgaaatccctcatcttttcaccgaattacaaaaccgtccttcaaccgaaaacccaaatatctaaggtctgctagttgagggataattttgtaattcggtgataagataagagacctctgatatatgttttcctttcatgtatatttatcatgtgtgaagtgaaatggttgagggatataacttactactccctccgtttcatgctataaaacgttttgactttagtcaacatcaaactgctttaagtttgattaaatttgtagaaaaaatagtaacattttcaacccaagacaaatttattatgaaaatatattcaattattgatttgatgaaacaaatttagtattataaatattattatatttgtctataaacttaatcaaacttgaaataggtcaaaccgtcttataactcaaaacggagggagtataatagaagaatatacgctcttcagaaattgatggtttttcgtcacgtagagaaaaggaaggaggaagaatgaaagctattacctatatggttcatgagttagtctgcccatgagaaaaataggtttgtcaagtaaccttataattttcattaggggatggacttctaaaatctaaagttttaatttttagagttgaaaatcctagcactatattcgagatatgatgagtttttatattcaatgtattagtaactttaactagagtaacctatatcgcgaggtcttacattgttgtatcgccaatcagtatgcaacagaggttatgtgcatgatcaaaatgtctaaagcatatatgtagggaaatacattatagcctagaaatcaacaacctggatcattttctacttgtaacacaacactattagattagagagcaccgtaaagtaagttttatatgatcaccttgggtattaaatatggggtccactgagaaaataaccatcagaccgatgcatatgatctatccctcatatttgagtgatgtgtcggagttgttttctattgcgcaccagacaaatgtgacccgataagcttcgctctaatccgaggtgctacccgtggccagtgctagctttcacatcctcgctggattttctcgcgcataccatatcacactaccacccttctccatcccaataaccccaactttacacgctcggtttagcaacatttagatctttccaaacctcttttttaaaaaggaaacctacaaataaacccatgcgcgtctcaaagatacaaaaccggttcacacgcaccgtctcacctgacgtggcgagacaacactaccatcgttatacgtgctaatctttatagttgcaatggggatcctctagagtcgacctgcaggc

SEQ ID NO: 7703 - DNA, 1218 bp, Oryza sativa
gcaaattacccgataaagagtataaacttaatcgtgttttaaaaccaattacaaaaaatgcgaggccttggttcaggtgatcatcgatcgatcgcttgccgctcgatgcaatgtgatgttttggatgtcacctgggtcatcatctgatgtaaacaagaaggttttttggtgtttagctttgtaagttaagagtgatcatgcatggtagtgtgagtgaagaagggtagattgcacattcaactaggacagataaacataggtagatctatatgaaatcgccttggtttttgggtgtacttgtagtgagagagatgtttccatgtgcatgtatgagatgtttccatgtgcatgtatgagtatgattggtggatgatgcaccctggattcagtgcaaaatgtttatcatttcagattttgatgttaagcttgatttgctccatgtattcagagagtagaaacaaagatacgtacgtcgttacacatgacacttgctatgcaccctacgaagtaggaacacgtcaatctcgatcgatcatatgtacgtacatgttaacatgagattgcggacaaccttttgatgtcttaagagccttgagatggataggcatatatctatttaattcatcatcttggtcaacaggttcagcccagtccagtcctagcaaccataagctaattatgtactacgaaataaaaaagagagagaaagatattaacttctctgcagttaggcaaagcagactaatccatccactcatccaccacttctgctgcataacgggcgcctcctacaggcgcagtagttgttgcaccagagctcttcttcaccttctcggcgaggaacttggccgtgtcggcgcccttcacgttgaactccatcaggagctcctcgaacagcgtcttgaggttgtcgttgaacgtggggcgtctactgacggaatccaccttgtccggccgcggcttcagagcggcggcggcggcgctggcgctggcgctgctggtggatgctcccgcgtcgccgtactccggctccttctcttcggggaccaccgatccgaccttgtggccttccatgtagtacctgcatgctgccaggatggtgtgcccgcgctccctgaagtggctggtaacaaggtctgcgaagtgctgcgagggggcaaagagaggagtgttaaagcggcttggaaacttgatttctgttctactttgtgatgttaa

SEQ ID NO: 7704 - DNA, 3151 bp, Oryza sativa
tgaataagacgaacggtcaaacatgtgctaaaaagtcaacggcgtcaaacatttcgaaacggagggagtactccgtatacacaaagcatgagtaccgcaaacaccaaatacaacgacgagatatataactttccttagaaaatccgcaaaaaaaagtcaaatataagtgtagactgtagtatactcatattgtacgaaaatgctgccgctcggtcgcccagaggaggaggagaaaatcgggcgctcccccctccctccacgacgtgcccatgtgtttctactgggaccccactgtcgacgtttgatgtcacgactacggtatttggacagtatggggatcgttggtgttaggatatacgcgagactgaggtaaaagagacggagacagggatttttatacaggttcaggcccctaagttatcaggtaataaccgtacattctgttggccgaagccggtattgcttttattcatgataatcacaccagtataatatttggggtagcccatctaactgttgtcgacatggcggtctgacgatctgactcgtagtcgacaacagggtagccttcctcctcgaatccgtgcccggcgagatcagagatagcgtttttgtctctcctgacagtatccggagacaccgtagggtactagccgtgcttatccctgaagtcaatatccggcggcgtgtcttggcgtatgtaggcctctatgttgattgtgttgagtgttgatcctccgttaatcgccccctctcctcctaggggggcttttatttatacccataggtgttcccttgtccaagtagaactagggaaaccaatatggatacaatccgagtagttctcatcgtttccatgtagaactttggttgcctttccttatcggaactcctcctatatccgaagattgtttccgtataggacacggtatgtggtgggtcctgccgagatttagtcgactactattaggtatgtggtatccataaccctgacacccaccatgtgtccttactacttgccacatatcttcaccatatactctattgcaaaaaaaaaaactcacatattttggaaatcccctattaagggaaatttgatttattttttgttccaccaaaaatgtttcacttagtgtattcacaatgtttcactatgtatagatctaatgttgcagtgaactgaaatactccattgcaacaaaaaaaacccacatattttagaaaccccctattaaggaaattcgttttatttttttttctaccgaaaatatttcatctagtgtacttataatgtttcactatgtatggatcaaatgttacagtgaactgaaacattgtttcgctatttgctgaaacattgtttttatataaggtgaaacaacacccgatttaaacgagtgaaacatttccgatctacttagtaaaacaattccgatatacccggtggaacatcgtgcaacatttaaaaataattcaataataagctaaaaaaaatttcgtcggaatatatccatgtgtgatcttgttttgaagatttaattataacgaatttaatggtgcaatcggatcatgatttggataagtaatttttgagaaaaatcagtttaaaatagtttttgcacgtaaatcggatgacgtcagcgcccgatttttccccaaagcatcgggtgtccgacacgtaggcccttcccatattgtatagctatagagtgtataaaatatatgtgtaaaaaaaacgtacgcaagtacatcgtgcggccattagaatttttctcctccgcaaagacaaatcgaaaaatcgaaagttttgttgcccaatttttagtcaataatagcataccaaaccgtagtatatatacgtcgcacaaatgatagtcccattgcaccgtcgtcatgtatgcataatgttgatagttgattactggcacgatgctatccaccaaatcatcctcgatcaacatcaataacccacttagaattgaaaaaagtgactgatattttttagggtaagagagaaactttattaatggctaaatagcgaggccttcaagccacaaccgcggtatgagttctttgtttgggggctgcttgccccttcgcgttgacaagaaaactgtggacgacaatgggtttagaattagaatagaacgaagaccctatcaaccaaatagaggaaaggacagaaagggggaaaaagtaaagtctaaacaacatatggcatgaaaaggaaatcaaatttcggtaagacttgatctgaatcgtagttcagatccaagtcggttcagtgaggatgaccgcgaaagtcaccgaatgggttcggtctgtcttttcctgatctttgtttgtccccccaaaaaacagcgtgaggggacgttgcagatgacttcttctaacgctagaagaccacaggaagaaacccgggaccagagcatgtggtgaaagacgcacacggtgcgagcatgcttcgaccgtgtctccgggccacaattacatttctggtttaacaagtctaggattggtgagggggcacacaacctccactccccacacgacctaatactcattgccatttgcgctaaaacatgagcaaccctatttgcttctctcttaatcttgtgcacttgcacccgttagatacattgtatcacactgttgatttctgcaattgtcatcgcccaagaggatcttgaggccacctgctttgttaacgcctgaacaacttcagcgttgtctagttccagaataatcgacatatgaatccacttcattgcttcttttagcccttctaagcatgttaaagattctgcttcagctgctgaggtacactggtgcagagttttatacacagccaagagcactaaccccctgcaatctctaatgataatcctagcacttgcttcaccagtttcacttatgtaagttgcatttacattgagctttgcacttccagcaggttaatatattgttcgtgtatgatatattggcttcatgtttagcgagcctatatgtcattgactcacgccaaaggaaagtactgtagaagagactcatctcatatatgttattgtatcagacacgaacaatatttgaaatacgtattattcatcatattttcaacgagcaaaacctcacttgtaccggcacatacaca

SEQ ID NO: 7705 - DNA, 757 bp, Oryza sativa
cccacccgccgccttccctgaaaaaaaaaataattaaccgcacgtggtaaatacggatatactcatcatacacaatcgattaatgttgttcttgtaataacaaagacgaataaaaacttgacctaaaatatcttatattttagtacagagagagtcgtgagcgatttaccggcggtgatggtggaggcgacgccgatgaagacgaagaggaaggtgaagaggagctcgccggcgacggcgcggaggcagccgggctcccacgcctcgccgcggtggccgagctccagcttcgtcatcggcagcaacggcatagaccgatcaccgatcgatcaatctgatatagtatttgacaacaatataaatccaaatatatatggctagctagcagcaaagttaggcgatagatcgaacgatatgccgaaatggttggtctctgatcgacaataagatgaatagatgatcgatcgagacaagccactaaagctagctagctaagctaagcgatcggtggaaagttgggaaccattttttccatggacaaaaaggaaaaaggctaacaagctttatatatagtgagagcattgagaggagatgatcagatatgtttttcatacaagtcaagaaagctcataatggcgagcttgaaatttctgcatcgacgcactggattactgcaaaggaggagctgtacatgcacgtacacgcatcgatcagctgcggcctgcacgaacatgtgcacactgtcacaccaaattgt

SEQ ID NO: 7706 - DNA, 592 bp, Oryza sativa
gagtcacacgtcgacatcgtctcgtcaaccgaaactgaatctcctgaatgcataggggagacgaagctgctgcagggtacagtgacaggtgccagtgcagcagtcggcacaatgctaggcactttaggaggaagaacagactccttctgtgtggcgctctcatggcgggatatggccggagccggcttggcggaagccgatttcaccgccgaggcccgattcgtgcccacattgcggccactggccaaagatcccttcttcactggtgcagctgaggcagctaaattcaacttttgcaggaggatgggacaagagaaatcaatttataatttatttcaatctgttcatttgggatttcacagaccacaagcatgaaaaggaataaaaatttaaaaacattagcagcacgcaagtatcatattaccaattgaagattccaaagcaagcaaacgtacaaaacacttcacaaataccaagaaagcttgatttttgaacttttgaaggtgccaataaactttatgcctgttgaccatggatgctcccaagaaatcattaatcaattaccatgaaaagaggcctaaaatcagcaagg

SEQ ID NO: 7707 - DNA, 278 bp, Oryza sativa
  unsure (1)..(278): unsure at all n locations
nnnnnnnnnnnnnnnnnnnnnnnnnnnnnnnnnnnnnnnttctttgtcagaaaccgtcggagattcgtgagatggggcgaagaacagcccacacagcgcattgcgagaggcatagccccgtgcttccagccagcaaccagggaggagggccgccagacgggggaggaggtgagggccgaagaaaggaggaaaaagcctcgctgttcgatgtccactcgccgccgagnnnnnnnnnnnnnnnnnnnnnnnnnnnnnnnnnnnnnnnnnnnnnnnnnnng

SEQ ID NO: 7708 - DNA, 734 bp, Oryza sativa
tatgatacttctactagccacactcacggcacaagtgacataccaggcggtcctagagccgcctggtggagtttgccggaacaatgagggtggccacaatggcggtgacctgatactcctcgctactcatgctatccggtacaaggtcttcttctattgcaactcggctgcctttgtggcatccatcattgttgtgatcatattgcagagcaaggatctagtcaaccgatatgcgctccatgccgctataatactggaccttatgggactcatgggtgcctacgctgctggaagctggagagatattggtgcctccctatctatcttcgtcttggttgctgccatcattgtattgttagtagtgacctacattgtgagttgcaagtctctgactcgagggaacaatggaaatgtgtcgttagcggagcagaaaagaaaaagggaattgcagaagaggcaaaaaaaagggctgtggctcaatcttgcagtactggccatcaccatcacctaccaagctgggctaactccaccgggcggcttctggatcgaacatgccgatgaagaacaccataatggagatccggtccttggtgacaaccaccgtggctggtacacggccttcttcttctgcaacacgacgagcttcatggcgtccgttgtcaccatcgtttccctggtgagccaaagcctctctgagattgatatggcgtactgcaaggcgctctactgctgcg

SEQ ID NO: 7709 - DNA, 4195 bp, Oryza sativa
  unsure (1)..(4195): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcccatccctcctccgctgttcaataggatcatgtcgaactgctattcggcagggttctattttggcgaaaaaattccggccagccatcatttctgtgattttcattaaaataatattattttaaaaaataggtacatgagcctttcttttgcctctacatccttcccaaggcaggttcagtgcacgcacgaacaaatgtgaattgtgtgcagtctatagcgatgggctcatgggcacatgccaatacacatgttagaaattagaagtcgatcttatataataatttcatataacgaaaacttaagcaaaaagcatagagccaattattggcaaaactaactaattctatagcataaataaattcacaattttgacaattatcaattgcttgttttatgaatatttaagataatgaaaatggtttacattcctattgtctgcgccgcttgccagtggcggacaagaaattccatattgagtgtgcctacgagaatttgcaggctgattctagcagcctacatccacataaatacatagcaggtctaaatttctaaagaatactctaaataattcgagtgaaatagatagcaagaatatctcatgagatattttcatagcataaaaacatgcgattacattattgttgctcatttttcaacaaaatggcttgctcggtaaatatgaccaaccaattattgaataattgtttggacattgattaaaacttttgaatttatttgttttatattttggttatcaattagcaaacatgacttcaatctcattgatttcacattccagttcaaacaaaatctcagtggtccatggaaagcggataacagatttaaagaaaatataatgtagaggagatgaaagactacctggtgagtgagctgcttggtttgtgagctgtgtggagtgggagggagtggctgattgggcttatgggctttgctttttttaattgtggatctagaaagcaatgaaaatagagtatttaggctaatgattccctgaaaaatagtgttttaggccaactgattaccgcagcagcgtacgtcctaattttttcgcgtatgttttgcaactaataatatttttaactaaatgaaaaacatagggtgaagtaacaaatccatagtgaccggcgaagaaccatggagatggcgaggtgcagccgttgtgctccacgcaacccgtgtttgaccctggatatgctcacctttttcttaataatttcgacatagagtctttccaattgtctaacgttttatttaaaacgcaaaatcgtaaaattttcaataggatccaatgttcctccagaaattctttatttcaaaggggctatgaggtatgatagttattgcctttttatttttgaaaaaaagtacgaattaccccctgaactatcgcggtcgaccgaattacccccttaacccaaaaaccatacattgctcacccttaacttttaataccggacgaattacccccccgatctaatctagagcggttttattctacgtgaaatacgcgtggcaatccagtcagcattttatttattaaaaaaatttaggatacactggtcacactactcttcccctcttcctctctctcttgcgtgcagcggcggcacgggggcagacggtcggcgcagacgctagcgctcatggtggcacgcacagcgtggtggagtgcatgggatggggctgtggcaggccaggcggggagtggcagaaggggcggtcgtgtgcacgtcggcggccgtggcggaggcgcggggaggaggcggaccgagtggtcagcagcggaggcggcgatcgcttgcacgcacacctgccgcccacccttccctgccgcaaccttctctttccggaccactgttgacatcgccgctttctccgcttgggccgccaccgccttctccacccggacaaccaccaccgacgcactgcaggaaatgggagggagtcgaaagagaaggaaaggggcaagggaggagcagcggtgacgaccctcctcgttgtcgtccgcctcctgcgcagctccatctcgcgtgtcgccgccacggatgccgtcaccgacacccgtgcttcacgttcgcagtcgccgcccgccttccccgcgcgcccgccatgctcctctatggcagagagagaaaagagagagagaggggggggggtgaggtaggagtacatgacaagtgggcccatagttttttattattttttatgattggattgccaccttggtgccacgtgtatgccatgtaggagcaaaaccactccggattgagtcaagggggtaatttgtccagtttcaatagtttagggtatcaaatgtctgtttttgtggttcgagggtaatttgtactgtcgtaattattcagggaggtgggggatgattcatacttttttctttaattttttttaccccacgaatctagctgaaattatttaaggttctgttagtcacaaatttagatccaagattacttgaaactggatatttgtagcttcttggatctatgaatttggatcctcgattatattaataacatttggagaaccattttgaccctattttggatgagataaaaaaaattaaaccaatataatctaacaaacaaactttgaatccagcgtggatatgaggcgtggagatgtgttatttgctcggtgttaaaaaaattaggctgtgttatttgcttagtgttccaacccctctccctcatgttccgcgcgcacacttttcaaactgctaaacagtgcgctttttaaaaaaatttctatacgaaagttgcttaaaaaaatcgtattttcctattttttttaaaaaataactaatacttaattaatcacgcactaacggaccgctccgtttttcgtgcggaagattacttattagcaagagagggataagaggcaaacataaatccacatagttgcagttggatatatacatatttttttaaaaaaatagagtttgatgccgaaacagctaaaaaaaccaaaattttccttttctctttgtttttttaataaagaggacactatctttgtcttgtactatgtattaatagagcatgatcatttttatcttacaaacttaggccttgtttagttggggaaaagttttgagtttgattgtcacatcggatatacagacatacatttgaagtattaaacgtagtgtaataataaaacaaattacggattccgtcaggaaactgcgagacgaatttattaaggctaattaatctgtcattagcaaatatttactgttacaccacattataaaatcatgacgcaattaggcttaaaagattcgactcacgatttacacgcaaactatataattgttttttccacattagtactctatacatatgtcaaacatttaatgtgacgggtgaaaagtttttcttttgggaactaaagagggccttaaacaaactcagccgtcaccattcgctaacccaattattggaaagggatccggctcctctaactttgcaagcgaacggcagggaattacagtaaagcccttgtttagttccaaactttttttcaaacttccaacttttccatcacattaaaatttttctacacacaaactttcaatttttttttgtcacattgttccaatttcaatcaaattttcaattttaacgcgaactagacacacccaaaatgagtctggtgctacagtgaagaacagtgtttttgcagtttttcattgtagccgcagtatagaaacagtaaaaaccaccgtgctaattcactattcactggataatgtagcgtactgtactgattaatctcgctcgttcgctccagcatatccagctttgcctttatattgccgttgctaactactccagcttaggcagatccagcatccaggcggctactcgatt

SEQ ID NO: 7710 - DNA, 6080 bp, Oryza sativa
gcggggctggacgtcggggtggtggtgaacaacgcgggcgtggcgcgcccgtgcccggtgtacctgcacaaggcgaagccggaggcgtgggtgaggatgatacgggtgaacctgtggccggtgacggaggtgacggcggcggtgctgccggggatggtggcgcgggggaggggcgccgtcgtcaacatcggctccggctccacggaggccatcccttccttcccactctactccgtctacgccgccactaaacggtatactaattaatgctaattatctttgtttgtgtcttactaatattccccacaaaaattacttttgtgcattctaatagtatatataaaagcatattaatctcggcaattttgaataatagctagcagtttgggcaaatatatttgttttgccatcagactaattgaacggtgttcttgtgttcttcagtatctgaagatggttaatgacttcagtatctgcccaatgccatcagactaattaatgttggatttaaatcatttgacgagcaatgcatcatatcctgatatatggagtacactcgcttaataatgatgtattaaatatagtactagctagtactactcgatataattggagtgtccagtatactgctctaattggattcaatgttctgtatccacaattccatatgctagctggttttaattttttttttcttcttgtactttcacttacgctgcaggtacgttgctgagttctcgaggagcctttacgtggaatacaagagcaaaggaatcgacgtgcaatgtcaggtatatattgtactcttgtttaagtttttagaaaacaattttttcatgtattgctggtggtttgacgaacgctttcatctgttcgcttctcaaaatggggatgactagaaataaccggtcgatcaaatttagggctactttaaaacgtatgatttaaaagcacacgagaaaaatcatacgaataggatatcatgtcaataaatcctacatgaaatatatttaataggattttgaataattattgtttgataatactcctttcgttttacaatgtaagtcattttagcattttccatattcatattaatgttaataaatctagatatatatatctatctagattcattaagtgggaaatgatagaatgacttacaatttgaaatggaggaagtactagaggtgggtacaattacttctcgaaaaccgagcaccgatccaacccgaacagtcgggttttctcggtctttcgttttcctttttccaaacttggctgtgtttagtttctgaaattggagagaaatttgaggaaagttggtagtttggaaaaaagttaggagtttatgtgtgtaggaaagttttgaatgtgatgaaaaattgggagttggggaaaagtttggtgtgaactaaacacacccttgtcggtttgatgttgctagaaaccgataagcccataaaaactgaacgcatctgtatcttcatgtaggattaatcaattcaatccccaatttaggaataattacctattagacactcttataaatggtaattaaagatttatcactggaatcatatgtcattaacacatgaggacccacatgttatagacagcaagtggcaaatgcctaattgccacatttaaaagtggaaaaaatttaaatgccccttgggtaaaccgaaaaggccaaaccgaagtagttcgatttgttttgctcggttttagttccttttttttcttagcaaattcggttcgtatttcttgaaaaccgaactttcagcaaacttaagaaaccgaaccgagaaaaccatataaactaagtgctaagtgcccagccctagataataccataagaaaagtaaaggaactttgagtcataaggatgagaaaacatgtggtcaagccttatgttagtttttttttctaaaattccttcaaagtgagcaatttcataggaatttcaaagaattttagagaagcaattcctatattccctaaaaaaatttggattttggagaagcaattcctatattccctaaaaaccatgtagggaaatttttcaatggatccaaatcctttagaattcctctacttttccttaagggcatgtttagctccaaaaacatcacatcgaatctttaaacgtacgtatggagcattaaatattagataaaaagaaaaactaattgccagtttgcatgtaaatcgcgagatgaatcttttgagcataattagtccatgattagccataagtgctacagtaacccacatgtgctaatgacggattaattaggttcaaaagattcgtctctcggttttcaggcgagttatgaaattagttttttcattcgtgtcaaaaaccccttctaatatccggtcaaatatccgatgtgattcccaaaattttttattttaccaactagccttaagttccaacaattaatttgatgcacaccgtaccgtcaaatccttgccagcccaactgtcattaattagtagggtccatcctctgatccacgcatgtgaaactgcagtatattcacgtggtgagtgacagtgtaacagcgaaagtaaacaaacaaccatgtgttgatttggaagttggaacttgattcaagtcaaaaggcgccgatcctatatatttatatgagtaaattttataaaatcacgtatacttttattaatttattgtaaaactatctataaatcagacgctaatagttttcttatttcacgtgttcatacttaatttttatcttcagtgaactcaaacatgagcttagttttgaagttataaagaacgacagatttaagccatacctgatactccgagataagccatatcatcatagtataactttttgtcacttgatgatcgttcaaggtgcagaatatgtatataaaacataatctattaatgaacagttttgttatacatatgttgacaaattttattttaaaaatttgacagttacaaatatagaataattatattgtaagttgtatataaatacaatacaacttgtatattaaaatcttgcagtaatatgctattttcacgaagcgaggttatgggaccaaatctctttatgtgcacgttgtgatttttttcttcttcacttacacaaatttaaagtaaatctaacagttttaaatttatataaaaagttatatatcatttatattggagatatatgtaagttataatatgagtatattataattgtactaaatttacgtttgataaccttttagaagaaaatttatcgataaatttttcaactttctaagtcgtgaggagggttgaagtacctgtgtccataaaccctcttttatgtcataactgtgatagtcctattaactaatggtacacacgaacgcgatgtacgcgcatgcttgcaggctccgctgttcgtggcgaccaacatgaccttcggcgtcgcgaaggccggcggcggcggcgacgacgccgccgccaaggggagcaagcggcggcagcggcggtggctctcgccgctgttcgtgccgaccgcggacgcctacgcggcggcggcggcgcggtggatcgggcacggcgcggtgtgcatgcccaacctctgccaccggctgcagtggtgcgtgtcccgcgccgtgccggacgccgtccacgaccgtgtccgcctccgggagaacctccgccagagggccctcttccagcggctgcgtcgccggccgccacctcctgatgatcaaccaaaggcaaagatcgatggttgattggtcattggtttagttagctcgttagctagcctcgcgcgctgcatatgtagctatagctatatagctagctcgttgggtgtttctgcctgagctctctgatgagtgatgactgattgagcagaggtgtaaaactagcgtaattataaaaaaaataaataagccgaacattaaaattgggcatggaaactcatgattgaaaccgaagtagtaggttctaatctgtgagtattaattaattagccaaaatcatgtgttccgttgcatgcatatatgcgagtggcctcacgtcattcattcaagcaacaatcatgtgcacgtgctttcaaatacaagtggggtgtttagataaaggggtgtaaagttttgtcgtgccatattggatattatataggatgccgcatggggtgtttgggtaacggtcaagcaacggtcatgtgcacgtgctttcaaatacaagtctttttagggggtgttaaaggggtgtaacgttttggcgtattatattggatattatataggatgtcacatggggtgtttggacactaataaaaaactaattacagaatccgtcaataaaccacgagacgaatttattaagcctaattaatccatcattagcaaatgtttaatgtggtgctcaaatcatggagctattaggctcaaaagattcgtttcgcaaaatagttgcaatctgtgcaattagttatttttttagactatatttaatactttatacatgtattcaaacgtttaatgtgagaggatgtaaaatttttgcgtggaatctaaacagggccttactctcccatctctgttctaatctgatatctatggaagcagctcatatgacgtaaattcagagggacatgtgtcccttatgggtggggcccaccatcatggccccacatgtcagtggcccatgtccttctaacgtacataacataagagagcctcattcgatatatatatatagagctattttttatgttttgagatctttattgtagttggggcatctcttaaaaataagcaaggttattaattagtattgggatctgtatttcagtattttacgatagtgcaatgacgaaacaaaatcggtcctatttagtatcaattttcatagtatatcgatattactattcattttcacatgattctataaaattttagttattatcccgattttacgatcactgcgatcctgcttaataacataaaatggattgaaaaatattgtgattaaatatgctcaagttttcataaaaaccaattaaatttatcaacattaatattatatggtttaatttatctaatataatatatatttgatataaaatatgtacattctaaaatcttatagtataccgattccatgatactacaaatagaaaacgattctatatagtatctcgatagtggttaccttgtaaataagtgatccatttctccaactcaatataaatatagggcaattaagtcatgtttgagattagtttatagtttgtacgcccaagtatagtttatagaacgacgacttacaggtgctccacagagagtatttacaaggcccgttcggaagtgattttggctatgttaattttctcattttccattagcatgtttcttagaactgctaagctcgttaggctcgttaatgcatttatatcattcttataatttcaactttaccattttatcatatacaaatataataataatcattgactaataaataacctactaaatataaataatttggatgtaattaaatgactaaacactaaataggaagcacagcatacatatgaagtgatctcttatacttaatactaatgagctaaacgagtagcttgtaagttggctcattaagctcgcaagctaaaggcctagcttgctccaagctgatctgagacatgagcttttttttctaccccttatagaagtttctttaagaaaattaaataaatccatgttttatgtttgtagtaattagtactcaattagtcatatgctaatgagttatcttgttttttacatactgctaatatgccaagctttacagactagtcaaacagagccttcacaggagtttccaaccatcatattagtagacatctttctattagccattagataagtgctctctcggatgtttaatttaaaatttatctattaaaatattttaaaaataacttttattttcaaagtagtacatatttaaaccaccaacgctcctaagaacaattttttatgactttgacatataatagcgtatactaaccgccgcacagagtaaaactaaccatttagtg

SEQ ID NO: 7711 - DNA, 11848 bp, Oryza sativa
  unsure (1)..(11848): unsure at all n locations
tttttattttaaattttatctattaaaatattttaaaaataacttttattttcaaagtagtacatatttaaaccaccaacgctcctaagaacaattttttatgactttgacatataatagcgtatactaaccgccgcacagagtaaaactaaccatttagtgaacactccttacaaccatcccagaggaggacaaggagtaacctgtaaaatgtcacctataccatttgcaggtgacccccttgcaaaatagtcaacccttcttcatacaaacgttagcattgattaataattatatcccgcatcataaaaaacacttctcatagtatagttcttttataaaaagtgccctcccaaaaaatattagagaaagattctgtaataatttaaaaataaaaaaaattaaaatattttaatgaataaaataaaaatatcatatgcttcaaccgcccccatgtccgttccacttcggttccattcgattcacctcgcttgcctacattgataccgtcgcccgagaagtctccacgcttcaagaaaccgccggggcatctgagtcggcagcgatgcatactaccgtacgtacatgctcattaacataattaatctgtatatatactagtaatatacatacaactgtgcctaatatttctgcaggccgcgcctcactttgccaccagctttaatttggaggggtcggtgctaataatgtcaagatcaaggctggtcctggggctggctatgtaacaccctgaaaatttcggttttgatttgtgaaattaaaaattcaggataatcaaaaatctttttcaaaatccgtcatgttggattttatctcccatttttcggttgcgcttggaccacgaggacggaaatctaggaccaaaatatatttgggattcaaatcttatttattaaaagagccatgattatgaaatatattaattaagaaaatatttgcgaataccatttgtctttttgaaaacccttttctatgaattagaaacctatttgagatatttgttttataaataaaaacaaatactaaatatttcgaaaacatactttgagagatattttcccgagaaaactatttttacaaataagggctaatattagttaacttctgaaaaccctattttgaaattataagtgtttgggaattatttacaaataaagactagaaggaatttactagcaaaactctatttataaactaaaatcttaaaagagtttatttctaaagaactcacagaaaagtctagttttcctcattgaaaggcctagccgacctgcataatggaatttatgttaattgtgtgcatttgtattttcatgccaagatctcgatttaatccatccctgtgaatccaccctcttgccgtaattcctcaggattcgaattttgtagttcgattctccctctcaatcgaacccctctcgaaacaattgttctagtgtctggtattattcgaactcttagtagttcttgcagaattgcctctcaaggtaaaatcccttctctatcctctcaaccctcctatacaattacaattccccgtccctcccttgaatcgttggattacctcaattaaatcgttcggcctaaaggacatcctccgatcgacgtcttcccttttcgctaaatgcttcgatgctaagcgaatcgaaatcccaagatcctttccttttttcgcaatgtcgtttctttccccgaacccttggaaccttgcgatcggatcaaaacctgcttcggctattcgactcggctctccacggattctttcccccctatcactttgactcgaaattacagagtaaggcctttcgcttgaaactctaaaatcattcgacggatttaattgccgtacgttgattcatacattatcgattatacttctatccttgaaaccctaccgcatccaacggatttgtatgccaagcgtcacttctagaaccctcggcattgttgtcttttcattcgctcgagtgatcacaaaaaacccctaagttgagcacttaggcgactaagcggccgaattgaatctgaccattccacccaaacgatccgagtgcgggctaaaccaaaagtccatatttgcagttccaaaccccagttccaaatttcgacccagagccaaatcaaaagtccaaatatacatcatttacagttgtgcaatcccctttacaaattccctttacaatttccatctatagttatatacaaaacacatctattacagttaccccagccgtgtgccgcgctggtcgcaggcacaccgccgtgcaccgaagccatgccctggcatcccctgtataaggacgttcgtctctcttcacctcgaactccttgaattcctgtgtgcactaaatgcattctatagtggtggcttgctgagtacgggtggtactcaccttacttaactaaatcttttagaaaggagttggagttaactatatgagaactatgctaatgaagagatgtctaagacggtggagtcgggacctaggttcacccgtcgattcctgtggagtacgttggaccaccgctgcttcacttccgctatctaatctacttcttttggtattttgcaatgtacatgaccatgctcggtctatttgagtcccatttgggctacccttgtattgttaatgtatagttcaacctacataacgatgtcaacacattgggtttctggtgtatgtaagggttaatgtataggtatgttgcacatgtgcacttctaaccatatagcaatttgtcatttagtctatatgtatgtaagggttataatatatctctgtccacagtatgtcaagaaaataaaatacacatttatattaaaagtactaaactaacttattttttcttttattttttcccaggattatttatgggctagaaaaaaaaacattatggaatgtggaccaatacttacacttctgggcctttctctagagttcataatcgggcccgctacctatcatctcgaaattggggaaaaaatatgaacatgacgaatagatctggagtatctatatatatctatttagaaccgagaatactattagcgacaaaaaaatgaacatgacgaatggatcccgagaatatagatttagataccatatcatctcgaaattggtgaaaaaaaaatgtcagaacaaacagatcccnnnaatatgggatctatgtanannnnntnntnnnaatanncnnctatatatccccttcannnatatatatagtggagactgatatctcatcctaatctncaaactaancatctaatttttttaatgctttcttttctagtacacaggttgataatgttctgtgcggtaaaatgagtgcacaatgtcattcagatgcactttatgccataactaaagatttcatgaacaaactatttgatgagtataatatagattacattatccatagtgatgatccttgctgcttctatatgagatacatatgcccatgttaactagtcatatttcctccaaaattatatatagtccgaccattaatggtaaagacattataatgcacaaaccaccctttaaaaataacaacgaaaaaagataatagttttaagacatattattgatttggtcatatataattaactcttataattaagtctactaggaattggctgttaagagatggttttgtggatatggttaagtaaatttggttaactgttgttgatggtaatactcatttaaagcattggcaggataagattcgtagactaagataatttttaggaggatgggccaaatagactagtggtttctatagaaaaaagaaaaaggtctcgttatcttattttcttgataaaaaaacataatcaactttgttaactcaagaggagcttgattcaagactttatttgaggaataagttatcttgtgtgctaatagaagagtaaattaagtggtatctgcgagctaatactaaagatattttggaaagggactcaaatactaaatattttcatttggtagcaaatggtaagcataggaaaacaaggatttataagctacaggattgtgattgggtaatttatggtgatgcgaatttaaaggcgcatatcaccacttattataaaggtctttttggctgtcttgaagtttcttctttaacgttagatgaaagccaaataactgatattccacaagtttctcaattagaaaataatgctttagtacaagatttattttttgagaaggaaattaaagatacgatttttcaaatggaacataataaagctctgagtccggatgaattcctagctgagttttatcaggttttttggaattttattaagtccgatttggttgatttatttaatgattttcatagtggtagtttacctctttagtctcttaactttggttactgcccaagtgcaaagaggccttgaaaattcaaacatataggcctatttgtttacttaatgtcttaatgttagtttgaaaatttttactacagttgctacaaatagaatttctggagtggctcagaaggttattagtcccacacagacagcttttatacaagggaggaatattagggaggtgattgttattcttcatgaaacgatacatgaattgcatcagaaaaaaaagagtggtgtacttttaaaaactgattttgagaaagcttatgataaagtaaaatggtcttttgttcaacaaactttgaaaatgaagggtttctctcaaaaatggtgtgattgtattgcttttttttatccaaggtggacatgttggcattaaagtgaatgatcaagtggaaccaaaatttcaaacctataagggatttaggcaacgggacccgttatctccaattccttttaatatagttgttgatatgttagctatattaatagagcaaaagatgatggttaaatttctagagtggtcccacatctggttgatgatggttgtctatcttataatatgctgatgatactatcatttttttagagcatgatttacagaaagctaaaaatatgaaattgattttaattgcttttgaaaaattatctggcctgaagacaaattttcacaagagtgaattatcttgctttggccgagcaaagaaatgtcatgagcaatattcaaatatttctggatgcaaactaggaggttttcttgttaggtatcttgtcattcctatgcattttagaaagcttaataataaagattggctaacaattgaacaaagaattgagagaaaacttagtagttggaagggtaaacatatgtttgtaggtgggagattggttttgattaactttgagttatcaagtttagttatgtttatgattttgttttttaagattcctaaaggggttctttaaaaaattgattattatagacctcatttcttttggtaagatgatgaacataaaaataaatatagattgacaagatgggatattatttgtcagcctaaagatcaagggggccttggtgttcataatttagagatccaaaaccagtgtttattaagtaagtggtagtttaaattaataaatgagcaatgtgtgtggcaaaatcttttgaaaaggaaatatcttggtattaaatctataactcaagttgacaggaaacaaggggatttccattttttgtcaggtttgatgaaggttaaaagttcttttctaaatatgggttactggattattaataatggtgaacaagttagattctgggaggataagtggttaggtaattcatctttaaaggacaaataccaatcgttatcttctataccaatcgttatcttccacttaatgtcccttttaggagagcattagttggtttgaacttaattagatcgcacaatttgtgtggttcaaatgtgaatgctaacttaataatggagcatgatatatttagatggaatcttcatcaaagtggtcaattttcagtttgatctggctccaattaattatgggtattgttgatggtcgttatagaccaatttcgaccgtcaatataactaaaataaaggagaattagctatgcttgcaatgcatatttatttgacaataatgtagttccacttgtacctggagtattattattttgcagcgattaatacataaatggacacttcactccgaagcaagcttaagggtaagacgggcccacatgtcaggtgtaaccgtcccggaaaccgccataactgccataaccgccctaagaatccacctgtcaccgaccctggaaagtgcggaggcctgttgagccggcccaggttcggctgagccaagggttcggccaaaccctggaaagctcctctcatcccggccttccacgtggatgctcttgattgctcctcaatgatggttgcagggcaatttggacaattcacatagtgtaaccgtcattacctgcctataaaagaaggaggcttcattcacttcaacacacactcaagtagggatgaaaacggtcggaaacaatcagaaaacagcttcaaccatttccataaccatatttttctcggaaacaaaatcgaaaacggtaaagtcggaaacgaaaacaatatcggaaatatcggaaaaccataaacggaataatatggacggaaacatatcggtacagatcggaaaccggtaacaaatatgtaaataataaactataaaaacatatatttaactttacataagtatgttatatgtataaataaattcaagctcatactatataaattataagttaatttcattttagccattcactcaaattagggatttgattgaagagtcgatcaatgtctaaactgtgggtcaagtagagatatgccttataaatatcaacatatttagaaatacggtaattaccatatgataagaaacggtaatttccacaaaaatatggtaaatacggagacgatcggtataacaacaaaaccatttacgtttccatttccatattttttaccatttccatattttttcagtctattaccatttccatatggttcggccggtacaaagttagaaacgaacgccggtcggccggtaattaccattaccgttttcacccctacagtcaagcaagctcaacatttctctttatactttagtttagtattctattgctaagtggagtagaatagaacagctctcggagtcttcgaaggaattcgggtatggctctagtagctcttctttattcttttggaagactttcggaattaatggaatattattctttatatactctcggtactttagtttatctgagtatcggctttactttatatctgtatcgttatagttgtgtagctagcctaccagagaggtgcaatgtgtgggtttaatgtccgattattcggttgctctatgtcattcatagggatatagagtagtatttaataatgtagacgtggtgtctagattattaagtatcattatctgggaatatatgctgcgggatagtagaggtgggtcactgatggtgacagctcagtacgggtattcctccacgttagtaattattcctaagacaaattcctggggagggtactcctccgttagtggtacatagaagtcatgggtgactgttggttcgatgcttcgggtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccccagttgcatagaataattcgaactgaggcaatctttccggatttgctctgccttacagtcttgcttcccattgtcattgccatatgtcgcacgtgtgtggcccaacccataagtgccatgcggacttgacgtaatccccgccttctccagtatctgactggcaatcccacatgagtgcggcgacaatatccagaagtgctcgtgctgatgccgcatcgaaccaactacatcatgacaatattaccaatagacatctttcaataaaaataaacaattactgatagactctctgttagtaaaagttattggcaaactatatgtcggcaatactaggtaacaagacatgctatatgttggcaattttagatatatttttagtcaaaatatatgtcagcgatattaagagcagaaactaattatatgttagcaaaacttagtcatcaatcatctgtcagcaatgtttcgtacatcaactcttgatccgacggttaggacatgggatggcaaaacctcaggtggcaaatgaaaaagaaaaatatcaaaaaaatactaggggtgaaaacggtacgtaaatttccgagatttccggctgccgttttcagtttgtaccgaccgtttcagtcggtatatgtagccgacgttggtggaaatggaaatggtaatatctttcggaaatggtagtggacatgggatggaggtttttccgtccgttttgtcggtaaccgtatttgtacggtaatttctgtcaaaattccaaaagttcccagcggctcagccagcccaacacattggaagctcgtgaaggaaggaagcatggtagacttgcagcccacaaaaaatgggaagtgaccagggaaaatgttgttaatcctatgacgtggcatgtggattttcctgaactttggtctcctcaactaatcgatgttgtagtattgttgaactttgtttatattgttcattaaacttattatcatataattaatcatcatataatagtgttatgtagagtgtgatgatgcaaaaataaagttaaaaaagtcatcttcgtgcataattaaatgtgtgctatgccacactccacttatttcgacatgacttttcgacttcctaccaatatcggtatattccgttccgacgtcccgtttctgatgtaccgatattaccgatatcgttaccattttcaagtctacaattccgattctgttttcgagaagaaaaaaatatgaaaatgaaaatggtagggtttttctgaccgttttcattcataattaaaatacccgcgcagaaaatacccatggctcatttttgcaaataagtttttgcatggcctattttctgaaataagttttctaaaggggtcaatttgtcaaatttacggttcaggtgaccgtctgctgcgtgatgtagcaatgcagcaccacacctgccctgaactttgcttattagccatggtatcattccatgtaacttaagtaggtcatttaatttgcacataactgagtgaatccaacaggctccaggtaaccccatttcttcctcgaaatatatcaattgatttggatttggatttttttttttagttttgaagtagaggaacttgagttgaattgcacttccccctccaaaaggaatgaacagtactctatttattatctctcacattacattaggtgctcttatgcagagaatctgccgttgttgtcctttcttcccttcaaagaaaaacaatctaaaaaaactgttttatccccttctcagagtaaccgtctcaaaaaataccgtaaaacctaacccatttaagatcatgttgcaacgtgtaacgaccctaaaattttaaattgcttcaccacgctgttggcaacctagttattgtaaactcattgtgttgagttgaatgactagtcatgtcaagcgtttggttcggatttttgtgttaaatgatgtaacgtacccgaattataggggtttaaaatttcttgacaaagtagttggaagataacttttccatttttgagagcttaaaattttcattttaaacctagctgaggtcaatctaagttttgaatgtaaggaatttgagggcaaattatataaactttttcctctccaacccaaaatgaaattttacaaacttagtgcgagcaagcatatgcatatcatggctaggtttgagtccttgtgtacatgttgggtatgaaactaagcttaaataacaccatctcagagcaagaagtgttcaattataaattttataaaattgctcagatgcatttctataaatgaaaacacatataaaggaatgactagatgaaattctaaaaatctttagaacaaaattcacataaatactatccagtgtgtattcgctgtaattttggtcaaatattatcacttaagttaataagtcaaaccagtaaaatactagattaattataaaccctaagggaccatttgaatcacaggattgaaaaaacatatgaatagaaaaaacgcaggattttgatatgaatacaagggtaaaaatagaggattgcaaaatacaggaaaaacacataaatgactatttgattggaccgcaggaaaaatacaggaattacaggagagatgaagacccataggaaagtttccatgaggtagaacctcatgctagatttcttccgaaacttgcatggcattaggcattccatagaaaatttataggatttcataggattcattcctttaattgaaagagctatataggaaatattcatataggaatgaaatcctttaaaattcctatgaatttcctttgaatcaaagggggcctaaatgtttaaaatcttacctcaccaaaatgtgaattaaaatgcataaataagtataaggaaaataatttattcaaatactaggttaattatcataaataaatataatttttgcagaatttatttctttagtttgatcctcctaaaaatttaaactagattctaccgagcccttttctttatttttctgagagcaaactacacataatttttgtgtgaaaccaaagaaaatggaatctaggtaccatcatctatctaaaaaactctaatttatcccacccacaaattaggagaatgacagggatcggtcgaccgggcggggggagcaaaaatcgggtgctgcccccgccccccacctcaagtgcgcgtgcatgccacctgggcctcaccacagtccctgcccccacctgccacgtgtctccagcatatactccattgcaacaaatcatccatatattttggaaaccctctatttaagggaatttggtttattttttgttacaccaaaaaagtttcatttagtgcactcgcaatgtttcactatgtatagatctaatgttgcagtgaactgaaatactccattgcaacaaatcacccaaatattttggaaaccctttattaagggaatttggtttattttttgttccaccaaaagtgtttcacctagtgtacttataatgtttcactatgtatggatcaaatgttgcagtgaactgaaacattatttcactatttgctgaaacattgtttttatataaggtgaaacaacgcccgatttaaatgattgaaatattttcgatctacttagtgaaacaattccgatatacctggtggaacatcgtgcaacatttaaaaaaattcagtaataatctaattttttttcgtcggaatatatccatgtgtggtcttgttttgaagatttaattgcaacgaatttaatggtgtaatcggatcatgatttggataaataatttaagagaaaaattagtttaaagtggtttttgcatatacctgttgtcatgctaatatcagcgcccgatttttggagatttggatcgggcgaccgatccctaggcacctcccacaaattaaactattgaatttacaaagtaaaggggagaattaatcatgacaataactgaaaatcgattttcactcaatcccccaccccataccccttactctatcctagcctatcatgcgctggacccacctagcagccacgtagacttgccccttctctgtgcatcatactccacttttctccatcactgctcaacataggggacacgcgcgagagagaaaagccgggagaacaaggtgctcgac

SEQ ID NO: 7712 - DNA, 10858 bp, Oryza sativa
gtgtccgttccatctaattttgtgctattccatgcagcggttaaacaggaatgcaaccgcgcactcggacgctctggagcgcactccaccgcatccccatcaccgtttctggcggccgtggacagttgcaggccaaaccaccgcgccatcttcatcacctcgacctcttttccgttacccctcaatagccccatcgggagatgcaaagaatggggagatcgttctctttcttgttggaaatttggttataattcgatatattttaatctaaaatattaagacgataaacatgacatacacaatgagaagcgatctagtgataaggctaaacataaacatgagcatgtttaaggtaaaataagcatagacatcgttgacattcacataggattgaaatcctatggataacattgtgaacatgtaaataacgagaagaaaatcgaataaaattagaatcttatatccagagaatggtgcagaagatgttgaggcattcgtattgccttcattgatgttgtctcctccgttctctccaatagaagccatggtgaagcagaagcagaggaagatgcaacgttgtcatcgaagaacgaagaacaggagcagtcgcgcttgaagcactacccgtgcaagtttctgctcccgtgcaagcgcaggcgctacccgtgcaagttcctgctcccgtgcaagcgctacctgtgcaagttctcaagcaggaactcgaagtgcaagagtcggaagaacatctcaattctccgtgtttattaccgtccgttacaaaacgagagagagaacagcagtagcagcttgcctcgcctctccccgccctacctggctgtcagcgtaccatctcaactaatcaacatagactctccactagctccgtatttaagttgagatctcttcacttagattttcaaggtgggccaatggaatttattaggatttaattgggcctagcccattaatctaacatttctttctcaacttcggccaccgtcgctgttgtcgttatcttcttctccggtgagccacgattcaacattcgcatgtgtagcttcatagggacctctctaatgttgtggacatgcatgcatgccagcccttcggggagattttgctgtgtccatctttccgagcaggagcgccgccgccgtccagacccaggcaccgccaccgccaccaagctatctcggatgaaccggataatttttggtcaaaagccagtgaatcagaggcttctgaacaggtggtcccaacgagcagatggtcccggctagaaagagacgctgcccactaggccccaagtcatgcatgcgtcgaaccatggttgcccactaggccccactagctcaccagtcaccacctatgggctaagggtgtgtttggttacctacactagggttggctcacatccacacgtgcagtggatgggtgtttgcaaagccaccacggctgactctatgcgtgcaaaatcgcttctctagccaggcccgaggggaacgctcgaattgagattcacttctcgtctaggccgaggccatgttggcgtagggacgagcatgtatagagcgggatgcgcgcgtgcagtaggcaagaggggtcgcatatccccttacctccctcaccccatttgcatgcttgactcctcccaagtcatcgacgcctccatcgttgttttcttcagcaggtgctacgggtgccacctcagatctggctgcttcgtgagtggtgggggtggagtcttggaggagcagcaatcgaagggaacaaggaggtagggctgtggtcatcaccgcttgggcctacaccatctttctctacctcagattcctctcttcctcacctttcttcttcctcactcctaccaccctctcctccttggaagccaaaggcaccaaattggatggcctggaggctggagcaggaggccacaggatccaattactaccgtgacggcggtgagcgtaggaggccctgtcggagatgccaggtcagaggagagagaccggatgcgaggcgagttgacggcaatgacaacgaggcaccacgttcgatcccatagatggtcgtaaggcccgctcggcccagcccggcccgagatgatcatgccagcacggcacagccggcacttcgagccatgtcgtgccggcccacaggctgcacctcaggcccaggcacagcccaccagtagtctggccgtgccatgccggcccaaaggcacgggcggcctatcgtgcattgtttaaaataagtctatttcctgtccctcatctttgggctttgacatatatatagctaaaataagtctattgtacgtccctactctttgggccatgccatataatatatctatttctccactatattctttgtaccgtgccttacatatggttgaaaataagtttgtttcacatccctaaacttcatgccgggccatgctggcccagcgtgccgagatagcagtccaggcacggtacggcacggctgttaggccggaccggcacgggcatgacccgagtcttgcggtgcctgggccaggccaaatcaccgggccttgggcgtgccctcgggccatatggccatctatagacgatcccctttatttctacctcccatctttttcttttttttctttttaatttgtttttctcaggtaataaattacagattagttgaccggttcgtcttataaacttgtttttgaagaagtctattttttactaccaatttcactatgaaaattgaaaaaaaaatcaattatatggagaatcactattgctatatagtagaggtaatataaacttgtcatatgatattgtagaggtaagctcacccaactaaatgaagaggtctatgctcaatgccatacgaccaacaaaacaaaatctcttcccaacagtatctatcatgcaagtaatcaaacaaaatctcatcccagccaaactaaacagatggaaacaaccaaacagtatctcctcatcaaggttaaactctgattccatgagagagatgggccaggctaaaggaatgcaagcaaacaaactcaccctaagccaattagggaccacccatgcacctaattagtgaacaatattcacaccaaatgaaggctcggttctgtagtcgaactgcatgaccagacggtcaaaccaagggctcgaccaattcgatggccggtccgactttttgcactttgttcggctgtcaagtagggagaaaccagaacttgacatctaatcttcattcattattcattttaaattcagtttcagatttcagatttgagaaattaaaaaaattagaacttaacaatttcagaacttgacaacattatatgacatgacaattttagaactttacaacttctgatttcagtactagagtattttggtgacaattcaacacttcatgttcacaagttcatatgacataacttgacaattttagaagttatcaattctagaacttgacaacttcagattttagatgtatagcacatttcagtgacaattcagcactccatgcttacaacattagattgcataacctaacaatatcggaacttggtgatttcagaccttggaaacattagatttctacgagagagtatttcagtggcaattcagtacttcatccaatcgatgaattgcacagcttgattgtataggtctataggacacaacaagcttatgggaagattacagtgcattttcaatgtattcttcttgatgtgcatgatgttatagcgttaccctccattatgcttcatgatctccatcacgcaaccctgctgggttgggaaaatctggttggccctttccaaagggtacttgcgatatgcttgatcaacctttgttacaatttgatcaatattgttaggagggctgttctaaaacaatgcctagattgttgtaaaaaaagatatagtgcattaagatcaggtgagttcggaggttggcatgttagtcatatgttccacccatctatttgaggaatttctacaattttggatcgttttacgtcaatgtgcgtcttttgttgtcttgttggagtaatttggacattcctcttcctttggctttccactttacctggattgcaggcaaaaccttgttgtcaaggaattatcggctagtttccttagtaacggacatcatcgtctttgttattaataagctacctctggtagcaaaaataattttagcataacttgatcaattaagatcacaaatttaaaatatacacgaatgtcatacttttaggcctattgtcacgcccggaaattcactaataatttccgaactaatttgtgcataaaatcctcgtccaggaatcagccgaggtacataaactgacaatttaatatacaaatccatcataataataacgttacatacttacaaaacaaaagaaaaacagcagcggaattaacggtctagcgatggcttcagctccactcccacaggcaactcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcaaaagcagcatttagcaaacatttaagagtaataaaacagtagagtaatttaatcattaatttcaatcaacactgaacaacacgcccatgctgctcaggcccaaccattctgaacaaccatacccggctgtacagatctaactctaaaccaggagctaaacaaattattaccagttatagcatcaataattattgtgagaggcatgagactaatcacgaaaaacattgctcaactcgcccataaccgcggacacggctattcgaatagttttactctggccagaggtgtaccactgtacccacaagacacagcctcaacatcatgtctaccatgtgtcgcgatactagaaggtacccgaatagaggctgtgacaataccctctgtacaacacaactcaccacagtgcaccattcctggatcataatcacccccttataaaacaaggcatggactccccagcgacccccatgggcttatctccgccacttctcagtctggtgctccgcaatgaaccatgctatacaaaaggtaaagccgttgcccacgctggcttgtggttggcacgattaatgtttcacaacaacagtagctcgtgaaccggtccttaattgcaatgaacacgaccttcaaaaccatgtgctcacaacccaccattaatcatattttaattaccaatttaattatcataacacgattaaccatcgtgagctaccattaaatatatccataaataataatgtagtatatatgattcatcctattagtgagctaatgtttctaagcatggctaagcaattatatctaacatctagttgaaccaatatatatacagctcaactagtcatattataatatcccaaggtatcaaggaatagagtaatcaatgcaaacaggccataacaaaggaatagattcacaccacccagtgacattcgaaaataaatacacacttgaaataaatagggaatttaaatataggatcaacatgctcaaaggattgtatttaggatctgtgtgacttgccttgcaataatcggtcttcaattaatcttctgaacactcccgacgcactcacgaaccttcgcaacgacggaaacgacaagctaacacgcaaaacgaagaaaaagactaataaaaaccaaataaacagtacaaaaacaagcataaacagtacatataaagtaaacaaacatgtagatcatgattttagatgaatttagcaacttgaaccactcaaaaccgagttacgatgatttagttatgaatttccgaatatttaatctattagaaaaacaggaaaaagaaaaacgatgatgacgtcatgatgacctcatcaatggccaaaccaagatggcgacctcgccggagattggatggtcggctgcgactttggaggacatgtacacgtagaagacgacgagacgaacccaacggtactcaccctcgaaccaaacgacgaacgacgacggccggcgacgaggtggacggcgggggcggcttcggtcggcggtggcgccggagctgcggtgaccggcgacagcggggagggagcggccgagcttgcccacacctcggcgcaccttacggcggtgacggcgaccggcggcaacggcggaggcggcggcgcgacacggatggagctcggccggcgacgatggcggggtggagcacgtggcggcggcgctacgaggcacgggagatcacgggagaggggcaaacgaaagaggaggactagggggtcctatttatagccttggattgaagagatcggactcctcccgcaagaaatcgatccgggaaatcaaaaactcggttttggagataaactcgaaaacgagttcgattcggataagatactcaacgattagctccgatttttggggtaaagatagaggaggataagaggaatatttcccctcaactaaattggaaaaaggagcaacggggaggcgagatttggaaggaggaggcggcggcactgtgcacggcacggctggctcgggctctgcctgagctggaagatgaacagtatatcagggaggaaaagtagacttcttgccgggcttttcttttctcagcctgattagaagagggagctaaaccagactttggctgagagaagaagagaggatgcaggctcgggttggaccggcggaagagagaggaaggaaaggaatgggccgattcagcctaaggacaagggaggagaattttattacttttccaattaaaataatcacttaaatgatctttgaattgttaaaaatacttccaatgctcaaataatttcaagaaaaatcctgaaaatacttggacactcaaagtacttaaaaaaaattataattagaccatttaataattaatttaatatgtgggtaattactgaaatgctctttgtaagattaaaattaggaattgagctccgaaaaaaatccaagaaaattccagagagtataattaaccatgaagaatttaataaaaattaaatccatccatgctttatatttaggaaattttatttcccacatttagcttcacttgtaaattaatgaacatttaatataaattataataataatttattaaataatttataaatcctgaaacaaaaatcaggatgtgacacctgtttatgcttgatctgttagctggttctacataaacggagagcaacataccaattttcccatcaaatacatatttaccttgttgttaacaccaaaaattggtaagattctttagcggattcggctaagaaaagagcacatttagccgattgaaacttccctagaagagaccgagtttaagaaagaatcgtgaagactatggcatggcggcataattctatctattaattaggtaggatttagtagtttccttttatttttaggaaagtttctttcttgtccaataagtatctacccatgggtataaatatgtacacatggagtcattgtaaactatcttacatatcaatacaactactttcgccgcatcgccaccctcttttccgaggattttacttatcatccagtggaagatggcacctgacgcggggctgcattagcttttgatctccggcgaaggggtaagtcctatgttccatcggcccagacaattgtatcggctacattggtgtgcttcaaggctgcatcgcttcgatctcttggatcgcttcggttcggttgatatatttccctacatatttatcatatatcttagctaatctagtttagaatcttaatttgatcatatcagctgagattcattttagggtctatgttagtattggctaaattatctagctagattaaattaactaagatattcaccaccctaaaaattagtcaaatgcttgattgtttagactttatgcttctttgcatactccgcgatgcatcattcctagctgtgcttagaatcataaaggctaacctgtttttaattatagtaacggtttcatcggggtttcagccgataagttatatggacgttgcatcggcttacaaggattacatataagtcggtttgagccaatcgcaacaaaggttttaatgtttatctaatcttgtggattttatgacatcagacctccagccgatgtatgctttaacctttggatcaggtcgcttattctatcatatcactattagctgattggtttctaccggattatattgttattttgttacattaccatcagccgattgtctttatatcgtatctacattggacatataaatgattgctcaaaaccctattggcatcggctagtatcagcattgactggaactactccgtcggcttgtcagccaatcagctatttgatctgttgtttacatatcttgtcagttgtaggatcaaactggctggcacacccgtatcttatcaatttttggacctacactggagcaaagcagatctcctaggccgttgctgttgtcgacttagttcgtgctaacacagttccggcaccatcgaccgagcacggatttttcgtcaatacttgctcgtcaaatttgggtcgagtaaccacaacaatgaacatcaagtatttgctcttaacctctctttccgttcttggttcgacattattggtgaatagtatttctagttctgtcttgtcctgtagaactatttttttttatctgtgtacacattgccgtgcattggattgaatttaagttaatttctaaaatcaatcctatattgttaaaggcaatgttcaatacatgttcagatttgagaacaagatgtgtaatactccatgttacagaactaatcaaatcacaacagtttcgtccttaacaatatatgattgatttctgaacttaatttaaattcaagctagtgcgtaacattgtgtacattgatgagaaatagttctataggacaatgcaggactagaaatactatttcatcaacattgaaccaagaccggaaagaggggttaaaagcatatacttcatagagaaggtgatgtttcttgttgcggttactcggccccgatttgacaagcatggtagttgtgtatttgatggtgaaattagtaccttttccattgtctttttagagctagctaagagatcgagtacaaataaggcccaacggtatgacatgtacgtgtagtttaaagttgccatcttaattgatcaagttatgctaaaattgtttttatactaccataggtaccttggcaaaccaccaaatgttcaaaaatcatccaggaaaataataagtgtcatcaagcttcacggttacaacaagtttaacacagattttgttactctagctcacatcattaaactaatagcagcaaacaaacaagtcatcttcttctctgcagtagcaagctcgctaccactgttgactagggatgaaaacggagtggatacggatggataatgctcataccatatttgttttcattttttttaccggatacgaaaatgaatacggatagcttgaatacggaaacaaatacggattatcttgaatgcaaataagaatcgaatatgatcggacacgaatacggaaatatttttttctcaggacacaaatgccaactcaacttctaatagaaacaaatatcaacatatataattagctcattttatataaaaatgaagtatagtttataaatattttttaaaattgaaataatactaaaagtatggactagtgttaagagataaactactattaaaatctataaaggtatattaaaggttatagagttagaaagaaatagggtatgactcatggcttctgcggatatccgaatagtactgttcaccggatatccgaattattatccgtatccgacagaaaccccaataacatatcagtattcgtatctgggagacaatatccatatttgtatagctatccatatccgaactatccgatccgaaaggtatccgtatcagtttttatccggagcagatggaaattattcactccgttttcatccctactgttgatcctcttgcactggtaaaacacttcgttttcaggcaagtttatcttcttgcactggtaaccttccctatcggtaaatctaattggagaggcctctccagttagtcttaactagagacacccacgtgctagtattttaggagttttgattgctattaatccattaagcaagtaggggaaatattcatatcatctatgcttcaaataaaattttctcttaaattactcatccgatttacaatccgattataccgttgtgttcgtaataattaaatctttacaacaagatctcacattattatattttgataaaaaatcacaaattacttttatgatacgtctaacttacttttagatttcactaagtttcttcttagacatataaaagtaaattaagtaaagcctaaaattcattcacatatattatagaagtagtttatatcaaaacaaaagtcctttaattaaaaaattttttattgagcaaattatcatatatatatatatatatatatatatatatatatatatatatatatataccggtatatatatatacgtatatatacgtatacgtatatatatatatcgtatatatacgtatatacgtatatatatacgtatatatatatatacgtgtatatatatatataagttatttttagatttattaaaatacttcctatacattcataatgctctaaggtgattacttttattatttttttagttaattccata

SEQ ID NO: 7713 - DNA, 28711 bp, Oryza sativa
atccgctttgtacttgagaatccggcacctgagttttgctggccaggaactccaccatagccaacattgtcgaaatcttccacgaccacattgaccccataacattcgctcctagttcacatcacgaagtagaccattggccatcccacacaggcgatggtagtaaatgaagttgagttgtagagaagaagggagaagccttacatgtgtaaaaaaggggagatgagcatccgtgatttatttattcagcctcctgacatgcgaactgaataacatcgacactttccacatcaatgcattaaccatgtatgctgaaccgaggttctacatacaaatctgcatgcaaatccctccttgttttagggcaccttataatgatcttttagatgagccaccattagccataaggactggctacgaggaataaaaaataaaaaaccattcttcatctctctccatcgcagatccctctcctacgagtgctatgctgctgcggcctcctcctcctgtgagccccgctgcttgctcagccgcccccgccgatgtagcctcctcccacgagctaccacacagccgtagagttcctcccaagggcgccatggtcactgcttccaccacctcttccttccacgaggcaacgtaactattgctggatatgagctcttcctggttgggatggtggggaagaaaatactctctccatcccaaaatatacggcacaaccacgtttctcttatgtctcataatataaggcgtgcatgcatgcatacattaactagcacctcttggtctaataaaattgatctgttttaaatcctataccatcaaacctcctaatcacattgcttacatgcataaaggtgatccagccaagaagatgattaaattaatgttttcttgatctttgtgttatgagtggttgagcaaatggagtaaagaggactagaggagtcattggttggatggtaaaaggtggggcacagctaacttaacactcccttactactatatacattgtaaaatactctagatggtatataatagtggggtccacctagaacccacggtaagatccacttgcacattgcgcatgcttgaatttttcattttgggttttatgctgaccatatcatatactccctcaatctcaaaatataagcattttgaccctgacacgatctccgagatgctactttgaccatcaatatctataaaattaagatgttttcaataaaaagagttgcatattataatagtttgtttaatgataaatctagtaacattaattttacatggttaatctttttttatttttttgctattaattattaaagttaaaaatgtttgacttgacactatgttaaaaatgcttatattttgggacaggggagtagaaatttcaatctacaaaatcccactgcattacctggtttattaaccggttaatgtaaagagaggttttacagtgtttgcgaggtacttagaggtattgagaggtggagtaatatggaccgttgatcaagagaggggcaaggtatggaataaaattatcataaccaatggcaatgaagtaattaactagtgaaatattgccattattgccgaattgaataccttacttcgttgatcgttacggtaagatagagaaaatataaatctacctaggcattgattagatcaacacagaaaaaaattaggttatgttttatttctcttctcccacatcgtttcgttcttactagggtttgaattggttcactagaaaaaaaaggagggagaactgtcaatatggttgaggattgaagcgagacaaggttagccggtcaatggcaaagcgaagcgcatccgcaagatttcatttacgcagttgatttgtgatttacatagctcacaatttcattcatatataagagattggaatgagttctcctcccctgttattcttccagattttgaattggtgcactcgcaaggagacacagtcgtcatggttgagcatctatgcaatctacaacgaatatatatcaatggatatttggcatgtggtgtagacgttgtggcattgcaggccttctaaagtggcatgcaatccatggatggcatgtatgcacatatatgtccaataaatggacatgcaggaggtagtttccattttatcagatgtgaagtaaatcaaggagatggttatttttaggtaatattaaaatctaagtgtgtgaatggtattataaaataagttatttaattccataagatatataatttttttaattagtgaattctacaaaacatataaataacgtaacgtatgattaccgtacgaatctgttattaagaaaaaaaacgtaaatctcaaaaagaacacgcaaacaacatcctgaagataatgactataccgatgtggtacctatgtacttataattataccattctctatctcttagaaaattatctttttacccttactatctaagtacatgtgctaatatttaaataccttttaagtggcactttttattatggagtgttggatcattatcttttttaaatgtaaacaccgtaaaacctctctaatgtaaatcatagcgaagccaaatgggctacggagagcaaagctactacagcggtacagataacgtttcactgtgccagcgcccagcttggcacgaggagtaccatgccgtgcctgaccaagttacttttttttttccgggtttctctgtctgttttttcctcagtttttttttttggtttttctgtttttcagttcagtttttatacctacatatacaaagtttttatacatgtatattttttatacatacatatacaaactttgtattcgtgttcttttttgtttttttatgttttgaatatgtacgcatacacatataaagtttgtatacgtgtatatatacttttatacaccaaaagtataaaaaaatataatatatattgtatatatcgatatgcatacatataaatattatactagaggaggtggggtccaagaaacccacagcgcggtgggcacgcgaccacccgcgtaatagcgtcctccctattatgtgcactaagacctgtttagttccaaagtttttgtccaaattaacttccaattttcaaccacaacttttctatcacatcgtatcaatttcaaccaaacttcagcgtgacctaaacacaacctcagatttaaactcgccttttttttaagttcaactgcgctgcatgcagcatgacctgtattattgactgcattcatttcgagcaggtacgttgctcaattctcccggggcctacatgtcgagtatgcaggtaaaggaatccatgtgcaatgccaggtaattgacgaccgaccaatctataaccttctcctcattactgacaggatcggatccgatgaaatttgcagccaaacacacacacacaaacttgaataacaataacaaatttacgccaattatcttttatacatgcgcaggcgccgttcttcgtggcgacgaggatggtggaaaacctggtggaggcgaggcgcctctcgccgttcacggcgaccccgggcgcctacgcgcgcgcggcggtggggtggatcggccgcggcggaccgctctgcacgccgagcgtccggcaccagctgctgtggtgcgccgccgccgccgccgcgccggacttcgttctcgactggatcctcctgcgcagccacctggagcagaggacgttgctttcggcggatcagagcatcgagggcgccatctccgtcttcgcagcacagagttgattccagtgcaaaagggcacgtagcctgatgggttacagtgacccgagtaatacttcaagatccaaaattcaaattaagttcccaattaaaaaaactatatttatcctgttggatataaatgttgagtaaaattaaaaaaacaaattgagatgagtgacgaccatcttacgctgtactacattaaggtgtgtttgaggaggaggggattgaggagattggggagattggaaagatacgtaaaacggagattggggagattggaaagatacgcaaaacgaggtgagctattagcttatgattagttgagtattaactattttaaattttaaaaatggattaatatgatttttttaaaacaactttcctatagagttttttttgcaaaaaacgtaccgtttaatagtttaggaagcgtgcacgcggaaaacgagatgttttctctctcaatctcctgtatcacccgggaacgaacgaagcctaagtctataaaagcgagtcagcactcagcagttgcattgtactatatatatacacagtactaagcgtacatatcacctatatttatatttactgtacttccttaatatcaaaatataatgatttttaagagttttacatgatgataaaaaaataggtgaaattaaatgaggaatgtttgtgatcggttaagattagctacgaggtggaaaaataaacacggaagatgattatgtatttgtgattggctataacaagagagtaaggtggtgtttagatcagagacttaactttagtccctgtctttagacactaatttagagtattaaatatagactacttacaaaactaattacataaataaaagctaattcacgagacaaattttttaagcctaattaatctataattagagaatgtttactgtagcatcacataggctaatcatggattaattaggctcattagattcgtctcgcaaattagttcaagattatggatgggttttattaatagtctacgtttaatatttataattaattttcaaacatccgatgtgatagggacttaaaagttttagtcccatctaaacagggcctaagtaaagagggggatagttttaccgtccttctgaagtacggcaattatttactacctccagcaagtactaggtaagttgaggtaccaaaatatttaatgtttggtatactttctccagtaaagaaattgatattttgggataaatttttaacactagaagttgctactcgctagcatttattttttcatggggtaattgcatccatgctcctactttcaaagccaattgttgttttatccctattttttagggtttacacttttaccctcattttttaatctgaagcagccatgtaccccctctaacagtcacaactaacaaacgacatatatatatacccttggtggttattgcagttttgcccccattttttcagtctttttgtgattttgccccattttttttcagcttgtgtgagtgttataatgtgaggctttgaccggccaaagctcgtgcattcactctgaacccctaaactacaggtcaacgcctgtcagttaatcgagactacgatgttagtatgcacaattgataccacatttagtagtacatagataatacaacagggttgttcttattaaaaaaatacaacacggttgtgaattgttccaaaataaaaaaggtagtagcctcaaccacgccggctggccctcgacgcgaccgcgcggccgccgccgcctcgaccacgcctgcggccgccattgcctcgcgcacagtagctggcacgcgcccgcccacggccggcgccgctgcctcgtgcccgccgcctccggctcgcgcgcgcccagggccgccgcctccgcaccgcgcgcacgccgccaccgccgccggtttgtacccgccgcctccgccccctcgatccgcagcctccgcgccgcgcgtacgctgccgccgccgccacctggtctcaatcggcgctacggttccaggaaaccgacgcacggtggtgggaggagactcactcatcctatccattcctttaggggtataaacgtaatatcatatttcctaaaacatttttttatttccttttgtattttttaacacaacatcgtgggacccaccaaacggctgttacaactgagggtagatggctgcttgaaattcaaaaagtgagggtaaaagtgcaaaccctaaaaagtaggggtaaaacagcaattggcttcgaaagtgggggcatatatgcaattgtccctttttttattagcatttttttaaaaatttgatgaagtttatagaaaaatttagcaacatgtactacaccaaatttgtttcattaaaactaacatttaatatattttgataatatatttattttgtattgagaatgtttttatattttagtacaaacttgataaacttgaaaaaaaagagttagtacaacttataatataacacgaagtataatttttaagccaacagagtaatatttttaatatgtgtattttaacagtttacttcggattttaccgggaaacaatgatagtaaattttgttaaacatgataaataatattttcaccctatgtattactaaattgaacattggaatcaaaacaaccatgtgcacggacgacacacactctgctatgtacctatctatcctcttctgcctaattatcccttaaatttactcgtgcaatttgcgggtagctgctgcgtgccaatcggcaggtaaccgttccatgtccatgtccatgccagacggctgatgcgctagcctgccagctcaacgacgaaccgaacggcctatgcgcccgggcgtcagcctagtgctcgttataagcatcaacaacagtccttttatactactcccttggttctattttaagtatagccatggttttccgcgaccaactttaatcatccgtcttatttaatctttttttaaaaaaaaattaaaaacataagtcacgagtaaagtgctattcatgttttataatctcataacaacaaaaatagtaattataaaaaattttcaaataagatggacgattaaagttggacacgtaaactcatggttgcagttaaaatgggaccgagggagtatcatcgatcctaattttttagaattttggtgaaaaaaaatcctatcttgatactatttttcttttttgaaaactccatctccatattcttcgctcttcatttgagggagagcgacccaaatccctattttccgtgaggtttttctctttgtacacggggagagaagatcgcgcacttggagaagcgatattttttttacacgggtcagtggaaaaacaaatatttggttggttgttcaataagagggtccatttttagtttttaaggattaaatttaggctttcacttatagaaagaagtttttctctttctattttcaatttagaaaacccaatgatataattttgggatagattatacacattccggtgatgatgctcttaattacattcagctcgacgctgtccattaatctccggaaaatcttcagcttccggcacgatccgtggtgacctcgcgatgacagcgtacagtaagtcgtacagaccaagcccgtggaccgtggtgtttggggtggctcaagcaggaggccttgcagctggctgggcgtcaagttttaactaaggactcattcggaacaaattaaggttttgggaggatttaaatacgatgggtggaattactacgaggtaggcctctcactagagagggtacgagtaacctatatctgtacctaattttactcataaccatttcataattagcttattcatatccaatgggtatgtaaaatccatgtggccccacattattagaaatggctcaaaaacttgcacaaagttgcttctctgtataatattttattcctacgaaattcaaccaaatttgataagcttttatagtgtaaacgcaagtcttaaaattttgagactgagttctacatatataaaatgggtatggataaagtgagtactactacctccgttttacaatgtaagtcattctagcatttttcacattcatatagatatatgtctagattcattaacatccatataaatgtgggaaatgctaaaatgacttacattgtgaaacgaaggaagtaatgggtattacccttccctacccaaaactaaaatcctttctacccataccctccctaaatatatagtgtggataagagatcttttacagtgcttgaaaggtaactgaggtgcctccttaatcaattaatatccaccgataattcataaagcgtcagtgctcggcaactacctcagcacgctactcatcagtcatcgtcaccgccatatccaccaggggcagcggcctcggatggatccccgacaacctcaaccgcggccatctcgactacttcttctggctgctcaccgttctcaatgctgtcaacttcgtcgtctacctctggattgccaactagtacaggtgcaagagaatcaccaccactgaaactgaaactcaagcagccgcccagacttgaggggagattacaatcagaatcaaccgggaacgtatcggggaggagcgctcaaaagcggcaacggcgggtgcggccgccgtgagctcgtggtcgtcgacgcctcagcctcagccacctccaccgatgcctggaagtggaacggatcgggagttcagaacggatcgtacataaatatacatatattgaaaaaaaagaaaatatgcatttgcccttaacctcataaatcaattatgaaactcaatcttttaaccttccacttttcatatctggcccacccttttaataccttttcccttgtaccttctcttttggtgcgttagatcattagagatcaaccctactatgaggctgttgggaagaaagtattctccttggacttcctttaaaagtgtaattttatcatcttaagaaaataccataagatatcatattttcgatattttcaaatacacttgtaagattttggtcttataagtgctttctccgtaacaataaaatttctccctttgaaaaccctaagccattcatttggaattttggggaaaaagaacaaacacgagatattacatatatactaaaatgaaagtaaaaaatgacgccttatatttttagcaaaacaaccatacaatatatttacagccagttgttgaccctctttacgaacgaatccaacgtatgagccagagagctcaatgctcaaacccttctatcccagtggaatcccatgaagagaaggagatatgaaaggtggaaaaggactagagggctggagtaggaagaagatgataagcctcctcctcactaatcctagatccggcctggcccctatttatgccatccacctgcccttgtgacagtgtaccagtgcgagtgatcgatcccaagtttcagtggtccgcgtcctgccggttttatttcatttcaattcactgtgacattaacacacactactgcttcctaccgtgcctaatcacaccgccaaattattactcgtgtgcattagtccgtgccgcatgcgttccgtcatatatttccacactatatatcgcatatatctggcctgtttggtgatatagttttggcgactcggcgagtaaccgttccaaatcgctctcaaccgcgccatggccggctagactgcatgctaatgctacacatttatattgtacaaccccgccggtggggaggaagagagagcgagagagcgaatcatcatggctagtcatgtcttcatgatccggcaagagacggcgccggcgcagtggtggttcctctcgctggctttcgtcggcgccgcctacgccgccaccgtcacgctccgtttagtcgcctacctcgcgctctgccggtgtcaccggccgaaggacgacctccgccgccggtacggcgaatgggccgtcgtcaccgggccaacgtccggcatcggccgtgccatggcgctggagctcgcgcgccacggcctcaacctcgtgctcgtcggccgtgacccagccatcctccgggagatctccggcacggtcaggtctctccacaaagtgaagaccaagaccgtggtgtttgacctgtccctcgtctggacccccgatggtgatgagccgctgcggcggctgcgggaggcggtggaggggctggacgtcggggtggtggtgaacaacgccggcgtggcgaagcccggcgccgtctacctgcacgaggcggacgtggaggcgtgggtgaggatggtgcgggtgaacatgtcggcagtgacggaggtgacggcggtggtgctacctgggatggtgtcgcggggtaggggcgccatcgtcaacatcggctcggctgggtcggagtacatcccgaccttacctctctacaccatgtacgccgccaccaaacggttcgtacacacgtaaagtgacatgtgtcataacttaaaaacaccatactttagatcagtggtattatactcttgtgtacatatgaatagaccatgagagtgaccggcctgttcatttcgatggagcaggtacgtggctcagttctcccggagccttcacgtcgagtatgcaagtaaagggatccatgtgcagtgccaggtaagttaatttatcagaaatctgtaaagaggccctgtttagatcttactttaaaattttttatcatgttacatcgaacgtttgaacacctacatgaaatattaaatataggctaaaaaataattaattataaagattgcgactaattcgcgagacgaatcttttaaatctaattgctacatgatttgacaatgtggtactacagtaaacatttgctaataacggattaattagacttaataattcatctcgcggtttactgacggattctgtaattagtttttattagtgcccgaataccttatgcgacaccctatataattaatatctgatgtgacatatcaaaactttacagccttagatctaattaaacaccccccatgcataatttgtaacttccatttgagtttactcattgacagattatgatgaaatctggaaagcataagggaatcaaatagctaggagtatgtatgatgctatgtatgtgcatgcgcgcaggcgccgttcttcgtggatacgaggctgatgttcaggttcgaggaggcggcgggcggcgtatcgctgttcacggtgacccctgacgcgtacgcgcgcgcggcggtggcgtggatcggccgcggcggcgcgctgtgcacgccggccgtccggcaccagctgctacggcgcatggccgccgccgcgccggactccgtccacgactggatcctcctgcgcttagccacctggaacagaaaacgttgtttcagcggatctgagtgacagatgacagattatgtgatgctaaagaattgccaacaaataaataatgtgtcttcgaaaagtgcaattgccgagaaattgtttgttgcccattttatgcatatttgcatacacataatcggttccgagatctagtattttcccaattaacttctgttgacaaaattggaccatggtgtagcgctggcgattggcgtttggtattgatttagtagtatcaacgaacataacaacgagtacttgcagaggagtcttaattatcccaaatagtatatatggggagtgtttgagaggagaggaaaagagaagattaagaaacgaggtgagtcattaacgtatgattagttgagtattaactattttaaattttaaaaattgattaatatgattttttaaagcaactttcctatggaaaattattgcaaaaaaatacaccgttcagtagtttgaaaagcttgcgcacggaaaacgacgtgttttctctctcaatctcccaggatcggaaggtagtgatcaaggggatcgtttcacttatcgcgtgattatcgcgcttaccgcgcgggtacggtagggaaaccggcgatatggtttggaagaattttcaccaaattcaaaattccggaaaaaaaattaaaaaaaattgaaaaaaatcatggatgtacttcttaatttgtaattgccaatggtaaagaaattttttgaaatagagaaagctagattcaaatttgtggacaaaaccgaaaatagtttacaaattaaaaaaatgaagaaaatattgggcgttaagtatcctacgtattcttccaattattctcaatttctagttttctacacatattcaaccataattttgatttttttccctatttattttttatttacatgatttcagctacacagctcgtgataaccgtacggatatcgctgttatcgcggtaaaccgtgcaattatcgcggtgaaacagcgaaactgacgagttttgaattcgaatttttggatgtgatttttgtgtgattttaggcgattatcatggttatcgtcctaccgcggggtggtggtaaccctggtccaaacgataaggtaaaccctggggatcacacatcatgtccaagaattacggttcaatgttcgttgtgaaagatctacatataccaacatcggcataacttatcaatgaactattggtcgatttccagtgacaacaccgagttacgcgtgtgtgatcgacacacgaggtgtgtgtttaagaaaacaggcaccgtcacgttcgtggtgttttgtaccggtgcatcgttctttgaaattcatgcatacgacgatactcagtaatgtgatttgtcggagtgccgcatattcacatggtttgtgtatcttttttctgctacatactactacataattagtttttataggtggctgaatttcctttctaaaggcggttaataaaacgccagtgaaaaaatgaaaatacaaaagattcccgcatggagctgctatctgcatatcacagtccacacaccacattgtcccatttccatagagaattaggatgaaatcaccataaaaccgtggaggataggggtgaaaaatgagcggattcggacggataatagctataccatatcctaaaccatattttttaagcggatgcggaccgggtgcggatgacgtgcggatgcggatgcggagcggattatttcgaacgtcggattcagtgcggagtcggtgcggactcggttcggaaacggacaaaaagttatcggatgttaagtttgtattcaatccatacaacaagagggcggcaatacatttagccccaatacgatggcaaaacattattagttcattgcgttcagttcaatagtaatagtataacaataagtaataagtgttcggttcaatagttcactagtaaaaataatccaagatacatccatgatccatcaaaaacataatataagtgttcagttcaatagttcaccggtcactacgttaaaatgtaaaaataaaagtcatcggcatgaggcaagccatacaggcatacaacaacagcaagcatagagcagtagagcacccctatgcagtggtgctacacgcagcatactgcatacaggcatacagcagtagtagtacaggcgtacagcacaaaacacacagcagtgagcagctagcagcctcctgcagccggcggcggcgctagcagcctgcagccagcggcggcggcactagccgaggaggagtggttggcgcgtgttggggaggaagatcggcctggcgcgtgttggggaggagcggccaccgcgcagggtcgccgtcacgccgtgccaccgcgctactctctccgactcctcgactgacagctgagggacggcacagagagagagctagagacggatctgggggatgaggagaggattaggttaggccaggttgggctattgggctagctaggtgggcctgaaagttgttgtgtggcctgaaatttgcggattatccgccaaacagtacatcggataatccgattaaaatatcggataatccgcatccgtcggatatcgttcatgtcaaagatagcatagtatcttctatatttggtgattgagacacgtatagaaagtcctctatcaccttcctttttatgtaattacattccattcatgtaatcctggaatatatttaattgaagatagccagcacgattgtgcttgaactgtgccaaatcctctccctgtttgcttggtatcagagcaggtattctgcttcttccaccccaaacttcccgatcccttcttccgctgcctctccatggatcatcagctccgtcccaacaacgaggccgctgcagccgcgggcgctgccgccggtgcccctgctggtggtgccatcgtcattcccgctgcgggtgccgctgccggtgctgccgccggtggtgccgtcgtcgttccccacggacctgcagcagcagcactcaccatcgctagtgtcaggacgcatgtgcctgtaaccctagagatgaaaaaccacaactacaccaagtggcgtaccttcttcgtggcattcctcggcaagttcgctcttctcctacacatcgtcggcccgatcccccccattcacgatgccgcctgggcccaagacgacttcgccgtcctcaccgccctctactactccatcgccgacgacgtcctggacatcatcatggagcccgagcagagcgctcacgctctgtggcttgctgcggaggaccttttccgagacaacaaggagactcgcatcatctacctcgagaccgaatttcgcagtctcaatcaaggcgacatgacggtgacggagtactgccgtcgcctcaagactctcgccgactccctccgcgacctcggcgagcccgtcaccgaccgcgcactcgtcctcaacctcatccgtggtctcagtccccgcttctccacccaggcggacctccttcccctgcagacgtcgttccccaccttcgcccgtgcccgctcggcgctgctgctggcagaaatgcgccacaccgctgacagcatcaccaccaacaccactggcctcgtcgccacctccgactcctcgtccggcgggcgttctttctccaacaatgggggtggaggaggaaaagggcgcgggaacggcaaggggaagcgaaccggtggcggtggcggtgggagcggaggaagcagtggtggcaacggcggatccggaggccgcaactccaacggcagtggcggtgttcctgcctcgtctggcaaccgcgcagggggtggcggcggtgggggcgaccagaccgggtctggtaacccttttcgcccacccactggaccgtgggttgtttacccacagtgggccgccgcttcgtggcccaccgcaccaccgcagccctggttcgcttcctggtgcccagttggtggaccgggcctcctcggacctcggcccaactatctgccatagcagcagcaggccttcgtcaccaacgactccatgggccagccggcctaggaccagtctggtttgatctctgcgattaataacatgtcgttgcagggaccttataacagtggttgggttgttgactccggtgcttcctcccacatggcctcctctgatggtatactccattcctctcaaaacccctcccaccccaccacagtcacagttggaaatggctcgtctgtacctgttactcgtgttgggcgcacctctctacactcctttaaactagataatattcttgttgttccttccattgttacaaatttactctctgttcgtcgctttactcgtgacaactttgtctccatcaagtttgacccttttggtttctctattaaggacctatggacggggaccgtgagacttcgcttcaatagctccggcgatctctacaccattcctcctgccgtcgccactcgattccatcccaacgtcgtccccaccagtccacgtgccctcctcgccaccgccccttcagtcgacctttggcatcgtcgcttgggccaccctggacgcgatgttcttcagcacctgcagaagcgttcttttatttcctacaataaaaatagtacacattcttgtcatgcgtgtcagctaggcaaacatgttcggcttccgtttggttgttctcgtactattacaactgctccctttcaaatactacattgtgatttgtggacatcacctttattaagtaattctggtttccgttactatcttattattgttgatgactactctcacttttactggacgtttcctttgaagcaaaagtctgacgtttttcccatttttcagtcttttgtctcgtatgtccatactcaatttcatctcccactgcagtgttttcagaccgacaacggccgtgagtttctcaactccgccattttgtccttcttcgacagccatggcatcattctccgcaccacctgtccctacacctcccaacagaatggtaaggctgaacgttctatccgttctaccaatgacatcattcgctgtcttctgtttcaggcccatatgcccggctcctattgggccgaggctctctccgctgcaacctaccttctcaatcgtcgtccatgtcaacccattcagttcgccacaccctttgagcgcctgttcggtatttcaccctccctagaccatcttagagtcttttgttgcttgtgttaccctaacttatccgccacagcaccacacaaacttgcccctcgctccacatcttgtgtttttctcgggtatcctcattcccaaaaggggtaccggtgtctcgacctcaccacaaaaagggttcttgtttcacgacatgtttatttcgatgaaacgatttttcctttctctactgctgcagcaccatcgaagtcttcttcactagacatggacttgtccttccaggatgatgcacctggacaaggtgttgggccagctgcagcccacggacagggtgcccctgctggagggccaccctccccacgcccgggtcctggtgcacgtgctcctgaccacgggccggcctcgccaccatcgactccacggcctgcttcaccatccgctgggctggcctcgccaccgactccacggcccgctgggccgacgctgcctggctcgccttccagatgggccattctcgtcactgggccggttggtgcgacctctccatcagctgggcggatcgctgccgccagtccaccaccagcgggcgatgacgcgccatcgtcgtccgcatctacgtgccatcctccaggggcgccgtccgagagcggcgctctcccacgggctgctcctggccctcatcgatggtgactcgtgcgaaggtgggggtggtcaaaccaattgactgcctcaatctctcgaccgtccacaaagacgccgctccgctcccgaagacgtaccgcaccgccttgcaagctccatgcaatgcgtgacgaatatgaggcgctggttcacaacaacacatggaccctggttcctcgtctccctggggtcaatatcgtcaccggtaaatgggtcttcaaacacaaatttcatgcagatggctccctcgctcagcacaaggcgcgttgggtggttcgcgggtactcgcagcagcccggcatcgactatgatgagacttttagtcctgtcgtcaagctggctacaatccgagtcgtcctcagcctcgccatctcccgcgggtggcccattcaccaactcgacgtgaagaatgccttcctccatggcaatttggaggagacggtctactgtcaacaaccgtctggcttcatcgaccccgtccaccccgactacgtctgccacctccacaagtcattgtacggcctcaagcaggcccctcgtgcgtggtatcaacgcttcgccagctacattcgcacacttggcttcactccatcggcctcggacacatccctattcatctacatgaacggggctgacatggcgtatctcctcctctacgtcgacgacatcatcctcactgcctcctcgacacggctacttcaccacctcactggtcgtctccatgacgagttcgccatgatggatcttggggatctctaccacttcctcggcatctccgtccagcgcacccccaacggccttcatctgtctcagcgacagtacgccgtcgaccttctccagcgggctggcatggccgagtgccatcccacggccaccccggtggatacccaaggccaagctctcggcttctgatggagaacctctccgtgatccaacggagtaccgaagcctcgccggggctttgcagtacctcactctcacccggcccgacctcgcctacgccgtccagcaagtgtgcctacacatgcactctccgcgtgacgctcacttggccttggtcaagcgcatcttgcgctatgtcaaggggtcactggatcaagggctctttctccatgctaccacggcatcgacgctcacagcctacagcgacgccgattgggctggttgccctgactcgcgccgctcaacatcaggttattgtgtcttcctcggtgataatcttgtctcttggtcctccaagcggcaagccatggtctcctgctccagtgccgaagcggagtatcgtgctgtcgctcatgctgtcgctgagtgttgttggcttcgcaagcttttggatgaactctgcacccctctccgctctgcgacagtggtcttctgcgacaacgtcagtgccgtctatctctccgccaaccctgttcaacataaacgtacgaagcacattgagatcgacatccactttgttcgtgagaaagttgctcttggccttgttcgtgtccttcatatgccgtcgtctcatcagttcgccgacatcatgacaaagggactaccagttcagctttttcaggattttcggtccagtctctgcgtacgggaacctcacgtctcgactgcggggggtgtcaaagatagcatagtatcttctatatttggtgattgagacacgtatagaaagtcctctatcaccttcctttttatgtaattacattccattcatgtaatcctggaatatatttaattgaagatagccagcatgattgtgcttgagttgtgccaaatcctctccctgtttgctgttcataccacatccgcatgacaaaatccgcatccgcatccggccggatatctaaaaacccttgccaaatcctcacatcggacggattcggagcggatcggatcggataacatccgctccgttttcacccctagtggaggaggataaattgtctagtttcatcagatgatgacacctctatatcggttagctcgtaactcctggttttggacagcctagcctagtaaggtagccaaccgtaatctaacacaccgacggatgcagatgcagcaccacgaagcaacacccagctcctcctctcgacatcgtcggctcaggcttcaaacccatgatacttgtcccctctcctctcgactttccaagggtacgccgcaggcccagcatcgccgcgtccacggcacgatgcaccggtggcgctccctttccctcttcaccgctgccatcctgtagctggccacctgctcggtgcacgcgatgtacgaccagcgtccaacaccttgtgcgatcacgctcagttcctcctcggctctcatttcacttgcttcttggctcctcgcctcgttggcttgatatatatttcccgagatattgagttgctgtatggtaccaatctgatgctgagtagacagtgagaggagggatgcagaccgccagggaaggaatgcgccggagtgaagttcgccagatcgcttggcagtggctgggtcaaagggattgatgtgtggcactgtggctatggaaggggagggatggattagccgtgaggatatggttggcttcaaaattacgtttttcaaaataaatctcacctcatataatacatatttgggcatataaactatcttaaatttaaatgttgtcagttttaaagttatagatctcatacattcatataggctatcttagattgtttaaaaatttcaaaaatttaaatttttccttatccgtggcggttcgtaacaacaatcattcacagataacattatttgtgatgggtggtaattaagacccatcacggatgagtgctctcattttttacgaatcatctcactacacccgttacggatgacttgttatacatgacggagcatggttgtgacccatcaaatgttatccgagacgtgttagactaggatccaacaaagttgacattctatcagtgatgggtcatctgctgtagtcattaatccgacatggatagttcatcaggaataatgtgtagatctgtactagggaggtaagttgttggccctgtttattccatcacgtgttgtgtgacagtgcaccagtgcgagtgccgactgcatccccaagtttcggtggtccgcgtcatgcgccgttccggccaaacaccgcagagcagcacgtttaatctaattaatttcactgtcacattaacgatctacagcagcttccttggtgcctaatcacgccgcgaaattattacttcctgtgcattatagattctcccatgctttaatttgcatcccgccagtttttgttggttagcaactcggcgagtaaccgttccaagtcgctctccacagtgctgcgccatttactgttacacacatatttatatcgtgcaaacgcggcgccctgtacagtggcgaagaagagcccggaatcatcatggctagtcacgtcttgttgatccggcaagacatcgcgacgccgtggtggttcatcttgcgggccttcgtcggcgccgcctacgtcggcttcgtcgcgctccgtctcctggcctacctctggctctgcctcccccgcatgcccaagggcgacctccgccgccggtacggcgagtgggccgtcgtcaccgggccaacgtccggtatcggccgtgccatggcgctggagctcgcgcgtcacggcctcaatctcgtgctcgtcggccgtgacccggccatcctccggcagatctccgacacgatcgcgtctctgtcggagttgatcgtggtgaacaatgcaggcgtggcggagcccggcgcggtgtacctgcacgaggcggacgtggaggcgtgggcgaggatggtgcgggtgaatgtgtcagcagtgacagaggtgacggcagcggtgttgccggggatggtggcgcggggcagggaaggcgctgtcgtcaacatcggctcagcggcgtcagagtccatcccgtccttacccctatacaccatgtactcctccaccaaacggtacgtacccacgacaacagcttctaaaataaacaacatagtacgagatataacaaattttatattatacaaatttattgttttattagtactatgttgagtaattttagaacaaagtgagtagtaaacaaagtgacatgaaacaacttacgacaccatatttatatcagtacacacaacgtcatacatatgcatgagaatgcaccactacaaaaatgttcataaggatcggccatataggtaaaaatcggcacctatactgtatttcccaccaacctctacaagaaccgatacctataaaactatatagacatcgaaccgatgtctataagatcgtatagatattctgtagaccggcttatttttttacagtattataggtgcccgttataatctaaaaaccgacaccttcgtaaattaaggtgtcggttataaacacaaaaccgacacctatgaagtattataggtgttggttttggtacagaatcggcacctatatgcttgcgagggcagcactttctctattataggtgccgattctttatcgaaaccggcacctacaatatcacataggcgccagtttggaaaccgataccaccgactttgatcattagtgttgactaataggtgccggcatcaaaaccattacctattaggtcttcccaaccgttacatatatggttttctgtactagtggtgaccggctggttcgtttctagcaggtacgtggctcagttctcccggagccttcacgtcgagtatgcaagtaaagggatccatgtgcaatgccaggtaacttaattcatcagaaatataattcgtaactttcagttgaatcatttactcattgacagattctgataaaatctggaaagtatgtgcatgcaaatagggaatcaaataggagtatgtatggctcttatgtatgtgcatgcatgcaggcaccgttcctcgtggacacgaggctgatgttcaggttcgaggaggcggcgggcggcgtgtcgctgttcacggtgaccccggacgcgtacgcgcgcgcggcggtggcgtggatcggccgcggcggcgcgctctgcacgccgggcgtccggcaccagctgttgcggcgcatggccgccgccgttccggactccgtccacgactggatcctcctgcacttaaccacctggaacagaaagcgtcgtttcagcggatcagagtgacaagttctatcgacagattatgcgatgctaaagaattgccaacaaataaatgtgtcttcgaaaagtacacttgccgatatattgtttgttgcccattttattcacactaggaaggtggcccgcgcgcatacgcgggcacttatattattgcaagctaagattattgtttgttcaaaattttcatctaatagattaagggcaaactaaagtttggataatgttatttcataataatttaagggttctattttgcttaagatatcttagaaaaccattcacaaaattttgagtaggagatacattaagtacttacgacttttgaatcatgttttttttcgagtaaataaaaaactattgtgacttttgaatcatgtttaactcaaaattcttgtgattaaatcgtctcatgaagacgcatgatatagttagaaagggagggaagcgtatgtatggaaaaaaaagaagaaagggaaaaatgaaaaaagggagggaaagcgcacgtacccacgtatgtaggtgcgtacctatgccgcgtatgtaggtgcgtacccacgtaggacctcgtagtatttagtttgttccaagatcaatttaatctaatagtttataatattgaacgtaccgatttaagtgaaaattaaataatagatactttgcttttttttttagaatttatagtactttctctaatttattagagcaccatgtggtagcttgagagcattttaagaaaatttaaaggacttaacacatgtaattagaatattaaccatgtaatatatatgtatggggcatatggtaatatttgtccagcttcgtccatgtttatataaataattaactatgtgtctaattaatagtaattaattttgacacctatttacaattgttcatagtagctcttacatattcatcttacgactttgattatcggttgatccccaatttactgatcaccatgactcgcatgaaaaaaaagtgctacttaggttttaggacagctgaaattgatgaattatcttatttgcgtggtagctatttgagggtataaacgaatgaattggcttctaaaaagttaaattgtcgtttaaaaagacaccatttataaacttggaaagtgtgcaaactaaaatccaaactatagaatcgggaaaaaagagaatcttaaactcccttataacacccttgtcttagtaagagttctattgttattcgttaatattgtgctcacatttataacataataatttctttcacctatacgaacaaatagtacaaaatccaaatacgacataacacaatacattataattattctataaccaactctcgtttttagcttaaacagagctaagtgttggaaaaaacataacccacggtgcttaattcttctctcgttgcatcacacctttaattttctttttatgttattaacaaaattaatcatctccatatatgatttgatatgtggcaaagcaatagcgttgcagcggtcgtgatcaccttagatgcctcacacacaacgcttgtcacgtgtgcgaaaggcaaaggtgcagacgtgcattgtgcagcgggccaaaaagagaacttcggacactttatttatttgcaaataatagatccgatgatttaaatgatgggtcatcggttctagtataagtgtaaattagttaatatagattttaaattactaatttaacaggtacacaatataatggtgtagactttattttgaaacagtgtattatttgagaataagagtccaatgtaataaaaaatagatacgatgttttaaataatgggtccatcggtttaagtgcacgtatatagattttaaattgtttatttgataggtgcacaatataattgtgtaaactttattttaaaatagtgtattattttaaaataatagtacaaagtaagtaatgagtacaccggtttaagtggaaatgttggcaaaagtgggtcatgatttagtggacgacgtctgcataggatcacaccaacaccagtctgccgccgtgaaccgtttgggccgagagctatactactatagaatggatttttctgtacaagagcgcctataggtttcagacggatggtaacttagtcttgcctgcaataatcactttttcaattgcagttaaaaacagcatgcgaaaatgcattttaactgatggaccccttaacatatctgcacgtgaaaattgataactctctattgtgcattaatttgctcagtacttttattatatctcattagtatatggcctataggtggttttagccatcgttgtcaaactaacgtaccgattaattaactagctttcagcttggttaatggtttgatactttgaagaaccgaaatctattttatggttagtattgttggcaattttttatgataagtcgacaagcacgatcgtagcacctaaacgccttgcggtgatatagagtcgccaaccaccttgatctagccaaaaggccaaatcaagatgggttttgtagaaaaaacaactaaaccggctagcggagccgatttagagtaggctgattttgatcgataagaggataactacccgtctcgtgggtaaaacggaaggttttcaggacaaacctacataaaggtgtcgcactctcgcagcagcggcggacgatttacggtgcaaatcgacaaagatgggctaaaactatggtaaaatagaaaacattgctgaaaagtaaagataaaagaaaaatagaaaactgcggtcagaccggccctactagtcggccagaccgcccacatacctgtggtctgaccggccctgtgaaggaaacccggcactttccaaactttgacaattttcccctatttcgtccatagatgccaaatttgggtgtaaacaagtatttccaagaaaactaacgaaatgaactgataatcaccattggctactccatccagttcaaaatataagacatatttatgtttagttatgacactcttgataattgctacactggaatattattagttatgtaatataaagtgagtatataagaaattatcgcaagtttttttagtgcaaaactattagatataactatagtataattacattgtaactgtattgtaaatacattttaattatgatataacttatataaaacttatatttaagtatggtttggttggctcgcatcgggattttacgcgtgttatgtgtgaaaatttctttctagtaatcttttccctttatgcacaaatctcaaggcgatcctatgaccacaaatctaaaacttttagagaaaaaacttgcgaaatttttttaagcaattccgaatataaaagcatattcataaggaagtagttttgaatatgaatctaataaatgaaactttaaaactatacttttctgtgatcaaagcctctgttcttgctaacaacttagtttttgagccctccgcgactgttagctagttgttgccacattattgttgcaacttggaactaattagttggcgggtaaccattccaaatcaacacatttacacatatatcgcccatatacgtccacgtcaacacatttacacattaacgaacaaaacctagctctacccacagatacgcgcgcacaactatgtgcaaatgacgccgaagagagctgtgcattgcggtcggatcaaatgatggctagccatttctacggcatgttccggcaagacgacccagcgccggcgccggcgtggtggttccagtcgctggccttcctcggcgccgcctacgtcgccggcgtcacgctgcgcctcctcgcctacgtcgcgatctgcctcggcgggcccaaggacctccgccggtacggcgcgtgggccgtcatcaccgggccgacgtcgggcatcggctgcgccatggcgctggagctcgcgcgccgcggcctcaacctggtgctcgtcggccctgaccccgccaggctccgggagatctccggcacgatccgctcccgccacggccgggtgcagaccaaggccgtggtgttcgacctgtccctcgcctcgaccccggacggcgaccagccgctgcggcggctgcgggaggccgtggcggggctggacgtcggggtggtggtgaacaacgccagcgaggggaggcccggcgcggtgtacctccacgaggcggacgtggaggagtgggtgaggatggcgcgggtgaacgtgtcggcggtgacagaggtgacggcggcggtgctgcccgggatggtggagcggggcaggggcggcgccgtcgtcaacctcggctcagcggcgtcggaggccatcccgtccttccccctctacaccatgtacgcctccaccaaacggtaaatacatgtcgtacattcaccaaacacaaaatgacatattacaacatgtacaattcatgttatatatacatgtgcgtgagatgcaggtacgtggctcagttctcccggagccttcacgtcgagtatgcgaacaaagggatccatgtgcaatgccaggtaaccaattaagtttgagtttagtgatcattgtacacacagattctgatgaaatctgaagagagaaaaaacaaatgttacggcctgctcgcggcgacgtgtgtgcgatgtgctttaattgtagacgccgttcttcgtggagacgacgatgttggcgaagttggaggaggaggtggggcttagcgtgtcgccgttgaaggtgagcacggacacctacgcgcgcgcggcggtggcgtggatcggacgcggcgggccgctctgcacgccgggtggactgctgcaccagctgatgtggtgcatcaccgccgccgtgccggagtccgtcctcgactggatcgtcctgcgcttcaccacctggaacagaggacggtagctgttgcagccagcggagcagagtgtcaaggacgaggggcatgcaagttcagagagctgtggtggctcgctaagttaccatcctggccgctgtcgttcgattaccctaacggcgatcagccgtacgtcgtgaccacaagtcgcgcccgatgtgtgtatctcgagcgagtcaggggtggagattaggtttgtaaaaactatgtcaaaatgtaattttactttcaagtattgatatggagttatggacagtatgtaatcaacaacttaattagcactatttaatctatcgtgatagatatggaattcaatgcaagatacgcactttcatcagtagaataggaaggggcgatttggtagcatcacggtcgggatgaggaggattaagcagtgacgattggaagagataggaagaggcagtgaggtctcttcttccttagggcaagttttatagtagatgtgactattacatctaattttatgtataacatacataattattgagaggtgatatgtataataggtcacatctaccacacaatccccaatatctttaacactctcatatgtttattgaagtttatgtaggggttgccccttgcatgagaggtgactatttctctctcatccttcttctctcctccacctcactatttagtcctatgtgacatcttgggatttgtgcttggatgcccatagtacttgccactactagaaaacttattttcggcgtcgtaggggatcgattttcgcaggcaggcatgtaattcggagccaaaaccccgccggcaaaaaagatacccggggtggaggggacggtccgcctgcgaagatcaatcttcgcaggcgccgcttatatggcccgcctgaaaagatgcccctatatagtcttcttcctcctcgagctctgttcattctccccgaagtttctctctcctaaagtgacttaaatatagagggaggttttgaacttcaaatcttcgggggatttttctacggtacttagatctacttatttccacactaggtatgcaattttttaagcttttagaccttaatttgtgatggatttatgcatgcaaaattgtgaaggaagagttccatgttttttaattttatttcttttgatatgttgatattagatgtatgtctaatacatgatgcctcttgttgtagtggtttaatgtggtaacataaattctcaattttttttatttttgctatcacatctacctccttgttctagatctagatttagatcttgtcatatatagagagaataaaatttttaatgtctatttattcggtgcaatcaaaaaatagttatagtattttgtaatatgccaatgatatgattttgttagattttcctaatgtactaatttgtcatgtctgtgtaaaaaaaattgaaataaactttgattttttattaatttacacttaacctttagttaattagttttgaatagcgataagttttttcaataaaccctacaaatttggtattaattgtgcaaatattttacgtgtatttttttagagatatggaaagtcgggaatggatgtatcattggccgaggtttttgtctccatatagaaacgaagtgtctaaatttattggtattaccaaggcacacgctgagaagaacaatatgaggaagataatttgtcc

SEQ ID NO: 7714 - DNA, 37898 bp, Oryza sativa
  unsure (1)..(37898): unsure at all n locations
tgagtcgaagggttgtgacagtgagttcacaacactccggtcagttcttgaacttatgaggttaaaagtgagacatggatggtctgataccagtttcgacagtctgttagaacttctgcagaaaatgctcccgaggcctaactcactaccatcgagcacatatcaagcaaagaaactcatatgccccctttcacttggtgtggaaaagattcatgcgtgcgtaaatcactgcatactgtacaggaaagagtacgcttctttagatgaatgtccaacatgcagtgcaagccggtacaagtcgaatagcaatactggcctagaaccctctgaagcaactgagggacgacagagaaaaatcccgcagcttgtgatgtggtaccttcctgtcaaagaccgcattaaacagatatactcaaacccgcgagatgtagaactaatgtgctggcatgaagaagggcacaagaaggatgggatgatttgacacccggcagatgctcgttagtggataaattttgatgctcagtatagagagtttgctaaagacccatggaacattagatttgccctgagtaccgatggagttaatccttttagagacgtgagcagctcacatagtacttggccagtgcttctcaccatgtataatcttcctacctggctttgtagaaagagaaaatacgtactactctgtatcctcatacagggaccccgtcagcctggtattgatattgacgtatttcttgaaccattgttggaagatatggctgatttatggaaagagggattgaaagtgtgggacgagtacttaagggaatacttcacagtgaaggccatcatcttcgtgaccattaacgattatccagcaatgttttcagtttcaggtcaaattaaaggtaaaacaggatgtgtgatctgcttgaatggaacgtactataggtatctcccgggttccaacaagcttgtgtacatgtggcaccggcggttcctacgcataaatcacaagtaccgcaagatgaaggcggagttcgatggtactgaagagactgatcctgcaccaaaacctacatcgggagaaaaggtgtgtgcaataacagagaaaattgtttgcgagtttggaaaaatgactaagaaaccatcaaaggggacaaagcgcaagaaacccgagaagaatacaaaacaaggggatagtaagaagcaagatgatagttcgaagccagatgataaactccctcccccattcaagaagcattccatattttttaagtacctcccgtactggaaagatctgaaggttcggcatgccatagacgtcatgcatctagagaagaatgtgtttgacaacatagttggaacattgttggacatgccgaaaaagactaaagatggtctgcaatcaaggatagacctagtcaagatgggaatcagggaagagttacaccctcaagaaggagaaaagaatggcgaagtatatcttccaccagcctgtttcacactgacacctgaggagaagaagtcattttgcaactcactccgtgatgtcagagtgcccataggtttctcatcaaacatcagtcgactagtttcaatgaaaaatttgtcggtatctggttataattcacacgactgccatgtcttgctcatcgtgtttcttgcaattgcaataagggccataaaaccggagcttttaaaggttgctatcacaaggttgtgctactttttcaacgcagtgtcacagaaggtcattagtctcgaagagttaggaaatctacgtacattcgcacatgagacacaataccaacttgagatgtgtttctctccgtcattttttgatatgatggagcacctcattgttcacatagtgccgcagatggttgcgcttggcccattgtacctccatcaaatgtggtcatacgagcgttacatggcggttctaaagggttacgtccgaaatcgtgcacatccagagggatcaatggttgagggttatagtactgaagaggttgtcgagtgttgtatcgattacctcaaagatggatatgcaattggagtacctgtgccccaacacgagggcaggttgagtggcaggggaacgataggaaagaagagattcgtcacccatgatcacaaatcattccaagaagctcacttcagcgtgcttcatcagtttgctatcgttgagccgtacatcaatcaacatatcgaactaatacaagctaacaataagggtcgcaccaccgagtggataatgaaagaacacaagcgtctcttcatagattggttgcgagacctagacttacctgagggacaaactaccgatgaaataactatgaagcggttggcttgtgatccatcaactacagtaaattcttggcagggatatgacattaatggatactcgtttagcacaagagcccaagataataagacctgtacgcaaaacagcggtgtccgtgttttcgcaattgatgaagccggggaaaaacaatcatacttcgggtttattgaagaaatatgggaaatcgactatgggcacacaatgcaaatccctatatttaagtgccagtgggtaaaatacccgaacggggtcaatgttgataagttcggtcttactgttgttgacctggcgagtgtgggtcacaaggatgacccttgggtactcgccaatcgcgtggaacaagtgtttaatgtgaaggacccttcaaatttgaagaaagatatagtgctaccagggaaacaaaagatattgggagtggatggggttgaagatgtcgaagattacaaccaatacgatagtatgccactttatagtcagtttgtacagaagattaagaatgtcgagacatctactcaaaagaccgtgaagccttacatacgcacggacggtgtgggcaaaaatgttaaagggtaatgattgttgagtggcatgtaagcatctaaaaagttagtagttatataatggtggtatgtaaggtgatgtgtgatcatatcgcaaattgacgaataattgtactcaacattttggtggtatgtaattagtttgtactaatttttatgtgtaattaccatttgtagtgtaaaaaatttgttaaaaaatttaaattagtaatatttgaaaagtgtaattatttttatgtgcaattacaatttttaccatttgtagtgtaaaaaatttgttaaaaaatttaaattagtaatatttttatgtgcaataaccatttatacatttgaaaagtaataatactaaggtttgtatattttgtaataatattaaggtttgtatattttggaataaatatattcaactctgtaccaattttcgcaggcgggcggtccgcctgcgaaaattgttgtacaaagtagggtttacatcttcgcagtcggacggcacgcttgcgaagatagtaaaaacgatcttcgcaggcggaccgcccgcttgcgaagatcgttgccctatataagggcaagcccgcggcgccaaaatttctaagtctaaaagggagaaagatgtgctaagtacggcgctgggtactactaagcatgggggaagggttcgaggtgtgtcgagcaagatgagttggaaggaagggttcaaaaatgacccaaacaagaagcgtgaagtgtacaaggataaacttagagacgaaggggctgcggagtttgaaaggcaaatgatggatttctgcgtcaagcacatgcttttgcctcgccccgaaaccaaagaacctgagccagattaccccttcgatgacctcaaggagaatacaccctgcagattgcacgttcccattggacgctccgggaaaactcttgaggccgctacagccattactatccctaggagaacatacaatgaagagttcatacctgatgcgtatgccaaggtgcagccgcaagtggtccacgaagggtttgagtcctacgacattgacttcccgactgcagatggtgtatccgtacttggggatgcggtcgatcttgtaattctctggcacaagaatgacatatcctttggattgggcaccgacgccacgcaaaaacctgtggtgcctaaaccggggttgggaaaacctccgagaccttctaagaggaaggtgactgataaggcagaggaacccgagatgcaaagggaaaatccagtgccggaagtgccaccggagattgcattgccagaggcagccatggagattgcaccgccggaggcagccatggagattccagtgccggatgtgcccatagagattacagtggcagaaccagaggtgcaatttgtggcatcagtcgggtcagaaatagaagaagtaccaggattggaatgggacggtacagagccagaaatatttgaagacccttctcctgcgaaagaccccgaggttcaagagaccacggtccctgagaaggccactaccagttctgaggtgccacgagtgcttaggagccacgactccaagtccaaagatgagaacaaggagaagttcatggtaaccgtctttagagggggtaaggaacgtgccaagctcaaagatgacgacccccagaaggctgctgaactagccgggccaacatatttcgcaaccgatgattgcccggaaaagtacgaacatgggaaagcattcttgccggaatgggcactgaaagaaggaccatgagagatgagaaggttacataccttctacatggaggccagcaagaaaggcttgggcaatataacagctcgatccccggctaattgttttgcgaagagggttacgtatggctagatttctcagatctccacgccatatatcgtcgggataagatggacgtcaactacgtcggtgtttggtgcatgtgagtatgagttttaattaattagatgaaaaatatgtacaatacaaatccatgtgattgttactaacaaacttcttctgtaggatgcaatacatggatgctaagaagaaaaaagaacccatcggcttcttggatctaactcagatctgccaaacacagcatacggtgaggctagcaccagggtctgaccagctgaagggcaagaatccaaaagagatagcagaatacaagaagggcttgcacaaggataaattgattactgtcgcacagtacattggacgagccttcttgcactttcaaaataagagagtcgtcatggccgcttataattttaagtaagtctggtacatttatcttgtacacatatgtcttattttagctggtactaactaactatactgttgttaatatgtagcgatcattatatctgtttactcatccaccctaaagacggaatcgtggtagtcttggaccctctcgattacagtcacaagcaatacaaagaatttctaacaatcttacagtagtaagtgagtatgactcttgcatttgtatatgaatgtattataaataaatatcctccttattgtgaaacggtacgacatccatacagtgcataccaatactacaagttcaagggtggagaatagacccgaacacgggagaagctgctagtacgtacctattggccggtaatactccactcacttaatgtattccaattgtttcactaattgcaaattttaactaattttttctatgatatgtactgaagtgtcacaagcaaccgcgaggaacggtcctttgcgggtattatgcgtgcgaattccttagggttaatggacggtacaggactaacgcagaggatgtaagtctctatactatgtactagacagcttcacatatttatgatactaatatatggattaacttcaatgcatgcagttgccaagattacaatgtcgaacaagctttaacgatacaggtaccacaaatgtccagcgtgatctgtgccacttcatccaccatgagtgttgtcatgtgaaaggagatttcttcgacccagagggtgccctagcggcaagtgatgaatttaaggatcttcgggagtggaacactgctatgccataatgtaactagatgacgttatttgaagtgacaaggtaaaaaaatattgtaatatatatattttggcaacacttttgagttatgcaatatatgtagatttctcagtaccaaatgtttgataatcttccaatatatgtatataataatctacctgcaataatttctattaaataatttaaaagtaatttacgggcaaattattattaaatttcaatattttctacctatcttcgcaggcggaagtttttttttttgcaggcggccgattcctattttcgcaggcggaccggactagccaacgtccacctgcgaaaattatcttcgcaggtggacggccgccccgcctgcgaagatcggcgattttcatagtcgttggcatacaggcggacggtcgccccgcctgcaaagacccttttcggccgcttgcgataatgcttttcctagtagtgtgcccttatccacctctttttccgatggcagcatcaccccatgcccgacgacgtgggtggctcccttatgccattcctaacccaatgactagaatgatatccatagcattaaataagcggtcacctagaattaaaaatgatatggcaaagaaataaataaggaaagagaggagaccatgtcttgcatgagacatggtttctatacaacattcaagacatcatatgaaataagtagcattaaatttaagtatggaatagtggtgtttgcattggaagagtagtgtctagtactagtgttagactattctcaacccaatgattagaatggtgtccatagcattaaataagctaccacctaggatgaaagatgatgtagcaagtgaataaaaaattaggaaagagaaggaaaccaggtcttgtatgaaacatggtttatacacaacttccaatacatcatgtgagataagtagcattaaatttaagtatggaaaaatggtgtttgcattgaaagagtagtgctagtactagtttcttgatgatgaggacaaaacggcagggtggtgaaaagaagatcgccggtgccggtgggcaggccaaaggaggcagcaacggacaagccatgcatttgcatcgtttgttgcatacgtttgaaccaaattgtttcatctagcgatctgaccatgttatactttttttttagaattaaaacattctttcgctatttgttgaaacattgtttttatataggtgaaataacgtctgattttttggaaaccgttgtttcatacgttgtagcaaaatgtttcatgaggtgatttggttgtgttttagtttttttaagcgattgaaacattttcaatctacttagtgaaacattttcgatctacttggtggaacagcgcccgattttgtaaaaaaaaaaaagaaaaatcaggcgcccgatttgtaggagccttggtttctctaggcagggacgtggaaggatgttttttaaaaaaagtttctcgaaggtttcggaagaggtttttcgtatttgagttgcgaggtatggatgaaaaatcagacgaaccatgtttacgtgacatggcgttataattttggaagaaaggattcttctttcatgtatttaaattaaatacgctacatgtgtttatataagtttatacgtgctgaatatttcttacccggaggtactcatggtgttttctgtagtaagtccatctctcttcatcaggatgcttagttatttcaagcatgggatgatgtcccacgctttgctgtggaatatatgttagatattaatgaaatgatttggattgaaatattataaaaatgatttaaaaataatgatttagcatgtgtatgtatagttttataataaaataaattgtagatatagttactatatacttgcacgttaagctttgtatgaatgcgttgacgtggcatgcttgcatatagattttagaagtgctaataaatattatacttgcatgataacctttagatgtttagtacacattagctcaataaaaagaagaaatttgcgacctatatatagctctcacccttggttagaaaacggaaatttaatttagattgagtatgggtgaaatttaaggcactgcaagaatctcaaagtacaattaacggttttgatatgggtgaagtttacaacggttaccttaaaatcgtgactcataagttgttggaaattaattgctgcagtgcgcgagcatatacagtactacatccattccaaaacaagtgcagtcatatatatcggtgtccaacgtttaaccgtccatcttatttaaaaaatttattaaaacttttttaaaaaactattcacatataaagtactatttatattttatcatctaataataataaaattactaatcataaaattctttcaaataagacgagcggtcaaatgttggacttgaacagtgtgaggaagtacaaccaacagtgcaaggttctcagtatcctaatccgtatcctaatatcttacaatattacgatcctaccaagcgaaacgatcacgataccgatcatagtcttacctagtatcctaaatgtcataatatctcgattctactattcattaccatacattttacgaaatcttaggtagtatcccgattatataataagatggtttgaaaatatgtaaataatatgctgaagtttatataaaaatcggttaaatatatcaaaactaatgtggtttctcttgataaatatccctatttgcatggtatatattattactatattttttatatagaatagctatatgtaattaatacaaatattaattaaacttaaaaaaatctcatagtattcgatcatacgatacgatactactttgaacaaaacgatactacttagcatcccgatattgataaccttcctatagggtcgcaccatttctctaagcaactatgtgtccgtgtgcacacgcggccacgcgctgcgcacctaatgctactgttttgttagtatttatttaatttagtactgattttttttctcatcaatacaatcactacttattttaagttatctttaaccaagtaaatctatttaatttagtactgatttttttctcatcaacacaatcactacttattttaagttatctttaaccaagtaaatctagaacgtacgaattatctctttttaaaaaagatcaatagtgtacgtgaaactattgcaattacatcgatcaaaggtgtggcccattgcatattttcattggtggcagctggcagctaggccaccacagtccacccgtttcactgtgtgtgtgtgtgtgacgttaacacgctactattcccttctgcctaatcaccccactaattttattattgtgcatatataatataatatatgcactaattttattattgtgcatatataatataatatatgcgcgtgctgcgtgtcgtacagcgcatatataatactccctccgtccctaaaaatttgacatcgtttattttttaaaacatgtttaaccgtcatcttattaaatttttttgtgaatattattcaaaaacttaagtagtagtatatttaacaatgaatcaaatgatatgaaaagaattaataattacttaataaaatgaacaattaaatatgtttaaaaaagtcaacagtattaaatattcagggtacaattttcccattttattgcatctgtttcactgtgttgctcggccaaacgtacacacagttcgttatatatcgtgcaacaccggtgcatggcgaggaaaccatacatatagagagagagagagagcccgtgaggtgtggctggaatcgtcatggctggtcatgtcttcatgattcggcaagaatcggcgccgccggcgccaccgtggtggttcctctctctggtcttcctcggcgctgcctatgtcgccaccgtcaccctccgcctcctcgcctacctcgcgttctccctgcaccgtcagcccaaggacctccgcagccggtacggtgcgtgggcggtcattactgggccgacatccggcatgggccgggctatggcgctagagctcgctcgccgcggcctcaacctcgtgctcgtcggccgtgaccccgccaacctcgaggagatctccaacacggtcaggtctctccacggggtggagaccaagaccgtggtgttcgacctctcactcgtggcgactccccacggcgacgagccgctgcggcagctcagggagacggtggaggggctggatgtcggggtgttaatgaacaacgccggtgtgggggagccggctatggcgtacctacacgaggcggacgtggaggcgtgggtgagaatgatgcgggtgaacctgtgggcagtgacggaggtgacggcggcggtgctgccagggatggtggagcggggcaggggcgctgttgttaacatcggctcggcatcatcgcaggccatcccttccttccccctctgcaccatttactccgccaccaaacggcacgtacatgcaacaaacacacgtaacatgttactacacttttttatagtaaaggttacttactctcactgtctctctctctctctctcttcgtaagtattttaatatttaatttttgtttataaggatttatgtaatgcttgttccatcaatcacctttcttcccgtgttgctcttaaccaccatcacactcccaaccatccgtgacaaatccaaaatgtaaattgacggagtgctaccgtgctagtgtaaaaacatagtagtatgactgaagcagagatatattaattaatatgcgcatatgatcgaaaaaaaaaactttctccattttaatttatggctgtgttaaatatccacaaatatctgttatagtatacctagagtaagttctgtattctgcaagttcaggccctgaaaaaaagaagtagaaacagcgagacagctgcatcggtgccgtccgaacagtttctttactggtggctaattagacttattaatgattaattaggggtagggattatggctgttcgtttgtaccggttagaagtctatccctccagcacagaaaaagaaacagcttattgttgcataattaattaagtgttagctaaaactaacttgaaaaatggattaatatgatatttttaagtaatttttttatatattttttaaaaaatacaccgtttagtagtttgaaaagtgtacgcgtggaaaacgatatagattagttgggaacaagcacaaaagaacagtgatcggccactgccaaccatccaccattcaatgagcgttatcaaagtcattttttcctcaaccttcttcttacaaacctaaaaattgtttatatttgtcgtcttaattacacatggttgtatatatgtgggcatagagatttataatcctttcatatgagttgtatatatgtgtgattgtcagcacaacctgatataattagtgactacgttcattaatttcaagatgcaggtacgtggctcatttctcccggagccttcacctcgagtacgcaagtgaagggatccatgtgcaatgccaggtaaccctgatctgacgagagcaatctgacgaaattttgcaaccaaaaaaaccaagtgaagaaacacacaacaaatttacgcgatgcatccatccgatcatcttatctgcatgcaggcgccgttcttcgtggcgacgaggatggtggagaacctggcggaggcgaggcgcctctcgccgttcacggtcaccccgggcgcctacgcgcgcgcgcggcggtggggtggatcggccgcggcggcccgctttgcacgccgaacgtccggcaccggctgctgtggtgcgccgccgccgccgcgccggactccgtgctcgactggttcctcctgcgcagccacctggagcagaggacgacgttgtctcagcaaatcagagcgtcgggggcgccggcgccgtcgtgacagcaggaagttcattcttggcgcttcgtcttgcgttcatgaacaataatagtgggcagtagcattgtgatatactgctacatccccgttttatatactataagttgttttaatttttttatctaagttgaacttctttatattatttgatcaaatttatagaaaatataataatatattttcaacacaaagtaaagaaaaactatcaaaatatgttcaatgttagatgtaataaaactaattaatttcgtgctataagtgttgttatatttttctataagtttgattaaaatttcaaataaaaaataaaaaaatcaattcgatttataatatatacggaaagattgcgtgcgtatgtccggatgctggtccatagggaaaaacctggttacatgactattctcgtagtgtaaaaacgtgcatatatacaacataacgatcacacacttgtggactgcccgtttgctagattattttggatctcattgaatgaagcgtttggatccgggcctagccttgcctagcaagaccagtcatttggaatcgtaacaaaatcctagctcctcagggcgagctaccccataggggtgagaaaaggctagctcacgaggaagagccaaataggtacgcctccaacggtaaaatgcacgtaagaaaaaattgttgataaggccgaagcgatttactccaaaacctactaccttcttcaacaactagtcccccaatttcattgttctcttcctccactcttggccaaagaattggcctcgcaaatctctagttctctttgtccacccttggctggactatcgggctcacatatccggtcaattggcaatcatcctcctcttcgccttgtcgaactctcaggtatgctcatcatctccggcgcacatatataaatgcagtagagcccatacgtagtaaatcagagggcttcggcaaggccaactttatttgaggataaaagataagaatcaagttggttgggtatgttgctaggaggagcatatctaatactaattatgcatacacctagtagtattgatcatgttaatcgtattataacctagaagtacagatgttgggtacggaggattcataccaccgtttcaccaaacccgataccatttgcatgaatggataggctataaacccaagacagcaaacgaatgactattcaacttaagacactcttctctccgcactactgttgagagagcgtctgtcttacttaaactcttatactatacttacttaaactcttatactatcactacatgacgtgtcatgttgtgaatatataaactctataactttcaactacttacattaaacggctaagatcattgtttgtaatagttttgtaaaggaaaattagtacgtggagcggtgctcatctcaaattaaaagaagaaaaggaatcccaggcatgaggcatcagtgttcagtcagtcaggcacctcgacggcgagacggcgcggcgcttggcgtggtgatgatggtgtgatcgccggttaattcgtccacccgaatataatgccgccgtagtggagtactggaggaggcacgtccaaacgaacgaaccattattattcctttaaccgctcacgtgcgcgcgcaaccccttcgtttccccacgcgtggcgctgatacgtaaccggcctcggcgccacttatattattnncctttgggaancccggaaacgtatcctcattctcaagcgggctcgatcgcactcgcttcgatctgcttcggttttcactccaccactcgatcgcaccatggagccggttgtctcggtctcgcgcgtgcggcccggtcgccgtcgtggttcacggtggacgcgggcccccctgaggagccgctgctcctgctcggggcaccggcggacggcgacgacggcggcgaccaggcgcgggcggcgctcctgcgcgtggaggagctcgagcacctcctcggcgacgtggcgcggaggctgtcgcggctggacgccaagcgcggcaggctcgagggccagatcgccgcggcgtcccgcggccgcaggggtggcggcgctcatcatcgccgtcacgggagcgctggaggaatatcggagtcggagggcgagggctacacgcggaagggcgcgggcgccgtccgcaagattctcagggcggcggccggcgacgtgaagaaggcgcgggagtggctggaggcggtggcggggaggctggaggcggcgctcgtcgacgcccgcgagcgcctcgcgctgcagcagatgctggcagccggagcgtagttccagcaaccgcggctatatattagtacttacttatcgaatgatactgcattagcgtatgtgtaatcccagctctgtgcttcttttaattagttttctgtttcatagactcttcgtcgtgcatgcatattcatcgacattgttgcattgtcactgtgacctctatggctctatgtaattaatgttattggttcctcgttttttaacttgttctgctcccgttccgagagttacttgttgtagtattatgcaatgtcaaattggtatattgtatatgtcaatataggaaggtgtttggttcaagagaaaaccaaggagaaaacaaaggaaaattttctattggaaaatctactgtttatgcgcttggaagaaaggaatatatgtcaatataggatgttttgtgggtataaaaaaattggtcttcgattgtgcgaccggagagcaagctattgtctgtaatggagttacatgcttgaaatggtagccaaaaatctcttgtttctcttcggatggcatagtttcgcttaggcttattgatgaatttaggtaaaattggttctataacatcaaaagttttcatttgttggttttgcaaaaccatagtttcgcttaggcttgttgatgataaaattggttctataacatcaaaagttttcattttggttttacaatacgaaatgtactgagcaatttaatagcaccaaagttgcatcccgatcatgattttagtttctctttctagagaaaggtatttttacccgggctttacatccaacaggatatatacaacctttttaaaattagaaacttagtatttcaaacaggaacttagccctcaaattaataacccaatctgaaattcgctcctacgaagatttgaactaaggatcttagggtgctactcaggtcgctgtaacttagtcctgattttagttttgtggccggtgccgatgaaaaaagtatacttcttactactactattactattctagcgtgtatgacagactagttcctctaaggctggatggattcagtatgttgtttgtctcagtttttgcatgttgggattgtccaacacctatttttattcctactgtactcttggctagatgtgctacaacacagacagacaggagaagtattactcatcttccattgtctaagaaaaaggaacggagggatgcaaaatatagtgggattattcctataaagtacttttgcgcacaaaaacatccgttagaagccagtgttttctcttcttacgctaaagagtgagatgagagagaaaattcctacactatagatcttttggaaaacatgattttgaaaatgtaggaacaagaaaaacattttccacgaatatgatggaagtgaatccatgggatagattttgaaaaaaaaaaactcgtcgttcggtagcactataggaaaaacatatgaagtttgagagacggagagaaaacattataggtcttgtctcttcgtaatttttcttcaagattcatatgaaatgagcaattccataggaatttcaaaagatcgtgtgaaggtattagtccactttacacccttcaactattacatttgtctaaaatacaccatcaaacttcaaaattaaaccgggtatctaatacccctcaattattaaaaccattagacttacccccccccccctcgttccaaaccaggcaattttggtttacgtggcatctgacgtggcagtccagttagcgaaaaaatataaaaaaactataggggcccatctgtcagttgctaaaatatctctctttctcctcttcctctctctctctcaatctcatatttcccctcttgatcccgtttctcgagtgacgacacacaacggcacagaagcgccgagcgccaccgccgctgccagagtcctccctctggaccaccgccaccgagatcctccgcgagactgccgccaccgatcgatgtcctcctgagtcccgaggtacaccacccgatttcgaccagcaacagagaccaacgagaagaggacggatgccgctggattttgtcctgctcctccctgcatcaagtatgagacccgccacccctgagaacctccaccgatccatcgcctctaggtgccgctgctccacccctacactgccgcggtgctacctcacgaatctactcgaggcttggctggcaacgattcctcatccttgagtaaacggcgatggcaggggagtggcttggccctctccgtctcaacctcctccttcgagctcgcggtgaaaggggattttggactttatgccatcttcccaacgcctcattcccaaatgccatcctcctgaacgtcctcgctaatttgccactaggccccataaaattgttgattctatgccattttcttcccattttgatgccacatcagcagcggacgtggaatctcgatggcgaattggccgtcttgcccctggtgtgtgtggacaaaaaaaaaagcgagcagcagccgtctccaaataagccacagcaaacaaataagattctcagcgaagaaataaagcagggattttggatcttgccacgatgggcactcagacagaaccatggcttcaacaaaccctagaccatcagatctaaaaaaaacaagtgaatccggagaaaaaagtgagggaaacagatgccaaactaaaccaaaagaggggaagatggtggatctatcgatctcatgtatgtgattggtgtcacggtttggccgccgtcgccagtcggtggattcatcagctgctactcgcgtttttttagggtggcggaatgagacgacgagaaacgacacgtttttctgttcacgcgtgccaaggggtaccggtgaggtggagtcaaaattagaggataatggcatagaatcaacaattttgtggggcctagtggcatattagcgaggacgttcaggagggtggcatttgggaatgaggcgttggggaagatggcataaagtccaaaatccccagtgaaagtagctcggctaactgcgagcccgccaaggaagtggcgtaggtggcatcaacctagcggtggaggcggtataggcgacgtcaagatggcggtggaggaggcgcaagtgacagcaagctggctgtggaagcatgcgagcgacagcaaagattgcgctggagacccaaggtagcacgtgcaaagtatatagggagggttgaagatggcaaactaggggatagctgacatgtaaaaaaaaatgttgccatgaaaacctcctggttttgataattgaggggtgttcgatacctggttttgaagtttgaggtttgaagggtatttagataaatgtaatagttgagaggtgtaaaatggacttgtacgttttgtgaacctcattattttgttccaagggattctaattttccttctaattgctatgttatcttccaagccttctaaacaaggtcctaggaatgttgtatgggcctaaaaataggcccacggatactaaacatcatgctcccctaaaaagcccaccaaatgagtagtctcccattctgacccttcctcccgtcgccgacgccctaaaccccgcaagaaacaccacacctcgccgccggcgacccaccggagagcgggcaagccagcctcccgcgccgcccaccccatggcgtcccgccggtcgctccatctcctcactgcctcccgcggcatcttctccaccccgcacctcgcctccctcggctggttcgacaagatcaagagcaccttcaccggcaagaagcccgacgaggccaccgacccctccgccaacttcaccctactccgtgagtgagctctccggacgcatatgccctgttctcttctcttctcttctcttggtggcggcgtgggtgatggccctcctgattcggcttcttgtttggttttttggggggagattcttgcagagttcgcggattcgatggagaaggcgaggaagctggggacgttcaagaacttcgtgatggggcggtgcagcgaggccaccgtcgtcaacgccttcgagaagcactccgccgtcctccgctacctcggcaccatcgaccccaccggcgaggtaggcaaggatcgattgcattcgattttttgcgttgcgttgcgtggtggttgtgttgattgtgttgctttgcagaaactcaagaacagcgacaagatcggtgccaccaagcactgcaactgcacgattgcggatgtggagcacatactggccaagtacacatgggctaaggaggctcagaagaagatagtaaagctcaaagaagaagggaagccgttgccgaagaacttcaatgaggtaattcctggtcttgaaagaccaaaggtgttattaatctagttgttcactacacattttagagatgcctgttatgaccgttgaaaggaacataattgggaacagataggaattgggaagaaatataatagattgagaaaatttgatgtatttgtctatttgagaaatataaacctaaaagcataaggtattaaagtcaatatcatggcccacatatgatggtactactgcgctctgtgatttttttcaatggcactaagcaaattggccccctaggatttctgtatgccaaaatatgaatgaggtcagtgcagagatatcattttctctagtgtttaccatgtatctgtgtagaatcctaatttgtgatcaaagtggcaaaagctactttcaattgttgtaaatgattttctgaacaatatttaaggagagagtaaaaaatgtggtatgtgtttcgattaaaagacatgatagaagttagtgattcatattacttcttacatatattagatatcggtattacaggatgctcgattttgaatgttggatttcagcttgtccaaattattgtcatcttgaatgcgacattatgccatataatctttcagtcatattgaatcattttaatcatatcatgcgtgtaggtgaaaaacctaatgggttctacaccactggacgttggcagatctaatctggaaaagagtggacagataagtagaaatgctatgtgcccctgtggttctaagaaacgatataaaaagtaagatgcttctgagcttgattctgttggtaacagtgtttgcattgtggtgctgctattctttgattggctatatttccccggttccttgattggctatatttcctcattgctctgactgcaatagtatcttttacaattataatgaggacaattgttctatttagtatacacatggctcttgctatttggagtatttagcaaaagatagatcaagattaatggatttaaactttccaatatgtgcattgtcctgtaaattttaacctattgccaatcttgaatagaaagatacatgtctcaatcctatatgctacaaaattggaagctaccacaatgtttgtgcatttcatctaaatgggttgttgcactatttatctattaaggaaataaaaactaagaatgtaataactctaatggtgcaaaccagatttagttttatatatttatagtgtatagtgtatttctcgcccatattgttttgacatttcccttttgctgccttgaatttgaaggtgctgtggagcttcttgaagtgaagaccatgttttcctttgtgctgaccacatgaaatattttgattagccatgatcaagaagagcattcctctctttttttttcacttcagcagcaatgcagatcatcctgccacaaacctgacattgaaatatgtaaagcaccataactgaggtttgcatgactgagttttttttttgccaaaattgcattacatctaagccggctttgttgttaaatttgcttgtttatataagaagtcatggaaatatccatcacattctgcgtagaaagcctgaactttgttcaagcaacgcccgtagatcaattttttttttggtttatgggtacattactaagtcgagagatgcactatacatgatgtatcctgaagctggtcattccgtttgtttgggaaagtagcatgtgaatactgatgcaattcaggacccttcattgacattcctaagtcctatagaatatggaaaaattttgaaaatatattttttttcattggtgttacatcaatatacacgtttaaaagaaatttatgaaagtataccgttgttgcaaggcggtgccacgagatcgcaagattcgccatggtctcgcagattgagggcatcagaccgcgcgaccgctcgaccttgcgcggtaagtgcgctagaccgcgatagagaattcaaactagcgcgattaatacattactcattagcaattaattaattaatatcatttctataattagcattattagttataaataattgctaattaggataattagttactaatcattctaaagcggtgtcgctgtttgccccttcgagacttgggtggtggttggatccaggtactcacatacgatgacggtatatttgtgctagaaaaattacatcccggatattctgaaaaaataaatgaacagtatattttcaaatttaatttctatagaatattgcagctctacgatagcagacagaaaagacaatgccccacagaaattttaatcatgcaaaacttttctttgctccaaggtaattttaaacatacaaaacttatcttctctcaaaatatgccagctacagtgtcattcgctccttaggggggagaggatatctagttatctagataggggaatcactgaattggcagttgacccaaccagaaaccgcaaaacatgttctagacttcctagtcctatcttcacttggtaggccgatcccatgtcgtctctgatgtgaggctgttcccgtagtacacctgctttgtagattcatccaggtatgcctgccaacaatggaaaagtcagcacttccattttaacgaacgtaaatgttaaataagcaaggctatcatggcacgatactggagcagagaatacgtgaacttggtcctcaagactttcttttagtgtgtatttgaattgtcatcagaaaatcaagttgcatgctggattttattctagacgtatctctagtcattggaaggacactgggatctgaaggaaggttgttaccacgaatatgctccagaggttggagctcggtgctttacccatgctactaacaagccagtctttgtgcaactgaacttcaactgtaatcacatctctggtgaagagattgatgaggtgaaggatgttctgagtggtaaaaactcgaattagcttgttagattaactagctcctatcttgttctcgaattagcttcaaaatgtttcgcttgccaggttgaattttcttcaatttactccatttaatataggttgagctcaactagtcacaatagaaacagcagtaaaaattgtactaacctgccatccagaaggaagacccttgcagagctctgcaagatcaggttgtcctttatgcagatcggtgacactcactggtgcagaaatagtctcgctatttgcctccttttttgcttccgctctcctgcgtttcacacgatcacgcctgcacaaaatatttgctcaaactgaaaaacccgcaatatatgcaacggaaaaacccacgtactccctcaaaacattggtagttgggttcccaattcccagttagtcaacagttttccattgcatacctaaatctatagcattttgttgtagaaaacttaaaacttgccatattataaactaaacagttcaccaaaaaaaaagcataaaggacatgtaatcttaatttgtacaatggtggcatgattcaaggtctacccacaacttatgtcaaggcaaatcaacaactatttttagacatcccatctaaatagttgaaaagatatcggaatccaaaaagcttttaaagttcgaattgagacatgtccaatcatttctccaataccagagtataagatatataggcatatggccaagttccagaaaccagctggaggtctaattgggcatctccgagatggtttccagctgtttcaacaaaacactccatattgaatccaacaaactccaaaggaaactaactagcccaaagcagaagttcagttttttggcagtcatcaaaccagctatcactggtagcaaccacagaacattgctcaactggcagaggtttggccgcacgaatcagacattacctatacctatttcaagttggaataaaatccttatttgttgtgtttggttcaggaggtgagttgggttgcactcatccatgtttttggaatgggatgcccccatccatccatccatcccaaacagaggcaaagcatgtgttttgattgaagtgatgggatgggtcgggtcgtgaatccacttgtcagggtgtttggtttggggacaggtgagatgggatgattcctgaaagggaatattccctctagatctaggtcagcttcatacctcgaaaactgctacaccgtccaatagtccaatttctcaaaaaaataggatcattccatcccttgtgccaaacacatggatgggaccatcccatcccataaaaacagggatgggtctaatccatgccacctcatccccaaaccaaaacattaagcatgtgtttggttccagggatggagtgggttgggttgggttgggtcgaacccatttttcaaggtgtttggtttgaggataggtgggataggatgatccctaaaaagaaatattctcctaacatccgggttggattggtccctcaaaatatgaagaaccaatccatcccacttttctgtctcattgacatgtgggtcatccccgaaaactaggatcattttccatccctcatgccaaacgaatagatggaatgatcccgtcctaaaaagaaggatgagtccaacccatgacccatcccacctcatccccaaaccaaacacatcccaagggatggcctatcaatgagaaaaatgggttggattggtctgccctttttaagggacaagggcaacccggatctcaagggaatattctcttttagggatcatcccatcccacctgtcctcaaaccaaacaccctgaaaaatgggttcaacccaacctgacccatcccatcacttcaaccaattatttgcccctaactgtcacatgacatggatggatccaatgaaacatcaagggcaaataagagatcacatgaagttgacaggggcaaataaggtcatcctttacatcatctatttactaatctaattacattagtttgctatacctccaaaaaatgttcatacataactttttttgtagtcatacacatgcaaccaaagtgaagtaccaaaccctcaaaagcaggcagctaaaacatattaagctagtgtacattacaaagaacaaatgattatcatatgaaaaatacaaacagatatcagatatggtaatactgcaaacacaagataaaacaaaatagccatgacagcagtcagaagtaatatgtggtaggtcttaactagtattctggtaagttaatgaaggtattaaaatcaaactatcatatagtaaggaaacaataccagtcaccaccaaggggaacaaaattggcattttcctgagcttctccgctggctatctgttgcttgcgccactcctgaaacaaatggaaggaacataaatgaattggcaacttcaaagatatttcatgtatgtgatgtcaggcgaaagagaagtttacatcaatatccttttgacgctttctttctaatgcgtccaaagcactttctggctcttcatcctcctcatcacgaagctcctccttagcagctttccactattataagaaaatacacaagcagttgtgttagcaaagtgaaattggtggaggaataagtatatgcacatcaatactcacctcattttatgccttaccatgtaaacagattgatctgcctttaaactaagaaatggtgaaatgagaaaaataaatcaggtagcacatagttaatatgttttcagaatctttttcagcataacctctatttgacagaaggaaataaacaagtttaagctgctctagttctttgttggaagaggcagttgaggacttcacaatctccatacacttcatcaggtatatatacataaacaattagcaattacacatgttgtgaacagatatgatgcttggaaacagttataggaggctcatcgtagagagctaccttatccaccagacttgaaaccttcttattagacctcagtgatgttgcaacagaaacagctcgcttcttgctacgaacaactgcaaaacacagcaaaaggttaaacaatgttttccatgtaggaaccataaacaagatagtatattagtttttttatgaggaataacagaattacctttgctctgacttgtggtacttgtagaagcctgtgcagaacttccctgtatggatgctgatgctgatgttgctcccacaggttggctcaaagatgcaagttttgcctccttggatatgatgttgtcagactccctggaatgcaaactactattcgcaggagcaagattggaagagcttgttgtgttatctaatacactgctagaagtggcagagactgatgccgcgtagtatccagaaggctcagctgcttctccagtggcagccatagtgactgaaggatagctatagtaagaaacaggtactggagcaatagatgtggcatcaacaggaatagatatgccacttgcagatactggtgcatagtaaccattctggtgtgcttgaacgacatgaggctcactcgtttgcatataatagctggcatgtgtaccttctgtacctgcagcagcatagtactccattccaggaactgtatagaccaagtttgcttgatcgacataggactgtggaattgtttcagtagaaacagatgacacagcaggttcttcaggaggaggtggaggagctggttcattctcaggtggtggaggtggaatccattcatcttctggtggtggtggaggaatgtcgctatcctctaggggtgcagctgaaccgtccaacaataacaaagccggtgactgaacttgctctgatggaggatattccttaataggcgtggaattcgagtgcttatgctcttcaacattgtcatcgtcaacctccatatccacatccatatcttcatcattgtcggattcaatttttgatgggactgttgtggtatcattttcttctgatttctgaatggatgatgttgaaaatggctcctcatttttaacatttccatccatcataacgtcagtgctcacctcagatttcaaaccctcaccattggagggtggcatcatcacttcagcttcattaggtgttttgtgttctgtgtctgctttctctggatgtctaggttcagtggtagagtaactagtttccaatttggaaactgagaattctagttgcttaaggtgtacctcagcatgcaaccacaatggaagcaaagaagatccatacgatgaaagtgcattgcagtctgatattcgtatctcaatttctctttttagcaattcaacattgtaaatggaaccatgcaacctacaacagaagcatgacaaaagtttagttatacagttcaaggtgtggaaaaatgcttgaaagaggaagtaaatggcagaaaaataataacaagcacctttctagcggcttcaatctttgcagcaattcctcgccatatcttgcaagctgcaaaggatcaatgtccatcgattcatgactagtgacagctccagcataagcataagcatcatgagtaggctgtcccattcccaaagtagcataagccactgagccatttagcacagatatatcacttggataagcttccacggcattgtgggtaagggcatgtgcttgggcctccatagagtagtctacatgagtaggagcagatgcagaagtgacactgtcagctgcaatttcagaagctaatacattaggaatctcccaagaggtttctccagtaactgtgttccaatagtaacactggttgctctgctcatgcattatagtcttccaattcccaccaatgtcaccaacaatttgcatcccagatgagtcaggaatagcttcagttgctgttgcagtcccatcttccagagttggctttatggcaacaacattttcttcagcaatatttccagtgcacttcttatcatcagcttcagttaactcttgttggacattagcagaaccagccagatcactttgtgcatcaccttcattcctagtcaagtccccacgttcatgagtaatctgaaacaagcaaagtagtgttaccatgaggccaggtgtgttcaaactcttcaataataaaatcaattctcaagccaaagagatatagttgacaacattgcttcctatagtggctagtgtacaggaaaacaatattgctaagaataggccaagggcctgtttggcatggcttctcctggattcttgcggaaaatagagtttgcaaactgaacaatgtaatttaatcatccaacggtagactcaaatgtgtgaacaaaatgtctcgccctaacagcatttgggcccagctccaactccaagatttgttggagctagagatatcgaactccaagtctccaacaatactagagagtagctgtaccaaacagggcggcttgttggccaagcaagccccccccccccccaacaacacacacacacaacaaaagctagcttattataagccatttcataggctccagcttatttgttgctttatatagtacaaaactagcataagcttaagttcaagagcccataagataaaccaaagctgtagatcgacccaaagaaatggataaagagaagccaaaatgaaaggtagaattaccttatcacctgcatctgcaggattagcctctgtttcatcattgggttgatctgctgcttcctcttcctcttcatcatcactatattgcccaagcaacgctagaggattctccttcttatctggaaataagaatggatcagtaaaattgcaatagcttgcatgtggcaatctgcattgcactttattctgaagtatatatgaagatacacagtattcgagtataatagaagtcaaacaagtggtatatataggttaaaactatgttacatgcagtatatcagcctggcaataatataacaaccaggttaggagatgaattatagagaaagagacatacgaaccgaggaggcaacaatcacattctgatccgcacgcttagaggctgccaaaagagaaattacccataggcatttactcaattttgacagtagcagcccggtttgaagaatttactcaatgttccttgcaggccggaaccctacatgtgcctcaaccatatatgtggagcatatatatgcttgtacaaaaattccaaatttccaccaaatttaggttccacaggcatgtcttctttacaaatcccttggaaggaaactgatgaaacccacctgaagaagatggtgaagtgggaaccccagtttgttggtcatggttttcccctcgctctccctctttcgaaggtgttccccctgcaaaataccgtagcagcagtcagcttttcatcaaaaatatctatcccaaaatatatcagaatgcctctggaggcatgctaatttaatatctcttacatattaggtcgctatactgttactacttacaagcacgtattgctaccctaattacccctttcatcgttaaaaaactaggaagagtatccaagaactacacctctactatataaacgttgatttaatttgtttatcgaccttccttcccttaaccaaacctaaacttttatttgctctgactgctatatgaggtttctgccccctcccatttcacatgttcaaaatttggttagttcaatataaattcacctctgccttcaccaccgaaccttttcattgcccaagctatcgccgcaacccaaccctatttattcttttttaaggcaaaaacatcagaagcaccatttaagttatatttatgtgtttatgtgcagcttttatacatgattttgtgttatctaggttcagtgcagtttcacttgtccccgtccaacgtatttattgtcgttccttggatgttgacacttatcttctcttctcttcctagtgtttaaacatgatgataatccatatttttgtttcagatttggccagttcagaagatgtgctggatatatttatttccaaatgtggcgaacaattgtgccctttggtattattaaaccttattagtcaacactttggataactgcttagatactgctgactcaaagcctaacaggctgaccatttgtcagttaggcacttcatcctcctttcaaatccatatcgtgtgctacctccagatcatacatactagaaacaaccaaacaacatattccaaacccatccgcacggatcagacagccctcaggttgagttcaggattagcttcgagcagtgggggatggaccgatccacgcaccaaacgataataagtaaccacaagacaaaaaacaatctcgtgctgcccgaatcaatcaagctcgatcgaaaagcgtagcccgcctacaaatctagcactagtcacgaatcaaccgctctcaaccatcagctattccctaaaatcaatcaggcgagcgagagactaatcacgaacgcacgccgcgatcgatcagaaagcgaacgagatcgcccccccccccccccagatttttcgagaggccgtaggacgactcaccgggggagggatcgaggaagaggtcgagcttcaccctgcggccgcccgcggccgccttggccgcaaggcggcgctccttcctcctccccatcgcgcggcgcagcgggcgggcgagcgagttttctctctcctgttttctttttcctcctcccctagggttagggtttcggaggccgtgagatggggaggaggcgaagacgaagaacgaaagggaggggtctcgtgctctctcgtgtttggaaaggagaggaaagcgaagcggggtagggcggcgaggcggtttcaatgtgcgcgaatcgtaaagcatggggtatatatatgggcttcagagtccaaagaactcgcttatcgttgggcctagtagtagggaataagttcacttgacgtccctcgacttcatgtcgagtctgtctaaagtccctaatcgcaataccagaaatttctacccctcaattattacaaactgtgcaaaaaaaaaaaaagtcccaaggcagtattgacccaatttttccaggtttcgctgacatggcatacagtgggcaccacatgtctgtgtcatctcttctcttctctttcttttctttttcttttttcttcttctcttttctatcatctttcctttcgtctcctctattctcttcttcagcgagactgagaggctagcagacgaagcaggcaggggtcggcgcaggcaatgactacgagtgcaaaagaaacatcagtaactttaataatcctcaagtttctaaatgataatcaaattcatagttaagccgttgttgtgttgctcttctctctcgcgcatttcatcgagcatctctctggccaacggcaagatcttggccttccactcccggaagtccgcctcgaagcccaaccgctccattcccatcaccatcaccatgtacatgtacttgtccaccttgcagcctcccatcctcaccgccacctcgtacacactccgccccgcgcgcgtcttcgccctcaccaccagcgtgcgcaccagttgtacatgtcctcctcccccctccacgaccccgttgccttgctccttctcctctaggaacgcctccacaagcgcatccacggcagcggtggtgccgtcctcggtgaccggcgaggaggacacaaacgtggcatagagggtcaggttggggcgttaccaaggctcggcgcgggcaacgtggagcgtggagagggcgaaggaccagtagccctgacattggagctcggccatggcggtgaggaggtctctcttgaggaggagcccgtgagaggttgaggcggcggcgacggccggggagcggttagagtaggtgagtcacttgagggattgcacggcgaggatggcctccatagatagggagcagtcgcgctgaagcgggccacagttgatgcgccccgcccctgtctacttcgcctcccacccgctctcgcgctcgcccaccatcgtcctgcccgccggctcctagtctcgctgaagaagagaagagaggagacgaaaggaaagaggagagaaaagagaagaagaaaagcgaaaaagaagataagagaagggagaacgctgacatgtggggcccaccatatgctacgtcaacaaaaccaggaaaattgggtcaatattgcctcagtgtctttttttgcatggtttgtgatagttgaggggtagagatttctggtattgcggattgaggacctcaaatggtagcaattactattctagcccatttaaaatcccacgcaagcatgtcacatcttcactcactagcaattacgcatcatttacaatattatattatagagatcaataaaattattagaagttaaagctcacatgcaagtataccacatcatcacccactagcaattattattctcgtccatttaaaatcccatgcaagcatgtcacatcttcactcactagcaattacaaatcatttacaatattattgtcaacgtttaatgtcgcggcgattccggtatttgcatagtatggggatcgttggtaccagatatatgcgagacttaggtaaaagagatggggacgaggatttttatacaagttcgggcccctgaattgttaggtaatagccctacatcctgttggccgaagccggtcattgctcttattcaccataatcacaccagtacaatatttggggtagcttatctaaccgtcatcgacttggcggccggatcaccaacactagtcgacgacggggtagtcttcctcctcgaatcagcattcagcgaggtcagagatagcgctagattcctctctttggttcctgtaggtaccatatggggttttcctaggcttatctctgatgtcgatatctggcagcttgtcttggcgtatgttggcttgtatgttgatcttgtgtcttgatctattgttccgtgtcccctctcctcctagggggccttgtatttatacacataggtgtccacttgtccaagtagaactaggaaaaccaatatagatacgatccgagtagtacttgtcgtttccatgtagaactctattcatccttccttatgcggaactcctcctatatccgaaagttgtttccgtataagacatggtatgtggtgggtcctaccgagatttagtcaactactattaggtatgtggtatccataaccctgacaattatattatagagatcgacaagtatgtgtcaaatcatcttcctcacattattttctcaatatttcaactttcactatttcgataatatttaacctatacttattcatgaattccgcagcaaagcacggggtatcacctagttctatatgtgaacacaacaaaacattagagacaattagctattttatttattgctgactaaaaacaatagttcagccacctaggagaataggagaacaaccaccaaagcacaacggttgcgtaccaaacaagttatgaagctcacatctatactatctatatagttgatgcccactaacttctaaaacataatatgtaagtgtgacacatcattactcactagcaacacttagagtattttaaatatcatgcaaacatgacatattgtttacaattttgttatatttttagaactcaatatgcaaacaatgttaaacgattaactccacatcattttttattatttaaacatgaacatttaccatttttataatgtataacatgtatttaccacatatcccgcaacaaagcgtggggtatcacctattcctctaatgatgggattcttcttagagcatgaacaatgcaccgacacggtgagtggttttagctcgccaaaaacggagcgactgctccacgttgtcctctggcgtgcactctggagctacacgtgtcctcgacaaaggattttagtcattctcagtttgttgatttcacaaattaattaaatgtcatgttggagggctgagaatatagcattttatccctagccccaattcccgcataaattaaacttttttaatgttcactccataatgttagagcaagtttaaggccattcccaacgcaataactaggatggtgtttatagcattaaataagatgccaactaggatgaaaaatgatgtggcaagtgaataaataaggaaagagaaggaaatcatgtcttgcatgagacatagtttctacacgacatccaagatatcatgtgagataagtagcattaaaattaagtatggaatagtggtatttgcattggaagagtagtttcttgatgatgtggagtttatggaaactatatctagtatcttgggttgggaatggcctaatagtataaccaactactagctgcaaaataactatagccaacttaatagccaattcatacaaaaattacctataaacatacacttacatggtcccacccatcatacacgtattctgtcttggagtccgtgttgcagctgcctacaaatctgtaacctgctgctcttctctctcctcttttatcttctcggtatgtggttatagttggcttatattctgctattgtacctgctcttacaacgactaccggttgtgctatttccccttcttttctaactcaccactctttttccgcatgcacccttttttaaaattgttaaatggtgttttttttaaaaagttttctacatgaaagttgctttaaaaaataatattaacctattttttaaaacaaatattcaatacttaattagtcattttttcagttcaatgtgcgtgggagatgagttcccaactcattgagaataacacagcctccggaattaataagttttggcacgtggtactgttgcacgctgcagttttagcaaggaatcaaatctttcaccaaatcatgttgttgaacaaccatggtgaatggtccaatcactttctagtgttgtactaccattttagtcacgtgttgcgtgtgataaaatggaatgcataaatgtttttcaactaaaaggactattcaagctagtccgtcaattttagtttacgacttttcctagcacccttgtaaatagccacccttttatgcagggacatattcttagggaatttgtttcgccttaagctttcattgtctgcttagggtgtgtttagttctttgggtgtaaagtttttaaaatatacggacacacatttgaaatattaaacgtatagtaataacaaaaacaaattacagattctgcctgtaaactgcgagacaaatttattaagcctaattaaacagtcattagcaaatgtttactgtatcatcacattatcaaatcatgacgtaattaggcttaaaagattcgtctcgcaatttacatgcaaactgtgcaattaattttttttcccacatttaatgctcaatgcatatgttcaaacatttgatgtgacgttttttgccaaaaatttttgggatctaaacaaggccttagttacctattagctataagcaaaacttgaattctagttacctattagctataagcaaaacttgaattcgaatcttagttttgtagttgattttagggttttttatagtttattttttacatggggttttaaatcgtaaaacgtatagatagatataacctttttatccatacataatatggttgatttttttcaaggcttctcaatcttaactctacggataagtcataatttgccgcatacggcaacacattgaggcggacttctacctaattaaaaaccatcgctctcaagatggtaaaattcgagacaatttctcccaaagcgggaagatgcttggacctaaaccaaaccctctccataaattcgtcaaacagatagacaagcaagatcccggcggggcccaccaggttaggaagcgggagccaatcagagaagaatggtctaccgaggttggtgggcccaccagtcatacacagcagcagcagatgaaagtgatgcttggccctgtttagttcccaaatttttttttctcaaaaacataaatgaatctttaaatatatacatggagcattaaatataaataaaaataaaaacaaattacacagttatggaagaaatcgcgagacgaatcttttgagcctaattagtccatgattagccataagtgctacagtaacccacatgtgctaatgacggctaaattaggctcaaaagattcatctcgcggttttcagacgagttatgaaattattttttttattcgtgccaaaaaccttttctgacatctggtcaaacatccgatgtgacacctaaaaatttttatttcgcgaaataaacagagcccgtgtgtcgcgcgtttgagggcatgtacaacggtgtttattagtggtctctctattgccatgcaagtaaatttgatgacatggaagaaagagaaagaactatggttgttatgcatgacaacagctcagagtcgactcttagcatttattagagcaaattttgttgcatggttgtgaaacaaaggaaagaaaagtaagaaaaagtattttgatacattaatgattagagaccatattgtctctaactattataagatgctaatctttagataacgtagagcttatatctgactctacctttgtatatgccctgatgatgatctccaactggatccggggttccagaagggacaccgtaccaaacaaatccagcaagagcccttttctcacttgaaaacttgaaatgacggctttcccgttttcgatttatcaaaaccgattcataaattatttgttaagatataggagtataataaactcctaatgaggtgtttttttagcttaatttttttgttaaatgccaatagacgttcgattttgaacagattttttatttggcgacatgttattgctcgtcctctgtgtgtttcgtcaaaaggggttgacacacaaggaacatccggtgcacaatattttcccatttgagatcatgacctaaatgattttcaaagttaacgtaatcaaagattaaactagcttttaaaaaacattacttaaaataaaagaacaaagtaccagacacctttttgatgtccacatctacaatgatggccattttaactctctggaaagagactttcatgtgttcatcccgtaatctctccgtcaaaaaaaaacaaaccctgcgtttccgtgtctaattttaactatctgtcttatatgaaactttttataatttatattttcattgttgttagatgataagacataattaatattttatgcgtgacttgtctttttaatttttttcataatttttttaaataagacggacggtcaaatattggacacggaaattaaggtttgtctttttttttttgacggagggaggacagctcatgacacgatcggatcgacggatgctacagctacatacttcttatctactcaagcgggtagcagtgcaatatttgatgcctcagttttcccattgctccaatggataaatatgtgtggtgcctaaattgcgcatcaaattctccttttagtccctgcaattcggtgagctcgatttttttaatccatttttctttatattaattgtccttttgttttttcttttgaaaacaaaccttttcccaattgacaaggaaatgttgtaccctcacaaaagttttatttataaggtattncagatngatgacattatctttgattaaaagtannnnnntntnagagcctacttttgttatattacaaaagtatatanaataaanccattgtcattgctcggacgtaccgtgcaaacaaatttatactttttgaattgtaaattttcttttcgctacccatatacaaatttgaatttaaacccccggngcgaaggggatgaaagtctcnttttccgtaactcaaataaattcttttctaaaatttataataaatcatactctaatgatccgtaccattttcctggtcacgaatagctctagcccaactacacattcgaactgggcctttaagtcgagtcataatagtttggtttatttcagttttgatattttttatatcttaacaaacttatacatatcaaataattagttttgagcccttagactaagaatcagcacgacacaaatttacaggtatttcggtggtgtttaaatctcctaaagatgaagataaagattaagtgtttcatgtaaaataaggtggtaataatgtgtgattaattgagttttaattattacacacttgaaaaatagattaatatgatattttagaacaactttcatataagttttcgtacgaaacacgccgtttagccgtttgaaaagcgtgccacgagtatctaaaagtttatctaaaacttttaatagagaaaagaacatggcattcatgtaccaaagatggagttatttttccacagagagggtaacaaacaaacattctccatcaaaccaacgctctactcaaacttcggcaatatccatatacaaaggctgcttttagttcatgccaaaattgaaaatttgattgaaattgaaatgatgtgaccgaaaagttggaagtttatgtgagtaggaaaatttgatgtgatggaaaaagtcggaagaaaaaattggatctgaacacggtgaaagtcttctcttttctgccatgaaagtttgtacgcaccataattttttttgataggatcgcaatacaaaccaacccatcttaacgttatgcttattttcactatattattttctaaaaaaggaattatatagttaatctattactttaaaccatcaaaatcagataatctataatccgcttaaagcaattagatgggcttacatattttatctttttatcgtcttggtctttggtttctaaaattcacacaaatactacttctttatataataagttcatcttttcctttttgattgtctcaaaataaatttatttttaatcaacatttgtatcagagtatataaaagtacaaaataaaataagaaacaattatttaaaacgaacggattacttcactgcactcaagcttcaactaagcctcatcagcaaatggcatatttataaacgaaaaataatttgtaaataaaattttatatatatatgtttttagctatttaaaagtaaagactaaaaataaactttgataaaaagtaccttaaaatcaactttaaatataaagttaaaaatatttgtattttggttgataaaaagtataatcgaaaagatgacgtgtggacgtggcaggctgagggcggaaggaaatatgccgttggcggggccagctagtgcggcggtggccacgccaaccggaaacgggcgatccacaaccaccacctaaaattaccaaaataggcagagcgcggatgatgtcgctgtctgtcggttccctctgggccccacccgtcagcgactccacggcacgcgcggacaaaagtcagattgggccagtcgcggggcacctccaacttttcgcgcagcagtgccgccagcagcagtagcagcagcaaacccacgtctacccagcctcactctacccaacacccacagacacgtgggacccacgcgtat

SEQ ID NO: 7715 - DNA, 19426 bp, Oryza sativa
ctactactactctctctctcctccggctataggctgcgtgttccctctctctctcctcttatccttctcttctccgtttgcttcgctgctgctgctgctgttctacgcgcgcgacacggaagagagaaaagtggttttttattgggttcctaagccctttttgtttccagaggcttctggattgatcggttgatctctctcccttcccctctagggtttcctgggggtggatctgaggagcggcggcgctccttcgtcccggtgcgtgatctctctctctctcaatctccgttgaggcgttggtttccccgcttggattctgcgaggttggtagtgtttgcgtccgcgggggtttgcgctctggtttggatttggaccgagttcgagtacttcggagccctttcctctgttgggattcgttggctttggggtgttctgcatgcatcggtccttttacggaggatttggggggttttgttctgtttctggctggcttcgattttttactggctgagtgattgctgcttcgtgtgtactacggcgttgttcgtgtggttggatttgatatgggttaattttggtttggatttcgtccggggtcatgtaagtgagatttcgggttaagtttgtgacgacagctctgaagtttcttacaagatgttttttttaacagtaatcgacttttctacgattggctatttttttcccctttgtttcaatcagaaaataaatcttttcccctttaacaaatgggcgaagcatgtttttgaattgaatttgtgggactgtttttttattcgatgaactaaaaaaagttatggatcttaggattgtttttcttttttttattcttcgtatgttgtcactaaataaaaaaatttcagcttttttctattgtgaaatatattgtcaatatgttcttgctttttttttcgtactatggtctaagaaactggagttaaaatgaaagagaactcggtctttgactaattctacaattttttaatgggacatcttttctacatcttaaattccatcgttttcataaaattttctttcgtgcagctttttttttcttgcttgccatagctattaaaatctttagttccttttttttaatctttatccagacatagcttgcctagatgcaaaagttgtgtgttttgctatgcccgcctaaaataacatttattttgccatgtcatcaaacatttttctttctgccaatcctgcatgtccatgaaaacatttcttaataggcttccttaccctactttttactggagtactagtactcaagactgcaattttttcttcaccttttcgtttacctttataaggctttttttctcccctgatgctatgattttatcctgcaaattgacccttcttttggttttataaaaaagactaggatagctccgtctttctttgcttatatcgttatttcagcctcttctgttagatatatttcccccctatttcgagtgttcaactaatgcggcttgtcgttcgttgcttggagaaattgtgataaaatatactattttcataatgaaaccgataattgtcgttgactcgtaatgtagttattttggttcttgtgataattttctacatctctctttttcccttgcaaacttagtacctatgggaatgggaatatatgctagaagcaatgagtgaggtgctggaattatataatatgtgccaagagcaggagattccaaagactagttgctgatacttttgtagtgggatttcgattttttatgcttcggttggcaaatgggggcggagtccacagattaatgagtccgttgaaacctaaagtagatggcggtaatatgtcctaattaggaaatatatctacattatcctttagattatattattgatagctgatgcaagacgacgctgagtggaacatacttgttgctacctgttttgaacatttctcttggtttgaatgaaaactgaaaaggatggctacctagggtcctaggtcatagcaactgaaacagtaaaaaatataaaatctatgttctcatgtaggtggatgcccataaatgtatgaatattcatttatgaatactctacggttttccaatagtatgtgggaatatttttttatgtgctggtactaatgttttctaataactgtttgttgatactgtacaggtttatgtaaatctgatcgatccagaaagtttgtgaaaaaagagtgtggcacatacctaaagctggcttaaagtttgcccatagctaatatcatgggcgctctttgtgatttctgcggggagcagaggtctatggtttattgccgatcagatgcagcatccttgtgcttatcgtgtgaccgtaatgtgcattcagctaatgctctttctcggcgcccatacaaggacacttctgtgtgatagatgtgcttcacagcctgccatggtccgctgccttgtagaaaatgcctcgctttgccaaaattgtgattggaatgggcatagtgctgggtcttcagctgctggtcataagaggcagaccataaactgctactcagggtgcccatcatcttcagaactttcaaaaatctggacatttgtttcggatattcctaatgtagctcctgagccgaattgcgagcaagggataagcatatcgagcatcagcgccagtggtgtcagtaatcacgacaatgctgcaggggacaccagtttgttagatattgctagtgcaacccttatgagtgatcttggctctgctgtcaaaccaaagtctttgataggctcctcatctaaagctggcgtgaaccttcttccacttggtactgatcagatggctggatccgtggattcgacatcagtgaaggtgctataaggctttcacacattcctccatacatagatttactaattcgcctcaattaacctctgccgctgcatatactacccatatcccatggatgtaagataatcgactgttttcctccctacagttggccattatcatttgtttactctaccatatatgccatgattttctttttctgtgtgtactctattttgaatgcatattgtaagtgagttcacttaaatttctatacaagaaaaagaaataatctaactgttaatgatgcataagcataagcttgtcaatgattactttaccatatgtcatggattttttctgtgtactccgttttgaatggatattgcaagtgagttcagttaaatgtctataccaaaaaaaactgttaattgtgcataagcataagcttatcggggtagtggatggtgcatggaggttcaataggctagcagaagttgctgaaactgtatacatgcatgtgcaatgagatatgaacattatgatgtgtatggactacaatctggatccactcagcagatatgaatagatgaaacagggtaataacagaatatggagtatagaaaatgtctatattacagaaatagttataggactatcgagaggtttagacaggtggataactatggtgcttatgttcttatgtcaagtcttgtcttccaagtgttctgtgacctcatgcagatctacaaatgcatattctcacaacattaaaatttggtacaagtaatcttttaaaattattccttcacaatttctttggaaaatgttaagaacactgctttgtattatttggatgatgtagcatttcacattttagtctatctcgtattctaatttatcttactggaccatagattcccatgacaggttatttgtgtggagaactttaaagattctatacagagagaatttactttcgtctttcttcaaatcactttctctgtacagcatttgcaaattttcaggccgttttacttcaatcttccactacaccatgtttcttttttagagagcataagacacacacacacacacacacaaacacattcttccacatacattcacaccgtgtgtgcgtgtaagcaccctatgcacacacaaggcttcacccaggacatgctttctctcttaatccacacgtgtgcatgctccatgcttcttcaaaattagtttgtcactaatctgtgtttatggtctccttatgcaggtgccctatacggcagaccaagatatgttcagcaaagacagtatatatgaagatttctgtgtggacgatgttgatcttagtttcgaaaattatgaggaactatttggcacctcccatattcaaacagagcaactgtttgatgatgctgggatcgacagttactttgaatcgaaggaaataccttctggaaactctgatgaggtttgtagtttactcttaatggttcctttttaagaagtaagcttcaattccacagtaacattcatttgtaggttttctcgcaactcctgatcttctttgtttcaccaattcaacttgccctgcacatctttattgcttgcaggcttttctcttggttcgatttctcagatatatgttatttatttgacctggtttgagtcaaatttatctttcattaaagataaattattaggtgttaaatctctgtacaagaggagtcagcatttggattaataattaaattactctcgtctctcccaagtttatcatttcagtccatggtctcatccttctcttagatccctcccctttagttgttccttccctgctctccttggaactgatatattcgcagctcccatgttcaagaagcaaaagatggaagttcttaattagtgtttctggtctttgtgtttatgaaacaaacaaaactatgactgaaaatggtaatcagtatacattctcaaatgcagcagttcatttgtaatccatttgtttggaaattcatgttgtatttagttttgtctggggcttattggagttaactttcagcatttatattcattattatcttttcagcagcccaagctgatgcagccagtgaccagcaatgcagtatctgctgattcagggatgtcgatcccaggagccaaaggtgattccagtctttgtatacctgtgaggcaagctaggtccagtatctctctttcattttctggtttgactggtgagagcagtgctggagattaccaagattgtggggtatcaccagtgctccttatgggtgagcctccttggcatcctcctggccctgaggggtcatttgctggagctaccagagacgatgctatcacacgatacaaggagaagaagaagagaagaaagtaagtgcatttcttactaatttcgctactcatttgcttaaacatttatgctgtataaccacgtaagaattctataataaatttgtggctgcaaaagaactcaaagagaaattgtagcttgtaaacttttcggcacaacctctactttacacatttggtaaagagtgcttgtatcgttgagtttcatgaaagaagacacatggaagtagttttcatggaagttaaattttgagtttttggaaacatcagtttttgttaccctagttttacagtaggtagaagtaaaattaccttaactctgtatctttttacttacaccaaaaatgtttttggtaggtaactgcatcacataaaaacatgctgaagattttctgcttgaagataacttattgctaccttttcattcagagagctaataacttcttgtttcttgccttctcttctaatatgtcagtccactgatgctaacatgctatatttctagcataccaattgcctcctttttgacagctagctgattatcttttctcatggcttctcttgacagatttgacaagaaaatcaggtatgcatctcgcaaggctagggcagatgtgagaaaaagagtcaagggccggtttgttaaggctggtgaagcatacgactacgatccactctgtgaaacgaggagctactgaacacaataaaacattatccaagtgttaggttagcaagcatcaaccaatgcttgttgtggctggcaggaaggcactcatactacaaacaatgtggcaggcctgcctctaaaaacaacaaaaaaaacagagcaatcaaggggacaaaaaggacaaaaagatttgaatttgggaaatttttcagatgctaccccctcctttttcttctgtacagtggagggaatttgcatctttctgttgctttcgggaggagcgatttgagtcgctgcccaccttttgtgaattaatcttgatacagctgaacaaacttcacttgcatttttatctcctttctactaaccagagcatccacctacccttgctgtggtgtttttggtggtatgcttccagattggactattagcaagacaaggatggatgtagtcgtgaaatcttctgctgctctatttattgttatgtaaaatctgctgtaatccggagtttattctgcaactctgcatgtgtaaataccagatcagaataaactggtagatgtaaagttttctttattttctcaagtcgatgacattggaacccatgtaaccggccaccaacttttttgtttcactatgctcaaatattcgaaaacttcagactggcttaatgctattatttgtactaagcatatgcttgaatatgcggtcctttttgttacaagtaatattctttttgtggttgatttgaccttttacattgtacagatggtattggttcttttccatctctgaaagcagaatcttgttggggccagacaatcctggacatctgatttgctgtaaagctctctgaaaagctctggctggatcctttgctagatgccatcagatgtgtcagcttggtgccgcatatcacttggagaaagagcatctacaacagcatggctatttttgcctttctattcatccatttggccaacttgccaaaaagattcctctccatatctcctacacgatccaacagactgtccattccacactctccatttttacttgggccccacctgccaatgtcttggcactcttctccctttcatttcttttctttccccacctccccgtggcatggcagcaatagatgggcagcggcgtcggattgctaggggtgggggcggatggcggcagcggatggccgacggtggctgtgtggcggcgcggggaggcttaaaagagcggcggcgcggggaggctgaaaggggcggcagtggatggcggttgggcggcggtgccgggaggctgaagggcggcgcccgcgttaggaggcggggaggagccacgccggaatcctcttctcgaggaggtgcgatgccggcgtctcattgtcattgatcttgagcgcgggcgagccatcgacggcgagctcgggcggaggatgcgagcgagcgacaacacttctccttcccatggcagcggcaggcacgagcggagggagaaagggcgcagcggtgataggcggagggacttgggctcgtcaccgccatccaccgcagctcgggctccgtccccatccgccgccatcatccgctaccgccgccgccactcgggttcgtcgccgccatccgggctcgtcgccgccactcgggcttgtcgccgccatcctctgtcgcttgggctccgtccccattcgtcgcagctgttgccggcggtagctgcagccggctcgagcagagcaggtagtacggggcgagagaaaagcatctccaacgtggggcccacgaatggcaaggcaatttgggctggccaaaattggccattgagggaggagttttgccagtcatttggcttagcccttctagtagagaggctgttggagtgagatttttttttgctaaaatggctaaattttaacttggaaagtctattagagagtctgttggagatgctctgaaatttgggggataagagagagatcgaggtagaaacaggttctaaacacccttgaaatttcaaggaaaaggaatcaaatcatatttgaataagttgatggtcttattgtggctatctagatttgatttgttgtattaatattctattatatgataggttggtctattttggaacgaaggaagcacactttttacgttggcagagaagttgtggatgccaacgtaagttcatttaaattgaagtcgggggctactgtcagagttatggataaggcatatcttatatcctacgatttaccgaatatatcggattagcatacctcatatcctacgatatgtttccgtatgcgataaggaaacacacaagatattatggaaaatatcctcacgggctgaagattatcagagtcctactcggagaggatatggattattctatatcatgcggggttcgttgtctccgagttctacttggagactaaggtaacttatgatatgaagggcacaccccctgaggtgctcagatcattgaatcataacgccaacacaccaactaaagtttacgaagccgaaggactcaagccgaagccattgggagatctcgtcgatcaatcttgacaaggatctcatcggtatcatcggattcatctgttctcattgtactttgtgattttccatatcaatcttatataaactggattagagctattatctcacgaggggtctgaaccagtataactcttgtcttctgtttgctttgatatcgtatcgtgtaaattctcgtaccaacgtaccccaataccttatttatctggtctacgtgtatccccgtcaacaccggtgacgacctaaagctcatcactatcatcggcgtcgtcttcttcaagctcgtcacctcactgacagcattcatacacacataccactgccggtgtccccagacttctgatgagtatttgtaaatgacgtcgtcgtgcatctgccaatgatgatctcaagtttggtgccaccgcaacaagcttcatccatacacccgccgacgtgttttggtggctaccgtcgccaatggcatgtttgtctccactacaatcacaatctttacctccaccgatgtggcctttaagattgctatctttacatcaacatcatcacatctacatcatacattggagaacataaagcgaagaccaacgatgacgaccatcgtaccttaatcggaggtgtctcgtgagtttaactcgcaagagtatttaaccgggtgtcttccgagaccccgggaaccaggagagcacaatcgccaagttagatccaccatgtcgatgggctgtggtgcgtatttgttcaagtattttgtatttttgtaattcttaagaattataataaagtgcactttccatcgtctattttattttttgtacttagtacactggcacgcccgcacattttattttattttatttccctgggcagagagacgaaaaattaattttctctccaaacacacgtggtttctctctcctcttcaatcgaaaatatcattttaatgggtgcgatgtcccgtggcaaatattcaatttctgagagtgtcttccccaaagtggcttcgcgtggtatcctatagctaaaattacaaagtcacgacgttgtgtaggctgtagcaaaaattgccaattttcttctgtagtattggagaatattaaggtggtgattagatccggagactaaactttagcacatatcacatcggatatttgagtaattatacaaataagagctaattcacgtgacaattttttttaagcctaggcgcgcagaaaggccgagcgctcgcgcgtggcacgtcagaacactgtttgtagtacgcgaggtgtaaatgttttgaaaaagtccttatattgtttgcaattagatatagacccctcacgaacaaatagtactccctctattacatgatataagtagacccctcacgaacaaatagtactccctctattacatgatataagtagacccctcacgaacaaatagtactccctctattccataatataaggacattcccaacccaatgactagaatggtgtccataacattaaataagttgccacctatgaaaaaaaataatgtgacaagtgaataaatgaggaaagaaaaggaaaccatgtcttgcatgagacatggtttctacacaacatccaagacatcatgtgagataagtagcattaaattaaagtatggaatagtggtgtttacattggaagagtagtgtcttgtactagtttcttgatgatgtggagtttatggaaaccatgtctagtgttatgggttgggactgccttaaggcacaactactatttttagatgttccataatataaagcatacatgcatgcatacaattaattaggacatattctccattaaattattactttttaaaatcctccacccttaagatctctaattctattggatgcatgcattatatttattagggtgatccaaactagaagatgataataattgtttcttggtctttgggttaagggtagttgtgacttagggtgtgtttggatgggaggatttgggtggataggagatggcggcccatttttgtggctgtttggttgatgggcggaagtgggatacgacggccccaagaggaatattcctgttagatgctggatggggggggggtccggacgatttgcccggatgcagccgcccgggcgcccgggcgagcagggcgacgggtcgcttcaccccctcaccgagcgttagcagcggccacgcgagtgaatcgacggttgacgcaaaggagaggtcggcgaggtccgcggcggcggcgtgaaatgcgaacgccgcggggtgggaagggaggtcggcggcggcgtgaggtgaacgcggcactggcggcgggaggcgaggtcggcggcggcgcgagatgtgaacgcggcggcggcgcaagatgcgagagccgcggcgccgggaggcgacggtgagatgcgagctcggcggcggcaggatgcgagggcttatttttttcctttttgtcctttttcttttttatttttttctctatgtggatttgtagtgtgtgtatatatatgtatatatatatatatatatatatatgaatttgtgatttgttagggaatttgttatttgtagtatatatgaatttgttgggggtatactcaccctctctaagtgagaggtgaccacacctgctcatccaccctacttcttccaaccaaacaaaaaattagatcaccaaaaccaccttcattcctccaaccaaacaagaaattaaatcgtcatatccatccaaccaaacaaaaaactggatcgccatatccaacaaaatatggaccaccatatcccattcacgcttgaccatgaacaaacacacccttatattttggaatggatggagtatttaaaaagaaaaatcgcgaacagggagtgtgttgtaaaatgtggaagaggagggtttttttttcgcagaataacatccactaaaccccctaaaccctccgcctccccctcgcgccgtccccgtcgcctccgccaccgcctccgccgccgccgctgccgtgtaccgccgccgttcaaattattcccctcttccgctccactctcccgactctctctctctctctctctctctctctctccacacagagcacgcatccgccacccccacacgggagcggagagctcgccgccggcgatcgccgcaggaatccgagggtttcttcctgcgtccgcggtagatggttctgctcgaacgatcgccgttggtggtgccggaggcagccgccgctgccgcctccagcccgctccggaggccgtcgcctagggttcggagggaggtgccaccccctcccctcgatcccatcctcccctaccttcaggtaattgccaaatcagtatccatatctgcacctgctccttcgatttaggtcctatttaggggtgtaccagcgtgggattccgccgtagctgtgtggaatagtgcttggtttcgcctgaagctatgcgcgcgtcggaatcgtactgggattctgtcccttcctctgagttatgtagttaattgggcgtgtaattttgattttgacacttcgcctgtgtgcagttgaacttggacgaacggaaatgtgagaatgggggcgtatgttccccaaaaaaaaaaaaagaaaagaaaaagaattaaacgatatgaccaccactgtttgagtgtctggcaacgatagaagtgcatattgaggagacattgtgagtaatgtccagtgctgggacttggggaaggatttagttctggagctgatttgttttgtgcagctaggctgatttttcttgtgaaggattaccttgtttatgtggagacgtttctcttattcccttatcagttcttgaactgtcgagtaatgtaatgtgcccactttatttgctcctcctgtactaatgttttgctttccgatattttggtctaaactttgcatatataacttatttttatgttgttcctggtactatcatatctattttgtaaggtaaatctaatctttcatgcacatgctggtattcatgcataatttatctatgtatcagtgtgatttgtttgtcctggtcagggccagtcctggtgtatgcatttgcttatgccagtttctgacttggtattcaggtctatcaacaaggctatggatgagctcaggagaggcccaaaatttgaagcagcagcccttgattggctcaagatttgtgtaatggaatgcattgataagtatggtgacgattaccagtactccacagacccccgactcctcaagatctggatcctctatgtaattgattggctttgaagtttcaattcttaccttatccatttttctatccccttttgctcatcccccccccacttcgttctatgttaggcggatgcattatgtttttgttgaagtgaactttttgggcagcaataacctgatgtcaaatttgccatgttgatgtgatcgcaaaccatttctgtggtaccagaaaagccgagccacttgatcatttgaagaagacacatacaatatttttaaaacacttggagaagattgtagaagaagctgatgccgatgcccaggtatgataactgtgtggtggaatggacatttgtcgagtccttgaatatttgtcaaatgattcacatattgcgtattcaattgcattttagtaatcaggagattgtggctgtgttgtagatttgtaatattttatatatggtcagttggtcacaaggctgacagacttgcggcagtaagaactgctttgatattgtttcttacatgataatttttctgttgtggagcatttgcttttccaaaaaaggttggcaagcaataggataattgtcttcacatttctgtgctggtgaactgtgatacattcttttaccaagtctaatttacataatttattcatttatttgcatgcttgcctgttgtgaactgaatatttatttggggctaatcacaatgatatctactttgtacttgccgatctttactagctcgtacatctgtaacatctatttcaactaaatacaggatggtttatttttcatggaaagagtttctgttctgtcattcctacaactctatttttacaaaaatagcatgattctagttttttagagtggctttttgttatatgtttagagatatattttatttagtttaatcatagttgggaatgaatttcaggatgtactttccactgattcttgtggtgcatgtgttccattttgagtttgtctcggaaatatattagaattgggagtgcatctgcacagctttagcatagtggtgaagtcagaacataaatatagggggctatcagcataacagtaccataccaaacaatcttcttatatggtttaattcataaataaatagagaaaaatcaagcaaattgcaaaagcaaagaataaaatgaaatatcgggctgaagccacatgatgtgccattgaaagctacgcccctgcccttgcttgagtggactgatcattactagataaagaaacatgagacatgcaatttctatatgtttttgaagaacaatatctatataaccccgttaagcttgtgaagtaagtaatctatgcaaatacttttttttttgtttctattacttgtcattactggccattattgtagccagcaagcatattatggtcgcttaatgttattcttctttgtggataattcaccatactaactcccatctctttttggttactgtctgctagccgaaaccatccaaaatgcaaaagaaagaacctattttgctggatccatggtctgagtctactatgaataatttattggagaacattaatgttgacctgaagaagttcgctgtaagttgcatttactctatatgattcgctagtgtttagcttagctctcatcttggacggttgcccaaatccttgacagggctatcatcagagcaacaaggtctatcatggaaaggtgccattaacttcgcctcagaatgttttaagaaacaaagtcactgaattaggtataaactataatttcttgcttgtcggtcttttaccaaaactataatcatttttgttgtttggctccttcatgatcaatgctctgttagtcacaatgaatacataatgctccttgaaaaaaaatagaggaaggaatatacccttttttatttataaaaaaggccatttatattgatgatataataaaatttagttacaaatccctctgaattttttacattttggtcctttttaaaaacttattttacaaatagatccctggaaaaacttaatccaggaacggccctttttggtgcgccagagaggctggtgctgtcctccaacatggcaacgccagccaccctggcgccctcaccgtgctgccgtggcactagggctattgtggtagtgttgactgggcggatgggagtgctagccactctggcgccggccctcagaccacagcgccagcggtattggcgcacccctcctgggggccgcttaaccctcgcgggccccacctcctttctccttcagttagccatttgtgccagcacttctagccgagccgagcccgagttcttctccctctctctctccccctcacctttccacctcagatccacttaatttgaactcttttttcgtgggattttttgtggaaatcgaagagaaaggtagactcctccattccccccctttttttcgttttaatcggttgaatttgtagatcggagggtaaccctagaaccactttttttcccccaaatttgagattttttacatttgttgttgggatttgcttgttgtagtgctacatgtgtagatgaattgaacgaggagtttgctgcatgcaagaaggaagctggaaacacttatacttacatctggaatgaatgaatagtcaatcttgtcaagttgaacatctgggatgccctttttcccatacactgtgtgtgcccaaggttttacctaaaaaggggcaaggaagggaaatgtatagttagatgttagtgggtagtgtagttggtatagcagtactcaagtatgcctgtactagatagttgacatttgcttctataaagtagtagagcagctgcagctcaaattagttcagcagcaccaagtgtttgtgctctctgttctctcatcttcttccgcctctgatgtgtgagctgtgtgcgtgagtgtgagtttgagggactgtatttttctattagacatattgctagacatgataattctagggcaaatgatttagcacagcaagcatctggctacaatgtgaagaggggaatatttttgatattagaagagccgatgcttgattttaaatctttgagcgaaattggcaaaatcgcagaccaggggcggtctgaccggcgttgcacggccgatctgaccggcgttgcacggccggtctgaccggccactaggggcggtctgaccggccactaggggcggtctgaccggccaccccgggcggtctgaccggccttgcatggccggtctgaccgattatggatagaaggctggggggcacgccacaattgattcaaaggccgaattaattgtaaattcggacatttgtgcccaggaaacagaagaagattggagaattcctttgattagatatttgaaagttcctacacttaaggttgatcggaagattcggcggcaagcgttcaaatatacattgtttgatgaagatttatatcgccgtaatatggatggagttctattgaagtgcttagataatgatcaatcaaaagtggctatgggagaggtgcatcaaggaatttgtggaactcatcaatcggcccataagatgaattggttgcttaggagagcgggttctattggtagaggatgattgaagattgtttcaaatattataggggatgcgaagcttgtcaacggttcggcaatgttcaattggcgcccactgccgcgttgaaccctattatcaaaccatggccgttccaaggttgggctttggatttcattggtcaaatttatccttcgtcatcaaaggggcataggttcgtgctagttgcaacggattacttcaccaagtgggtcaaagccgtgccactcaagaatatgactcatacggaggtaattgactttattttgaagcatattatctatagattcggtattccgcaaacattaactacggatcaaggagcttctttcatgtctaaggaagtgaagagttttgccgaatcttatgatatcaaattgttgagttcttctccttactacgctcaggctaatgaacaagccgagtcgagtaataagacgttgttgaagctagtcaaaaagaagattgaggaacacccaaagaagtggcatgaggtgctttctgaagcattgtgggtgcataggatatctaaatatggtgccactaaagtcactcattttgagttggtttatggtcaagaagccgttttgccggttgaggtgaatcttggctctcttcggtatatcaagtaagatgatttgtcaagtgaagattataagacgttgatgggagacaatcttgatgaagtcatcgacaagcgtttgaagactttggaagagatagagaaagagaagaagagggtggccaaggcgtacaataaaagggtgaaagtaaagttgtttcaagttggagatttggtttggaagacaattttgcctttgggtactcgatccagggagttcggtaagtggtctcctagttgggagggttcttatcgagtatgcggcattgttcgagggaacgcatattttttggagacacttcaaggagagcgttttcagcgagcaatcaacgggaaatacttgaagaaatacttcccgagcatttggcaagatgcttaggaggtactatggccggtaattggattatcgccctaagaccaaaaacatgttctatgcttttagattcacgttgttcatcaaaaaggcaggggggcatgtgtttacacccaaatttggcacctagggataaaatagggaaaattgtcaaagtttggaagactgccggttttcctctgtgagggctctattagggccggtcagaccgccgtgtataggccagttgccgccgacagtgggccggtctgaccggcagagtccgagtccgggattgtttcgtcgggtcttgaagtttccttactcgggaaggcatgtttcgggtttcctttggattctatcccgagttggacgtggaggagggcctgtaaagggtaagaccaacccctatataaggacatggccggttcattgtaaaaaatcaatctacaatcaatcaatcgaatcgtttttcttattgcttttagttttcttttagtttgtccatctttgtcgatttgcgctgtaaatcgtccgccgccgctgcgagagtgcgactactctttgtaggtttgtcctgaaaaccttccgttttgcccacgaaacgggtaggtatctagaatcggctccgctagccggtttagttatcaaaacccatcttggtttagcttttgctagattgaggtggttggcgactttaggtgctgcgatcgtgcttgtcaacttatcacaaaaagttgccaacacatgtaacaggagctgtttgctgccattttgtcctttacaggtactggaacgtggagctgtggaaaaacctcttctgcacactgttcaacgcgacctccaacagcagcgaagcggctgtgctccggagcctccggatgtctttccaggagtacctgtacaccaacgggcagctcgtcggcaagctgaaccagcaactggccaaatagaagacctccctgtgcctatcctgaccgagacatatgcatctcgtttcacctgcatctttattcccgattcccttgtgttgcctgtgtaagtggtataaatacctttcgtaacttcgtagcacttcctcgtgcgtgcgtgtgcagcagtaattaacgtgccacatgtccacttgaaagctgaaacatctattggcccggatggaaattgcgtacagtatctccacctagcaggggagcgtatcctatgcacacaggccctcgcgtgtacaccgtgtacaccaactaaaaattatcacaaaaaattctaggaaaattcatacatgtactttcaatagtattacatctacgtgcaaagtcgcatcttcaaattcattctacatagagaataacaaaaaagataaaattctgacaaaattgtaaccttaaaactgtcagattttttgtttttttttgttacggctaaaatataatgaatttgacgttaagattttaaccctaggtgtaatacaactgaaagtatgtgtatgattttttctagaatttttggtgacattttttagttggtgtgcacgtgtgtacacgtgagggcctgtgtgcataggatatgttgccacctagcagctactaagatgttatgtgggtagatgaattggggtgctcgatgggagggcgaggcctgcagcctcgctgctccggagcttgggtgaggacgaacagaagaggaggggagacaagagataggttaacttctttcttgattcattccaaatgactgcggtgcctctccttaaatagagtcggctcctaacaaacctcctaacaaccttatctaataaagcctaacaaattgactgaatgtgctgagttctgcccataacatgttaatgagtgaattctgaagtaatgtctgtgttccttcattgtacaatactggtaatatagtgagcatgtcagtaagttttctgcatgtcagtaagttttcttgctgccccctttctatgcttctgtttttaggttggatgttttcttattgtcttctttgggtgatatatgtggtcttcatatttcttatcagattatttaggtttagtccatgatagcatatcttgtttatgctatcagaaggttttgcctcaatttccttcctgtccaacaaatcatattttatttgttaattcgtcgtgcactaattctgtacgcagaatggcactacacacatttgcattgatgatattctttgtcgacaatcttatattggccat

SEQ ID NO: 7716 - DNA, 9958 bp, Oryza sativa
cctgacaatctgggcatattacccttatatttggatcctgcagttaattttctatgagataaacctcagggtctttagggctcaatatagacagatgattgtgctgatattaaggtaatgatttgatttcatggtgcaagtcttttagcctcctatatggtgtaagctccattattctacgaatcatattgtaacctctacattgggtcaatattaggtctataagtcaaggcagtaatcacaaattatattgtacatctagcaaacaaatatttatttggcttgattgaggatttcagtatttttaagaactttactagaccctaattactacattttaaaatcagttcaggtcctatgtataacaagctaacatttttcttgtgctatacccatttctatatctgctactattatttaatatgtaatggaacattgatttcataggttagcattgtttgcagggtgtttcagtaacactgaaaccatggttgcttgagaggattaaagccacagatacttctaagttctaacctgcatagtaccatcctctgttgatctgtgtagtccataccgattaactgtacatatgtgctattccaaagaatccaatccttagtatctctagctatactgtgttattctcttttctgctttgatcataaagtattgtttcaatttattggtgtgtgacgaagtgacatgcacttcaaacaattttagatgagacatgtcatatgttccaatagggcacactgccacactggggtgtaattttttcttgacaagcattattcctactttctttctttttttttttgcagcgctgcactgtattggaattttctaatgacccatccttccagattgaatttttgctttacaaatacacttgtatagttttcattatatgctgacttcaaaatatgattttattacttcttttaattcatgaaatattatgtttgccccttatccaaagccacggagatatttcaacacagtttcttagacgagtatttgtcctacctgccatatattcattgtgtagcaatatatggatgacatccaaacatgccctgtattctgtaggggatacttcaaaattctgtgccattatgcaaaggaggtaccactcatctactaatctgttgtaagtacatgatgtgatgtactgttgtttttattgagctaaagcactaaattgttctctgtactgcagtgctatagatgagaaaagattcaattagttcatgacgaagatatctatgagaaaatgttgtcccaaatcccctaatgattgctgttttttctaacctagcccacatcatgtaagatccattgtcctctgtcattgctacttttctgtaagtgtacatgattgtataaacaattatgtgagcaaacagatcatattcacatttgaatcttggtgatagtcataatgtgtattagtgtatgcatatgtgggtatgcttctgacataaagttcttttagacgaatgtttatatataattcttaaaagttacaattatagatactgtgttgttttgatcttaataacacagcttgaaacattcatacccaggcacgcaacttagtgcgtgattcttgctagttacttgtaaagtaccagcgaacagctccacgccgcgacgactacacaggatgtccagggatggacatggacgcaaggtggagcacgacagcaatcaacggaattttatcggtggaatcagacacttcaggcagtggttgaaaccgttcaatggctgcaatcaatagggagaagaccagatgtggtgccggggttgatggtggtagaagcgattggtgatccaatcggtaggttggacacttcgggcgggtagcctagattttccattgagctactctcacccagggagacgtgcggccgcacgcttggggttgattgaagctggaggcaatcggcattcttggtcggtggaatcgaacactccggatggggtggtccggacttttcgatgagctgcgttcgacaggtagatggttagacgtagcgcttgggtcgttcggcggctgggaagacggcatggtgatttgttggctgactcgcgaccatctaattccactacccgcataaaaattcactagtttatttttcatatgatatagtacaaaatttgaaagaaaaaataaactagaagtaagataagtgggtaaaagaatcccatttggcagccataggtctggccttagatggaagaacctgacaatggtgttttgcttccttgttgagggtaacgatggtgcgtaaaaacgtcgttgcctttctagaggcgttgttttaggagagcctcttccacagtttaagtattgctttgatggagtttgagattgaggatcactcgtggttgtggtttgggtttgcggcgatttgatatttgttgtcatgttgtattttttcttttgtctttttaatcatcattagagttattatatcatcttggtgtaattttctaaaatcaataaagtttccttttatcttacaataaacttcagaatctccggcccaacagggtctatgcttataactcagggagccatccaactgacagcaccacctttgatttccttgctaagataatccaaaattccaaatagtaatagaatataaatatacatactctccagggtctaagtgcaatgttctccatacttacaacagtgcaagattttgaatcccctgaacgcgagcggcaacaaccaaaattcaagtgaatggatcaacccatgtatacatgggtaccagtggtgtaccagacttaaccatgaaaccaatcagatcaatcagtgtagcataaaaaaagaatggcttggtccattggttaaacagtggctcagtttttctggtaaattttcccatttcttttgtccgtaacaacagatcatgtaatctttgctggagtaaaaatctaaaaaaagaatggctacggaagctgcattgttttctgttgctaaagggactgacaactgataactacaatgacagaccaaagtttcgaatgatctatcttgaagagtataggcaagataccaaacctcttgttcaagaactgcatttgaacagtaacgttttcatgactagaacaacttcctagctctgctgtcagttctccagtctgaatcttgcatggggagatgttcatcagggtatggtacactgccttgcctgcgaagttagaacctttcgcattatgtactgattcttgctcagcatcaggaacaagatgttgtcaaaaccaagagacaccagacgacgatttcgggctatacatgggtgcaccagaaaacgcagggtatgaaaaagggcccctacttggctggtaacaattccttctcgagtaggccaaacatcttcttgaggcgagaagatgcactggatagtacctcttgagcaatcttctttctgttcttgcagctctttaaccatgcgatcccaatagacacttggacattgcatgccttgggcttggatgagatctgctccaattggtatcgcatatgcagctgtaaaaaagttaagagggagtgctgctcagtcatgtgagaaggaaagtaacactttcagttgtaataagatgaccaaaaagatgatttttcacttgaaagtagagaccaattcaataaatctgagactgccttcttttctaatttcaggtgaaatgcatatttgtttaatgagatcttctgtatatggtaatgtattggttttccagaatctggatgaacctctttaccatagtcaccattagtaattggacgtgtaaataaaggtgttctttgatattatgaaatggcaatgaacaattctccacaaccaggatgacatttatcagttactgtagtactccctccatttcatattataagacgttttgggtgtaagtcaaacttcttcaagtttgatcaactttatcgaaaaggatagcaatatatacaacaccaaattagtttcattaagtccacccttgaatatatttttagagtatatttgttttgtgctggaatgctgctatatttttatgtaagcttggtcaaacttaaaaaaaaatgacataggaaaaagtcaaaacgactcataacatggaacggagagagtagttcaattgaagataccacagaaaaccaacaaggagcaaacgaatggtcaatactgcagtagttattggcgtagcgctgggtttcagctgacagtatagcttctcagatagtcagatgaaccaaaataggggaaactatgtacagttgtggaaaccacaccttaggtggaaacttggaaactatcagtattattttatgtaaaatctaaaaaaacaaaatatagagaagatggtattagacagccatataaaatttcaagagcaaactcgacttagtttgagataggaagttaacaaatggcgaagaagaaatgctattcctggttgtctttttcttcactactcacaaacaaagacggattttttcttgaaattttgcatggttgtctgaaatcatcttagctatgtgatatatattctttttatttttttaaatattttttttatctggtttccatggttaccacgtggatagtggattagtggtttccactatatatttacccaacaaaagagggaacttgtcttgttctgctcactagtttaatcaaaatttggttttagttactgacacccatattggaagtttatttagtacggactaaatcctatttttatgtaacctcgttttcataattctgagacccaaacagatctctaggagacacacaactctcttgtttacatgactacaatactaaattaagggcataggattgaaatgtacataataaaagaaatagtataagccatgaaattgtcacttacgttgaagtattcaccaactggaataccttcaagcgtcatcacttcttcaacaagccatccatttttatcaggcaaaggggatttctgttgggtgctcattacttccccttcatggcgtgccaatctcttgtcgaacttgtaatgaatttgcctctggtaagcatcagctctgacggactcccatggtgaaactgagtactccatacagccaattttctccatcacttgatgctccaaaggaccaccctcaaatatgctcatgagtgttgatacctaatgaaacatacaagttggctacaatgtaaacttatgtttttctttttcattctttttgcagcatagagattgattgcagataattctcaggatggaataagaatcttacatcaaaaggttttgtagatgaaaatacttctgacatttttgcatcctctattcctaagaaagaatcactttcattattctggaggtctttcatttctgattcttcttctaccagctgtactttttgttcaggggtcaaggaccttgccttccagagcgccattattgttctgtaaaccgtgcaaagggaaatttgaaaaacaagttaccaaaaatagtacttaataggtgagtaaatagataaaaaatcgggcctcattgcaagaagtttttcatgtaatgaacagacgtgcttgacaagacaagttcatgttcgtcacccaagaagcagaacttacttatgtgccacattgaacgatacaaaagactggaaatgaaacttgagtcggccttcattatcaagttgctttgctccatgccttgcatccattcctctgcccttgtgaagaataataagcagagatggacttcccattgaatatagtgttgcaggcatcacttggatgtcctcgatatcttcccaaagaaagaagaattttgttttgtggccaaaaagattagtgtagaacccaataattcttggagataaaaacaggcggccctgcaacagacacaagcgtcagctaccatgcaagttcacagacaaaaaaaaagatcttaatgtctaacttggttgtgcagtaatatggctatgtgacaaaatacaccagtctcgtaacagaaaggctactgtacactttggtgacctatcatcattaggctgaaacagtaatgggagatggattaaattgaatatattgtttaaataggggtacaagttgaattatttaaatttaaaagggatgcagaagctgaattatttttaatgcattcctttttacaacttagtaccgaatagtgggtgaaaagtgtgactaccttctgtagacttttatatttattattgaaaaagtaccaacagctgattgtttggttttacgatactctctccgtcccacaaaaaacctatctaggtggggatgggacaccacatagtccaaaatattcatagtcctaggtgatgtcccatccatacctaggttggttttttgtgggacggagggagtactgacttcactttttcagctgtcagcaaaggacagtgaaattttatgaaacaaatgaagccatccccccaataaagaagaaaactaaataaggataaaccaatacaagagtgttggacacctttgttagctctctgtgtcataattaaaagacagtttacctgtgtgagcattttgcgctttagatgacaggtaaaatcattgattagaaattcttctggtggcaaagaaaagatcttctggaatgctgagtttgtgtgtggagaccttacagcaatctgcatggtaaatttgcataagaaaagaggcaggccaagataggatgacacttcacctcactcaaaaatagagaagataagtgcattacctttttgccaacctctttctccattttgtctaggtagtccttcatgacttcagtaccccttgaattattcaagataattctcaaatgcaattttgactgacatgcttgagccagcttacccttgagaggaatccaaatgtcggaaagctcggatagattagatttcaagaaatttacttcagcatgaccaagagactcaacttcatcaaatggtccatcaaaatcgtagacatttattttcataacggatggaggatcttccatggcatcaaattcaaaaatttctgcaaattttgagaagatatgttgcaaaattatgaattgtaattttatatagcagcaattataacataagataataagccaaacttttaccattccaccgaggttccagagtgtgaaatttaattgaactagtcttcgtctttccattgcaggtaaatacaacatatggatcagagtaaccagatgatttggttgctgctaaattggtaccatcaatcagagcgacagtcagcaaccaaccattcccttgtgctttgactccatgatcacttcctatatactcccaaataccatgtaagcaaagtttagttcatatgtgcataaatcacgggagtatatatgtccagaacaagaatagaaggtttttctaaagaaaacagaaagtaacagtatgtccagactccacaataataattaataagcgaagattttgttgaggaaaacaaaaggcaacagtaacatttttccatatcagggaaagattatacaagcacctgtatagaacactaagtacatgtaacatgtgccgttgagtgccatgtactgtaggattatctactgaactttcattttcaatttccaccaaggaaaaataacagcagcagcaaaaggagaaatggacactacctctctgcctcttagcctggatgaatcgtgcaatcatatttaggacacgctgtccttgcagaacaagaactccacaaaccacgacttcaccaacagaatctggtaggtccaggccaggaaactcaagaccttgaattatactggggcttgcaaggatgatgtgtgaaaaaacataaatgaatgcaaccagtgaggatacaacagtaaaatttccaaatatacggaatgctagtttccaatcagattcttgctctggttgtactgaagacaaaactttatcagtagctgctgcatcttttgaatcaactggcctgatatttcgagccaggagttcagagaactgaatgtagttatccttcaacccttgtttagccccattttctatcatgcccttcatcattgtactctggataaaattcaagcgccaggagactacaagacgtgaggatttttcattatcaggtagttcaggccctggcattatgcatgttaaaacctccaccctaaaagaattcccaaatggaacatctggagtactaacatcagctaaagttgcatatatatctccatctgccttcagatatgacacatcctctgttgctttcacagccttgactagtgcagtaggagcttttgtgtagcttactaccctcttcaagacctcaccatcattttcaagtctccattgttggatttcaagaccagtagttccttgcatctccgctagtgattgcaagaaatctgaacttggtgagaaaagaagtccattcaagtcactgggtgcaacagcataaacttgatcaataagaactccacctgacaagttttcaggtatttcattcccttcatggcaagatccaaaggcttttagttgttcatcaaaggacatagttacaccagtttcataatcctggttatcaggaagttctgaactagttgatggtgtttcttcaagaatatctgaattaccatcgcccgtagtgagaggtggagctgaagctgaagcttctgcatcttttggtttcgctgagaaaaattgatacagacgattgacaaatgatgggacaccatttgatctatcctccttgatgatttctgtttcatcaccccctgatactgacgtgggtatttctataggaatatttggcaaagaagatcctttctgtaattcagttgatttgtcagaatatgacgcgaggtcatctgaaacgcaatgtgcaagtgtcgttgtctcttcagggtaatttagagagagagatattgtaagacgaatttctcctacagaagttgttgcctgttatcagtatataaattacttgcatgcataaataaaattggatataggcaaacaaaagtgggctttgttatggaaagagaaggactggagacttggatgaataaaaacaaatagaaaagcttgaacagcaaacaatagtgctagtatatcatccaggcgaaaacatatccatactagtacatcacaaccataactccaataaaaacggaattgtgtagatggcttaatttcttgtttgtcaataatgctattaattatttcaatggtttccaatgcgtataaaattattggaaacatacctacatgaaagtgttttcgtaccaaatatactaatggcttctttttgaataccaaatcttaacatctttgcctatatgagtggtttaagatttcgatgtttgattgcacacattaaacatcatctatttgagaagatggaatagtaaataaagacatggtaggagactattgccaagaaaaaagaacaataaggaaaaagaaagtgagaaactagtacagctactcatccaacactctataagtactccctccgttttatattacaagtcgcttcgactttatttcatagtcaaacatagtagtatttttcaacaaaaaaaaacaaacatattatcaaattatattcaatgttagatttaatgaaactaatttggtattttagatgttggcaagtttttctataaacttgatcgaaaattcaaactaaacaaagtttaactatgaaaacagtcaaagcgaaacggagggagtaacaaagctccacttcaaaggtaaaagcaacacattaccatcacgaggcaaaccatccaaaacagcacaagctggatgaatttgcaaaacagcagcataataccttttcatatcttgaaacaagggcaaattcaagaactcaagataacattagggggggggggggggggcatgaatttaccggaatccttgatcttggacttcttg

SEQ ID NO: 7717 - DNA, 6251 bp, Oryza sativa
aaaaaaaaaaaatcaagaaaccggagattgctcctcctatcctatcttttttaactgcagcttgtggttcaggttggaaacatggaagtggtcgttgaactcggagaaatcaagaacgaactttcccgcttgctcttgtccaggaaacaatccactctttcccgctcgcaccgcctccaatcaatcaatcaatcaatcaatcagtcaatccatcgagattaaaggcgccacgaactcagcgggaaatggcaagaaacgagggcataaactagaaaccaacccccaatcaatgagaaaaaagaaaatcaggagaaaaaaacaaacatcagcagcaggcagggcgggcgtttgcggaggccaatcagaatcagagagcgattggagggggggagcctgggtgaggttttgtgtggaagcaacggatgggcggtggtcggcttcgggcacggaagactttgatttgagccgccggcgaagaggaagaggagaggaggtgaagaactgaaaaatgaaaatgaaaaaatgagaatgaaaatgttttgaggactcaacacaacagtcaacacaacgcgaggcgtacggtgtgtgtgtgtgtgggtcttctctcctctgctgactttcaaaaccgctccgctgcccgttagcgtttgcttttagcactggtacagttttactatttcgacttttttttaaaaaaaaattacacttttgttcctctatgactacaacctctccactaccaccgagaaaaaaaaaaactctacctcactttacctggcaagcacgaatggctggttcagtttgttatcatttctaaccttttcaaatttcaatattttaagggtaacaaactaaacacggttcaattttattgagttttgacattttccgaaactttctactctcaaatcattaccgaaatagagtctaacatcacaattctcaccttatcttatatgagatacacttgatagtacatagtacattaataaaggtgtgtagttttaactatgagttcctgtattcaatcccgtacacggacatctctacccctctaagcctctcttttttttcaccttacatactgtactaggtaatacctcattttctgtgctttatatgaaaatttgtccgagttagcttaacaactctatcatttcacttatgcttgaatttataatttaatatttaatatttaattttgtggtttttttactgtggcttatcttatagcattttcttttgaatagttaacgacatgtctataatatttttacttataaattattttttattgctaataagcgaaacgatggacacgtaaggctgataagacgtggagaaatgaactaaaaaataatagtttagacacctttttatacacatattcttagctatctaaaagtcatcgttgaaaatttaactacgatgaaaaaaaatcttaaattaaatatacaattatgttttaaaatttaaatttcggctgtggctagcaagacaacaagcagcagacaatgaaaagcgccggccaaagggaggaagagtgcaagacatgaaaaaaatactattgggtttttttatgaatcatttagattttattagatattcataagaatctttcaaaattttatagaaatttgtgaaaaatattatgtgtttcaaaagagatttgtgtttagatgagtatgctgggatctgtttatccctgcacgcgaaatgaaatgacccattagcgtatgattaattaagtattacctatagaaaagaaaacttgaaaaaaataaagaattccctatagatttttttaaaaacaactttcctatagttttttttaaaaaaatacatcgtttagcagtttgagaagcgtgcacaagaaaaatgagagaataaaagttgagaaaatgtagtatcgaacaaagccttactagtcgaataaggtcctattcaaaggcaggaaaaaaaattcgggacttcatttgaacacaggaattccacgtgtatcaattctaccggatctaaaaaaacacgtggcactcaaatgagggtgttatatgggaattgaagtgtttcaagtgaagttattgggtttcaatcaggccaaattacgagttgtcaaaagattttctttttaggacaaaagaaattgtgcacttgttaatccctgtctagaacgcaggaaaaatccctctttcctgtggaaaacataattattttatatgaaatcaatgtgttctagacaatgaccagttcttgagcatgcttcaattatcaggagcagtagccagtaggattggagtgccatgttgactttttttttaaaaaaatgggattactgttttttgtccttttttttaacagggataagatcactttgactaattatgcccatcttcagatatgttgactaataagttgggtccatattaaggtacagcactgacagcagctcttccttcttgaatgccttcatgtcactgtgggttcttctgggactaatcattatattcttctctataaagttcatgtgaaatcaagcttttaaaaaataattaataatcctattagattaaacaggtaatcaagtgccaaatgcacccaacagtatgcagcacgagaaagctggaagctgtcataaaaaagcgtgacacatcgacacgatgattatccaagctagaggcaagctataatcataattccacaggacaaaactaaattccaaattagcagaatgagtagtgtcttttttaaataaaaaaaaatctcccaagaagtactttgtcggttgcagctgtgtggtcatgactggactgggtaaagaagaggcagcttgacagcaaataattttcagctaagaaagtttgacagggagcatttgtgtcaacgtcaatggacacagcacacggacagttcgaagaatatgacaataattaatagcttctctctagatgaactgtgctaaaagatggagtattccttggaacaaccaatatgacctctagaagaagtacaggttttacaggtgtgctagccacaagggctgttaaacaatcaactctccagatgcagataaggtttagcaacttgatagatatacacataagattatgacgtgatttttccccgtaaaggaagtgttggaaaaaatttcaaaactaaggagtgtactggttccagtttcaatttttcctggaagttgcagaaattcttgcaaaaaccgaaaaggaggttaggttactccatatcaactgaagccatgtttagatcaaaagtaaagctgcaaagcttttttgagcgcaagctaacacggcagatgacatattactccagtatttgccccaaggaacaattcagggtaatcgttcacccgcaaactcaagtgtcacattaagaagcgaagtaaaaaaaaaaagcacaaacctagagtaggagcagaaacagaggtgattagctatctgaagtctggacagttaccttttgcagcacaagtgcaaggaacaggagtcttttgtgaagatgtccaggtttgactctatgaattcttccagactgcttgatattgccatattggaacctttcagcaagcacagcgcgaatcgaaaacaacagtgaaagaaaagagagtgattcctcaagactaatttcattatttgtactaaaaattacagaagttggatgcaggtaataaggcgcatcagaactagataacataacaacatcaacatatcaacaatgctaatatgcagtttattcatttcattgaccatagcaccaatcttactaatactgtacattttggttccaatcaactagaggggattttccacagataacaaaaccaaaactatggaaagatcaaatgcagattaagtagcattgtagcactacagagagggaaaattacaaccaggataagtatcacaactggtgcaatgcaaactcaactatggtacaagggcaaagccatcatggaaacagagtaaaaatcctacatgtattccctcaggacaagttgttttccatctcatgctagctgctggtctcctctgaatcagcaagcacaaactctgtgtacaggttcttcaatgccatcaccactgtcattataaggggacctaatattgcaccctgcagagttacatcagatggtcagcccaatgtgagtaaagaaaatatcaattctcagatgctcggtggaatggcactctagtacattggtgtgctccatgttccaaggactagaatgattccataagaattttctggacagtaaacaaacagatgttgtacagagtacaagtgtacaacacacacagactatacagaaaatcattcaacataatacattagtgtccattttttgtagcctagaagaaacgcaatcttttcagattttagctactagattatttaaaagacttccgatatagaagttacttttaaaaaatcaaacaaatccatatttcaagcttgtaatagttattacttaattaatcgtgcgttaattacagaacttcactgataagatacgtggctgatcagccaaaaccctcctcaacagggccttaaaatgtataacatcataggcatgaaggccagatagagtataacttttttttttggagtacaaaaatgattggagttacacccataaatagggttgaaaaggtatagatttttggagcaagaaaaaagcagcatgtatgaataggggatataggtaaaatagatatgcttttggtgcccacagtaggagattctttagtatcaaatgcaaaacgtaaagcatttattctagattatgtcttctgattatccacaccatatgtaaaatcatacaattgaactaacaaaagttcatcttcaaagcacctaaatgttgtctgaacgaaaatggtgaaaaacatttaacacaacaaaagtgaatagatttggtataaaaagtcagtacctccagagcattggggaacaatgccatgccaccaattatgctaaggccagtgagatatccattgtacccgggtatatcctcctgaatgactgtagttccataatccatgattatgagatgaaccactgtcaccacaatagcgagcacatatctcccttccatgagcagctgtcctgcggcaaatatcgaggacaaccatggtgggagtattggcagaagtgcactgatgattgcaaacacagttgatgtgtacacaaaatgcaccttgaagagcttgaacaacagccatgtcaggcatccctggaaaatggcaatcttggcagtggctaacaagacactactaatggcatggtcgatgacctcgacgcatcgatcctttacttgttttgacaatggcaaaagatcaatgacctgctctgtagccccacctccctctacagtgatgaggtagtacagcacccacaagaaaaccatcaactgtgacacaaaattgagcacctcagctgcaccagagacaatgtggagagtaatggataacatcagattggcactaccaccgagcaccgatgtgctgctagacagcagactttttgcgatctcagccccctgcaatgccaatcccttggccttcaccaccaaatcctcccttgtgattaacagctccctaaagaatgagtccagctccctgtaaatgtccatccactccctgttcttcacatgcttcgcaataacctgtagcttcatcgagtacgggtgtggtccggatgtgatgagctccttgccctttgcaccagatgggtcaactgattggctgatcaagaaatgccggaatccgctagtgaaatcggtaaggttgtactgcactgctaactgatctatctgctcccacacggtatcgtagagcttcgcggaatactgatcaaccaagccggggatgtcattgtcgtcaagccacttcttgaggccaatcttttcagagtagttgccattctcgacatgggacttgagggacatgacagcgtccttgccctcgagcccaatcttgtaggagaagaagacgctgccggataggaacccgagtatcatcccgagcatgaggccgacggcgacgagcgtcttgaggtggcggaggatgccgccggtaaggaagaggcagcgggaggagggtgttcgtccggcgattcgggaggaggcggcgcgggataggaaggaggagggcttgggggatgcggcgaaaaacgcgagggagagggcgaggaggaccaacgcggtggcggtgccgaggcggtcgagcaggaggagg

SEQ ID NO: 7718 - DNA, 5995 bp, Oryza sativa
agcgccgtggcgagccccgcgtgcgccatcgcaatgtacagcgccagccgcgcgtcgggctccagcgacaagcccccgatatcgtcttccgccggagacgccttccccttcccctggggctttttggtcgtcgtcggctcctcctgcttcggcagccgcagcgacgcggagcggaacatctccgaccaggggaggtccatcacctccccgtccttgcacgcgcctccgttgggctcacccttagccacgagcgccatgtcaccggcgccggaatgcctgcgccgccgacttcgccgccgccgccgcggagggcaagctccgcctccgggtggtggtggaaatggaatgggagggaggaggggatttggggggtgattagcgcgggtggggtaaccatgatgggagagattaaggaaagattaattaaattaagcgggggattaattaggattaagatgtcgcgttttggaaagggaggggaaggagacgggttaacgccttaacggtggctaaccgggtacgcgctccgaggctgacgtatggggccccaaggggatggtgacacgtggcaactccctttctcgtcgtcggcaatggggagcgttgctctgacagctgtgtctgtttgggcaggagaatacgaggtggactgttgatgaataggctaggaggttttgcttaaactgattataaaccataagagtaaaaataatgaaaaaaaatactgttcgtaatttaaaagttaataaaaaaataataaataaaaaacttttaaaaccaactctagaattagcttttaaagtttaaattttttttatggtttattcccttcattccaattcccaaatatttatggagtttttcaaggaaactaaaataaataaaattgagatgtctaagtgattccaacgatattaaaacatatatgtcataattttccagagattgttatattttgagacaaattttaaatgctagaaattactataatttttgataaatagagtaacaccctaaaattaaatccagtatattttatagagacctatctcgcacttgttataattttatttgttgtcaaaaagggttagaatctaatatttaagtatattagcatatgcaacccagaagacaccacattcatttctcgggaagactagttcgcaaacgctctcaaactaggcatctcacgaatgggttttcaaccgtgtcacaacaaacacacgggttaggattaaggtagggttttagggatgggggtagtgattagggagaagggtggtgttggggagagaaaagaggggatcgggtttagaggaatttaacctgaaaaacagcagatcggtgatgggcggtggaaagggtgggcgcagttgatcaacgaggctatatatgcattaaatctgctgattaataaactgtctagttgacaaaactaattaaagtgtcactaattaagatttagactatgcatcaacgggtgatcaacgagagtcacgtggaatcggatcttatagctagagggcagttccaactctgctaattaaacactccttgtcaattatatgtttttagtctcattaaggagaggatggcaaatcactgtcacgcatatgcacgtttctttcttccctatctgtccgagaccggcaaatgctgtcatgcatatgggtccggtttacagttgcattattttgccaatatacagctggacgcatctacgaagtcttcaattgattttggggagaaaaatacttgagaagccttttttttccgtttacacgtggaacacacaaacaccactacacacataataccacactcgcacactgtaaatacgttcactaacacatgcttaaaaagacgaaaacaataatacatccttgatcggtctcactaaactcgtgttcaaaacctatatacttgtgtgtgcgtaagtcaccaccacaacactagtgcttttgtaaaagatggtattttaaattcagagagcatgcatttttatgtattaaactacgtatgccacaatacaacatgcattttttatgcaagcctcaatgggatgcattttgtaggcagcgatttataaacaaagatatctatatatttaaaaataatattgacataagattcagtctgctaatttcacatcacatatactatggtcagacaatgcatgtgtaatactacttctcatatgtaggtcccacttgctcttgctctcaggctcacatgacagtgagcagcactttgctatatggcctgtggaggatctcaatccactattttgaccgattgttgcctataaatactacggtactggtctgtgatctaggatgaagagctgcaaatttctacactaagcaaagaaaagaagaagaagaaaataagctaaaataatttttatactagttaagtttgaaatttgacattgtcagccgcaattcaaacgagagcatgctccaaattaaacactttcaacaatcaatatttccagaaaaacaaaaccatcaatataatttcttttttaaagaaatgtttacacatggtctggtgcattggaaatggaaattgtacggcatgattgccaggtgcgatgcacatcctcccaaacaaaaataatgtactcctactagctaggatgaacataatcttctgagaattttttacttaaggactaaacaacatctaatctttatcctccttattttagagatggtatgccactattgtaccacactaacatgattccagacttccagcatatacaattcatatcagttgcaccaactttctggagctttgctaagaaagctggcccctaacgaactttgtcgaaaacaatctgcatcgtgctgctgctagtctttggatgcatggatgtgtttaatttatgggttaatttgatccatgccattgcaagtttatcgatttagaaaaactaccactactattcacgatatcggttgggtatcactgatattttacaaaattaaaaccgtaccattgtcatcacattttccatccctttcgtctttttccttcttctccccatcgaggggttaactgcaaggaggccgaccaaagagctctagcgaagcgagcggcgccgaagcccgggagcgagagaggtcaatgccagagagggatgacgtggtgaggacagcgtcagggacgacaaagcagcaagtgacaaggacagcagccggtgcccatgaagaacatggaggcggagcagcaagtgacgccagcggcgaccaccatcacctctccattcacggtgaggagtaggaggtgaagatagtagtggcgcctagttttaataggaatataagcataaaacaaatgattgaaaaatttaaaaattgttacaaaattgaccatttaagtagaccgcaggagaaaaaacacaggaattgaatgaaataaaaagacacaagagatacttttcaataggtttggaggtcttcctaaatttcctctaaaatttatgtagtctataggattgtggataaattttaaagggaatggtaggatttaattcttgatttcttggttttaaaggtttttctagccatttttcctacggaattggaatcctctaaaatttgaaccttcttttacaaattatataaattaaggcggcttactgtttacatgattaatttgagtgggtatggaaaagtgaccacgcatgataatacattaatattgtagaacaatgcttgctagggcactgtttacagtcggtcaatcccaaaataagtcaccctttatatataaatctaaacacaaactgtgtcaagatttatgtacagagttgattctttttgacaagggtgtactatgcatgcacagtgatagtgagtgtacagattgatctaaaattctgaaccattagatttttatccgtcgatagatacaagaacctaatgtccatgtcaaaatcccatggtttccttgcattagtacatatactccatccattcatattataagtagttttttctagtagtcaatctttttttatcaagtgtataaaagaatttaacaacatgtgtaacaccaaataagttttaattgaatataacattaaatatattttgataatatgtttgttttgtgttaaaaatattactatatttttctattagcttttaaatttgactaagataaaagttaaaaaaagaggttagagattataatacaggtagtatcaataaaggtagtagagtaataaatacagagtataatacttcctgatgaaatttatagagatagatgggccgattaatctgtgggccctaattcttggtactattgcgaacataggagaagggtgcatatggaaaagtgaccacacatttttaacaattatatatgtaaagaggaaaacaacattacaattttgtactggcaaaagagaaattacctctacaacggtagaattaattttgacttgcaggtgatggtattctttttcccctcaaatctaatcgtagtctgtggtggtggatccaacacttatcttaagcctggcaaaccttatgtaagtacttgcaaatctacatttactatagaagcacaccaatttaatcgattatagtcttatataagagaaaaaacaatgcttaaaatatatcgattaaatgatgatattatattgttgatgcgctagattacattgagttatttaagtattactccctctataccataatataaggcgcggttaaagttgacatggtcctcaaaactaatctttaacttataatttctcatatactataaagtttgtagaaaaaaaattataaccatttgaaagtaaatttaaatctcaatctaataatataatttttaacaaataaaactcatttcatattatgctaacggtttgtaatgcgtgcacgacttatattatgggatggagggagaatatactctacttagtgttcacctagaagccagacgttcactagacggacccatggtctagagtctagacagtctagagattagtctagacgatatatcatactatatactatcaacatcagtggcggatgcagaaagaaatagcagtgtggtctgagcaaactagatagagttacagtctcaccttcaatctatatatgctaaaaaattttagtggggtcttcgtgggggctctcatagtcttcacgtcagtagtgggggctcgagaccccgccgcccctgtgctggatccgcccctgatcaacatgacatgtagatacacttaacttgtttcatataatattggagaacatgtggtgttgtgaaaggtgtagccactcgcatagagccatgggttggagagaggaggaagcaaggtccacggtgacaactagcagaggagaggtgacatgacttcatggcagcgcgatgtttagagcagagaagaggggtttggaatggtgtcaaaaacccaaggcacatggacctagggtggaacacaaagttttagttactaccacacaaaaaatgtattggttgcctagaccatagtctaaacgatagttttatagtctacatttatctcgtttttgtttaattgtgtggtctagatagtctaggatcatctttaattatctagacggtcaaacggtctaattcacggattaggtcctaaactagacgataactcatcgtctagcttttagacgcggtctaaaccgtctagactacggtatttggttagacggtagacactactacagcatatggctgagaagattggtgcctaactgtgataattaaacactaatactctactactggtacatataatggagcccttgattcaccattatcataaatgcttatggcaactataactttttctagaattttctaaaactttctttagaacaaaccagatttttttttcaaaacatatagttataagatccaaaatatgaaatagaaggcttgagaaaaaaaaatctttttcagattctcgcaaaccgtttctatt
